United States Patent 12,606,815 (SELF-DIVERSIFYING SYSTEMS AND METHODS OF USE THEREOF) - sequence listing, part 4

SEQ ID NO: 1198 - DNA, 4000 bp, Escherichia coli
  misc_feature (1)..(4): n is a, c, g, or t
  misc_feature (7)..(7): n is a, c, g, or t
  misc_feature (9)..(10): n is a, c, g, or t
  misc_feature (12)..(18): n is a, c, g, or t
  misc_feature (20)..(20): n is a, c, g, or t
  misc_feature (23)..(23): n is a, c, g, or t
  misc_feature (27)..(29): n is a, c, g, or t
  misc_feature (41)..(43): n is a, c, g, or t
  misc_feature (45)..(49): n is a, c, g, or t
  misc_feature (51)..(51): n is a, c, g, or t
  misc_feature (54)..(57): n is a, c, g, or t
  misc_feature (59)..(63): n is a, c, g, or t
  misc_feature (67)..(67): n is a, c, g, or t
  misc_feature (70)..(70): n is a, c, g, or t
  misc_feature (72)..(72): n is a, c, g, or t
  misc_feature (75)..(75): n is a, c, g, or t
  misc_feature (81)..(81): n is a, c, g, or t
  misc_feature (90)..(91): n is a, c, g, or t
  misc_feature (97)..(100): n is a, c, g, or t
  misc_feature (103)..(103): n is a, c, g, or t
  misc_feature (109)..(110): n is a, c, g, or t
  misc_feature (114)..(114): n is a, c, g, or t
  misc_feature (120)..(120): n is a, c, g, or t
  misc_feature (122)..(122): n is a, c, g, or t
  misc_feature (125)..(125): n is a, c, g, or t
  misc_feature (127)..(127): n is a, c, g, or t
  misc_feature (133)..(136): n is a, c, g, or t
  misc_feature (138)..(144): n is a, c, g, or t
  misc_feature (149)..(150): n is a, c, g, or t
  misc_feature (153)..(154): n is a, c, g, or t
  misc_feature (162)..(163): n is a, c, g, or t
  misc_feature (166)..(167): n is a, c, g, or t
  misc_feature (170)..(172): n is a, c, g, or t
  misc_feature (174)..(174): n is a, c, g, or t
  misc_feature (177)..(180): n is a, c, g, or t
  misc_feature (182)..(185): n is a, c, g, or t
  misc_feature (187)..(191): n is a, c, g, or t
  misc_feature (193)..(195): n is a, c, g, or t
  misc_feature (198)..(199): n is a, c, g, or t
  misc_feature (202)..(202): n is a, c, g, or t
  misc_feature (204)..(205): n is a, c, g, or t
  misc_feature (207)..(207): n is a, c, g, or t
  misc_feature (212)..(212): n is a, c, g, or t
  misc_feature (215)..(216): n is a, c, g, or t
  misc_feature (218)..(218): n is a, c, g, or t
  misc_feature (220)..(221): n is a, c, g, or t
  misc_feature (226)..(226): n is a, c, g, or t
  misc_feature (229)..(233): n is a, c, g, or t
  misc_feature (236)..(236): n is a, c, g, or t
  misc_feature (238)..(238): n is a, c, g, or t
  misc_feature (242)..(242): n is a, c, g, or t
  misc_feature (244)..(245): n is a, c, g, or t
  misc_feature (247)..(248): n is a, c, g, or t
  misc_feature (252)..(254): n is a, c, g, or t
  misc_feature (256)..(256): n is a, c, g, or t
  misc_feature (258)..(262): n is a, c, g, or t
  misc_feature (264)..(264): n is a, c, g, or t
  misc_feature (266)..(267): n is a, c, g, or t
  misc_feature (270)..(273): n is a, c, g, or t
  misc_feature (276)..(282): n is a, c, g, or t
  misc_feature (284)..(284): n is a, c, g, or t
  misc_feature (286)..(288): n is a, c, g, or t
  misc_feature (292)..(294): n is a, c, g, or t
  misc_feature (296)..(300): n is a, c, g, or t
  misc_feature (302)..(306): n is a, c, g, or t
  misc_feature (308)..(310): n is a, c, g, or t
  misc_feature (312)..(312): n is a, c, g, or t
  misc_feature (314)..(315): n is a, c, g, or t
  misc_feature (319)..(321): n is a, c, g, or t
  misc_feature (324)..(326): n is a, c, g, or t
  misc_feature (329)..(330): n is a, c, g, or t
  misc_feature (332)..(333): n is a, c, g, or t
  misc_feature (335)..(335): n is a, c, g, or t
  misc_feature (337)..(337): n is a, c, g, or t
  misc_feature (340)..(342): n is a, c, g, or t
  misc_feature (345)..(346): n is a, c, g, or t
  misc_feature (348)..(348): n is a, c, g, or t
  misc_feature (350)..(355): n is a, c, g, or t
  misc_feature (357)..(357): n is a, c, g, or t
  misc_feature (359)..(362): n is a, c, g, or t
  misc_feature (365)..(367): n is a, c, g, or t
  misc_feature (371)..(371): n is a, c, g, or t
  misc_feature (373)..(374): n is a, c, g, or t
  misc_feature (376)..(378): n is a, c, g, or t
  misc_feature (384)..(386): n is a, c, g, or t
  misc_feature (389)..(392): n is a, c, g, or t
  misc_feature (394)..(395): n is a, c, g, or t
  misc_feature (397)..(397): n is a, c, g, or t
  misc_feature (399)..(406): n is a, c, g, or t
  misc_feature (410)..(410): n is a, c, g, or t
  misc_feature (412)..(414): n is a, c, g, or t
  misc_feature (417)..(419): n is a, c, g, or t
  misc_feature (421)..(424): n is a, c, g, or t
  misc_feature (426)..(428): n is a, c, g, or t
  misc_feature (430)..(432): n is a, c, g, or t
  misc_feature (434)..(434): n is a, c, g, or t
  misc_feature (436)..(436): n is a, c, g, or t
  misc_feature (438)..(438): n is a, c, g, or t
  misc_feature (440)..(440): n is a, c, g, or t
  misc_feature (442)..(442): n is a, c, g, or t
  misc_feature (445)..(448): n is a, c, g, or t
  misc_feature (450)..(450): n is a, c, g, or t
  misc_feature (452)..(454): n is a, c, g, or t
  misc_feature (456)..(458): n is a, c, g, or t
  misc_feature (460)..(465): n is a, c, g, or t
  misc_feature (468)..(473): n is a, c, g, or t
  misc_feature (475)..(476): n is a, c, g, or t
  misc_feature (479)..(480): n is a, c, g, or t
  misc_feature (482)..(483): n is a, c, g, or t
  misc_feature (486)..(490): n is a, c, g, or t
  misc_feature (492)..(494): n is a, c, g, or t
  misc_feature (496)..(497): n is a, c, g, or t
  misc_feature (501)..(501): n is a, c, g, or t
  misc_feature (503)..(504): n is a, c, g, or t
  misc_feature (506)..(506): n is a, c, g, or t
  misc_feature (508)..(509): n is a, c, g, or t
  misc_feature (512)..(518): n is a, c, g, or t
  misc_feature (521)..(527): n is a, c, g, or t
  misc_feature (530)..(530): n is a, c, g, or t
  misc_feature (532)..(534): n is a, c, g, or t
  misc_feature (538)..(539): n is a, c, g, or t
  misc_feature (541)..(545): n is a, c, g, or t
  misc_feature (547)..(547): n is a, c, g, or t
  misc_feature (549)..(552): n is a, c, g, or t
  misc_feature (554)..(555): n is a, c, g, or t
  misc_feature (557)..(557): n is a, c, g, or t
  misc_feature (559)..(567): n is a, c, g, or t
  misc_feature (569)..(572): n is a, c, g, or t
  misc_feature (575)..(575): n is a, c, g, or t
  misc_feature (578)..(580): n is a, c, g, or t
  misc_feature (583)..(583): n is a, c, g, or t
  misc_feature (585)..(585): n is a, c, g, or t
  misc_feature (588)..(589): n is a, c, g, or t
  misc_feature (593)..(593): n is a, c, g, or t
  misc_feature (600)..(600): n is a, c, g, or t
  misc_feature (603)..(606): n is a, c, g, or t
  misc_feature (608)..(608): n is a, c, g, or t
  misc_feature (610)..(620): n is a, c, g, or t
  misc_feature (622)..(625): n is a, c, g, or t
  misc_feature (627)..(627): n is a, c, g, or t
  misc_feature (629)..(632): n is a, c, g, or t
  misc_feature (634)..(636): n is a, c, g, or t
  misc_feature (638)..(638): n is a, c, g, or t
  misc_feature (640)..(640): n is a, c, g, or t
  misc_feature (642)..(644): n is a, c, g, or t
  misc_feature (647)..(649): n is a, c, g, or t
  misc_feature (651)..(653): n is a, c, g, or t
  misc_feature (655)..(655): n is a, c, g, or t
  misc_feature (657)..(662): n is a, c, g, or t
  misc_feature (664)..(664): n is a, c, g, or t
  misc_feature (666)..(668): n is a, c, g, or t
  misc_feature (670)..(670): n is a, c, g, or t
  misc_feature (673)..(676): n is a, c, g, or t
  misc_feature (679)..(682): n is a, c, g, or t
  misc_feature (685)..(686): n is a, c, g, or t
  misc_feature (689)..(695): n is a, c, g, or t
  misc_feature (698)..(701): n is a, c, g, or t
  misc_feature (703)..(704): n is a, c, g, or t
  misc_feature (706)..(709): n is a, c, g, or t
  misc_feature (713)..(713): n is a, c, g, or t
  misc_feature (716)..(716): n is a, c, g, or t
  misc_feature (720)..(721): n is a, c, g, or t
  misc_feature (724)..(724): n is a, c, g, or t
  misc_feature (727)..(730): n is a, c, g, or t
  misc_feature (732)..(732): n is a, c, g, or t
  misc_feature (734)..(743): n is a, c, g, or t
  misc_feature (745)..(745): n is a, c, g, or t
  misc_feature (755)..(756): n is a, c, g, or t
  misc_feature (758)..(759): n is a, c, g, or t
  misc_feature (761)..(761): n is a, c, g, or t
  misc_feature (763)..(763): n is a, c, g, or t
  misc_feature (765)..(768): n is a, c, g, or t
  misc_feature (770)..(772): n is a, c, g, or t
  misc_feature (774)..(776): n is a, c, g, or t
  misc_feature (778)..(780): n is a, c, g, or t
  misc_feature (784)..(785): n is a, c, g, or t
  misc_feature (788)..(790): n is a, c, g, or t
  misc_feature (793)..(795): n is a, c, g, or t
  misc_feature (797)..(800): n is a, c, g, or t
  misc_feature (802)..(802): n is a, c, g, or t
  misc_feature (804)..(807): n is a, c, g, or t
  misc_feature (809)..(810): n is a, c, g, or t
  misc_feature (812)..(813): n is a, c, g, or t
  misc_feature (815)..(815): n is a, c, g, or t
  misc_feature (817)..(819): n is a, c, g, or t
  misc_feature (821)..(824): n is a, c, g, or t
  misc_feature (826)..(827): n is a, c, g, or t
  misc_feature (830)..(833): n is a, c, g, or t
  misc_feature (835)..(835): n is a, c, g, or t
  misc_feature (837)..(837): n is a, c, g, or t
  misc_feature (840)..(841): n is a, c, g, or t
  misc_feature (847)..(848): n is a, c, g, or t
  misc_feature (850)..(852): n is a, c, g, or t
  misc_feature (854)..(857): n is a, c, g, or t
  misc_feature (861)..(861): n is a, c, g, or t
  misc_feature (863)..(864): n is a, c, g, or t
  misc_feature (868)..(868): n is a, c, g, or t
  misc_feature (871)..(871): n is a, c, g, or t
  misc_feature (873)..(873): n is a, c, g, or t
  misc_feature (876)..(876): n is a, c, g, or t
  misc_feature (878)..(881): n is a, c, g, or t
  misc_feature (883)..(884): n is a, c, g, or t
  misc_feature (886)..(886): n is a, c, g, or t
  misc_feature (888)..(893): n is a, c, g, or t
  misc_feature (895)..(896): n is a, c, g, or t
  misc_feature (899)..(899): n is a, c, g, or t
  misc_feature (902)..(907): n is a, c, g, or t
  misc_feature (911)..(912): n is a, c, g, or t
  misc_feature (917)..(917): n is a, c, g, or t
  misc_feature (920)..(923): n is a, c, g, or t
  misc_feature (925)..(927): n is a, c, g, or t
  misc_feature (929)..(933): n is a, c, g, or t
  misc_feature (935)..(935): n is a, c, g, or t
  misc_feature (937)..(939): n is a, c, g, or t
  misc_feature (941)..(942): n is a, c, g, or t
  misc_feature (946)..(946): n is a, c, g, or t
  misc_feature (948)..(948): n is a, c, g, or t
  misc_feature (950)..(951): n is a, c, g, or t
  misc_feature (954)..(954): n is a, c, g, or t
  misc_feature (956)..(956): n is a, c, g, or t
  misc_feature (958)..(959): n is a, c, g, or t
  misc_feature (961)..(963): n is a, c, g, or t
  misc_feature (965)..(966): n is a, c, g, or t
  misc_feature (968)..(968): n is a, c, g, or t
  misc_feature (970)..(970): n is a, c, g, or t
  misc_feature (972)..(972): n is a, c, g, or t
  misc_feature (976)..(978): n is a, c, g, or t
  misc_feature (980)..(982): n is a, c, g, or t
  misc_feature (986)..(986): n is a, c, g, or t
  misc_feature (989)..(997): n is a, c, g, or t
  misc_feature (999)..(1002): n is a, c, g, or t
  misc_feature (1004)..(1005): n is a, c, g, or t
  misc_feature (1007)..(1007): n is a, c, g, or t
  misc_feature (1009)..(1018): n is a, c, g, or t
  misc_feature (1022)..(1022): n is a, c, g, or t
  misc_feature (1024)..(1030): n is a, c, g, or t
  misc_feature (1032)..(1035): n is a, c, g, or t
  misc_feature (1039)..(1047): n is a, c, g, or t
  misc_feature (1051)..(1055): n is a, c, g, or t
  misc_feature (1057)..(1069): n is a, c, g, or t
  misc_feature (1071)..(1077): n is a, c, g, or t
  misc_feature (1081)..(1082): n is a, c, g, or t
  misc_feature (1084)..(1084): n is a, c, g, or t
  misc_feature (1089)..(1092): n is a, c, g, or t
  misc_feature (1096)..(1098): n is a, c, g, or t
  misc_feature (1100)..(1100): n is a, c, g, or t
  misc_feature (1102)..(1102): n is a, c, g, or t
  misc_feature (1106)..(1106): n is a, c, g, or t
  misc_feature (1109)..(1112): n is a, c, g, or t
  misc_feature (1114)..(1114): n is a, c, g, or t
  misc_feature (1116)..(1116): n is a, c, g, or t
  misc_feature (1119)..(1120): n is a, c, g, or t
  misc_feature (1123)..(1123): n is a, c, g, or t
  misc_feature (1126)..(1128): n is a, c, g, or t
  misc_feature (1130)..(1134): n is a, c, g, or t
  misc_feature (1136)..(1136): n is a, c, g, or t
  misc_feature (1139)..(1139): n is a, c, g, or t
  misc_feature (1141)..(1141): n is a, c, g, or t
  misc_feature (1144)..(1146): n is a, c, g, or t
  misc_feature (1149)..(1153): n is a, c, g, or t
  misc_feature (1155)..(1155): n is a, c, g, or t
  misc_feature (1157)..(1159): n is a, c, g, or t
  misc_feature (1162)..(1162): n is a, c, g, or t
  misc_feature (1164)..(1164): n is a, c, g, or t
  misc_feature (1167)..(1167): n is a, c, g, or t
  misc_feature (1169)..(1171): n is a, c, g, or t
  misc_feature (1174)..(1176): n is a, c, g, or t
  misc_feature (1178)..(1178): n is a, c, g, or t
  misc_feature (1180)..(1185): n is a, c, g, or t
  misc_feature (1187)..(1187): n is a, c, g, or t
  misc_feature (1189)..(1192): n is a, c, g, or t
  misc_feature (1194)..(1194): n is a, c, g, or t
  misc_feature (1196)..(1204): n is a, c, g, or t
  misc_feature (1206)..(1209): n is a, c, g, or t
  misc_feature (1211)..(1215): n is a, c, g, or t
  misc_feature (1220)..(1220): n is a, c, g, or t
  misc_feature (1222)..(1222): n is a, c, g, or t
  misc_feature (1224)..(1224): n is a, c, g, or t
  misc_feature (1227)..(1229): n is a, c, g, or t
  misc_feature (1232)..(1235): n is a, c, g, or t
  misc_feature (1237)..(1239): n is a, c, g, or t
  misc_feature (1241)..(1242): n is a, c, g, or t
  misc_feature (1244)..(1251): n is a, c, g, or t
  misc_feature (1253)..(1262): n is a, c, g, or t
  misc_feature (1264)..(1281): n is a, c, g, or t
  misc_feature (1283)..(1283): n is a, c, g, or t
  misc_feature (1285)..(1285): n is a, c, g, or t
  misc_feature (1288)..(1288): n is a, c, g, or t
  misc_feature (1290)..(1291): n is a, c, g, or t
  misc_feature (1295)..(1298): n is a, c, g, or t
  misc_feature (1301)..(1303): n is a, c, g, or t
  misc_feature (1306)..(1307): n is a, c, g, or t
  misc_feature (1309)..(1309): n is a, c, g, or t
  misc_feature (1311)..(1311): n is a, c, g, or t
  misc_feature (1313)..(1314): n is a, c, g, or t
  misc_feature (1317)..(1317): n is a, c, g, or t
  misc_feature (1320)..(1320): n is a, c, g, or t
  misc_feature (1322)..(1323): n is a, c, g, or t
  misc_feature (1325)..(1329): n is a, c, g, or t
  misc_feature (1333)..(1334): n is a, c, g, or t
  misc_feature (1338)..(1339): n is a, c, g, or t
  misc_feature (1344)..(1344): n is a, c, g, or t
  misc_feature (1513)..(1513): n is a, c, g, or t
  misc_feature (1589)..(1589): n is a, c, g, or t
  misc_feature (3677)..(3677): n is a, c, g, or t
nnnncgngnngnnnnnnnanacncgannncgcgcgcgcgannnannnnngnacnnnnannnnngaangangnaancgaagnaccgacgcnncgacgnnnnagngcgagnngacnaacacnancangnacgagnnnnannnnnnngacgnngtnnacgaaganncgnngcnnngncannnnannnngnnnnngnnnacnnccncnnanacgangannantnngacgncgnnnnnggngnagangnngnngggnnngngnnnnnangnngannnngannnnnnncngnnngggnnngnnnnngnnnnngnnngngnnggtnnngannncgnnanngngngannnagnntngnnnnnngngnnnncgnnncggntnngnnngcgacnnngcnnnngnngngnnnnnnnntgcntnnncgnnngnnnntnnngnnntngngngntncgnnnngngnnncnnngnnnnnncgnnnnnngnntgnncnnatnnnnntnnncnntctngnntngnnggnnnnnnngannnnnnntgngnnnctcnngnnnnncnannnngnncngnnnnnnnnnannnntgncgnnncgncnccnngcgngctcgcnacnnnngntnnnnnnnnnnntnnnncngnnnngnnncncngnnncgnnnannngncnnnnnngnannncncgnnnncgnnnnagnnggnnnnnnncgnnnncnngnnnnccangancgcnnaanacnnnnancnnnnnnnnnntnaagctctcanncnngnangnnnngnnnannngnnnaagnntgnnnccnnngnnnnanannnnanngnncncnnngnnnngnngcnnnnanangcnnacgcgnngnnnannnnggcnanngcgnaancncgncnnnngnncnannnnnncnngcnctnnnnnngcgnnaagangcnnnngnnncnnnnnancnnnannccgngngnngtngncnngnnngnncncncnaccnnngnnncggngcnnnnnnnnncnnnncnnancnnnnnnnnnncgancnnnnnnncnnnnccgnnnnnnnnngccnnnnncnnnnnnnnnnnnncnnnnnnngtcnncncgtannnnacannncnanaaanttnnnnantnttnncgntgnnncnnnnncnacnangannncgnnnnnancnnncgncncgntnnnttnnntncnnnnnntntnnnnantnnnnnnnnnannnncnnnnncacanananaannnaannnncnnncnncnnnnnnnntnnnnnnnnnntnnnnnnnnnnnnnnnnnntntntantnntacnnnnccnnnccnntnanannttnaangnntnnnnntcgnnattnnatttngatggatgttgcataaatgtatatattaatacttttgcgaccccctcgcattttgaaggttcatgactagtcatttcattttgtgaatttttcgtgaatttttcgagaaattccagaagatacggttttgaccgttcatgaatcaaaaatggagtaacccactcgcgtnacgagacctaactcaaagtttacaaaattggttttttcttcgaatcacgaaccgacaagtgagtcccccactgcgnacgatttaatactcaaaaaacgcaaattttcgagaaaaaacgtaaattattccgaaaataatgcacgagtcgtcactcagaaaacttttgggactcgggacatttttggtggagattacgatggaaatttacgccgaacgtgaattttcgtctttgcccgcgcctctctccgcgacggccgcgccgatggcgctcgttctcgagtatattttgtaactttacatcttctttccaacgacccctcgttcgtcaccactcgtgcggtatcgagttctcgaccgcgcttcttcgatggacccttcgcccgccccgtcgagctctacggtttcttgtagtttcttttgaatcggtactttgtcccattaagtatgttgagtagtactcatactgtgataacgtatttccgattcgttatgtttttgtgtgcatgtccgcgagagggcttcgacgcggctgcgctcggcgggcgcgcgccacacgacggcgtccgcacgcgcgcgcgaacgcgatgatgacgacgagaatgacgacgacgaggacgatggcgctcccgaagactcggggcgccgccgtcggacgccccgcgaggctggcgacgacgacgtcggtcgtgggtggacgaggaagattcgcgacgacggtgtctcgaccgacggcgtggaaggcgctcgtcgcggcggcgtccgcggccgagggcggcgaggagtacggcgcggcggcggcgagcgatgatgacgtcgcggcgtacgaagaggcggcggcgccgacgcgaagaacggtggtgccgtttacgagaacaaaggagaaggatccgtacaagaggttagggatcgataaggatgcgacgagcgaggaagtgtcgagcgcgtttaattacttgatccgggaacacgccggggacgagcgcggagtggagtctatcgaggcggcgtacgataaggtgatcagtgagcgattgacgacgcgtaagatgcaaaaggggcttagaaagttgaaaaaggagaagaagggcgacgaggttgattacgacgcgccgattgtgcagcgcatcaagtttatgtttgccaagccggatcagcaaacgctcatccgcagaacgttgttgtacgtcatcatctcgggatgggcgatcgcgcagccggcgacgagcggaccggcgttccagatggcgtgcgctttcggggcgtgcgtctacttcttgaacgagaagcgtgggggacagggaactttgggcaaggcgttcagagattccctcatcgcgttggtgctcgcgtggttagttggttccatcgttccggtgtacattccgttgttcccgcaaggcatggccccagaattgattctcgcgttgttctcttttgtcgccatgtgggctacgtgcacctttttgaagtagaggaggcgcataacgcaaccactcgcgcgcgtctcgatgccgccgttgcgtcgcgaggagaggagaaaagaatcagtacacgaaagattgtttgagcgttcctgtcgagacggaacgacgagaaggatttgctgctaatagcttgttataattctaacaaaaaaattattgaacgtcgtcttcccgtctactactaacgttcgtcgccgcgcatcttgcgaatcggtggtacgtaacctgccggcttcggtggaagaatgtcatatcgcaaaagtctgcaatcgactccgccgataccgactgggtgtttgcgcgaagcacgcatgcgaatggctcgagatacctcgggattaccgctcaatacgtatgcggaagaatccggacactcgcgcttgaggaaaaccccgagcgagttccacacctgttcgagcgcctcttccggagtgacatccgctcctcccatcgtcgtgtcgcggtcgtacgtctcttcttcgtattcatcgccctcctctgcgtactcttgttgctcgttccttcgcccgttcccggcgccgatgcgcttaccccaaggtggattagtgacaaccagccgaggggcgtcgggctcgattctcgccccagctcctgatccactgagatgaaacatttcgcaatcatttctgaagacctctatcatcccatcgacgcgagcngtctcggctcccttgcccgcgagtgtcacggcgcccggatggatatcgttcccgatgatgactggtggaacggacgaaatcgcccgagtctccgcaccaattcgcctcgcattttcgagtgactcttccaacgttcgtgggttgtgatccggccagcgctcgaacgcgtagccgatcgtttcgcttctaatgagccccggggcgacgttggccgccatcaaagcgccttcgatgagaaaggttccactcccgcacattggatcgatcaatacgggcggcgacccgtttgatggatcattttgccactgttcgagcatttgggg

SEQ ID NO: 1199 - DNA, 4000 bp, Escherichia coli
  misc_feature (34)..(34): n is a, c, g, or t
  misc_feature (406)..(406): n is a, c, g, or t
  misc_feature (438)..(438): n is a, c, g, or t
  misc_feature (453)..(453): n is a, c, g, or t
  misc_feature (455)..(455): n is a, c, g, or t
  misc_feature (1583)..(1583): n is a, c, g, or t
  misc_feature (1591)..(1591): n is a, c, g, or t
  misc_feature (1854)..(1854): n is a, c, g, or t
  misc_feature (1985)..(1985): n is a, c, g, or t
  misc_feature (1987)..(1987): n is a, c, g, or t
  misc_feature (2180)..(2180): n is a, c, g, or t
  misc_feature (2222)..(2222): n is a, c, g, or t
  misc_feature (2225)..(2225): n is a, c, g, or t
  misc_feature (2279)..(2279): n is a, c, g, or t
  misc_feature (2282)..(2282): n is a, c, g, or t
  misc_feature (2348)..(2348): n is a, c, g, or t
  misc_feature (2413)..(2413): n is a, c, g, or t
  misc_feature (2522)..(2522): n is a, c, g, or t
  misc_feature (2552)..(2552): n is a, c, g, or t
  misc_feature (2764)..(2764): n is a, c, g, or t
  misc_feature (2906)..(2906): n is a, c, g, or t
  misc_feature (2979)..(2979): n is a, c, g, or t
  misc_feature (2983)..(2983): n is a, c, g, or t
  misc_feature (3158)..(3158): n is a, c, g, or t
  misc_feature (3206)..(3206): n is a, c, g, or t
  misc_feature (3208)..(3208): n is a, c, g, or t
  misc_feature (3214)..(3214): n is a, c, g, or t
  misc_feature (3226)..(3226): n is a, c, g, or t
  misc_feature (3228)..(3228): n is a, c, g, or t
  misc_feature (3235)..(3235): n is a, c, g, or t
  misc_feature (3259)..(3259): n is a, c, g, or t
  misc_feature (3280)..(3280): n is a, c, g, or t
  misc_feature (3309)..(3309): n is a, c, g, or t
  misc_feature (3358)..(3358): n is a, c, g, or t
  misc_feature (3397)..(3397): n is a, c, g, or t
  misc_feature (3457)..(3457): n is a, c, g, or t
  misc_feature (3503)..(3503): n is a, c, g, or t
  misc_feature (3508)..(3508): n is a, c, g, or t
  misc_feature (3517)..(3517): n is a, c, g, or t
  misc_feature (3592)..(3592): n is a, c, g, or t
  misc_feature (3619)..(3619): n is a, c, g, or t
  misc_feature (3631)..(3631): n is a, c, g, or t
  misc_feature (3637)..(3637): n is a, c, g, or t
  misc_feature (3649)..(3649): n is a, c, g, or t
  misc_feature (3766)..(3766): n is a, c, g, or t
  misc_feature (3778)..(3778): n is a, c, g, or t
  misc_feature (3820)..(3820): n is a, c, g, or t
  misc_feature (3850)..(3850): n is a, c, g, or t
  misc_feature (3861)..(3861): n is a, c, g, or t
  misc_feature (3871)..(3871): n is a, c, g, or t
  misc_feature (3878)..(3878): n is a, c, g, or t
  misc_feature (3895)..(3895): n is a, c, g, or t
  misc_feature (3898)..(3898): n is a, c, g, or t
  misc_feature (3910)..(3910): n is a, c, g, or t
  misc_feature (3955)..(3955): n is a, c, g, or t
agcgatcaacctattcatcctggcacttataggncgcattctcatagagatgattgtctcgttctctagaaattttcgcgcccccagctggtttacccgctgcgcagagctgctttttgttgtcactgatccggcagtaaaagcactacgacgaatcattccgccgcttcggatgaataatgtttccctcgatttatcggtcttagtgctctatatcgggttgcaattcttatacgtcctcgttgctaactatcttcctggctaatgcgtgacctcaatgctgtcgggtagcaaaatcgactacagtcataggctgcaaacttgctagataccgtcatgtgggtgtggtttgacgggctggtgtaggggtggaaaactacccaattatcgccataaatgtgagagnaatacaggaattagctgcggttttgttaagantaaccccctacttancntaaaaattacctgggatatattccaggggtagcccattacccacggctgggggtctaagaaccctcagatttgcagtaacttcgtcacatttggtgagaaattggaaaaaatttccctagaccacgtttggccctaaaaaccccgctgacgggtgtattttttgatgcatagcgctaaaataacgggtacataacggttagatttcatctttatacttaacatttagacttgaatgtgcgttatggttaacaggaacgttataaaagctatatcaatgatggacgatcatcgttgatattttatgaatctcgaagggaatagttccatgccgctgactccagccgatgtgcataacgtcgcattcagcaagccgccaattggcaagcgcggctataacgaggacgaggttgatcagttcttagacttggttgaagatactcttgccgagattcaagaggagaacgacgatctacgccaacaaacagacgaattgaagtcggaactggaacaagcccgtgccggtgggggcggcggcggtggagctgacgaagcggccatccgtgcccgggtggaagcccagctcaagcagcaattcaacgccgaacttgcggcagctaaggcagaaactgaacgagccaaagaagaagcacgcgcagcaaaggccgaagccgaggccgcgaagaaggctgccgaaggcgccatggttccctccggggagactgcacacccagaaacccacatgcaagccgcaaaggtgctggggctggcgcaggaaatggcggatcgcatgaccaccgaggcacaggccgaatcgcggtccatgctggaagatgcccgcaccgctgccgaaaagcagatctcctccgctgaagcgactgcccgcgctactcttgacgacgcacgcatgcgcgccgagaagcaagtgaacgaagccaccgccaccgcggaacgcctcgtcaatgaggcacgtatccaggccgaaaaaaccatttccgaggcgaatgctcgtgccgaagcccagatcaaggcggccgaagacaaagccaatgccctccaggccgacgccgaacgccgccacaccgaaatcatggccacggtcacgcagcagaagaacgccctggaaaccnggattgcngagctgcgtactttcgaacgcgaataccgcacccggttgcgcaccatgctgcaaacccaattggaggaattggatgctcggggttcggcccaacccggcccccaaagcaacaacaaatagcccagtgttgctgtgaactgataagtttaagccctcaatgtagaccacgcattgagggcttttccctgaggaggtagtgaatgttcatagcggcactgggattgggcgtggccagcttaggatttctcattgcggccatcgtnggcagtagccaaatctggcagtggccggcaatcggctgcgcgctcatcggcctggtgctacttatcgttgaccacattcgctaccggggtgctagccgtgagttggaggaggagccggagccgccccgcangncgaacccgcgcagctctcactcgcatcatcgtcgccaagacccgaaataagttgacgcagcgtgggccacaatccgccgcgcaccgcatccgcatgaaaataccaccaaaaatagcctcccacgaaccgtggccccacctgtgcccgtaactcattatgcatgccgtaatagtattgggctatttgttgtttntccgctaaccccggatcctgggaccgaccatcgctgcggttntgngccccaacctccccaatgcccaggcgcgcgtggggaaacaccgttcccagggcngtnagcgtgtgtgctatgtcggccgcggtggggtgctgcggcggatcgcacgccgtctcatagataganaaaaacacatagtccggttgcctggtgacggtgtgggcgaaccgcattgtgtcctcccatgcgtnttcgtagcagtccggcgacgaccaatagttgagggtgagcgcggtcggccgaccggcctgggctacgacgtcgtgcgccgcggccaccttggcgttgatctccttaggnctggaccccgcccactccccattgggctcnttaccgatctcccacacatccacccattcccccaggtcacgcagcgccgccctggtgcggtcggccacctcggtggtcgacaactccgtaagctgttcggagtccaccacctgcaccatgacctgcgcccggtcgtggattcgggccaccgcatcccggtactcctcgggttgcatcgcagtgtccatgaccacccgcaccgtgagcggggnggggcttgccgccatgaggtccaggctccggcccaggtcatctagagattcgagggtgatgccccgcagcggggtggtgagctgccgcggtggtggtgccggcggcgactctgaggtggtgcacgatacgagaaataaggcngccatgagaaaaacggccaggtggccgtgggcgaagcgtcgtaaagcgcgcatggtttcatcatatgtggtangctntgctggtttaaacggctatgatccggcaatcaccggggagccatctggaagaaccggcagcgactgcctcagtagaaccagacgggtaagaccgacatctccttcaaacgaagcggggcccatgcggcccaaccagggtggtaccgcgtgcaagcgtccctggattcccactgantctttgaaggagaccataccgtgaccaaagtcggcaatgtataccctngngtgganatgaccgggggntnccagcgnttttccgacatggaacaacaggtnctgcgctactgggaccttgancaaaccttccaagcctcctgcgacaaccnggaaaccagccccgaatatgtgttctatgatgggccgccgtttgccaangggctaccgcactatgggcacctgctgaccggctacgtnaaagacatcatccccaggtacaaaaccatgcgcggctacaaggtggcgcgcgtattcggntgggactgccacggcctgcccgccgaactggaggccgaaaaacagntgggnatcaaaganaaaggccaaatcgaggccatgggcctggaaaaattcaacgagtactgcgcccaaagcgtgctgcaatacacggangaatggaaagcctacgtcacccggcangcccggtgggtngatttngataacggctanaaaaccatggacctggatttcatggaatccgtcatgtgggcgttcaaaaccctctacgataacggcctgatctaccagggcttccgggtgctgccctattcctgggccgaacacacncccctctccaancaggaaacccgcctggacgactcctacaaaatgcggcaagancccgcggtcaccgtcaccatgccgctggtngacaccccagnccatccgctnggggccncgctcgccggcgtcaangcnctcatctggacnaccacgccgtggaccctgccctccaacctggccatcgccgtcaanccggacgtcacctatgccgtggtgcgggccgccgacggggaacgc

SEQ ID NO: 1200 - DNA, 4000 bp, Escherichia coli
attgtccgtagtaggtattagatcaccgtcagagtttatacagatttcaacaccactggcgccaacacataaggcatctggatttgtaggcatattcccggtaacacgggcagatataagaccactataaaacccaatagcaattatgataaaaagaaataaacctaaaaacttaaatattttttgcattacttttgcctccggtaattatcaatgtttcgcattgcgctatttgtcggatcgagaattccggcggcgcgttttaattgttcacacattcttctaaacattggattattaacttcctcattaaaagatttatcgactgctgctcgatattcttgattcttggtagcatcaagtttaggccattttcctacttcttcttttgtaagagcgtgtttctcgatgtatgctttagcttggttaaactcttttaaggctttatctttttgctttccacttccttcttttggaaggaacgcggctaaagccctttttttaaccgcaagttgctgttcaagttgcgcgacattaattccgcctgcttcaaaactcgtgattccttttaagtccgttgaacctttttttaatccgtctatatacacctgatcacgattgatttcatattgccgagcttctaccgcagcaggtgatataggcattatttttctccgtaaaactcttccacttccttttcttacagccatattatccctccgtctgtatttttacttatgaaacttcatgtccgaatataggtctccaatcgggagagctaacattacaagacatataacctgcatgttttgaagttagcgtatcaatatcaccagcataaaagaactcaaccggattccattgataaaacttaaaataatccttcattaagtttttagttcccatgaaccaattatcatcatcggtgagccagttgtgccatacaataagctcataacggcctttatggacgttaggattattgttcgcggtattaacctgttttacagaagagattaattcaagaccagcatcctcattacctgtggctacaataagagtatccgggaagtcaagggcaatattatcgcgattagttttatacttaatcattaaccggcgagtagcggccactgaggcaggtgaaaatgaagaagatcctgcattagcctggctagatccaccaacatcggaggtatgagtgctattgcacaaggaaacagcatccgcagtgagtgtcgtgctaaacgaattgtttaaaaaatttgcacctatagattctttttttgcgcgaaatctatcagctaaagcggcagcagatcttttagcgacaccatataaatcatttcttcggaattttttggatattttaataccgagagagtattcaatttcctcaacggtctttttatatgattgtttactttcatcataataaatctgtccgtcgaatgtttgaacaccaccaagatcaccaagcattaactcggtaactatagcttgatccggagtttcaacatcaaagattgccggaatcatggatttaaactctccataccttactgcaaaaatctgagaaagatttttttgtataacatctgggtgattagcttgtgttaatgcgggcatataagcctcctattattaattagtgtaaattcctacatactaccgattagatattttattaatctatcggcgctataaaagtgttattgggcattacaagacttctgaataccgggtgtaatccattcaactgaaaattatgatgtgcgttgggttcaagatcaatccagctttcagagccatcatatctcatttgattgcggatagttctagcggtccaagttccggctgcggcatcagttccgaatttatccattgttgcgtttaagtggtgtaatccgtgcccgataggtggtattttaattaatgtggtgtctgcagcgaccaaagtcgtagtaagcgcggcgatagttagatcggtattatcatcatagttaatgaaagctaattgaccaataccagtgccggcaacagcatataaccagcctccacttatatgatcttcgattgaagttatagtgattgcagttgcggttgctgtggcaatagccatagtatcagtttggtcatattcacatgcgacaacacagccaggacagaatggttcaacttccgccataacatgagccgcgccagtgaacacatcagaatcaccaactactgatacatcatgtttagcaacaaggagtccgtacgcatcagcgccggtttcatcagcaagaacagcactgccgtaagtgtcacttccatttccagcttcggttgttcctggtttgagcatagcgccggcattaatatcagcagctacaccgtcgataggtaattttattagtcctaaaggagagcttataattttcatacacacctcataataattagttcaaggtgagtattcaggttggataaaatttaatttttccaggttggattaatcaaggtggatacttctctaataggatataatactttttttaatgtgtcaagtcttttttaaaaaattcttacttccgcagagtgggcaaccggcgccttttcttacagaattttcacctactccgtcggtaattgtgatagttccaagaccgccattacctgttaatgttccgccggaatgatcggttttatttatatcaacaggatgcccacattgcgcgcatttataaattagcttagggcttttcttgccgtggccttctccggtttttagactattcggccgggctctaccactcccggccgtatgagaaggatacatttttttttcatttaattgtttaggattaaatttcattttaatcgaatgatggagcctcatcaaaattatttggaatttttacatcattgggactacgttcattggactgaacttttttccactcttttttatcgattactccaccgacacggattttttcaccagtcttagaaatatactcaccatcttctatctcgcctttttcagcgccggtatttttaggatcctcatcataagaaatatcgtcgtcatctgcttgcgctatcttttttgtaagtgctttaggagttttcgtaaacccatacttgcctttagcatagaagatagcagtttgcatatgcttagcaatagcttcattagtgagtttttgattgtttggaattgtatcaaagtgctctttaattcctgccctaagttttgtaagccgaggatttttttctatttcatctgcgatagcatcgcgaacattttgacgagcttctatatcgtcttgccttttatttgttacatgagatctatactcagctttaatagtctctcggtctttgccggtttgagtttcaagcgttatccattgatcttcagagaactgatccatatttacagctgtaataggaacagccgcgggagttttaggtttttcaagctcagttattttctcttttagtttgacgttttcaatctcagcctctgtaagttcgagttcttcttctgtaccttcttcttctataacttcctcatctgtaggatcagcagcgtttgccggcgccggttctccatccatgagtattctaaataatttgtacatgttttccctccttgggtttgtttattagtttttttatcttatcattgtcgttagcgatatcctcattaagtctatcgattgatatttgagaagacattatattctttttaattcctttaatgataagtgcgactttagcattagaccgaagtgtgacctgctctttttgagcgtcaggaatatccttagtttcaaggatggttgtgtttattctatttaaagtatcaattattttatcgaattcattgataagtggtttattggtttttaatttagccaattgttgtaactgtttaattctttcgtgcttagttttaatgctaactttaatattagcggcctctatcaatttttgtttgctttccatt

SEQ ID NO: 1201 - DNA, 4000 bp, Escherichia coli
  misc_feature (1)..(2): n is a, c, g, or t
  misc_feature (4)..(9): n is a, c, g, or t
  misc_feature (12)..(14): n is a, c, g, or t
  misc_feature (16)..(16): n is a, c, g, or t
  misc_feature (18)..(18): n is a, c, g, or t
  misc_feature (20)..(21): n is a, c, g, or t
  misc_feature (23)..(28): n is a, c, g, or t
  misc_feature (30)..(32): n is a, c, g, or t
  misc_feature (36)..(38): n is a, c, g, or t
  misc_feature (40)..(43): n is a, c, g, or t
  misc_feature (49)..(49): n is a, c, g, or t
  misc_feature (52)..(53): n is a, c, g, or t
  misc_feature (57)..(58): n is a, c, g, or t
  misc_feature (62)..(63): n is a, c, g, or t
  misc_feature (69)..(70): n is a, c, g, or t
  misc_feature (72)..(73): n is a, c, g, or t
  misc_feature (76)..(76): n is a, c, g, or t
  misc_feature (78)..(79): n is a, c, g, or t
  misc_feature (82)..(82): n is a, c, g, or t
  misc_feature (84)..(84): n is a, c, g, or t
  misc_feature (86)..(88): n is a, c, g, or t
  misc_feature (93)..(93): n is a, c, g, or t
  misc_feature (95)..(97): n is a, c, g, or t
  misc_feature (100)..(102): n is a, c, g, or t
  misc_feature (104)..(105): n is a, c, g, or t
  misc_feature (107)..(110): n is a, c, g, or t
  misc_feature (113)..(113): n is a, c, g, or t
  misc_feature (115)..(115): n is a, c, g, or t
  misc_feature (117)..(117): n is a, c, g, or t
  misc_feature (119)..(120): n is a, c, g, or t
  misc_feature (124)..(129): n is a, c, g, or t
  misc_feature (132)..(135): n is a, c, g, or t
  misc_feature (137)..(137): n is a, c, g, or t
  misc_feature (139)..(140): n is a, c, g, or t
  misc_feature (143)..(146): n is a, c, g, or t
  misc_feature (148)..(152): n is a, c, g, or t
  misc_feature (154)..(155): n is a, c, g, or t
  misc_feature (158)..(161): n is a, c, g, or t
  misc_feature (164)..(164): n is a, c, g, or t
  misc_feature (167)..(168): n is a, c, g, or t
  misc_feature (170)..(170): n is a, c, g, or t
  misc_feature (172)..(173): n is a, c, g, or t
  misc_feature (176)..(179): n is a, c, g, or t
  misc_feature (182)..(182): n is a, c, g, or t
  misc_feature (184)..(189): n is a, c, g, or t
  misc_feature (192)..(192): n is a, c, g, or t
  misc_feature (194)..(195): n is a, c, g, or t
  misc_feature (197)..(197): n is a, c, g, or t
  misc_feature (199)..(206): n is a, c, g, or t
  misc_feature (208)..(215): n is a, c, g, or t
  misc_feature (220)..(225): n is a, c, g, or t
  misc_feature (229)..(233): n is a, c, g, or t
  misc_feature (235)..(236): n is a, c, g, or t
  misc_feature (238)..(238): n is a, c, g, or t
  misc_feature (241)..(242): n is a, c, g, or t
  misc_feature (244)..(246): n is a, c, g, or t
  misc_feature (248)..(254): n is a, c, g, or t
  misc_feature (258)..(258): n is a, c, g, or t
  misc_feature (260)..(261): n is a, c, g, or t
  misc_feature (263)..(263): n is a, c, g, or t
  misc_feature (266)..(276): n is a, c, g, or t
  misc_feature (278)..(278): n is a, c, g, or t
  misc_feature (280)..(282): n is a, c, g, or t
  misc_feature (285)..(287): n is a, c, g, or t
  misc_feature (290)..(294): n is a, c, g, or t
  misc_feature (298)..(298): n is a, c, g, or t
  misc_feature (300)..(300): n is a, c, g, or t
  misc_feature (302)..(302): n is a, c, g, or t
  misc_feature (305)..(306): n is a, c, g, or t
  misc_feature (310)..(317): n is a, c, g, or t
  misc_feature (319)..(321): n is a, c, g, or t
  misc_feature (323)..(328): n is a, c, g, or t
  misc_feature (330)..(330): n is a, c, g, or t
  misc_feature (334)..(338): n is a, c, g, or t
  misc_feature (340)..(344): n is a, c, g, or t
  misc_feature (346)..(349): n is a, c, g, or t
  misc_feature (351)..(352): n is a, c, g, or t
  misc_feature (355)..(355): n is a, c, g, or t
  misc_feature (359)..(360): n is a, c, g, or t
  misc_feature (362)..(362): n is a, c, g, or t
  misc_feature (364)..(368): n is a, c, g, or t
  misc_feature (370)..(372): n is a, c, g, or t
  misc_feature (1315)..(1315): n is a, c, g, or t
  misc_feature (1631)..(1631): n is a, c, g, or t
  misc_feature (1715)..(1715): n is a, c, g, or t
  misc_feature (1992)..(1992): n is a, c, g, or t
  misc_feature (2018)..(2018): n is a, c, g, or t
  misc_feature (2054)..(2054): n is a, c, g, or t
nnannnnnnttnnnantnannannnnnnannntttnnntnnnnaaaaanatnnaaannaatnnattaannannaanannttncnannnaaaanannntannnanntnnnnaangnantnngaannnnnntgnnnntntnnaannnnannnnnannaannnntanaannangnnttnnnnatntnnnnnnttnanntntnnnnnnnnannnnnnnntattnnnnnnactnnnnntnnangannannngnnnnnnngatnanntnaannnnnnnnnnntntnnnttnnnaannnnnaaantnantcnnattnnnnnnnnannncnnnnnnancgannnnnannnnntnnnnannaantagnngnannnnnannnttggttgcgggggctggatttgaaccagcgaccttcaggttatgagcctgacgagctaccagactgctccaccccgcgataaaatttgtatatttgttctattttttaatattatattttatgtttttttaagcaaacaaaattagatattataatctctcattcttttgattttttttgatcttttaatattttcttgtctttctcttttttttctttcagaaggtttttcgtaattacttttaatttttaaaattttaaaaaaaccttccctctgaagctttcttttgagaattcttaatgcttgatcaacattgttatctttaacttctattttaataattacctcctaattaaagatgcattaactaacattaaaaaaaaaggttgtccagctagaattggaagggttttgtagattcgttttttctaagctttttttataattaatcttcaattttttgattttctttgtctatcttttttttctttccagtagcttttaggttagctttctctactgcattttttatatcaatttgagaacagagactggagaccactggatcctttggtgtcaaattagaagaattccaataattgttgttttttatcaaagatacagtattttttgtgctccccacaagttttcctatttgtctatcagacagctcaggatagtttttgattaaccaaagcgctgcgttaggtctatcttgtctttttgataacggaacatacctcggttttttttttcgagtacttatacttatatctaaattttttttacttagtacaagaggtctattactatctttagaagatgctacaatttcttctcttgtcaattgtccagctaggataggattataagcttttattcctttttctacatctccatcagctataccctttacttcaagttcgtgaagattacaaaaancagctatttgtttgaaacttattttagtgttttcaactaaccaaacagcagttgctttaggcattaaaggtctatcattcattactattttttgctcgttgaccgcaaattcttaaattttttaaaaaacttacttactctacctttgtctaagactttttgagttccacctgtccaagcagaatgagatttagaatcaatatcaagtttcaaagtttcgccctcttttccccaagtagacatggtttcaaaatgacttccgtcagtcataataacttttatcttatgataatttggatgtatgttttttttcatntcggaacaatttaatataataaaacaaaataattgacaataaaaaactaactacttcaaaacttcaatcatttcttcattaatnttggagtttgttactaaaatagttttattttcgatatattcgttatttcctttaaaatctgtaacgaatcctcctgcttctttaactaaaactacgcctgctgcaatatcccaataatttaaattcctttgccaataaccatcacatcttcctgcggcaacataggccatatcgagcgaggcactacccattttcctaattggtatcattactctggatgaaaatttgtaatattcatttaatgagagttgtctgtccttatcttttgatttaaagnttggtcctccggtaataattaaacantcttttaattttgatctagatgaaactcgcagtcgntgattatttaaatatgatccattacctttttcagctagaaacatctcatctttaattggatcaaagataattccacaaataatctcttttttatgttctaaacctaaggatattgcaaagtgtggtattccatgaagaaaatttgcagttccatctatgggatcaattatccatttaaattcttcatcatttgtaatttgcccaatttcctcacttaaaatagaaaatctaggtctagctttttgaagttcttcgattaaaattttttctgcctttatatctgatgctgtaacaaaatctccaggtcctttaagagaaacttggagtttttctatttcaccaaaatctctaattatattttttgcagcttttctacaagctttaaccattacatttatatttgctgaagaaagtttcatttatttaatttttttaatgtactccaaagtacttgtatctaaaataattttatctccagaattgataaatggagggaccataatgttaattccattttctaaagtagctggtttgtaagatgatgaagcagtctgccctttgattgttgcatctgtattggtaattgttaattcgacagaagatggtaaatcaaccgataaagcttgatcttcataaaaatgaacatttaccgccatgttttcttttaacaatttgtttttttctcctaatagagatttattaattgcaatttgttcaaagttagtttggtccataaaatgacaattattttcatcctcatatagaaaattaaattttttttcatctaaaactgccctttcaacactatcgctagatctaaacctttcatttaatttagttcctttcttaacactttttaattcgacttgattaaaagcaccaccttttcctggtttgacatgttgtgcttttaaaaccgaccataaatcatttctatgttcaatgatcattcctggtttgatttcatttcctaatattttcatttttttatttaaatttttttattgctgaagctggatctaattttttattattccaaatatagctagagcaagcaataaaatctgctccattagataaaatttttttataattagaactattgattccacctattgcaacggtcggcatattaattttttttttagcccaacgcaatattgctaagttggctttaaaagcagttttttttgtttgagatttaaaaaatgatccaaaggcaacataatttgcaccatgcttttttgcttttaaggctaattttttagaattatgacatgtcactccaataattttattttttcccaatatttttctactactcataaaatccacatctttctgaccaatatgacaaccatcagcactaaccatttttgctataaaaggtttatcattaattaaaaatttaacattattttttctaactatttttttaatttttttagatatttttaataaattatgagtaggtattttttttaatcttaattggaagtatttaactttattagtttttaatacttgattaagttccttataaaactttgtccctcttatcctttgaggtgatattagataaatatatcttttcaattttagttaggcagttatttgtttttccaagtccatactccattttgctgaagtagaaaggccattcattttagatctatgattaaagattttttgagtattgcttgtatctttaatgttttttgcccaatttttaagagcactttgttgtagagctcttccataagaaaaactcattataaaatttgtatcattaattttattaatttcgtttaaattttgtgttgcctcaatttcagtttgtccgcctgataaaaaagctattcccggaacatcactaggtacattttcttttaaacatttgagtgtcattttagcaatttctgctgtgttacttttatcttttgatt

SEQ ID NO: 1202 - DNA, 4000 bp, Escherichia coli
  misc_feature (7)..(7): n is a, c, g, or t
  misc_feature (25)..(25): n is a, c, g, or t
  misc_feature (61)..(61): n is a, c, g, or t
  misc_feature (82)..(82): n is a, c, g, or t
  misc_feature (172)..(172): n is a, c, g, or t
  misc_feature (178)..(178): n is a, c, g, or t
  misc_feature (181)..(181): n is a, c, g, or t
  misc_feature (184)..(184): n is a, c, g, or t
  misc_feature (187)..(187): n is a, c, g, or t
  misc_feature (196)..(196): n is a, c, g, or t
  misc_feature (301)..(301): n is a, c, g, or t
  misc_feature (307)..(307): n is a, c, g, or t
  misc_feature (322)..(322): n is a, c, g, or t
  misc_feature (364)..(364): n is a, c, g, or t
  misc_feature (385)..(385): n is a, c, g, or t
  misc_feature (486)..(486): n is a, c, g, or t
  misc_feature (796)..(796): n is a, c, g, or t
  misc_feature (867)..(867): n is a, c, g, or t
  misc_feature (893)..(893): n is a, c, g, or t
  misc_feature (924)..(924): n is a, c, g, or t
  misc_feature (1221)..(1221): n is a, c, g, or t
  misc_feature (1266)..(1266): n is a, c, g, or t
  misc_feature (1296)..(1296): n is a, c, g, or t
  misc_feature (1299)..(1299): n is a, c, g, or t
  misc_feature (1419)..(1419): n is a, c, g, or t
  misc_feature (1455)..(1455): n is a, c, g, or t
  misc_feature (1476)..(1476): n is a, c, g, or t
  misc_feature (1503)..(1503): n is a, c, g, or t
  misc_feature (1512)..(1512): n is a, c, g, or t
  misc_feature (1596)..(1596): n is a, c, g, or t
  misc_feature (1599)..(1599): n is a, c, g, or t
  misc_feature (1842)..(1842): n is a, c, g, or t
  misc_feature (2003)..(2003): n is a, c, g, or t
  misc_feature (2024)..(2024): n is a, c, g, or t
  misc_feature (2030)..(2030): n is a, c, g, or t
  misc_feature (2036)..(2036): n is a, c, g, or t
  misc_feature (2216)..(2216): n is a, c, g, or t
  misc_feature (2476)..(2476): n is a, c, g, or t
  misc_feature (2496)..(2496): n is a, c, g, or t
  misc_feature (2538)..(2538): n is a, c, g, or t
  misc_feature (2568)..(2568): n is a, c, g, or t
  misc_feature (2595)..(2595): n is a, c, g, or t
  misc_feature (2598)..(2598): n is a, c, g, or t
  misc_feature (2766)..(2766): n is a, c, g, or t
  misc_feature (2775)..(2775): n is a, c, g, or t
  misc_feature (2817)..(2817): n is a, c, g, or t
  misc_feature (3343)..(3343): n is a, c, g, or t
  misc_feature (3465)..(3465): n is a, c, g, or t
  misc_feature (3635)..(3635): n is a, c, g, or t
  misc_feature (3638)..(3638): n is a, c, g, or t
  misc_feature (3647)..(3647): n is a, c, g, or t
  misc_feature (3848)..(3848): n is a, c, g, or t
gagtgtncctgcatcatcactattnaaagtgttcttgatgcgcaatggaatacccttttcnataagaggaataatggttttngcgtgaagtatagaagccccaaagttagccaactcattggcttcttcataagaaagatgacgtatgattttggcttcgggtactaattcnggattngcngtnaanataccatcnacgtgagtgtagttttgcagttcagaggcattgagatagttagccaaaagggctgctgaatagttgctaccattgcgccccaaggtggtggtatcgcctttttcngtagangcaataaagcctgtnactactgctacgtgattgggaggaatagtagcaaagcggtcncgggtgagtttttcggatacngaattgataatttgtgcattgcctactacagcatcggttttgaagatttcacgactatcaacaaaggtgctttctaagcccttgcgtttgagtagtgctgntacgagtttagctgacattagttcgccttgtgccaataccaaatctttagtcttgggactataatcttttaatagagatactccttcaaggagtttttcgagtagctgaaattcgggttcaaacgacactcgaggatcatactgctgttcgtttttcaagtgttgaaaatcggcagtgtaatcctctcctttacttgctttttcaagcagtgcctctaattcatcagtagtattacctctcgctgatactactaccgatagaggttctttatgtgaagtaatgataatgtcaatcaccttttcaataccntcattggcaagtgatttaccaccaaattttaatattttcatatttttatcttttacttagtttgagatttnccgttagattaaaagattttcttcanaaactgttctaactgtttgtgttctatcaanaaagcatcgtgcccgtgtatagagtgtatttcgtagtaatctacaggtttgcccatttcgcgcagctcggctacagtatcgcggttttcttgaggcacaaaatacaggtcagaatcagtacttacgatagtaatatgtgccgtaataggcgctaccgcttcagcaaaactaccacggtctttagaaatatctattgtttttaccaattgattcatcagcttataagccgaaagcgaaaaacgtttgttcagcttttcaccgtgatgcagcaaccagctctctacattgtataactgngtaggcagatgggtagtgcgttcgaacttcattttcagtgattgnggggtacgataacacagcatagcgtgcagncgngcatcgtgcaaggggtgtgtagagtttttgagtatctgctcttgcaagaggcagttgcctataatccaatcggttgccttccagtcagcggctactattactaattgctgaaagtagtcnggcgcaagagctgccatctcccaagcaataccgccncctaacgaacagcctactaangcaaaaacagagtttagccccaagtgntctttgagngctatattgaataagcgcgccacatctaccgccgcccaatgctggtagttagttatcatatcttcctcgcgtgcgtggaagccnttnccgggaatgttaaatgctactacggtatatgtatcagtattaatcactttggcagtacctatagcctctgcccaccaaccgttttcgcctgctacttgcgaattgcccgtaaaagcgtggtttaccactactaccggagctgtgcctaaaggcttaccaaacagttgataggtaaccctaagtgaaggaatacgcactccatacgaagtaacgaaatcaagcaagtcataatgcaaaatatcnaacatagcttactttttaatatctaccattaaccgttaataattgtttgatttgtttgctctatatattgtgttagctcctcttttcctgttttattctgtgctgaagttacaaaataaggaggaaattcctcccaccactcgagtagcgcttctttatangctgctacattgcgctctatngcttgnggtttnagcttatcagctttggtaaagataatagcaaatggtatagcccgttcgcccagccactgcataaactctacatctattttttggggctcgtggcgtatgtctactaacacaaaagcactcaccaactgctcgcgttgctcaaaataatccgtaataaagcgctgaaatacttgtttagtngtttttgacacccgtgcataaccatagcctggcaaatcaactagaaaccagcggtcatctattttgaaatgattgataagctgtgttttaccaggacgccctgaagtcttagctaaattcttacaattggtaagcatattgataagagacgatttcccaacattagagcgccctataaaagcatactcaggcagcctgtccttaggacacttggccacctgtgagttgctcattacaaattcagctttttttatcatctnttgctaattatcaattattnattgttttaagccactggtctaatatttggttaaactcttgnggtcgctccatcataggggcgtgcccacanttgtctatccaatgaagctcggcattnggnagtagttccttaaattcttctgctactttaggaggggttactatatcatttttgccccagataaggcaagtaggagtggtcatcttaggcaaatcttttgccatattatggcgaattgcactcttagctaatgctaatgttttgatgagtttagagcgatctgaaatnttagcaaanacctcatctactatctctttagtagccacagcagggtcatanaacacctcttcgcatttttttctgataaaatcatagtcaccacggcggggatacccatcgctcatagcactttcatacagccccgaactacctgtaagcactaaacctaacacatttttagggtacagcttagtataaagtaagcctacgtgtccgcctaaagagtttcctaacaagataactttttcaaatttcttgtattttataaacttttgaatgtatttagctaatgtttttaccgaagtagtgagcaaaggcattgtgaaaagaggtagctcgggcactaccaccttatatctatccgaaaaaaaagaaattacgtcttcaaaattactcagcccccccatcagcccgtgtaatacgatgataggggttccttctccttgttcgatatatgaaaatttaccttctttttttacttctgttgtcattggtatttatcaaaaagatttttgaagcacaaagataatattttatttctaattgtacacaacaaaagagaaaaatattttttatctgtttattnttcaagtgaaaaacaagtgattatcaagtcttctaaaaaataaatacataaaaaaactttgccaaagtcgtgaaactttggcaaagttttttatcaattttgcgttctttgttttgtatttngtctttggtattacgcctctccggtgataccaaaaagcggaatagtgtgtgtatcgcttttttctgctatcataccgtgagcatcttcgtagtggcgtatgttttctgccaaagcccctaacagacgcttagcgtgctctggagtgagtatcaccctactgcgcaccttnccnttaggcatncctggcattacgcttacaaaatctactacaaactcagtagccgagtgattgatgatagccaagttagcatacaccccttgcgctatctgctcgtccaactctatgcttagttgtccgttgccttcttttatctcttctaattcgctcatagtctatctcgattttttcttttccactactggttctaagtcagctttagancctacgattatcttctcataacgtttaagaccagtacctgcaggtatacgatgtcctacaattacgttttcttttagtccgtctaacgaatctaccttaccgcttaccgcagcctcattgagtactttagtagtttcttggaacgatgctgc

SEQ ID NO: 1203 - DNA, 4000 bp, Escherichia coli
  misc_feature (1985)..(1985): n is a, c, g, or t
tccaggaacgcggcgagaaccaccccgcctcggcccgcttgcagcactcggcccgaagtccatcgcccacaggctgtcgcagcagctgcccactgttgaagtcgccgatgtcgatcactcgggctatcacccgatcggggttgcgcagcgactgttcggcaggttgccacagatcagctcagccgcctgccgaagagcttcaggcactccgggtacaaccgcttctgggtcagtgcagccccctcaccaggggcagcactgaccctgctggcgcagcaggtggtcggcgagtaccagggcccaccatcggtacggcccgcggcagcacgccgggatcgtggcggcctttggctgtgccaacaggctctgccgatcggcgacagggggtcgctcctaggccggctcaatctccgcgtttctgctcgccgctgagctggcggatgtactccttgtggctgaccgtggctgaacggctcggccgctgcatccgcatccggagcagactgcgctggccttcctccagcaacgagagctccgagccacggcggcgcgcgaagatcgcgaagccacaggccagggccaggcaggcgccggtgttgcgcaattgctccggcaacaaccgcagcggatccgtggccggcaacgccgcccgctggcgggcgaactgcacctgggcctgatccagcgccatggtggcttgggccttgagctgtggcagcggcagctccagatcggccggcgatacgccggggccgttcaaggcctggaagcggctcttgaggtcggccttgctggctgcctgggccaccgcctggtgcaggccggccagctgccgctcagcccgctgcaactggctgcgctgctcggcgccgccgcggctctgcagccgcaggccggcactgatctgcagcggcgccagcagcagaaaaccgaggctggcggcgatggccagctgcgcgaaacgctcctgccgcgccctgatgcgcggatcgcggggctcgaggtggcgggccagctgcagcagcgctagggccagcagcggcagcgtggctacattcaccagcacggcaccgaggcggatctgccaggcggcatcgaggggctggaaggggaagaggctgccgagcacgagcagggcgaacagcagggcgaacaccagggctagctggctgaaactgcgcaccggcatcacgggcaccacggggagaacaacggatcaggtcaacaaaaaggccccgccgtggcggggccagaagagggaagacaaagccgagagctcaggcctgtgacgcggagccggcgcgcacacgggcccgcaggcgacggctgtgggagaaggcggccgccgcaccgagcaggggaagggggcccgggacggaactgggtggaggagcggtaccaacccgcacttcgatgctgtcgctgcccacggtccaggtgccgagcaggcctggggtggcactcagattgaggccggccagggtttgccctgaaaacaaacctgagccgttgattacatttccctggacgtagctactgtcgagaactagttggttaaaaattccaaacaaaacaacgttgtcgcccgtgtagctgctgaatgagaacgtggtgctgcccccggggccaaagctggccggtcctgagactgcaagttgcaggccgctggcaatattgccggttgagaccagagcaaggtctggtccaataactgagccaaggctggtgctgccgttggtgccagacggaagaccggagagtgagccagcaatattcaatccaacatcgctgccttgctggatgaattcaaaaacaaggagggcatcggcatcgcccgcgttgatcacagtgcatgccgaagccgtcaagagagcgatgggaaaccttagtcgcttgagcatgccgccgatcgccatcatctaagccgtaaagacgctgcaatgctgacctccggcgcgtttttgtgggggggggggggggggccngtgatccggccgtccccatctctgggcgctccgccatgcggaaaagggatcagttcggcgaagattctgaggaaaattccgggttgcgcctggctgttgctcgtgaacggctgctgatgccctggccgcgcggagccctggttggcgccgctgacgccgcgcgtcggtagcagacaggcccaggagagcagcgcctcgacttgtctgcagggctgccgcacccatcctctggcccgaagacatcggcgggcagttcatcgcccagggcatccggggtgcgggtggggcatagagcttgtccagcacccgggcctggcgttgcccggcccattaccagcagatcaacatccgagcgacggctggctgtgccccgtgcccagctgcctcaccagactctccagtgacgccagcagcccgcagcgaaacccaacaggcagattgttggcctcgattccgcggtgtagcgccggccgtgcgtcagccccaggtttgattccagcgcctgggctttccggttgtgctcaggcgctgcgctcccctgcgagaagccctgggcctcacttcgggccgctcccttgtgggctgacaacagatggctgtgatcttgctcgtccattgcctggcggagtggtactccctgcccgccggcagaggcgtgtcgtccgacgcacggctgagccagaaatcccccgttctcctgttcaggggcgacggtgctggcctcccagcaggcgattcagtccgtcacccctggaaggctccggatgccatagtcttaagaccatggtcattctgagtggcatggattcccctcctcctgcgccatccgccacgccgcagcaggtctcgaaatcccacttcaaggcccatgccctggagttgttccgccaggtggaggccagcggtgaaccgctcgtggtgaccgatcacggccgccccaccctggaggtgcgcccctatcgcccggcccggcccgactccgacccactggaacagctgcgcggctcggtcctgcgcttcgacgatccgttcgcgcccgtcggcgagaacgactgggaagccctggcgtgatcctgcttgattcccatgcgctgatctggtgggcggatggggatcgtctgcggctgtcagcgactgccctggccgccatcgatcaggagatcgagagcgccgtccgtccgggcggttccccagggctgctggtgtcggcgatcagctgctgggaagtggcgatgctggtgaaccggggtcggctcgccctcagccttgatgtggagcgctggttggcgctgctggcctcccatccggccgtgcgctttctggctctggatcccgccgtggccgtggcggccacgcgcctgccgcagccgttccacgccgatcccgccgatcgcttcctggtggcccaggcccgcgcgctggggattcccctgctcagcgccgacagcaagatccgctcttatgaccatgtgaacagcctgtggtgagcaggcctacctcctttgagcggggctcgtgcatccagcgggagcccgctcgcgtgggcggcttcaccagaggctgcactggccctgctggcgcagcaggtgatcggccagcaccagggccaccatcgcctccaccatcggcacggcgcggggcagcacgcagggatcgtggcgacccttcgccgccagggtggtggcggcgccggaggcgtcgatggtctgctgctccttgcggatcgtggcggtgggcttgaaggccacccgcagccggatctcctcgccgttgctgatgcccccctggatgccgcccgagttgttggtggcggtgcgcaggcggccgtcctcgctgggcaggaaggcatcgttgtgctcgctgccccgcagcagagtgccgccgaagccggagccgatctcgaagcccttggtggccggcagggacatcagtgccttggccagatccgcctccagcttgtcgaacaccggcatgcccagagccaccggcggccgtcgcaccaggcactcgatcac

SEQ ID NO: 1204 - DNA, 4000 bp, Escherichia coli
  misc_feature (1102)..(1102): n is a, c, g, or t
  misc_feature (1986)..(1986): n is a, c, g, or t
  misc_feature (2328)..(2328): n is a, c, g, or t
  misc_feature (2370)..(2370): n is a, c, g, or t
  misc_feature (3109)..(3109): n is a, c, g, or t
  misc_feature (3113)..(3113): n is a, c, g, or t
  misc_feature (3117)..(3119): n is a, c, g, or t
  misc_feature (3122)..(3122): n is a, c, g, or t
  misc_feature (3125)..(3127): n is a, c, g, or t
  misc_feature (3131)..(3131): n is a, c, g, or t
  misc_feature (3133)..(3133): n is a, c, g, or t
  misc_feature (3141)..(3143): n is a, c, g, or t
  misc_feature (3149)..(3149): n is a, c, g, or t
  misc_feature (3153)..(3153): n is a, c, g, or t
  misc_feature (3156)..(3156): n is a, c, g, or t
  misc_feature (3161)..(3161): n is a, c, g, or t
  misc_feature (3164)..(3164): n is a, c, g, or t
  misc_feature (3168)..(3169): n is a, c, g, or t
  misc_feature (3173)..(3173): n is a, c, g, or t
  misc_feature (3184)..(3186): n is a, c, g, or t
  misc_feature (3188)..(3188): n is a, c, g, or t
  misc_feature (3191)..(3191): n is a, c, g, or t
  misc_feature (3195)..(3195): n is a, c, g, or t
  misc_feature (3198)..(3201): n is a, c, g, or t
  misc_feature (3205)..(3207): n is a, c, g, or t
  misc_feature (3210)..(3210): n is a, c, g, or t
  misc_feature (3212)..(3212): n is a, c, g, or t
  misc_feature (3215)..(3215): n is a, c, g, or t
  misc_feature (3219)..(3219): n is a, c, g, or t
  misc_feature (3229)..(3229): n is a, c, g, or t
  misc_feature (3240)..(3242): n is a, c, g, or t
  misc_feature (3251)..(3251): n is a, c, g, or t
  misc_feature (3254)..(3254): n is a, c, g, or t
  misc_feature (3258)..(3259): n is a, c, g, or t
  misc_feature (3263)..(3264): n is a, c, g, or t
  misc_feature (3271)..(3271): n is a, c, g, or t
  misc_feature (3277)..(3277): n is a, c, g, or t
  misc_feature (3279)..(3279): n is a, c, g, or t
  misc_feature (3283)..(3284): n is a, c, g, or t
  misc_feature (3293)..(3295): n is a, c, g, or t
  misc_feature (3299)..(3299): n is a, c, g, or t
  misc_feature (3301)..(3301): n is a, c, g, or t
  misc_feature (3305)..(3305): n is a, c, g, or t
  misc_feature (3307)..(3307): n is a, c, g, or t
  misc_feature (3309)..(3309): n is a, c, g, or t
  misc_feature (3311)..(3312): n is a, c, g, or t
  misc_feature (3314)..(3314): n is a, c, g, or t
  misc_feature (3316)..(3317): n is a, c, g, or t
  misc_feature (3320)..(3320): n is a, c, g, or t
  misc_feature (3330)..(3330): n is a, c, g, or t
  misc_feature (3334)..(3334): n is a, c, g, or t
  misc_feature (3336)..(3337): n is a, c, g, or t
  misc_feature (3339)..(3339): n is a, c, g, or t
  misc_feature (3344)..(3346): n is a, c, g, or t
  misc_feature (3348)..(3348): n is a, c, g, or t
  misc_feature (3358)..(3358): n is a, c, g, or t
  misc_feature (3397)..(3397): n is a, c, g, or t
  misc_feature (3406)..(3406): n is a, c, g, or t
  misc_feature (3421)..(3421): n is a, c, g, or t
  misc_feature (3431)..(3431): n is a, c, g, or t
  misc_feature (3629)..(3629): n is a, c, g, or t
  misc_feature (3668)..(3668): n is a, c, g, or t
  misc_feature (3842)..(3842): n is a, c, g, or t
tatggtcctggtagtactgtagcacaagatagaaataaaattcatttctttgatataaaaactggaaatcttgtacacacaatacgagatccggaacattcaactgaccctggcaaaaaatggccactgtttatggatgtatcagaagatggtaattggttagtggtaacatgttataatagaactgtgaacggagttgtaaatgctggtagagcttatatctatgatgtttctactaaacaactagttcacacattagacagaattcccaatgatacttctcttttatatggatattcggccgcaaaaatcacaaattcccatacatttattccacattcgtattatgacaattacacaggtggcatacacatgtatgagaattccactggcaattacataagaacaattacaagtccatgggctaatcatactttcacgggatctcccaatggagttcagtctatcggtggcacccctggcggatttgcggcatacggtggtatttacgctgttagctcacacgcatatgaatggaatggtagtacttatgcatatacttatagaatctttctatattctctcgttacagggaatgtagttcttactattgataaaccaggtaacggttcaactggatggggcgagaaaattacattagattctaattatattgttactactgacagcctcagagtttacatttacagtatccaaagtggaaatcttgcaggtacagttaatcggcctgcgcagcctaccgatcatcaatatgacacaggatatgattggggtaaactttcaaatttagagatacaaggaaatagaattattgtaggatcagaaaattggagtaatatttacggcggcagtgcagagtctggcagaataacaattatcaccggtgatatgtgggaaaatgcagttgctggtcagcctacttttgcgagtgtgtcacctgcatcatatagtggtggcgcaaacagaagtttaacattgactggtactaaatttgaattagatactacaatagagttgattgattctaataacatttcaactacagtaaccgatttcacaacaatggaccctaatactattntatttaatacaccaaaatcatatacaaccactgaaggtccattaagtataaaaataacatcatctacgggcgagtctgttactgaagtaaatgcattagcgacaggttttaatccagtatggacaacagcatcaggtaatttgtcatctggtactgcggatggagcaggaacaaatgcacattatttcttaacagaagatgtatcagaaacaatagttgcgactgatacagaagatccagaagtaatatatactatagaaagtggtagtctaccaccaggttgcacaattaatgctaattctggtgaaatttctggtacaattccagcagcagatattggaagtgatactgtatataactttactgccggtgtaaatgattctggtggtaacttaacaaccagagattttagcataacagttaaaaattctgctgctgttaattatgatttcacatcatttacatttagaggaaaagcaactggtgccacggggccaacacttagcgaaacattggctttttacgatacaacaacttattcttggttaaataatactacatatttcaatgttacttcagacaatatgcaaatttggaaggttcctgcgacaggtaactatagaataaaaacaattggagcagcaggaggatcaccaactgcacaaatgaatattgataatggcggaatcggtggatatggatcatatactgaagcagatatatatcttgaacgaaatgcacatttgttaattgttcctggacatatggggtcagcagattcacttggtggcgcaggtggtggcggtggcagttttgtagcgtatcgtccatctggagcaggaacatcatttaccgatgctgatcttatttttgcaggcggcggnggcggcggcggtgcaaagatgtctacttcaacaggcatagctattggtggcaacggcggtcttgagtttaaaggtgaaaactcaccagatggatatcgtacaggtgcaggcaatagtgcaacacaaggaagcttaactagttacgtaggcgataatgcctatggagatggcggcaattggggcggtggaaacggtgcaggttggcttggcgctggaagagcaagtggcggcggtgctggctctgctggtagatatggttccggcggtggtgcaggtttcaacgattcatatgttcctctaggcggtggccaatatcgtattgaaggtggttttggcggcggnggctctccaggcggtgctaataatggagaaggtggtggcggnggtggcggtggctacagtggcggcgcaggtgattatgctgactatggaggaaatgcaaattggtccgattatagatatataaatggcggaggcggaggtggtctatattatcatagtgatcctactcttccatctatatctaatttggctacaggtattaatacagtcctagagcatggtactataataattacactgattccataataacacaaatataatctaaagaaaaactcggcattaatgtcgggttttttgttgtttatctacataactacgaatataaatgataaatactgttgtaattgggagaagccgcaatgaataaagatagcatatggtggaatgcacctgaatatttcagtagatggagattatttccacgtgcatttatttcaatgtatatatatcttctttgggatgttgttacgtggtttatggaattgcctgatccaaatatgaatcaagcaggacttgttagtgttatcgttggtgcaggagcagcatggtttggactatatgtaaattctaattctactaagttcgaacaaactacaccgacaatgccaactactacaatatattcagatgaatcaagaagagaacctagtagagaacctgaacctaaaaaagaaataaagagtagatactaatgagtaagaaaaatttcaaacatcatattcgaattcaattgaatgaagaattagacaagcatgacataactggtatcttaatggtncttnaaannnctnttnnnaacntntttgatgnnnataaanaagnagnaaatnatnatanngaanataacaaacannnanatnattntannnnagannnttnantancagnagcagaaggngaagcaatacnnnacgttatanaanagtnnacannaaatganttcttntnaganntaacaacannngaanantacntncnanntnannatnaatatgaaantganannantagtnnncntcataatagntggatgaatgaaaaagtaacagaaggatggagatacggnttagaattnagtgaagatcaaaanactgatcctngattaagaccgtatcatgaattgactgataaattaaaaaatttatagtataacttgacaatattaaatttatagtgtataattgatattgtagaaacataggtagaaaatgtccggtataaggaaaacatatgacttagcagaaaagaactatttcaagttcttcggagtcaataaacaacaaaatttgagtgtgcgnagtcttacaacacactacaaaaaaatactcacaatactnaatgaagaagaagatagtttttataaacgtgaaaagattgagtttgcaacaagagcatttgaaacactcgcagatcctatatcacgtgcaaaatatatcatatcattaaatggctttgataacgatgtgcgtgatagtgcagaacctagtgattttgtttttgtaaatcaattnaatttccaatatgataatgccaatacaaaggaagatataaatgaatttatattggaacttaaaaatcaaactacatggatcaaagaacagatagaagacagtattgatgtatatgaaaactttaaggttgcagcagggttgttgaatcgcttttatga

SEQ ID NO: 1205 - DNA, 4000 bp, Escherichia coli
  misc_feature (1188)..(1188): n is a, c, g, or t
  misc_feature (1513)..(1513): n is a, c, g, or t
  misc_feature (1597)..(1597): n is a, c, g, or t
  misc_feature (1990)..(1990): n is a, c, g, or t
  misc_feature (1994)..(1994): n is a, c, g, or t
  misc_feature (3974)..(3974): n is a, c, g, or t
  misc_feature (3982)..(3982): n is a, c, g, or t
ttttcgaagcccgaaagtacgccagagcccgtcgtcctgaaagcctactcgcatgtaatttgtgattagtttgcgattatccagcttcagttcgttgccaggtttaccattgatcaaatcaacagaaaaatgatctttccattgttcgccccattcggtgcgataataacgcttcaggacaaataccagctccttcacatactggggtatgctttccagccattcattgtatgagtcggtgtaatctttactggatggggtgagcagtttgatgacagatcccaacgagcgttcgtggctgagaatgccacgctgatcgacccgagatgtgtcgcggaatcgatttgaaaaatctcgattcagaatcgcttcgacttgttcgaggtcttccttgatattagcgacgatgaccggtccctggatgatggcgtctgttaccggtttggagatttccgatttgcctccccctgaaacagtgcagggtttatggcaaatcagtccctcagccaccgtgccaatcagacgccaggatcggttcccgggcggcttttccagatgtactttgtagccggagggtctgacataggttttcccttgaagtaacttgatggactcggtgcgacctttccagggccagctgactcgttggctatggaggtcgaaatgcacatcctccgagacatagatgatatccgagaatcgcttgtcgatggcatagccttcaggctgcaagtccatgatatcttcgaactggtctagcatctcctcaaagctgtgccccagtcgcttgacgtgcagatgcccgctgaactcctcgcccaggtcatagctcgggtagaccaaagctcctccagcatgctcctcttcggccaaaccaaacagattggccgagaaactgatctgcgtcttgacctccttcttgcaatagccgaaataattatcagcaatgatggtgaccatcaccccctggtcatcccgtgcgcagagcttgaatgccgtgcctccattgtaaagttccttggggtcttcccaacacatgccttgctcccgctgcctaggcgttgcctcatcatgatggggtaaaccggcttccttcttggtgatttttgtcaggtggggtgcgaggatgacgcagccggtgtgacccgtccagtgatcggtatccaacccggcatcattctctggtanatttggatcccccccattaccgaagatgctctcgacgaagtccaagttgctgaccaaatttcccggggcaaaaaaacggatctcgctgcgcttctccttcatgactccggggacttctgggatgaccaaaggtcggagcagcagggatacaaagcactgtgccttttcttcttgttcactggtgaagggtaattgcatcagttcggccggcggattgagcgcatggcgcagcatccggttgaaagtgcgcctgggcgccgcaatcttgtctgctgggactggaagacccgcatcggcgatatgaaagacgccttgggttgtgcgncgatcattgactggattgtgtaggacgccttgatggatgcggtaggaatggatgatgtcggatttgaattcatctcccttggcngggagagataaattgcgcgcgactccgtggcgatcgaggacaaaagttcttgatgggagtcgagggatgtctccagtgtcctggagaaaggtgtccagccattgttggatacgccagtcagcagggcagaggtaattggccagtaatcgcttctgttctcgatgattggcaatgagtgactcagcgacatcccgaaatggagaatctgattctatgtcggcagtcgggcaacctaaggcggccaattttaagttgatatattctaccaagtgctgacttgggtagacatcaccggttgcgggcaaaccgatgagcttttgtaatttgctggtattcattcgagttttgagaaatgcagtgaacagaaggcactgagaagctccaactaggcgncatnttattccaagaaggcaggctaggcaagcatgtgactgagcgccggctgctttcagcctctcgatgggtggattttacttgggttgcggcttgcttgatgctgtaggatacccctacgtgaaaatggttggttcatggcgcccggagttgctgatcaaataccttgccttcctgctgatgtgctttggcatgagtggcgtgagcctatactggttccagcgggctgaagcagctggtgtgggcattgattccagcaccagcctcttgcttagcaatttgatatttcttcaattgggtatgcttggggcgacctggctgcttgtgcgagaccatggactgacctgggatcaggtctttggctttcagttcgttgctcctggcaaaatcctgtttcaagcttttaaggtagcctcatttggcttcgtggtctcatgcctattgggaatggtggtgcatcaaatttttgaattgctgggaagagaaagttccgagcaggctattgtggagctcttcgttcaaaatcagggtctagggcaacgagccctgatttgctttacggctttgctgatggctcccctggtggaagaattactctttcgcggcgtgctttacaccgttttgctgcagtatctgacaaggccgctcgccttgattttgagctcgctactctttggtctggttcatttccacgaaatcggtttgcttcccttaagcgcgctcgccttgttgctggccctctcctacgagaaaagtcgcaacctctgggttcctatttttgcgcacactttttttaatttgatcaatcttgggctcctgctatgggtgccctccttggattgagagaacaaggtatgaatcgagaggtagaactgattaagtcccttacccaaggcttgcctcgacgccaggacacgatcctgggtgtcggtgatgattgtgccatcgtcaaggctggccccgagcaggaatggttgcttaagaccgatgccatggctgagggggttcattttttaagggatgatcctgcggtcatggttgggcgcaaggcaatcagccgacttttaagcgatgtggctgccatgggaggtgagcctggcagcgtgttggtaaccattggtgtgccgaaggatttggatccggcgtggctagatggtttttatgaaggtctaagggatgtcgccaagcatcatgaattggccatcgtcggaggtgaaaccattcagacacctgggccatttttttgctcccttgccatgacgggtcatgtgcaaccaggcaaggctatcctccgaagcggagcccgtgtgagggatgctatttttgttaccggggatttaggtggttccatcgccggtaagcacctgaactttgaaccgcgcatcagagagtccagatggctagtcaagcagttcgagattcatgccatgattgacctttctgatggccttgctggagacctaaggcatctctgcgaagcgagtgaagtgggggccgagttatggacttccttcattcccatcagcaggtcggcaaaacaacgagcccaatccggtgagtcccctcttcctgctctggctgctgccttaagtgatggagaagattttgagttgctcttcacggtggatccctcggaggctgttcgccttaaagatgcctggaaagaggccttccccgagaccccactgagttgcattggtaggatcatggagcagcccaggctcatgctcagggatgaccagggtcttcgtccccttaccctcgatggatacgaccatttcaacgcatcctgatcagaccttcgagctgggcaagcagtgggcccttgagctggatcatgcttggaccctaggtttttcgggcgatttaggcgtcggtaagactcgtctgatccagggtatttgtcatggatggggtgtcaccggtcgagttgtgtcgccaacttattcgctgattcatgaataccaggctaacggaaaggtgnttcaccanctggatctttaccgactc

SEQ ID NO: 1206 - DNA, 4000 bp, Escherichia coli
  misc_feature (1025)..(1025): n is a, c, g, or t
  misc_feature (1418)..(1418): n is a, c, g, or t
  misc_feature (2341)..(2342): n is a, c, g, or t
  misc_feature (2355)..(2355): n is a, c, g, or t
  misc_feature (2367)..(2367): n is a, c, g, or t
  misc_feature (2655)..(2655): n is a, c, g, or t
  misc_feature (2697)..(2697): n is a, c, g, or t
  misc_feature (2889)..(2889): n is a, c, g, or t
attcgacgccgaatttctcaagcacataggccaccaagcccaccgacggcgaaaacaaaaacaaccacagaaccccagccaccactggcgcgaccgcataaggcaagattagcaggctgcggtacaaccagatgccccgcaccacgcggtcggcgaaaaaggccaaaaccaatgacagcgaaatccccaagcctgccaccaacaccgaaaacaaagcggtggttttgaacgattccaaataggtctcatcgcgccacaaagcgacaaagttgtccaggccgctccactgaaccgaagtgccaaaagcatcagactgttggaaagactgcaccaaagcctgaccggctggccaaaagaagaacgccaaaatgatgaagccttggggtgcaatcagcacccaaggcaaccatttggaccgaaaaataacttttttatcgctgctcaaaatcattcaagccagccgacgcgaacaccggctggcttgccttaaaaaagacctaaaaaatcaggacttattggctttttcaaacttctcgagcaattcattgccgcgcttgacgatgctgtccaaggcgtctttggcagactttttgcccgcccagacttgttcgagttcttcgtcttcaatggttcggatttgcacatagttgcccaaacggatgccgcgcgacttttcggtggtcttgcgaatcatctggttgaccgacacgtcagttccggggttttgcttgtaaaagcccgaagcttctgtgatcttgaaggcttccattgtcacaggcaagtaaccggtgcgcttgtggttcaccgactgaacgactgggtcagacaggtaattgaagaaagctgcaacgcctttgttctcttcggctttcttgcctgccatggcccagaggctggcgccaccgatcacggtattctgaggcgcaccggccacatcggggtaataaggcaaggtgcccacggcaaacttgaacttggcgtttttgctgataccggcataagcagccgatgagttggtgtacatngcgcactcgccagactcaaacgtggcaccggcagcaccggcgcgacctttgtaaacaaacaggccttgttgggccatgttgcccaagttttctatatggcgcacatgcaaaggcgagttaagaaccaagcgggcgtccatgcctttcatgccgttgcctttggtggccaattcggtgttgtgccaagtggagaagctctccaactgggtccaaccttgccaagcagtcgtgaaggggcacttgtggccgctggctttgagtttggccgcggccaaagcgacctcaggccatgtttgaggcagcttgtcggtcgaaacgccagctgccttaagggcatccacgttgaaccacatcacggtggttgagctgttgaacgggaaagacatcatttgnccgttgggcgctgtgtagtaaccggacacggcgggcacataggatttggggtcaaatttataacctgcatcgcgcatgattttttctgctgggaccaccacgcctttggaagccatcatcgtggcagtgcccacttcaaacacctgcaaaatatgtggggcattgccagcgcggaaggcggccacggcggccgtcatggattcgtcgtagttgcccttgaagacgggcacaattttgtaatccttttgcttgccgttgaaatctttggcaatgtcaccaacccattcgccaagtgcgccagacatcgagtgccaccactgaatttcagtttgggcttgcgcgccgaagcttgcaaatgcggccacagcgacagtggcaagtgtttttttgtagttcataagtactcctttgagtgttgtatcaaacatcagcataaattcatggtttgtacatcgtattacaacctcatgaagctttggtgacaacccgagctttccatgatgaaactcaaagtctggggtcactgtccccacctgtggtgcgtgaattagcccctgaagtaaaatatcgctcaaatctcatgaacgctccaaccacgctccaacacctcctgcaggctgacgattcgtcaccccgcttgcgcgaaattccttacaactacaccagcttctccgatcgagaaattgtgattcgtttgttgggaaatcgtgcctgggacctgctcaatcaactgcgagacgaacgccgcacgggcaggtctgcccgcatgctttacgaagttttgggtgatatttgggtggttcagcgcaatccctatttgcaagacgacttgctggacaacccaggccgccgaaagcagttggtagaagctttgcaacaccgcttgggtgaagttcaaaaacgccgcacacccgaagcagatnntttgcgagacggnttggtgggtganttgttggtgttggcgggccatgcggtcaaattgtttgatcaaacttttacggccatggcccagttgcgccgtaagacgcaaaaaggactcggcaagcacacagccaaagacaacatcaaatttgatgccttgtcacgcgtgagccatgtcacagatgccactgactggcgtgttgaatatcctttcgtggttctaacccctgacacagaagccgagatggccaatttggtcaaagcttgtttcaccttgggcttgaccatcattccgcggggcggcggcacaggctanaccggcggtgcagtgccgctgacttggaacagtgctgttatnaacaccgaaaaactcgaggccatgtctggcgtcgagatgcttcagttacccgggctcgacaaacaagtgcccaccttgtggaccgaagtgggcgtggtcacgcagcgcgtggccgatgccgcagagcgcgccggttgggtgtttgccgttgatcctacgtctgctgaggccagctgcattggcggcaacatngccatgaatgcgggtggcaaaaaggccgtgttgtggggcactgcactcgacaatttggccagctggcgcatggtcacgcccgatgcgcagtggctcgaggtgacccgcttgaaccacaatcttggcaagattcacgatgttgaaatggccagctttgaattgaaatatttcgaagccaatggcaccacgctggttcgcgaagaaagactcgacattcctggctcgaccttccgcaaagaaggcttgggcaaagatgtgaccgacaagtttttggcaggtttgccaggtattcaaaaagaaggttgcgacggcttgatcaccagcgcgcgctggattttgcaccgcatgcccgatcacacgcgcacggtttgcatggagttctttggcaacgccaaagacgctgtgcccagcattgtcgaaatcaaagacttcatgtttgccgaacaaaaacgctcaggcgtgttgctggcgggcctagagcacttggacgatcgttatttgcgggcggtgggctacaccaccaagtccaaacgcggcggtctccccaaaatggtattggtgggcgacattgcgggcgataacgccgatgacgtggccaaagtcacttctgaagtggtgcgcattgccaactcacgcagtggagagggcttcattgccgtgagtcctgaagcgcgtaaaaagttttggttagatcggaaaaaaacagcggccattagcaaacataccaacgccttcaagatcaatgaagacgttgtgattcccttgccgcgcatggccgaatataccgacggcattgaacgcatcaacattgaattgtccttgcgcaacaaaatcaagttgtgcaacgagttggaactgtttttaagcaagggcaatttgcctttgggcaaagacgaagatacgagcgaaattgcttctgcagaattgctagaagagcgcgtttcacaagctttggcggtggtgcacgaggtgcgtgacctgtggcaaggctggttgcacggcgtagaaactttattccctcaattgcaagaccacaccttgcgtgccagttggaaaacgcaaatcaagacaagcttgcagaccatcttcacgggcgctgccttccagccta

SEQ ID NO: 1207 - DNA, 4000 bp, Escherichia coli
  misc_feature (272)..(272): n is a, c, g, or t
  misc_feature (365)..(365): n is a, c, g, or t
  misc_feature (401)..(401): n is a, c, g, or t
  misc_feature (1202)..(1202): n is a, c, g, or t
  misc_feature (1454)..(1454): n is a, c, g, or t
  misc_feature (1480)..(1480): n is a, c, g, or t
  misc_feature (1987)..(1987): n is a, c, g, or t
  misc_feature (3681)..(3681): n is a, c, g, or t
  misc_feature (3957)..(3957): n is a, c, g, or t
catcatcattttctaatgagtccagaatccatctcttcaaggcttcatattttgagtcaaagccacctagttcttcagcggcaataactagttcatctagatcaccaaatctaccgagaattctatgctctgcctcatcaattgtaatatcagttgcttcgtcttcgccctctgtgtcaaaattaaatgcatttcgagcagcatctcttagttgtgtacggacatgatttgcaaacgcaggcagacaactactagccattctttcaggaacnaccaatgcccaatcaaaacggtcagaatcaggatgccgcagttgcattaaatgccatgtccaccttcttgctgcttcatacaatctccattcngcctcagttaattgtacatctaatgtgattgcatcncggcgtgctaaatctagttcaagatcacgttttcttgtccgcacaatcaattcatttagtggccgtaattgccgtagtaaatctgccaacaatcttctctgcttatccaatgattctcctgtccaaccaagtgggtcttgacatagctctattgcggcccgcaatcttgggtctgcagtaaaaccaggcgtcaattccaacatatccaatgctttaaccgccgctgctaaatcaggtatggtctgtgacactgcatccaatgatgtattgagtaaacgcattggtctcatggtattctgaaaagacatgaaatcgggccacctatcaggtgctagaagggagagttgcacccataattcctcatttgaaagattgactggagttgctgtgaggaacagagtgcgtttgctatgaagtgttagaagttgaaccgcatcatgtaggcgactgcgcgggtttcggcagtggtgtgcctcatcaacaatagttaggagcatttcaggaactccctcctccatcaactcacgcaacaatgttggttgccttagaattccatggctagtgactacaactattgattcaccttgcctaatcctttcaaacgcctcacgcagttttgcaccagtattagcttcaaaaccttcaaggtcacatctatgaaacatctcttgaatccatttcagtcgtaagccgcccggacaggctattatcacacccccaacttctccaatagaatgtaaacgacgtagaacatgaagtgctgagacagttttgcccaatccaacttcatctgcaatcaanaggccattccaatgactagatgcaagccgagacgctggtaaatgttggtgaggttggtcttgccagcgcccgaaatgtagcaaggggcagtaatctgtaggtggataacgtatgtctagatcataacgcaacagattccattcatcttggtcaagaaccaccccgctaacgcccgcttcattactctccaagtcgctcaacagggaactaccgcaaattgaccgtacttgaatatacgcgaatccagaggcnatatttgcaaaaaatcaaactattcnggtggaagcgttacactaatttccttgacagtattgagtactacatgtgtagttgagcgagccacaccatcagtggagagaactgtcttagtaaaatcatccaagtcatctctatctctaactcgtgcaaataccaaactatccatttcaccagtcacatcatagactgcaaaaacgcggggatccgatgctatgagttcttgaacttctagcaattctcctttcattatttgaagacccacaaccaccgtcatctcccagccaattttatctgcgtcaagattggcggtatatcctgtaatgactccgctgtcctctaatttaccaagtcgattagaaaccgtaccaagggcgacgccaacttgttctgcaagtgacctcattgatagccgtccatctacttgcaatgctgaaattaattttctgtctacctcatctagctccattttaccactcccggagtcggctcggattacaggcggcatttgaacgttatcgtggaaaatngcgatattattgttcagatgaacagttattcacatgttatcattatatgagttacattcgttcatttttcaactaactggtaaaattaagtcaagaacccaaccacccagttcttcaacctctactttccaatgtgtaggagcctctgttgttgcatcctcagagcaccttaacttgacagtgaaatttctactagttcctgctacaactaactgctgtttggggacctttcctaatttccaaggctcatcagcatacgcccccattaatgtcacatctcgtttgccagcagtaattacaacctctgcataccaacccttcttatcttgaagtaaagttcccctcaatcttggtagccctacctctctttgttgatcttgacgaatgatgattattaatccaacaattactgcaatagcaattagaatagtaggtaacattccagcggtatctggaatgctgctaggtgtttgcaactgtacagaatcaaccccatatatcgagttattaaggtcgtcaacgaagagaattactacttctaatctccacaaatcttctgctgagaatggtatgccatcctcttgcagacgttccgtacttatttcctgactccaattagtgacatttccttcatcatgatagaaagatgaagtccacccgtaatgtttcactaggtcgtgaacaaccccttcccctagaggggagtggtcaactgtgatgaaccatctgagattgagtgattcctcaaggtcttccaatggtacaatctgagcagatagatacaatcctggaataatatcttcaccaccttcttgtacatctgtggattcagatggaaaatgtgcgtctacttccaaagtaacttcaactaattgaaacaactcacttgcattattggaagcaacctcgccattaacccatgatgaacacctttcagctccaagtgctgttgctctttgttgccctgcaagtgtacttccatcaccataagcccagtttagccgtacatcgtttttcgaagcgtcatcaagattacattctgtttcgtcaataaatgattccaatactgcggtggtaatattttgagagttacccccttcaacaattccaagagagattggtgccatcataaataatagtaaagccatcacaaaagaaagaaccttcacgatatcacctccaaccctaaggagtgagagagcagaaggcgttcggcatcgggtatcatcaatgtcaacttaccacccagccatgcaggtagccaccatgtaacctcttctttagtgaagcgtagtactaccccacccaatctttcattttcaagagtgggaattgattgaatcacctcttcaacactttggccccctttagtaagaattgtagtcaacagttcttggcctatttcatgaacatgcacctgacattttggggctgtgaggtgtattccttttgaggtgggcctctgcaatatgcccttgcgcaattcccaagttggaagtcctgcttgtatgatttgaaatggatgccaatgccctccgggtaattttttccctcgcctcaacattctttcaccaagccagaaccaatcatgaatttcatatgatatggtgtagattttactaccacggacgaacattttttcaggttccacgccccaatcatttgaaatggtctgaagtagttctgaagatgcnggaatctgttggtttctattgggttgaggtggttctcgcaggggcttttcagccatttccgaatcattcagtaatgcttcagcaacctcactatcacctatgtgcttgaaagccgcaacaaagaatcctccagaatcattttcatcattccaaatccgtttgcattttgtcaattctgccaacatgtcactatcaaaagattgagcagcatttctttccatcccattccattctgtcattcccggcctcgtaaccagccccgggcaataatcagtnataccagtttcatcaagaataagaaaatcacaggtgtggagta

SEQ ID NO: 1208 - DNA, 4000 bp, Escherichia coli
  misc_feature (1213)..(1213): n is a, c, g, or t
  misc_feature (1972)..(1972): n is a, c, g, or t
  misc_feature (1978)..(1979): n is a, c, g, or t
  misc_feature (1982)..(1982): n is a, c, g, or t
  misc_feature (1984)..(1984): n is a, c, g, or t
  misc_feature (1986)..(1987): n is a, c, g, or t
  misc_feature (2652)..(4000): n is a, c, g, or t
gcagaggttgtgaggaattcgtactataatgtaaagttggcagactcaaagaaaccttaggagctctaccatgaccaattgacgccggtggagacatatggctgcaaagactcccaagatgacgagaaatctccagcgactcagcgaaacgaggtgaaccgaaatcgcgaattcatcacaaacgagtaggcagcatactgcgacgactagaactgctcgttgagtctgaggtgctcaagatgtctcaggaaccagaccgaataacgccaatatgccaaccaaaatattcagccacgatccaagtctcaaaattctcgcccaccacagcaaagcacatcatacatacatacatcctctcaaacacaaatctagaccaaagctggttctcaacagtccagatcccaccaaagcaactgcggtaccgatgcgaacgtggatcgagctcatcatagcgcctctgcctcacgacagagaagccaacagcaatcactgggtcaaataaaaggaataaatgtaaggcactcacatcaagatattgaaaatagagaggcactcttcttgaggaattcttagaacttcgatggctaccagcatcctaatcaatcagaatatccccagttggatgttcggaactctcataattatcaaagcctagtagaaatatcctaccaagacctgtaattgttcaaccgcttgaagaagatgatcgatgccacagcccagatggagtgcattggatgccagaagctcatccctaccattcagttttatgagcacctccttgagtcaaatgatgctgatactgaagaagagtaacttgcgatgtagagccacatgcagctccatggagaggaattccagaagatgactcagaatcaccagcagttcaatcagttttatgatgagtccatctccgatgccaattgccttgcaatgtccaacagcaatcttcacaatgagtctcatggcgcctatttgaaccctcatcaagactctcagcaacgagtgggtgctttctaggccaattctcgtccaagtcgttccaagtcagcaggcaggccaaccgccaaccagcaatagcatcttctcacacagccacagctcgctatgacagggtagccattcttggccgaagactaataataataagacaccttcaagccaaagttcctggaacaatcgcagaaatatcaaaatgccctgataatcatcnaaaagcagtaggtgcaaatagccgagcagagagcatagctccaagagttccaagaagtcatccaaaagcaagatcaagcactgctggtatatagccaccagctccagcaaaatggagctgacggctcttggcaacttcttcagtcagccaactcaagccagctgccaaatggtgagatcgaggagcttcagcagctgaaggatgacaagcaaagaatgcagctcagcatggatcgactgaagctataactggaacaaaagaagacatagctcgccctcctagaagagaagaaggcagagaacgagctcgagctaaagaaagagaagaagttcttgctcgagtccttcctcaaggccagagacgagaacaagtagctcattgaactgcagcagcaacagttcatggaggcatagtgcagcaacgaccaatttactcagaatcagcaaaattacaacgacgatcaaataataaatgaaaatgattttgatcttcaaaactacgaaaacaatggcgaagagcatcctctctatgatcataacgatgagagtcaataattgataaaccttcaataatttgagctacagagtcagcatacatcatcacatcatagcagcacgtagaatcagaccaatatgaatttgaacaagacagactacatcttggcttcaggcttctccacccatatgaattctcaggtcgccaacatgaaagctctgaatgccaatcaataccaaacatgtgctgagtagaactaccagnaaaatnngangnannaggctcagcagaaccagcagcagaccgttggggctgccaagctggcaagtcagaagaagtatcgcctcaagatcattgattcatcacataccaatacgagagggaccaatagtcagtattagtcagccagcaatatttctagagcttccatataattgcccggaagtcagtagcaatacgcgcggctcaaagagggcgcagagcaccactcaggtggcggtgatctggacgatgacgtgaatgatctcagctccaagaggaggcaggatgaggagacgctctctcagattgaggagctcgagaagaagctagaccagcagatgagcggcatgtacgagccccacaggcacaccgcccatgataattacgatgaggtctctgaaccaaccaactatcccgtctctggcgatggccacatctccagcaagcgaagctccctccgccagccacaacccaagagtacctcgcacttccatcaacaacaagtgacctcaagcaaaaagggttacatcgtaaacccacaaccgatgttctacaacagcaggcaatcacagtggcaagaggtcggccacaacggccactacgttctaaattaatgactcaaagtaatgtctgatactacctatcatgttaattaattataatcgacatttaaaaactaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1209 - DNA, 4000 bp, Escherichia coli
  misc_feature (407)..(407): n is a, c, g, or t
  misc_feature (1775)..(1775): n is a, c, g, or t
  misc_feature (2351)..(2351): n is a, c, g, or t
  misc_feature (3146)..(3146): n is a, c, g, or t
  misc_feature (3185)..(3185): n is a, c, g, or t
  misc_feature (3730)..(3730): n is a, c, g, or t
gcttatattaatgaacatagttgcagaaggctttggcgcaatagccgttgttttaaattttattgggtatcgccaaactaacgtagacaagtatttgcttatttctgcgtttgccttaagtgcacttagcgtgcatttttttatgctagatgccatggccgcaggcattggaacactgcttgccagcgttcgtaactttattgccattaaacatagaagcaatgccattttatttttctttgttgcggtgaatctaggcttcctcgcttatgagtggtttgtgctagagcacagctggataatcttcattgcctatgcgtcttcacttatttttacagtgggatctttggttatccgcaatacgcacactattagaaaggtttttcttgttgctgaaactttggggntgttatatgccatttccgtgggcagtatttttggaacggtattcaatgtaagtaacttgatcagtattttaagtaagctgcgcaagccctaacgctttagcaataaaactcaccttatcaattagtctaatttgcccactttaatcccgtttagtcgggctgcttttctgcgacttacgctacctgctatatggcttttcatatagtctgcacacccttgtaggccttgccctacatgacttataccaaagttcaatgagctaaagttcaatatcaatttgcgtatgtaagcgtatcattattaatcagtaagtatggtttcagcaatttttcctctgaatgtacggaagtagactcagtgtgtagtaatgaggggagtgtgcgcagtgaaattagtagataactcacaacaatttgaccaatcacctacgcttgaacaatcgtttcagagcgctattaatgaaggcgctgcggtaaacgtgtttgagcttgctcaacagtttaaaaataccaaccctgcttttaaaaaacctcaactggttgaagaacgcacgagtttagagacagagcagctgtggaagaagcgtctttcgatgctgcttgatgcagaaaataaacttatgaaagttatacgttttcgcaaaattactggtatatttaccgttgcaagtatggctatgtttttattttccctgtacatagcgccaacaatgtcgccagtattgttctatggccttattgttgtagctgcatttggaatggcaacgtatccggcgtggttgttagcgtctaaaagcaataaaaagcagagagatgacatttctcgtttgttttataaaagtaatcacgagattgaaatgtcggacggtaaaattacgttaattaacagggcgaactatgcaagtgtaacgcaaatacacgtattggatcgcaaacttggactattcgcaaactcgtagacaacactacacctctcagttcattattgttctgttagtagcatcctttattcttggggtgctactgctggcacccatggatgcattgggccagcttctctcttcaatcgttatcctcattgcaatatccttgtgcagcaaagaagcgcggcacacgcaaaaataccagcatttattccgcattttagctctggtgctagccattgcgcttagcgtcaggtatttgctgtggcgtggtatttacacgctaacctactcagattttctttcaatgattgccgtctggctattatttggcgctgaaatttatgcggggatcacttcagtgttaggggcgatcgttaacgcgtttccgctcagtcgaccgcttttgtccctggaaggggtagataaatcaactctgcccagngtagacgtcatgatcccgagttataacgaagatgaagggatattagaagttactatccgcgctgcaaaaatgctcgattaccctaaagaaaagcttcgtattcatttgcttgacgatggcggaaccgaccagaaaattaacgctgaaaaccctgtgtcagcggccactgcaaaacagcggcgacaagatttgcaagcactgtgcaaacgcttggatattacctatcacactcgagcaaaaaatgagtttgccaaggcgggtaatgtgaacagtgcaatacaaaataccacgggtgatttgattgttatcttggatgctgatcatgttcctacttcggattttcttgatagaaccgtgccgtggatgcttaaaaacgagaaggtctttctcgttcaaacccctcattttatggctaacccagatcctgttgagcgtaactacttctctgcgtttactcgcatgccttcagaaaacgacatgttttacggcactatacagaaaggcttagactactgggggagttccttcttctgtggatcagccgcattgatgagaagaaagcacctcgatttggtngggggcatttccggcgactctatcactgaagatgcagaaaccgcgttagatcttcacaaaatgggctacgagtctgtatatgtggacagacctatggtaagcggccttgcgccagaaacttttgatgcgtttattcagcagcgtatgcgctgggcacaaggcatgacgcaaattttactactcaaaaagccttttaaagcgcaaggactaaaatggtatcagcgagtgggctacatgagttcaatcatgttttggctgttcccgtttgctcgcatcatctttttgcttatgccactggcgtatttggtctttgggcttcaggtttaccatgcatcgatgctggaaatttttgccttcaccctgcctcacgttattgccacatacatgatatccaccatgctctttgggcgaacccgatggcccttagtgtcagagttatatgaaatactacagtgcgcatttacgctaaacgcattaatcaaggttttcttaaagccgcgggcaccttcatttgttgtaacaccaaaaggagagagtcttgacagaacctttgtatcgccactatcgagcgtgttttactggctaatattggtaatcacattcgcattagggagcggtgtctataagttcataacagagcctcttacacgcgaacttactgtggtggtcatgttgtggaatgtatttaatttgattctattgttgtctgttcttagtgtgttattagagcggaaacaggtgcgtagtcaggcacgcctaccagctacgaacagtgtcgttattaagactacaagngatgaagcttgggttggagatttggtcgatctttcgctnggtggagctcggttacgcttgaaaggtgagggagcgttagtacctgaaaatgccacgctcacatcgtggagtcacgcactgaataagaacgttcatttgccaattagcgttctgcattacgacaataggtcaaaaattcttcgagtacgctttatgcctcaaaccgaagaacaagaaaacgaagtcgtcgcctattcactgtgtgatagtctgcgctggatgtcgtttcaacgaagaagaacaagggctatctcatactggttcggcgcaaaacatgtgttgaaagttgggttaaagcctgttttattgcatatgcttgtattaatggggaagttcgccgggaaattaggtttgcttgctaaaccggcaaaggaaaatcaatgataaaaaaataccttatgttcatcgtatgtttgtgcatgccttttaccctagcggcgcaaactgacacgtatcgattaaccgacttttttggcggtgaaagtaccgtgcgcttgcagggaaaatctgcctccattgatattccaattccccttagttcagtnactgatgtggacagcgcgctacttacattagaagtggtcagctcgcaggcgttaatcaaaaaacgttctcagctgtatgtgagattcaataatgcgaccattggacagattgcgttcgacccagacagaccttctcttgtatctgaaattgcgatccctacttcattgtggcgagccgggtttaactctctgacactagcggtaagtcagcactatgccgagcaatgtgttgacggcagtgcgcctgaattgtggagcgaaattaatgca

SEQ ID NO: 1210 - DNA, 4000 bp, Escherichia coli
  misc_feature (695)..(695): n is a, c, g, or t
  misc_feature (704)..(705): n is a, c, g, or t
  misc_feature (771)..(771): n is a, c, g, or t
  misc_feature (1422)..(1422): n is a, c, g, or t
  misc_feature (1988)..(1988): n is a, c, g, or t
  misc_feature (3103)..(3103): n is a, c, g, or t
tagtgtgattgcaagaattcttggtggtaaaaaagctttatataaagttccattaccaaaaaaaaatcatgaaaaaaaagcaattctagaaacttatacaaaagaatactctgcagagtatcaagctcaagcattgatagatattgctaaaaagctaaataaaaaaattaataatttaaatgaaattaaaaaaatagatatttttaccagtcatcatacacattatgtaatcggtacaggtgcaaatgatccacaaaaaatgaatccgaatgctagcagagaaactttagatcactcaataatgtatatttttgctgtagctcttgaggatgggaatttgcatcatataaaatcatatactaaatcaagagcaaaacaaaaaagtacaataagaatatggcattcaattaaaacacatgaagataaaaaatggactaaaaaataccacgacccaaaaccaaaaaataaatcatttggagcaaagacagtagttactttaaaaaacggaagaaaaattatagaaagtttaaatagagctgactctcatccatacggtgcaagaccttttaaaagagataattacataaataaatttctcattttaacaaaaaatataatttcaaaaaaagaaagtgatcgttttttaataactgttcaaaaacttatgaaattaaaagttggacaacttgataagntaaatattnnaattaaaaaaacaaaattaaaaagaaattataaaaaaggaattttctaatgcattttgtcaaaaanaatccagaagaaaaaaggaaagattttgataaaaaacttaaatcaaaaaaaattttgagatttcctggggcttacaatccactgacagcaaaattaattgaagaaataggttatgatggtgtgtatgtgtccggtggagtaatgtctaatgatttaggttacccagatattggtttaacaactcttaaagatgtaagctacagatcaaatcagatttctagagtaattaatctaccaacaattgttgatattgataccggatttaaatcttgtaaagaaacaattcaaacttttgagaattgtggaatagcagcagttcatattgaagatcaggttgaacaaaaaagatgcggtcacttagataataaagaacttatctcaaaagaagaaatggttaaaaaaattaaagaatgtttaagttctagaaaagatcaaaattttaaaataattgctagatcagatgctaaagacgttgaaggaatagataaaatgattgatagatgtaaatcctatgttgaagcaggagcagaaataatatttcctgaagctcttaaagatgaaaaagaatttgaaattgttagaaaatctctggactgttatttattggctaatatgactgaattcggtaaatcaaaaatattaaattacaangaattagaaaatcttggatataatattgttatttatcctgtcactactcagagattagctatgaaaagtgttgaagatggtttgcgtgtcatttatgaagatggacatcagaataacattattgataaaatgcagaccagaaaaagattgtatgatttggtcgaatatgaaaaatacaatacattggacgagagagtgtacaattttagctccgagggacacgaataatgcataatgaaataaaaaaaggattattggggattgttgttgatgaaacaacaatatctcaagtaatgcctgaaataaattctctgacttatagaggttatacagtacaagaactttgcgacaaatgcagctttgaggaagtagcctatttaattataaacggaaagcttcctaacaaaaaacaattaaaaaaatttattaaagaagaaagatcgaatagaaaactttccaatcaaatattaaaagatattgaaaaaatgcccaaaaaagcacatccgatggacgttgtaagaactgcagtgagtttgatggctctggaggataaagagacaataganaactctcctgaggcgaatatgagaaaggctatgagaatattttcgaaaacacctgctgctgtagctgctttctttagagtaagaaagggtaaaaagataataactcctaagaaaaatttgtctttttcagaaaatttttttcatatgtgttttggcagagtgccaaataaagaaatagtaaaagcatttgatgtttctttgattttatatgctgaacatagttttaatgtttcaacattcaccgcaagaacaatcacaagtagcttatcggacattcatggagcaataacaggtgcaatagccagtttaaaggggccattacacggtggagctaatgaggaagttatgcgtatgatgaataagattaaaaagcctgaaaacgctctgaaatggataaacaatgctcttgataaaaaagaagtaataatgggctttggccacagagtttataaaaaaggagattcaagagtaccaactatggaaaaatattttaataaagttgttaaaataaaaaaggataaaaaatttcaaaagatttacgatgtggttaaaaatgtaatgattgaaagaaaaaatattcacccaaatgttgattatcctactggaccaacttatcatttaatgggatttgatattgatttttttacaccaatttttgttatttcaagaattactgggtggtcagctcacattatggaacaacatgctgctaataaattaataagacctctttctaaatacagtggagagaaacatcgaagagtgatgcttttaaatcaaagataattcaattttaagaaaaagcttctgcccaagttccttctgttgctgccttagaatattctgttgcacgaccttcaaaaaaattcatatgctctactgcatttaacattgtatccaaccatgttaacggatttttttctatttgataaattggtttcaatcccaattgaatcaatcttctatttccaatccatctaatataatcttttatctcctgtgaagttaatccttgtataggtcccattttaaatgcaagatcaatgaaggcatcttcgtgagaaactattgttctacatgcttcatagatttctttttttagttgagaggtccanacttctggtttctcttctataaattctctgaacaaccttatcattgaattacaatgcaaagtttcgtctcttactgaccaagtaacaatctgacccattcctttcattttattgtgtcttggaaaatttaataaaattgcaaaacttgcaaagagttgaagaccttcagtgaaagcgctgaatacagcaattgtttttgctatattgtgatctgatttaacatcaaatccttgcatgtaatcatatttatctttcatttctttataatttaagaatgcagaatattcggattctggcattccaattgtatctaaaagatgagagtaagctgcaatgtgaaccgtttccatagaagcgaaagaagacatcatcattaatacctctgttggtttaaagacattcatataatgtctaatgtaacagttgctgacttcaacatcagcttgagtaaaaaatctaaaaatttgcattagtaaatttttctcttccggcgttaaatttttttgccaatctctaacatcgtctcctaaaggaacttcttcaggtagccagtgaattctttgctgagttaaccaagcatcataacaccaaggatacctaaaaggcttataaacaggattacctactaataagcccattttttttgttttttgtttttccccctttttttttaagttttctactgacatgataaacattcctcgtattctatctcatccgatttttcagtttttgatttatatacatttaattttacatctgttgatgatccattgttaatgttctctgctctttgaatagattttgacctgcaataataaaggcttttaaggccttttttccaagcttgaaaatggatttggtgaagttcttttttatgtacatctgcagggataa

SEQ ID NO: 1211 - DNA, 4000 bp, Escherichia coli
  misc_feature (2)..(5): n is a, c, g, or t
  misc_feature (10)..(13): n is a, c, g, or t
  misc_feature (15)..(20): n is a, c, g, or t
  misc_feature (22)..(22): n is a, c, g, or t
  misc_feature (24)..(27): n is a, c, g, or t
  misc_feature (29)..(29): n is a, c, g, or t
  misc_feature (31)..(31): n is a, c, g, or t
  misc_feature (33)..(35): n is a, c, g, or t
  misc_feature (37)..(37): n is a, c, g, or t
  misc_feature (39)..(39): n is a, c, g, or t
  misc_feature (42)..(45): n is a, c, g, or t
  misc_feature (47)..(47): n is a, c, g, or t
  misc_feature (50)..(54): n is a, c, g, or t
  misc_feature (56)..(63): n is a, c, g, or t
  misc_feature (66)..(66): n is a, c, g, or t
  misc_feature (68)..(69): n is a, c, g, or t
  misc_feature (71)..(77): n is a, c, g, or t
  misc_feature (79)..(81): n is a, c, g, or t
  misc_feature (83)..(86): n is a, c, g, or t
  misc_feature (88)..(88): n is a, c, g, or t
  misc_feature (90)..(94): n is a, c, g, or t
  misc_feature (96)..(101): n is a, c, g, or t
  misc_feature (103)..(103): n is a, c, g, or t
  misc_feature (105)..(106): n is a, c, g, or t
  misc_feature (109)..(115): n is a, c, g, or t
  misc_feature (118)..(118): n is a, c, g, or t
  misc_feature (120)..(123): n is a, c, g, or t
  misc_feature (126)..(129): n is a, c, g, or t
  misc_feature (131)..(131): n is a, c, g, or t
  misc_feature (133)..(133): n is a, c, g, or t
  misc_feature (135)..(135): n is a, c, g, or t
  misc_feature (137)..(137): n is a, c, g, or t
  misc_feature (140)..(141): n is a, c, g, or t
  misc_feature (143)..(148): n is a, c, g, or t
  misc_feature (150)..(150): n is a, c, g, or t
  misc_feature (152)..(153): n is a, c, g, or t
  misc_feature (155)..(156): n is a, c, g, or t
  misc_feature (162)..(163): n is a, c, g, or t
  misc_feature (165)..(170): n is a, c, g, or t
  misc_feature (173)..(173): n is a, c, g, or t
  misc_feature (176)..(177): n is a, c, g, or t
  misc_feature (179)..(180): n is a, c, g, or t
  misc_feature (184)..(184): n is a, c, g, or t
  misc_feature (186)..(186): n is a, c, g, or t
  misc_feature (188)..(189): n is a, c, g, or t
  misc_feature (191)..(195): n is a, c, g, or t
  misc_feature (197)..(197): n is a, c, g, or t
  misc_feature (199)..(199): n is a, c, g, or t
  misc_feature (201)..(201): n is a, c, g, or t
  misc_feature (203)..(203): n is a, c, g, or t
  misc_feature (206)..(209): n is a, c, g, or t
  misc_feature (213)..(213): n is a, c, g, or t
  misc_feature (215)..(217): n is a, c, g, or t
  misc_feature (219)..(229): n is a, c, g, or t
  misc_feature (231)..(234): n is a, c, g, or t
  misc_feature (236)..(236): n is a, c, g, or t
  misc_feature (238)..(238): n is a, c, g, or t
  misc_feature (240)..(242): n is a, c, g, or t
  misc_feature (244)..(246): n is a, c, g, or t
  misc_feature (248)..(249): n is a, c, g, or t
  misc_feature (251)..(252): n is a, c, g, or t
  misc_feature (254)..(255): n is a, c, g, or t
  misc_feature (257)..(257): n is a, c, g, or t
  misc_feature (259)..(260): n is a, c, g, or t
  misc_feature (262)..(262): n is a, c, g, or t
  misc_feature (264)..(273): n is a, c, g, or t
  misc_feature (275)..(279): n is a, c, g, or t
  misc_feature (282)..(288): n is a, c, g, or t
  misc_feature (290)..(290): n is a, c, g, or t
  misc_feature (292)..(292): n is a, c, g, or t
  misc_feature (296)..(297): n is a, c, g, or t
  misc_feature (300)..(300): n is a, c, g, or t
  misc_feature (304)..(304): n is a, c, g, or t
  misc_feature (306)..(308): n is a, c, g, or t
  misc_feature (310)..(310): n is a, c, g, or t
  misc_feature (313)..(313): n is a, c, g, or t
  misc_feature (315)..(315): n is a, c, g, or t
  misc_feature (317)..(327): n is a, c, g, or t
  misc_feature (329)..(333): n is a, c, g, or t
  misc_feature (335)..(338): n is a, c, g, or t
  misc_feature (340)..(342): n is a, c, g, or t
  misc_feature (346)..(347): n is a, c, g, or t
  misc_feature (349)..(349): n is a, c, g, or t
  misc_feature (351)..(351): n is a, c, g, or t
  misc_feature (354)..(355): n is a, c, g, or t
  misc_feature (357)..(357): n is a, c, g, or t
  misc_feature (359)..(359): n is a, c, g, or t
  misc_feature (361)..(362): n is a, c, g, or t
  misc_feature (364)..(365): n is a, c, g, or t
  misc_feature (367)..(367): n is a, c, g, or t
  misc_feature (369)..(369): n is a, c, g, or t
  misc_feature (371)..(378): n is a, c, g, or t
  misc_feature (381)..(382): n is a, c, g, or t
  misc_feature (384)..(385): n is a, c, g, or t
  misc_feature (389)..(389): n is a, c, g, or t
  misc_feature (391)..(392): n is a, c, g, or t
  misc_feature (394)..(394): n is a, c, g, or t
  misc_feature (397)..(403): n is a, c, g, or t
  misc_feature (405)..(408): n is a, c, g, or t
  misc_feature (410)..(414): n is a, c, g, or t
  misc_feature (417)..(418): n is a, c, g, or t
  misc_feature (420)..(424): n is a, c, g, or t
  misc_feature (426)..(426): n is a, c, g, or t
  misc_feature (428)..(428): n is a, c, g, or t
  misc_feature (431)..(437): n is a, c, g, or t
  misc_feature (439)..(440): n is a, c, g, or t
  misc_feature (442)..(446): n is a, c, g, or t
  misc_feature (448)..(451): n is a, c, g, or t
  misc_feature (453)..(457): n is a, c, g, or t
  misc_feature (459)..(460): n is a, c, g, or t
  misc_feature (463)..(464): n is a, c, g, or t
  misc_feature (466)..(471): n is a, c, g, or t
  misc_feature (473)..(480): n is a, c, g, or t
  misc_feature (485)..(486): n is a, c, g, or t
  misc_feature (489)..(492): n is a, c, g, or t
  misc_feature (495)..(496): n is a, c, g, or t
  misc_feature (498)..(502): n is a, c, g, or t
  misc_feature (504)..(505): n is a, c, g, or t
  misc_feature (509)..(512): n is a, c, g, or t
  misc_feature (514)..(515): n is a, c, g, or t
  misc_feature (517)..(518): n is a, c, g, or t
  misc_feature (520)..(524): n is a, c, g, or t
  misc_feature (526)..(526): n is a, c, g, or t
  misc_feature (531)..(534): n is a, c, g, or t
  misc_feature (536)..(536): n is a, c, g, or t
  misc_feature (539)..(541): n is a, c, g, or t
  misc_feature (544)..(552): n is a, c, g, or t
  misc_feature (554)..(557): n is a, c, g, or t
  misc_feature (559)..(560): n is a, c, g, or t
  misc_feature (562)..(565): n is a, c, g, or t
  misc_feature (569)..(569): n is a, c, g, or t
  misc_feature (571)..(571): n is a, c, g, or t
  misc_feature (573)..(573): n is a, c, g, or t
  misc_feature (578)..(578): n is a, c, g, or t
  misc_feature (580)..(581): n is a, c, g, or t
  misc_feature (583)..(585): n is a, c, g, or t
  misc_feature (587)..(590): n is a, c, g, or t
  misc_feature (593)..(593): n is a, c, g, or t
  misc_feature (595)..(600): n is a, c, g, or t
  misc_feature (603)..(609): n is a, c, g, or t
  misc_feature (611)..(617): n is a, c, g, or t
  misc_feature (619)..(627): n is a, c, g, or t
  misc_feature (629)..(629): n is a, c, g, or t
  misc_feature (631)..(631): n is a, c, g, or t
  misc_feature (634)..(636): n is a, c, g, or t
  misc_feature (638)..(640): n is a, c, g, or t
  misc_feature (644)..(647): n is a, c, g, or t
  misc_feature (649)..(649): n is a, c, g, or t
  misc_feature (652)..(662): n is a, c, g, or t
  misc_feature (664)..(674): n is a, c, g, or t
  misc_feature (676)..(683): n is a, c, g, or t
  misc_feature (685)..(686): n is a, c, g, or t
  misc_feature (688)..(689): n is a, c, g, or t
  misc_feature (691)..(691): n is a, c, g, or t
  misc_feature (693)..(694): n is a, c, g, or t
  misc_feature (696)..(697): n is a, c, g, or t
  misc_feature (699)..(699): n is a, c, g, or t
  misc_feature (701)..(704): n is a, c, g, or t
  misc_feature (711)..(711): n is a, c, g, or t
  misc_feature (713)..(713): n is a, c, g, or t
  misc_feature (715)..(716): n is a, c, g, or t
  misc_feature (718)..(721): n is a, c, g, or t
  misc_feature (723)..(729): n is a, c, g, or t
  misc_feature (731)..(735): n is a, c, g, or t
  misc_feature (738)..(740): n is a, c, g, or t
  misc_feature (743)..(758): n is a, c, g, or t
  misc_feature (760)..(762): n is a, c, g, or t
  misc_feature (764)..(764): n is a, c, g, or t
  misc_feature (766)..(770): n is a, c, g, or t
  misc_feature (773)..(776): n is a, c, g, or t
  misc_feature (778)..(778): n is a, c, g, or t
  misc_feature (780)..(790): n is a, c, g, or t
  misc_feature (792)..(797): n is a, c, g, or t
  misc_feature (801)..(801): n is a, c, g, or t
  misc_feature (804)..(807): n is a, c, g, or t
  misc_feature (809)..(809): n is a, c, g, or t
  misc_feature (811)..(818): n is a, c, g, or t
  misc_feature (820)..(821): n is a, c, g, or t
  misc_feature (823)..(823): n is a, c, g, or t
  misc_feature (825)..(832): n is a, c, g, or t
  misc_feature (834)..(841): n is a, c, g, or t
  misc_feature (844)..(846): n is a, c, g, or t
  misc_feature (848)..(850): n is a, c, g, or t
  misc_feature (853)..(857): n is a, c, g, or t
  misc_feature (859)..(863): n is a, c, g, or t
  misc_feature (865)..(875): n is a, c, g, or t
  misc_feature (877)..(879): n is a, c, g, or t
  misc_feature (881)..(881): n is a, c, g, or t
  misc_feature (883)..(885): n is a, c, g, or t
  misc_feature (887)..(892): n is a, c, g, or t
  misc_feature (1942)..(1942): n is a, c, g, or t
  misc_feature (1986)..(1987): n is a, c, g, or t
  misc_feature (3419)..(3419): n is a, c, g, or t
cnnnncgcgnnnngnnnnnncncnnnngngngnnncncncgnnnntntcnnnnngnnnnnnnnggngnngnnnnnnnannngnnnngngnnnnncnnnnnngngnnccnnnnnnnggngnnnnctnnnncncncncncgnngnnnnnntntnngnngcgcgnngnnnnnnccncgnngnngagngngnncnnnnngngngngngcnnnncgcncnnnannnnnnnnnnntnnnngngngnnncnnngnngnncnngngnngngnnnnnnnnnngnnnnngannnnnnngngngcgnngcncccncnnngngcncncnnnnnnnnnnngnnnnngnnnngnnncccnngngngcnncncncnngnncncncnnnnnnnngcnncnncgcncnngngcnnnnnnncnnnntnnnnncgnngnnnnngngngannnnnnngnngnnnnngnnnngnnnnngnngcnntnnnnnntnnnnnnnncgcgnntcnnnntcnngnnnnngnngcgnnnncnncnncnnnnncncgcgnnnncnctnnnccnnnnnnnnntnnnncnncnnnncgcncncncgcgngnngnnnannnncgngnnnnnngcnnnnnnngnnnnnnncnnnnnnnnngngngcnnngnnncgcnnnncncgnnnnnnnnnnngnnnnnnnnnnngnnnnnnnncnncnncncnncnngngnnnncgcgcgngngnngnnnngnnnnnnngnnnnngannncgnnnnnnnnnnnnnnnngnnncncnnnnnggnnnngngnnnnnnnnnnngnnnnnncacnggnnnngngnnnnnnnngnngngnnnnnnnntnnnnnnnngcnnngnnncgnnnnngnnnnngnnnnnnnnnnngnnnanannntnnnnnncacggcagccggctgaacgccacgctgcctcagaagcttgggaaatccacaccgggagggctcttgtagcccgaggagcgaagcttcggccagcgcccgataacccccttcaggcgaacccggtccgtctcccccatctcgtccgtcgcgtccccgtcaatgtcgacctcatcggaatccgcagacaccccctcgcttcggcgcaacgtggcgtgggccctcgttggcaatctcggctacagcgcctgccagtggggagtcctcgtctgcatggccaagctcggaaccgcgaccgacgtggggcgcttcgcgctcggcctcgcgctgacggctcccatcatcaccctgaccaacctcaacctgcggctgctccagtcgaccgacgcgcgcgaagactatccgttcagcgtctacctgtccgtgcgcctgatcggcaccgtgctcggtctggccgccatcgccgcaatggcgttcggcctcggctatcaggggatcacgctctacctgatcctggcagtggcgctcggcaaggccttcgaggcggtgagcgacgtcgtgttcgggctcctgcagaaggcggagaacctgcggcgggtcgcggtctcgatgctcgccaaaggtgtcatcagcctgctggcagtcgggctcgtcctccagatgaccggggacatcatcctcgccaccgtggcgatggccctctgctgggggagcttgctgttgacgtacgacctgcctgccgccgtccggctggagagcattcggccgacgctggagctcggctccctcggccggctcgtatcggccgcctttcctttgggctgcgtcgcggggatcagcagcctcaccgtcaacgtgccgcgctatgccgtcgaggccaacggcggtgagccggcgctcggcgtcttcacggcgctcgcctatctcttcgtcgcggcgcttcagccgatgctggcgctgggcgcagccgtcaacccccggctcgcgcgccacttcgtccacgacctcgcggctttccgacggctcacgtcgcgaacgatggtcgtcgcgggngccctcgggctcttggggatcgcggcatgtgcgctgttcggtanncccatgctcaccctgttctacgcgcccgaatacgccaagcacacgggcgtcctggtctggttggcggtggcgacgggcgtcgcttttctcgcccaggccctcagctacgccgtcaccgccgcgcgacggctgccggaacagctcccgattgcggtgttgagcctcgtcgtctgcttcctggcgagccagtacctggtgccacgttacgggctgctgggcgccgcctgggcggtgctcgccaccgagacgtcgaggttggcctgcctcggtggcgtctacgtcgcggcgatcgccggcgcctcgtccgcggcgtcgcgggcgagcaggcgcgccgcccgctggcgggctcctcgcagtgggcacgcccccgaagagcgaggcccctcgccatcctcgcccgtgcggccgggcgctaccgacccgaaggcaccacccctgatcgccgagatcacgggttgctcggggagcggcaagtcgacgctgctcgccgaaattctacgggagtgcgccgcgcgcggcctgcgggttgccaccgcggaggatgtcctgctgccgaggctcgggcgcctgatcctccgccacccgactctgcagaacgtcgcgctcgatctccggggcgcgagcgaggtgatccgcggccgacgacccctcgagtttctcaccttcgcctggacagtcatacgacgcgacaccgactctttcgccaccggcttgagggcgtaccgcgccgtactgcggaaagtcggcatccactccctcttggcccgcgaggcgaccagccggcacgcggtgttcgtagacgaaggcacgatccattcggcccacaacattctcgtccacgtcgagcatcctgcgcgccgcgaggagatcgaggccttctgtcgcctcgtcccgatgccggacctcgtcatccacgtcacggcgccgctcgagacggtgctcgccagaacctttgcgcgccgcaacccgcctctacgcggacgcagcagggacgagatggaacgattcatccgacacgggcacagcatgttcgaccagttgatgaggcacgaagcgctttcgcgaaacacgctgagggtgcattgcgatgatgacgacttcgggagttaccgcaggtttgccagagagatcgtggagcgcctcgccgaacgaagcgcgggtactgccctcgttgcgtgcgctgtttgattccttgcgtcgcgccggcgtgcgctactgccattggaagagcaactggcggctgcgcgagacgctgcgcggcgagacggacctcgatctgctgattcaccggggcgacatctcgcagttcctctcggtcgtcggggctctcggctacaagcccggcagtcgcgaagatcatccctcggtctgtcactactacggattcgaccaggagagcgggaagctgttcgacctgcacgtgtactatcgngtgatcaccgggggcacgatcaagggctaccacctaccggtggaggacatgttgctgggcggcgcacggcagacggaggacggggtgtacgtgcccatgcgcgctgcggagctggtgttgttcgtgatccgcaagagcctcgactacgccgtaccgagcgaggccctcattccacgggatcggaccgcggccgcagacgagctcgggtggttgcgccagggagtggacgatcaggaggtgcgcggcctgctggaggagtatcttccgagcgtcgaattcgcgctcttccggagcctcacggacgccatcgagtcggggcggtcgggggtcggtcgcttccgtctctgtagagcgctggcatcgcggctgagaccgcaccgacggttcgcgggcgggagtgcgagcctggcgcggggccggcgcgcgtggcgcaaggcctggcgcacgctgcggggcgggacgccgacgcaggcgctcctctcgggcggagcggtcatcggcgtggtgggcgcggacggttccggcaagtccacggtggtccgcgaggtgagccgctggctcggagacttcgtgtccgtggc

SEQ ID NO: 1212 - DNA, 4000 bp, Escherichia coli
  misc_feature (590)..(590): n is a, c, g, or t
  misc_feature (667)..(667): n is a, c, g, or t
  misc_feature (743)..(743): n is a, c, g, or t
  misc_feature (798)..(798): n is a, c, g, or t
  misc_feature (806)..(806): n is a, c, g, or t
  misc_feature (838)..(838): n is a, c, g, or t
  misc_feature (890)..(890): n is a, c, g, or t
  misc_feature (980)..(980): n is a, c, g, or t
  misc_feature (1136)..(1136): n is a, c, g, or t
  misc_feature (1342)..(1342): n is a, c, g, or t
  misc_feature (1355)..(1355): n is a, c, g, or t
  misc_feature (1987)..(1987): n is a, c, g, or t
  misc_feature (1992)..(1992): n is a, c, g, or t
gaatgtagcattcgcataatcagttgcatctacatatgaaataaatattgatagagataaaaataaattagttttaaaatttttcattgttttagtcctttgtttcgataacgtctatagatgtaggtactttatacccaacactttcgttaacgtctgtaatattaattgtgatagatttttcaacagtttcaacaccatcggttatggttaatgttatagagtacgaatcttttgtttcaaaatctggaggtgaaacaaaacttaatatattagttgcagaaagttcaaatgactcagcatctgttcctccaagtgttaatgtaaaatcatcaccatcaacatcagcggctgatggattaatggtatcagtcttgttttctacgtaattaattgttgatgctataccaagtgttggagcatcattgaccgcagcaacagtaacagaaactgatgaagttgcagagattgatccctgagtaactgtgtaatcaaaggaatcttgaccattaaagttagctgaaggtgtataggtaagagtatcacctgagatagcaacagaaccattagatggagatgaggtagtaatnacaaaagatgaaccagtggtcaaagaatcatttagtaatggagaaaatgaaacgcttgaatcctcttgcaatgaaanagaatcagaaaatgctaaaatcgttggttgaatatcttcaacattaacattttgatctgtagctatatagtttaanacatcagatgaatatgagcttataagtgattgatctgcagtaccatttactattnaaagaaantcatcttgaaatttatttgtactaaaccttanaacagatgcggttaaatcatttgttgatttaataccaattactggtatcacngatgaaagtgcctttacagcattttgtttatttgcatcatcaattgttaaggatttggcactaattaagttatcaataactttttctatnaatatatctttttcaatatttactgtagcttcgttatctgtataggcaataacaatttcttcggatatagctttaaagtaatcagcagtagaatccatcgatgaattaagactattagaaatattttgcaatgaatatgcaagaatagttaactgnttacctttttcatatagcaaatcataacctccaccatcaccaatatttgcaactggatctgtagtatatatatcaagatcgctgtctaatccaagcacggtatagatatcctgggagggcatgaaatgggcaacagaagttactggtgtaaccataaaactactttctgagtaaccacttaaatctcttaaaagtaataagttatntaattgtgtttgngtatcaacatcttgtccccccaaggaagccaaaacaccattttcatatttgattgtaaatgaaccatcggtagaagaagtcgtggatgtttcatttgaatcaagagcatagtcactatcagtgtctataaaaattgaagctcctgatatatagccatctacagccacaccttgaatatttctatagccttctatcgttatggttctggaagcattaccaccctctccattacatgtaagggtaaatgtagattcaccagctgttgatatttcaacagtttctgaaccggttgtagatttagaaccggtccatgatcctgaagcagtacaacttgttgcattagtcgatgaccaagaaatatcaacagaagagccaacttccgtagaaaaaatgttactagtaaatgaagatatagcagcagcaagtttagcaactgctgtgcttccaccaccaccaccgccaccgccgcaggaggtaataatcaaaagtgaagataagacaaatgtatatttgagacgtgaattcatattaaaaccctattggaggaatagctattaagtaatataaaaattaaatttatttttatttaatttaacaaaaacttaataaaccaaacccatttaaatatcccntaatntaacatataaaattactaaaatgaatatttaatagacgcattaactaagccaaaatttgaatcaaaatgatgttcagatctttgattaaaacttatatcctcataaccaatcaaattattcttgtataaagaaccagatagagatacagatagatttttatgtttatatttaacacctgttttaagtctaatattatgatttggagaagaattaaattgatgataatcacgtgttttaagatacattaaatcaatatcataaaaatagacaatcttagaacttaagttaatatctttatataaatttagacctaacttatgaatttgaaagctagatctttgcggaagtcttcttatttcatttgagacaagatcaccaattctagatccattataagacaaatttgcaataaagccggtctgcagctcttctattggagatatccaattaaaagaattttcactcatcccaagatatataatgtattcatcaaacgcaaaagttttttgtgctctggtgtaatgaatcatatattctgtattttgagcatcaatcattaacaaattatcatctccaagaacgtcatatttacttttggtgtttgatatcgttagaagtgcttcatcgcaaaagcctatggttaatgaagagaatgtataacattgaattttttgagtttctgctacctgatctttataagagatagaaattgcatgactctcagaaagcacatacattaattcgaaataatctgattgagtattaagcgctaatgactttggttgaactggtctttcaagatttaaaaagaaatcgctttttctgacttttaaaccaacattaccctcaataacaagaaactcaaaagatgaaatatcgctataatcaaatgaattaactacctcaggaataaaattccaatctttatcagtagcagagaattcaatctcgaaataaccatttaaggcaaataaatttgcagtaaaggttaagaatattaaaacaagtttattaattataatttagtaaattttatttttattataactgagcatttaaagctggcaatgcttcaaataagtcagctactaaaccataatctgcaacttggaaaattggtgcatcttcatctttgttgatggctacaatgacttttgaatctttcatcccagctaaatgttgaatggcaccagaaattcctactgctatatataaatcaggagcaacaattttaccagtttgaccaacttgataatcattgggaacaaaaccagcatcaacagctgctcttgaagctccaacagcagcacctaatttatctgcaattgaatccagaagatggaagttatctccagattgcatacctcttccacctgaaacaactatgtttgctgcagttaattcaggtctatcacttttagctatctcctctcctacgaattcgctgatgtttgttccgattacagaatctatggattcaactgatacatctgtattatccatcggcgcagcatcaaatgcagttgaccttacggtaattaatttttttgaatcatttgatttaactgtagcaatgcaactaccagcatatataggtcttttaaatgtgtcctcagattctacagagataatatctgaaatttgttgtacatctaatttagcagatactctaggaagtaagtttttaccaaaggttgtagctggagtaagtatataagaataagcatctgcaatactgataactaaatttgtaagatcttcagctaaaaagttcttataaagctcatcatcacaagaaataatatttgatattcctgagattttttttgcttcatctagaacggttgatatatttgaaccagcaactaaaagtgttacttcaccattaagacaagtagctgctgttacagtatttaaagtagctcccttcaaagaagaattatcatgttctgcaataactaatatactcatgtgatcacctttgcttcgtttttaagtttctcaacc

SEQ ID NO: 1213 - DNA, 4000 bp, Escherichia coli
  misc_feature (1)..(5): n is a, c, g, or t
  misc_feature (7)..(7): n is a, c, g, or t
  misc_feature (9)..(10): n is a, c, g, or t
  misc_feature (12)..(16): n is a, c, g, or t
  misc_feature (19)..(19): n is a, c, g, or t
  misc_feature (21)..(25): n is a, c, g, or t
  misc_feature (27)..(30): n is a, c, g, or t
  misc_feature (34)..(35): n is a, c, g, or t
  misc_feature (37)..(37): n is a, c, g, or t
  misc_feature (39)..(39): n is a, c, g, or t
  misc_feature (41)..(42): n is a, c, g, or t
  misc_feature (44)..(45): n is a, c, g, or t
  misc_feature (47)..(48): n is a, c, g, or t
  misc_feature (50)..(52): n is a, c, g, or t
  misc_feature (54)..(55): n is a, c, g, or t
  misc_feature (57)..(60): n is a, c, g, or t
  misc_feature (62)..(65): n is a, c, g, or t
  misc_feature (67)..(69): n is a, c, g, or t
  misc_feature (72)..(73): n is a, c, g, or t
  misc_feature (76)..(82): n is a, c, g, or t
  misc_feature (84)..(84): n is a, c, g, or t
  misc_feature (86)..(86): n is a, c, g, or t
  misc_feature (88)..(93): n is a, c, g, or t
  misc_feature (95)..(97): n is a, c, g, or t
  misc_feature (99)..(101): n is a, c, g, or t
  misc_feature (105)..(108): n is a, c, g, or t
  misc_feature (111)..(112): n is a, c, g, or t
  misc_feature (116)..(117): n is a, c, g, or t
  misc_feature (123)..(123): n is a, c, g, or t
  misc_feature (126)..(128): n is a, c, g, or t
  misc_feature (130)..(130): n is a, c, g, or t
  misc_feature (134)..(135): n is a, c, g, or t
  misc_feature (138)..(144): n is a, c, g, or t
  misc_feature (146)..(155): n is a, c, g, or t
  misc_feature (157)..(158): n is a, c, g, or t
  misc_feature (160)..(162): n is a, c, g, or t
  misc_feature (164)..(165): n is a, c, g, or t
  misc_feature (167)..(172): n is a, c, g, or t
  misc_feature (174)..(182): n is a, c, g, or t
  misc_feature (187)..(191): n is a, c, g, or t
  misc_feature (193)..(193): n is a, c, g, or t
  misc_feature (196)..(197): n is a, c, g, or t
  misc_feature (199)..(201): n is a, c, g, or t
  misc_feature (203)..(203): n is a, c, g, or t
  misc_feature (205)..(208): n is a, c, g, or t
  misc_feature (210)..(212): n is a, c, g, or t
  misc_feature (214)..(215): n is a, c, g, or t
  misc_feature (218)..(218): n is a, c, g, or t
  misc_feature (221)..(226): n is a, c, g, or t
  misc_feature (229)..(233): n is a, c, g, or t
  misc_feature (236)..(236): n is a, c, g, or t
  misc_feature (239)..(239): n is a, c, g, or t
  misc_feature (241)..(242): n is a, c, g, or t
  misc_feature (244)..(252): n is a, c, g, or t
  misc_feature (254)..(254): n is a, c, g, or t
  misc_feature (257)..(257): n is a, c, g, or t
  misc_feature (259)..(259): n is a, c, g, or t
  misc_feature (261)..(264): n is a, c, g, or t
  misc_feature (266)..(266): n is a, c, g, or t
  misc_feature (271)..(272): n is a, c, g, or t
  misc_feature (274)..(274): n is a, c, g, or t
  misc_feature (276)..(276): n is a, c, g, or t
  misc_feature (278)..(280): n is a, c, g, or t
  misc_feature (282)..(289): n is a, c, g, or t
  misc_feature (294)..(295): n is a, c, g, or t
  misc_feature (297)..(297): n is a, c, g, or t
  misc_feature (299)..(300): n is a, c, g, or t
  misc_feature (302)..(303): n is a, c, g, or t
  misc_feature (305)..(305): n is a, c, g, or t
  misc_feature (307)..(307): n is a, c, g, or t
  misc_feature (309)..(314): n is a, c, g, or t
  misc_feature (316)..(320): n is a, c, g, or t
  misc_feature (322)..(326): n is a, c, g, or t
  misc_feature (328)..(330): n is a, c, g, or t
  misc_feature (339)..(339): n is a, c, g, or t
  misc_feature (341)..(342): n is a, c, g, or t
  misc_feature (345)..(345): n is a, c, g, or t
  misc_feature (347)..(351): n is a, c, g, or t
  misc_feature (353)..(354): n is a, c, g, or t
  misc_feature (664)..(664): n is a, c, g, or t
  misc_feature (891)..(891): n is a, c, g, or t
  misc_feature (1073)..(1073): n is a, c, g, or t
  misc_feature (1195)..(1195): n is a, c, g, or t
  misc_feature (1580)..(1580): n is a, c, g, or t
  misc_feature (1803)..(1803): n is a, c, g, or t
  misc_feature (1980)..(1981): n is a, c, g, or t
  misc_feature (1985)..(1985): n is a, c, g, or t
  misc_feature (2425)..(2425): n is a, c, g, or t
  misc_feature (2585)..(2585): n is a, c, g, or t
  misc_feature (3243)..(3243): n is a, c, g, or t
  misc_feature (3454)..(3457): n is a, c, g, or t
  misc_feature (3459)..(3459): n is a, c, g, or t
  misc_feature (3462)..(3465): n is a, c, g, or t
  misc_feature (3467)..(3470): n is a, c, g, or t
  misc_feature (3473)..(3474): n is a, c, g, or t
  misc_feature (3476)..(3480): n is a, c, g, or t
  misc_feature (3482)..(3495): n is a, c, g, or t
  misc_feature (3497)..(3498): n is a, c, g, or t
  misc_feature (3500)..(3501): n is a, c, g, or t
  misc_feature (3503)..(3507): n is a, c, g, or t
  misc_feature (3509)..(3511): n is a, c, g, or t
  misc_feature (3513)..(3516): n is a, c, g, or t
  misc_feature (3518)..(3519): n is a, c, g, or t
  misc_feature (3521)..(3525): n is a, c, g, or t
  misc_feature (3527)..(3528): n is a, c, g, or t
  misc_feature (3530)..(3530): n is a, c, g, or t
  misc_feature (3533)..(3534): n is a, c, g, or t
  misc_feature (3536)..(3540): n is a, c, g, or t
  misc_feature (3543)..(3544): n is a, c, g, or t
  misc_feature (3546)..(3548): n is a, c, g, or t
  misc_feature (3551)..(3555): n is a, c, g, or t
  misc_feature (3557)..(3557): n is a, c, g, or t
  misc_feature (3560)..(3563): n is a, c, g, or t
  misc_feature (3566)..(3568): n is a, c, g, or t
  misc_feature (3571)..(3573): n is a, c, g, or t
  misc_feature (3575)..(3579): n is a, c, g, or t
  misc_feature (3581)..(3582): n is a, c, g, or t
  misc_feature (3584)..(3586): n is a, c, g, or t
  misc_feature (3588)..(3591): n is a, c, g, or t
  misc_feature (3593)..(3594): n is a, c, g, or t
  misc_feature (3596)..(3598): n is a, c, g, or t
  misc_feature (3600)..(3605): n is a, c, g, or t
  misc_feature (3607)..(3609): n is a, c, g, or t
  misc_feature (3611)..(3613): n is a, c, g, or t
  misc_feature (3616)..(3619): n is a, c, g, or t
  misc_feature (3621)..(3622): n is a, c, g, or t
  misc_feature (3624)..(3625): n is a, c, g, or t
  misc_feature (3628)..(3629): n is a, c, g, or t
  misc_feature (3632)..(3632): n is a, c, g, or t
  misc_feature (3635)..(3636): n is a, c, g, or t
  misc_feature (3638)..(3638): n is a, c, g, or t
  misc_feature (3642)..(3645): n is a, c, g, or t
  misc_feature (3647)..(3647): n is a, c, g, or t
  misc_feature (3649)..(3651): n is a, c, g, or t
  misc_feature (3653)..(3654): n is a, c, g, or t
  misc_feature (3656)..(3658): n is a, c, g, or t
  misc_feature (3660)..(3661): n is a, c, g, or t
  misc_feature (3663)..(3664): n is a, c, g, or t
  misc_feature (3666)..(3668): n is a, c, g, or t
  misc_feature (3670)..(3671): n is a, c, g, or t
  misc_feature (3674)..(3674): n is a, c, g, or t
  misc_feature (3676)..(3679): n is a, c, g, or t
  misc_feature (3681)..(3687): n is a, c, g, or t
  misc_feature (3689)..(3692): n is a, c, g, or t
  misc_feature (3694)..(3711): n is a, c, g, or t
  misc_feature (3716)..(3717): n is a, c, g, or t
  misc_feature (3719)..(3719): n is a, c, g, or t
  misc_feature (3721)..(3721): n is a, c, g, or t
  misc_feature (3723)..(3728): n is a, c, g, or t
  misc_feature (3730)..(3730): n is a, c, g, or t
  misc_feature (3732)..(3735): n is a, c, g, or t
  misc_feature (3737)..(3740): n is a, c, g, or t
  misc_feature (3742)..(3743): n is a, c, g, or t
  misc_feature (3745)..(3745): n is a, c, g, or t
  misc_feature (3747)..(3749): n is a, c, g, or t
  misc_feature (3751)..(3755): n is a, c, g, or t
  misc_feature (3758)..(3762): n is a, c, g, or t
  misc_feature (3764)..(3764): n is a, c, g, or t
  misc_feature (3769)..(3769): n is a, c, g, or t
  misc_feature (3773)..(3777): n is a, c, g, or t
  misc_feature (3779)..(3779): n is a, c, g, or t
  misc_feature (3781)..(3787): n is a, c, g, or t
  misc_feature (3789)..(3794): n is a, c, g, or t
  misc_feature (3797)..(3801): n is a, c, g, or t
  misc_feature (3804)..(3807): n is a, c, g, or t
  misc_feature (3810)..(3812): n is a, c, g, or t
  misc_feature (3816)..(3817): n is a, c, g, or t
  misc_feature (3819)..(3822): n is a, c, g, or t
  misc_feature (3824)..(3825): n is a, c, g, or t
  misc_feature (3828)..(3832): n is a, c, g, or t
  misc_feature (3834)..(3847): n is a, c, g, or t
  misc_feature (3849)..(3850): n is a, c, g, or t
  misc_feature (3852)..(3865): n is a, c, g, or t
  misc_feature (3867)..(3869): n is a, c, g, or t
  misc_feature (3871)..(3871): n is a, c, g, or t
  misc_feature (3874)..(3876): n is a, c, g, or t
  misc_feature (3878)..(3880): n is a, c, g, or t
  misc_feature (3882)..(3884): n is a, c, g, or t
  misc_feature (3886)..(3890): n is a, c, g, or t
  misc_feature (3892)..(3893): n is a, c, g, or t
  misc_feature (3895)..(3896): n is a, c, g, or t
  misc_feature (3898)..(3898): n is a, c, g, or t
  misc_feature (3901)..(3903): n is a, c, g, or t
  misc_feature (3905)..(3905): n is a, c, g, or t
  misc_feature (3907)..(3910): n is a, c, g, or t
  misc_feature (3913)..(3916): n is a, c, g, or t
  misc_feature (3918)..(3918): n is a, c, g, or t
  misc_feature (3920)..(3921): n is a, c, g, or t
  misc_feature (3923)..(3927): n is a, c, g, or t
  misc_feature (3929)..(3931): n is a, c, g, or t
  misc_feature (3933)..(3935): n is a, c, g, or t
  misc_feature (3937)..(3942): n is a, c, g, or t
  misc_feature (3946)..(3946): n is a, c, g, or t
  misc_feature (3949)..(3958): n is a, c, g, or t
  misc_feature (3960)..(3965): n is a, c, g, or t
  misc_feature (3968)..(3968): n is a, c, g, or t
  misc_feature (3970)..(3974): n is a, c, g, or t
  misc_feature (3976)..(3977): n is a, c, g, or t
  misc_feature (3979)..(3982): n is a, c, g, or t
  misc_feature (3984)..(3990): n is a, c, g, or t
  misc_feature (3992)..(3993): n is a, c, g, or t
  misc_feature (3995)..(3995): n is a, c, g, or t
  misc_feature (3997)..(4000): n is a, c, g, or t
nnnnnangnngnnnnnggntnnnnngnnnngggnngngngnncnncnnannngnngnnnncnnnngnnnccnngannnnnnngnanannnnnncnnngnnngcgnnnnccnngccnnaggggnccnnngncccnnggnnnnnnncnnnnnnnnnntnngnnncnngnnnnnngnnnnnnnnnatttnnnnnanttnncnnnantnnnntnnntnnggngcnnnnnnggnnnnnggnggngnngnnnnnnnnngnggncnannnncnctttnnancncnnnannnnnnnnaaaanncntnntnntncntnnnnnntnnnnncnnnnntnnngggttattnannctngnnnnngnntctctgaccgaaaacacagtcacgtttctgagaagtatattcggaaattgattccattttccaggaataataccttcagggatcatctcctccgtcaaaatataaaatattcttttttgaaatattccattgcccactgtgtcgcgtcactcttcccgcgcaattggttggttatgggccaaattgtgctcatcatgactagccatcatacgtcgtttattatttcgcgcgcgatttataactggcacacgtacgttttggccgagatgcgattattaagcgagtaccgttgacctctcgctgctggtgngacacaacaacgttcgtgtcgccctccgcatggaccggcgttcgctcctcgccaccggacttctcgcttgggcgggtgcgctgcaggtgcacgtctggtacgtcacctccacggacgagtacaagtcctcctccatcgccaagtccggcgtcgcggactggacgttcaggcttccaacatcgctgggagggggcgggtcggaggaagggggcgggtcggaggaaggncgcgacgggggtgagcgcggcgcgtgagagccggggtcgatatcgtcatgacagttccgctgcccgcggtcgaggatggaccccggggggccgagacgaagcgcaagttcttcgaggacacgcgaacggcggggttgaacgataggagcctcgaacggcgcgcactgggcgtggttctcgcncacgcgcacgcggacgtcgccgcgcggttggcgtccgtcaaccgagcgctccgtgcggacgcgaggagggtgccgcagctcgcgttcggacccgaatccgcgctgtggagacgcgcgggcgncgacgccgacgcgacgctgattgagatcctcacgcgtcaccggcctggaagactccaacgcctggtgctctgcccgccgacgacgcgcgacgatgatcacgaactcccctgcgccatctcgcccgcgaccgtgcagttcgcggcgcgcgcgcagctccgcctgcgatgcctctggacggagcccggcgccatgcgacccgatccgacggctcgcgtcccggctgcgcgcggcgtcgtcacggtgacgctcgatcgcgaggactgcgtcgcgatcgtgacccggggtcagtgcagtgggataccgagggcggtgcacaacaccggcgtgttcgcgcccgggctcacgcggctctccgtgggcgcggcggctgagatgaccgacgcnggcgttcgcgtcgtttttcgctcgtgttcgaggctcgagtcgctggaggtgacggacggcgactcgagtgggctgacgggttcggactggggcggcgcgggtgtcgacgcggcggtaccggagctcaccgagctgaggttagcgcggtgtgccggtctgcgcgcgcttcggttgcgacgcgttgaacggttgaacgcgttggcggcgactgattgcgacgcgntgacggatttggcgttgacggcgtcgagcgaatcgggcgacggcgaggtggacggtgacggggctgacatgcccgcgcttcgtgcgctgaccttggggtcgttcagctcgcgtcgtgtgggtgccggctcgaacgtgcccggtggtgcgctcgcggcgatcgtgcgcaggtgcgtcnntctngtttttttggctatacccgcgagctgcggcgccggttcgggcgacgacgagacggcggaggtttggtcccacgcgttggctcgaagcgcgccgtcgatcacgaccctctgcttccaggtgccgatcacgaccaccgcgctgatgctgatggtgtccggcgcgggcgagttaccgcggctcgaggcgctgagcgcggcgatgagagtcgggagcgacggcgactcggagggtggcgagcccttcgtcgtcgacgcggcgcacgtcgcggacgatttggtggcgtgcgtctctccgtgccccgcgcttcgcgtgttgaccctcgtggacccgccgcccggtgtcccgacgagtgtcgacgaggcgacggggatgcacgcgaagatgcgagcgagcgtggagttggccaggggcgcgttgtcggcgcggtgcgggctcgcttnagaggagtcagagtcggcgctgggtcgggagctggtcatcgacgtggcggatgatttccgcggcgtggcgggggcggcgcgcacggcggacgcgccgacgccgggtgggatagatgccgtgctgagagaatgcgacgaatgcgcgccgctcgagtggtcnctcgacgacgcgtgatggtgaatggcgcgtactcaaaagtagcggattttaatacaaagtgagagaaccgccgcgcgtttagatctcgtcgtcggagaagtcgaagtcgtcgactgggggaaagtccccgacctgcacgttgaccgggcgctgaaaggacccgtagccgtcggggcactcgaagtacctcttccccttggcggtgccgtcgtttttgcccacgggttcgtcgaactggatgccgatccaccaacccttgggcagcgtctcgcacttgcccacgaacttgacctcgccgcgcttactcccggggttgatctccgcgcgcatgcccaccgtgatcacgccggcctccgccgcctggtgctcgtcgtcctcgacgggccccgcgggcgggacccagacctcgccgcgcttctcagccatggccttctccaggcaccacgtcgggtccttggcgagttgcgccttcttccactcgcggtaggtgccctccctcgtgtcgtagtcctggtcggacatgatgtacttgtccaccttgctgacgtcctcgagccagccgttggcggacatggagttggtgtcgatgtcgttgatgtggatggtccacccgtcctcgggcgagtagtagccgagcatcttggtgtcgtcgcccagntcggagacggtggtgccgtcccagtccttcagcaccaggcgcatggtgctcacgttgctgccgacgtgggtcatgagcttctccttgacgcggaggatggtcatctgtcgcgggaaaggagcggaaagaggggacggggacgggtcaacgtcgggtcggcacgcgagatctgagggtcggcaaaaggcagatcgggatcgaggcgcgacgnnnngnggnnnnannnncgnngnnnnnannnnnnnnnnnnnngnngnngnnnnncnnnannnncnncnnnnngnngntgnngnnnnncannannngcnnnnngntgnnnnccnnnttnnncnnnnngnngnnntnnnngnngnnntnnnnnngnnngnnnagnnnntnntnnttnntgntgnngncgtnnnncntnnngnngnnngnngnngnnngnnggngnnnncnnnnnnngnnnngnnnnnnnnnnnnnnnnnnagaannangntnnnnnntngnnnncnnnngnngngnnncnnnnngtnnnnncngcggnggannnnngncnnnnnnntnnnnnnttnnnnnaannnncgnnngacnncnnnnannaannnnngnnnnnnnnnnnnnntnntnnnnnnnnnnnnnncnnngnacnnngnnngnnngnnnnntnncnncnccnnncngnnnncannnncnanntnnnnnannncnnncnnnnnncgcnccnnnnnnnnnngnnnnnncangnnnnntnntnnnnannnnnnngnngngnnnn

SEQ ID NO: 1214 - DNA, 4000 bp, Escherichia coli
  misc_feature (1985)..(1985): n is a, c, g, or t
  misc_feature (2347)..(2347): n is a, c, g, or t
  misc_feature (2351)..(2351): n is a, c, g, or t
  misc_feature (3218)..(3218): n is a, c, g, or t
ctgaacccgcgctggatgaatggcaacgcgccggcatccccgcccttctcgccggtttcgacgccgagtgcttcggcgcgtctcgcgccatcgacgacttgcacggccgcgccgcgcccgccgtcgacgtcacgggcgccacgatcggcgcgaagcgcaaagccatcgaagctccgaaacctcgttcgccgcccgcgcgggcgcgggcgcacagacccgaacccatcatgaccatcgcgccgcaccacgcgttcgtcatcgagcgcgtgaaagccgacgccctgacgtctctcaccaccgacgccctgaaacgattcttagccgcgcacaacctttcgtgcgccggttccaaggcgcagctctgcgatcgagtcgaatgtcacgttcgcatgtgcgccggagacgcactagactagctccggaaccgactgtaaaccgacgcgcgcgccgcacaacgcgaagcaccatgtccacgcccgcggcgcccgagccgcccgctcccgaggccccgcccgagccaccgagccttttgattcccggctacattccgtttccgcccgcgcgcgagggcgagatggcggaaccgacggtgcaaatcgcgcagccgccgccgctgtacccaccgctcccgcgcggtctcaagcccttcaccgacgccacgcccgaggaactgcgcctcgtgcgcctgtcgcgcgcgattcgagggttcttccgcgcgtcggcgtatcatcacggcgatcgggacgacgagctcgagcgccgcgcgcgcgagggcgacgtctcgcgatggcgggacgaggaggcgagcgggacgagctcggacgaggacgatgaaaggggcgataaggacgacgaggacgcgatcgatgaacgatggatacgaagcatgcgacgggcgttcacgctggaggatttaaaggtgacggatgagcggatcgtgcccagggagatattagaggcggcgttcggcgcgagggcgaacgcgccgaacggaaagggtaagaaacgcgccgcgaacgacgcgagcgcgagcggtggagacaagaagcgcggtaaggcgaacgaagacggtgaacgcgacgatcaaggggcgacggcgtcgacgaaacagagaaagggtgatatttcgcgtctcgagcgtctggcgcgtttagaagagtcgagcgcggccaaggagctcgacggcgacgccgtcgagggcaagtctcgcggtcgtctccaatcgcgcgcgagcgatcgtcagcgtcgcgcgcgatcgccgtccaaaaatgcgcgcgccggggacgaggacgacgacgaagccgacgaagacgccgtcgaccgcgccgcggacgacgacgacgagctcgacagcgacgacgactacgcccgcgccgccggtttcgacgacgacgacggctacgacgacgacatcgccgaccacgccgacaccgaggccttctattagctcgctcgtctctttcatgcgtcattcaaaacctaagcttcgtcttctacgtcgcgtctcgctacgaccctcccatgttttgcagcctcccgagcacgacttgcccgctctccaggtaccgcagcgcgcagttcgtcaggcagctcgactcgctcgacgaaaacttcgcgcccggcgcgtacgtcacgcacttctcgaagcacgtctccgtgagcttcgcgacgacctcgttgaacaccgccttgcgcttttcctcctgcggcgcgatgaaacgtcagtcgtgcgacgcgcgacggcgaacgcggcgaatcgagcgcacctcgaggaactgttgcatgtgcgcgtcgttggcctgcatcgcgacgcggcctcgacggatcgaggatcgcgcgcgcgggtgtgacgacgagacgcgaattcgagccgagtcgcgagcgcgagcgcggcgagacgacgcgaaggacgcgacgcgcgcgcggcgatcggtcgacggcgacgcgccgcgccgtcgactcgcatttcaattccaactcgcatnacaatgtacgtttcaattcgcgtttcaattcgcgtttcgattcgcgcgttcgacggacgctcgcgcgtccttgcgcctcggcacgacgaagacgccgaagtcggcggcgcgatcgcgccgaacctcccacggcgtcgaatcgtcgggctcggcgaacgcaccgtcgcgctcgaagtccacgcacgcgtccagggcgtcgacgcacgtgacgatgcgaaaatctccaatctcccaggcgcgccgcagcgtcggcgacagtcgacgcaggcccgcgcccgtgagccacgcgaacgcgcacgtcggcgcgggtgaatcgagcacgccgcgcgccagcgcctcggcggtcaacgtggtgagatctncctngtgcacggtgatcaagtcctcgagattctcgcgcgcgacgcgttcgcgcgcgtctcgcgcgagcgcgtcgtcgagctcgaggcccacgcagcggcagcccctcgccttggcggcgtccacgagcacgcgcccgtcgccgcatccgaggtcgtacaggacgtcggaggacgacagcgcgcacgcgtcgaaggcgacggcgcgtcgacgcggctccgtgggcgcccacggggcgagggacgtcgccgccgcctcggcgcacttttcgtcgtttcgagcggcgagcgcggcgcgcagcagcgcgttctgcgcgcgcgcgacgtcggcgggatcgaaatcgtacgcgtcttcgtcgtcgcgcatcgcgcgagcgcgcggtcgagcgcgagctcgatcgaccgcgcgctgtgcggtcggggacgcgcttcgagtcgaatcgcgtcgcgttacatgacgagtcgaatcgcggccaaagacagcgcgccgagcgataccagcgtccccacgctgtatcgaataatttccgtcttcgccgcctctatctgcgttcgcatctgatgcaactctcgatcgacgcgcgcctcgacctctttcatctgactctcctgaatcccgtgcaactctcgcagtcgtcccttctccagattcaaatccaacttttgcgactgcgtgatcctatcgatgttatacttgagatcggcgcgcagcttctcgttctccgcctgcagggtttcggtggagtgtttcatcgacgcgctcgcctcgcgcagcgacgacgccacctcctgcttgagcgcctgcgtctccgcgcgtccgtgcatcaactctcgctccagttcgtttctcgcgacgaatcccgcgcgcgtcatngacgtcagcgcgctcgcgacgatggcctccgcctgcggttcgccgaacccgcccgctttcgcgagctgcttgatgatggcgtgcgagtcgaaccggtcgaccgtcgccgcgggcgggtcccacgccgtcgccggcgacgccgcggacgcgcgcgcgcgtcgcgcgacgccgcgcgcgtcgaaacgatcgaccgtcgcgagtcgcgggtcgagcgcgcgcgcgcgtcgcgcgacgcgcgtcgcgacgccgcgcgcgaacatcgatttgaaggatgaattcaaagccgtcgtcgcgcggcgtcgcgcggcgtcgccgaagcgcgggcgtcgagacgcgcgcgcgagcgtgcgaacctcgagacgcgcgcgcgacgcggacgcgcgacgcgcgcgcgacgcgacgcgaacgcggtgatgtgaagcgacgcggtcgttagtcccgcggtacttcgtcgcgccgcgcgccgcgatggcgacgcgatcgacgctcgagcgcgccgtcgcgcgcgcgggcggtgcgcgcgcgtcgcgcgcgcgatcgcgcgcgacgcggcgacgacgggtgacgacgcgcgcggcgccgaagggtgagaggaggcgcggcggcggcgccggagcggagacgaaacgcgcgcccgcgcgcgcgaacgacgacgacgacggcgacgcgtggcgcgtgtacgacgtgcacgtgccgctcgatcgtgacctgggtaaggactcgagcgaggcgtcgcccgcggtgctggaggcggtgcaaaagattttggggacggcgcggac

SEQ ID NO: 1215 - DNA, 4000 bp, Escherichia coli
  misc_feature (4)..(4): n is a, c, g, or t
  misc_feature (7)..(8): n is a, c, g, or t
  misc_feature (10)..(13): n is a, c, g, or t
  misc_feature (15)..(15): n is a, c, g, or t
  misc_feature (17)..(24): n is a, c, g, or t
  misc_feature (26)..(27): n is a, c, g, or t
  misc_feature (30)..(30): n is a, c, g, or t
  misc_feature (34)..(35): n is a, c, g, or t
  misc_feature (37)..(41): n is a, c, g, or t
  misc_feature (45)..(46): n is a, c, g, or t
  misc_feature (48)..(49): n is a, c, g, or t
  misc_feature (51)..(52): n is a, c, g, or t
  misc_feature (54)..(59): n is a, c, g, or t
  misc_feature (61)..(62): n is a, c, g, or t
  misc_feature (67)..(75): n is a, c, g, or t
  misc_feature (77)..(83): n is a, c, g, or t
  misc_feature (85)..(85): n is a, c, g, or t
  misc_feature (89)..(94): n is a, c, g, or t
  misc_feature (98)..(104): n is a, c, g, or t
  misc_feature (106)..(107): n is a, c, g, or t
  misc_feature (109)..(112): n is a, c, g, or t
  misc_feature (115)..(119): n is a, c, g, or t
  misc_feature (121)..(122): n is a, c, g, or t
  misc_feature (124)..(130): n is a, c, g, or t
  misc_feature (132)..(136): n is a, c, g, or t
  misc_feature (138)..(141): n is a, c, g, or t
  misc_feature (143)..(144): n is a, c, g, or t
  misc_feature (146)..(150): n is a, c, g, or t
  misc_feature (152)..(153): n is a, c, g, or t
  misc_feature (155)..(155): n is a, c, g, or t
  misc_feature (157)..(158): n is a, c, g, or t
  misc_feature (160)..(163): n is a, c, g, or t
  misc_feature (169)..(171): n is a, c, g, or t
  misc_feature (174)..(174): n is a, c, g, or t
  misc_feature (178)..(181): n is a, c, g, or t
  misc_feature (184)..(187): n is a, c, g, or t
  misc_feature (191)..(194): n is a, c, g, or t
  misc_feature (196)..(200): n is a, c, g, or t
  misc_feature (208)..(208): n is a, c, g, or t
  misc_feature (210)..(212): n is a, c, g, or t
  misc_feature (214)..(217): n is a, c, g, or t
  misc_feature (221)..(221): n is a, c, g, or t
  misc_feature (223)..(230): n is a, c, g, or t
  misc_feature (232)..(238): n is a, c, g, or t
  misc_feature (241)..(244): n is a, c, g, or t
  misc_feature (247)..(250): n is a, c, g, or t
  misc_feature (252)..(252): n is a, c, g, or t
  misc_feature (254)..(255): n is a, c, g, or t
  misc_feature (258)..(258): n is a, c, g, or t
  misc_feature (260)..(263): n is a, c, g, or t
  misc_feature (265)..(265): n is a, c, g, or t
  misc_feature (267)..(271): n is a, c, g, or t
  misc_feature (273)..(275): n is a, c, g, or t
  misc_feature (277)..(279): n is a, c, g, or t
  misc_feature (282)..(282): n is a, c, g, or t
  misc_feature (287)..(288): n is a, c, g, or t
  misc_feature (291)..(299): n is a, c, g, or t
  misc_feature (301)..(302): n is a, c, g, or t
  misc_feature (304)..(304): n is a, c, g, or t
  misc_feature (307)..(308): n is a, c, g, or t
  misc_feature (310)..(310): n is a, c, g, or t
  misc_feature (312)..(315): n is a, c, g, or t
  misc_feature (317)..(317): n is a, c, g, or t
  misc_feature (319)..(322): n is a, c, g, or t
  misc_feature (324)..(326): n is a, c, g, or t
  misc_feature (329)..(329): n is a, c, g, or t
  misc_feature (331)..(332): n is a, c, g, or t
  misc_feature (335)..(335): n is a, c, g, or t
  misc_feature (338)..(338): n is a, c, g, or t
  misc_feature (340)..(340): n is a, c, g, or t
  misc_feature (342)..(348): n is a, c, g, or t
  misc_feature (351)..(351): n is a, c, g, or t
  misc_feature (354)..(356): n is a, c, g, or t
  misc_feature (358)..(359): n is a, c, g, or t
  misc_feature (361)..(362): n is a, c, g, or t
  misc_feature (368)..(368): n is a, c, g, or t
  misc_feature (370)..(370): n is a, c, g, or t
  misc_feature (372)..(374): n is a, c, g, or t
  misc_feature (377)..(377): n is a, c, g, or t
  misc_feature (379)..(379): n is a, c, g, or t
  misc_feature (381)..(381): n is a, c, g, or t
  misc_feature (383)..(389): n is a, c, g, or t
  misc_feature (391)..(394): n is a, c, g, or t
  misc_feature (397)..(397): n is a, c, g, or t
  misc_feature (399)..(405): n is a, c, g, or t
  misc_feature (408)..(408): n is a, c, g, or t
  misc_feature (410)..(412): n is a, c, g, or t
  misc_feature (414)..(414): n is a, c, g, or t
  misc_feature (416)..(419): n is a, c, g, or t
  misc_feature (422)..(424): n is a, c, g, or t
  misc_feature (427)..(431): n is a, c, g, or t
  misc_feature (433)..(435): n is a, c, g, or t
  misc_feature (437)..(437): n is a, c, g, or t
  misc_feature (439)..(440): n is a, c, g, or t
  misc_feature (444)..(445): n is a, c, g, or t
  misc_feature (449)..(449): n is a, c, g, or t
  misc_feature (451)..(452): n is a, c, g, or t
  misc_feature (455)..(456): n is a, c, g, or t
  misc_feature (458)..(462): n is a, c, g, or t
  misc_feature (465)..(467): n is a, c, g, or t
  misc_feature (469)..(471): n is a, c, g, or t
  misc_feature (473)..(477): n is a, c, g, or t
  misc_feature (479)..(479): n is a, c, g, or t
  misc_feature (482)..(484): n is a, c, g, or t
  misc_feature (487)..(490): n is a, c, g, or t
  misc_feature (492)..(492): n is a, c, g, or t
  misc_feature (496)..(504): n is a, c, g, or t
  misc_feature (510)..(511): n is a, c, g, or t
  misc_feature (513)..(513): n is a, c, g, or t
  misc_feature (517)..(517): n is a, c, g, or t
  misc_feature (519)..(521): n is a, c, g, or t
  misc_feature (523)..(527): n is a, c, g, or t
  misc_feature (529)..(531): n is a, c, g, or t
  misc_feature (534)..(541): n is a, c, g, or t
  misc_feature (544)..(544): n is a, c, g, or t
  misc_feature (546)..(546): n is a, c, g, or t
  misc_feature (548)..(549): n is a, c, g, or t
  misc_feature (551)..(551): n is a, c, g, or t
  misc_feature (553)..(554): n is a, c, g, or t
  misc_feature (556)..(560): n is a, c, g, or t
  misc_feature (562)..(564): n is a, c, g, or t
  misc_feature (566)..(566): n is a, c, g, or t
  misc_feature (570)..(570): n is a, c, g, or t
  misc_feature (572)..(575): n is a, c, g, or t
  misc_feature (577)..(578): n is a, c, g, or t
  misc_feature (580)..(580): n is a, c, g, or t
  misc_feature (582)..(585): n is a, c, g, or t
  misc_feature (587)..(588): n is a, c, g, or t
  misc_feature (590)..(590): n is a, c, g, or t
  misc_feature (593)..(597): n is a, c, g, or t
  misc_feature (599)..(601): n is a, c, g, or t
  misc_feature (603)..(604): n is a, c, g, or t
  misc_feature (607)..(607): n is a, c, g, or t
  misc_feature (609)..(610): n is a, c, g, or t
  misc_feature (615)..(616): n is a, c, g, or t
  misc_feature (618)..(619): n is a, c, g, or t
  misc_feature (622)..(622): n is a, c, g, or t
  misc_feature (624)..(625): n is a, c, g, or t
  misc_feature (630)..(630): n is a, c, g, or t
  misc_feature (636)..(636): n is a, c, g, or t
  misc_feature (640)..(643): n is a, c, g, or t
  misc_feature (646)..(646): n is a, c, g, or t
  misc_feature (648)..(649): n is a, c, g, or t
  misc_feature (652)..(655): n is a, c, g, or t
  misc_feature (657)..(659): n is a, c, g, or t
  misc_feature (661)..(665): n is a, c, g, or t
  misc_feature (669)..(670): n is a, c, g, or t
  misc_feature (672)..(674): n is a, c, g, or t
  misc_feature (676)..(676): n is a, c, g, or t
  misc_feature (678)..(681): n is a, c, g, or t
  misc_feature (683)..(685): n is a, c, g, or t
  misc_feature (689)..(693): n is a, c, g, or t
  misc_feature (698)..(699): n is a, c, g, or t
  misc_feature (703)..(703): n is a, c, g, or t
  misc_feature (705)..(705): n is a, c, g, or t
  misc_feature (708)..(712): n is a, c, g, or t
  misc_feature (714)..(714): n is a, c, g, or t
  misc_feature (718)..(718): n is a, c, g, or t
  misc_feature (722)..(722): n is a, c, g, or t
  misc_feature (724)..(724): n is a, c, g, or t
  misc_feature (728)..(728): n is a, c, g, or t
  misc_feature (730)..(730): n is a, c, g, or t
  misc_feature (735)..(739): n is a, c, g, or t
  misc_feature (741)..(743): n is a, c, g, or t
  misc_feature (746)..(747): n is a, c, g, or t
  misc_feature (749)..(752): n is a, c, g, or t
  misc_feature (754)..(757): n is a, c, g, or t
  misc_feature (759)..(759): n is a, c, g, or t
  misc_feature (761)..(761): n is a, c, g, or t
  misc_feature (763)..(763): n is a, c, g, or t
  misc_feature (770)..(770): n is a, c, g, or t
  misc_feature (772)..(773): n is a, c, g, or t
  misc_feature (775)..(776): n is a, c, g, or t
  misc_feature (781)..(781): n is a, c, g, or t
  misc_feature (783)..(786): n is a, c, g, or t
  misc_feature (788)..(788): n is a, c, g, or t
  misc_feature (790)..(793): n is a, c, g, or t
  misc_feature (795)..(795): n is a, c, g, or t
  misc_feature (798)..(800): n is a, c, g, or t
  misc_feature (802)..(805): n is a, c, g, or t
  misc_feature (807)..(809): n is a, c, g, or t
  misc_feature (811)..(811): n is a, c, g, or t
  misc_feature (813)..(813): n is a, c, g, or t
  misc_feature (816)..(816): n is a, c, g, or t
  misc_feature (819)..(819): n is a, c, g, or t
  misc_feature (822)..(823): n is a, c, g, or t
  misc_feature (825)..(826): n is a, c, g, or t
  misc_feature (829)..(837): n is a, c, g, or t
  misc_feature (839)..(850): n is a, c, g, or t
  misc_feature (853)..(853): n is a, c, g, or t
  misc_feature (856)..(858): n is a, c, g, or t
  misc_feature (860)..(860): n is a, c, g, or t
  misc_feature (862)..(871): n is a, c, g, or t
  misc_feature (873)..(874): n is a, c, g, or t
  misc_feature (876)..(879): n is a, c, g, or t
  misc_feature (881)..(884): n is a, c, g, or t
  misc_feature (886)..(887): n is a, c, g, or t
  misc_feature (889)..(893): n is a, c, g, or t
  misc_feature (895)..(895): n is a, c, g, or t
  misc_feature (897)..(899): n is a, c, g, or t
  misc_feature (901)..(901): n is a, c, g, or t
  misc_feature (903)..(905): n is a, c, g, or t
  misc_feature (909)..(909): n is a, c, g, or t
  misc_feature (911)..(912): n is a, c, g, or t
  misc_feature (917)..(919): n is a, c, g, or t
  misc_feature (921)..(921): n is a, c, g, or t
  misc_feature (923)..(925): n is a, c, g, or t
  misc_feature (928)..(928): n is a, c, g, or t
  misc_feature (930)..(932): n is a, c, g, or t
  misc_feature (934)..(934): n is a, c, g, or t
  misc_feature (936)..(940): n is a, c, g, or t
  misc_feature (942)..(943): n is a, c, g, or t
  misc_feature (945)..(945): n is a, c, g, or t
  misc_feature (949)..(953): n is a, c, g, or t
  misc_feature (956)..(956): n is a, c, g, or t
  misc_feature (959)..(959): n is a, c, g, or t
  misc_feature (962)..(964): n is a, c, g, or t
  misc_feature (968)..(971): n is a, c, g, or t
  misc_feature (974)..(976): n is a, c, g, or t
  misc_feature (978)..(981): n is a, c, g, or t
  misc_feature (983)..(986): n is a, c, g, or t
  misc_feature (988)..(992): n is a, c, g, or t
  misc_feature (994)..(996): n is a, c, g, or t
  misc_feature (999)..(999): n is a, c, g, or t
  misc_feature (1003)..(1003): n is a, c, g, or t
  misc_feature (1005)..(1008): n is a, c, g, or t
  misc_feature (1011)..(1014): n is a, c, g, or t
  misc_feature (1016)..(1019): n is a, c, g, or t
  misc_feature (1022)..(1022): n is a, c, g, or t
  misc_feature (1026)..(1027): n is a, c, g, or t
  misc_feature (1030)..(1030): n is a, c, g, or t
  misc_feature (1035)..(1036): n is a, c, g, or t
  misc_feature (1039)..(1040): n is a, c, g, or t
  misc_feature (1052)..(1052): n is a, c, g, or t
  misc_feature (1054)..(1057): n is a, c, g, or t
  misc_feature (1061)..(1062): n is a, c, g, or t
  misc_feature (1064)..(1068): n is a, c, g, or t
  misc_feature (1073)..(1073): n is a, c, g, or t
  misc_feature (1078)..(1079): n is a, c, g, or t
  misc_feature (1083)..(1084): n is a, c, g, or t
  misc_feature (1088)..(1088): n is a, c, g, or t
  misc_feature (1091)..(1091): n is a, c, g, or t
  misc_feature (1094)..(1100): n is a, c, g, or t
  misc_feature (1103)..(1104): n is a, c, g, or t
  misc_feature (1107)..(1107): n is a, c, g, or t
  misc_feature (1109)..(1109): n is a, c, g, or t
  misc_feature (1112)..(1113): n is a, c, g, or t
  misc_feature (1115)..(1115): n is a, c, g, or t
  misc_feature (1117)..(1117): n is a, c, g, or t
  misc_feature (1119)..(1123): n is a, c, g, or t
  misc_feature (1126)..(1127): n is a, c, g, or t
  misc_feature (1129)..(1129): n is a, c, g, or t
  misc_feature (1131)..(1132): n is a, c, g, or t
  misc_feature (1134)..(1134): n is a, c, g, or t
  misc_feature (1138)..(1139): n is a, c, g, or t
  misc_feature (1141)..(1142): n is a, c, g, or t
  misc_feature (1144)..(1144): n is a, c, g, or t
  misc_feature (1160)..(1160): n is a, c, g, or t
  misc_feature (1163)..(1163): n is a, c, g, or t
  misc_feature (1181)..(1181): n is a, c, g, or t
  misc_feature (1183)..(1184): n is a, c, g, or t
  misc_feature (1186)..(1187): n is a, c, g, or t
  misc_feature (1189)..(1190): n is a, c, g, or t
  misc_feature (1194)..(1194): n is a, c, g, or t
  misc_feature (1196)..(1199): n is a, c, g, or t
  misc_feature (1202)..(1203): n is a, c, g, or t
  misc_feature (1205)..(1205): n is a, c, g, or t
  misc_feature (1207)..(1210): n is a, c, g, or t
  misc_feature (1212)..(1212): n is a, c, g, or t
  misc_feature (1214)..(1215): n is a, c, g, or t
  misc_feature (1217)..(1217): n is a, c, g, or t
  misc_feature (1219)..(1219): n is a, c, g, or t
  misc_feature (1221)..(1222): n is a, c, g, or t
  misc_feature (1225)..(1227): n is a, c, g, or t
  misc_feature (1229)..(1234): n is a, c, g, or t
  misc_feature (1236)..(1238): n is a, c, g, or t
  misc_feature (1244)..(1244): n is a, c, g, or t
  misc_feature (1249)..(1252): n is a, c, g, or t
  misc_feature (1254)..(1258): n is a, c, g, or t
  misc_feature (1260)..(1263): n is a, c, g, or t
  misc_feature (1265)..(1269): n is a, c, g, or t
  misc_feature (1274)..(1280): n is a, c, g, or t
  misc_feature (1282)..(1283): n is a, c, g, or t
  misc_feature (1286)..(1292): n is a, c, g, or t
  misc_feature (1296)..(1297): n is a, c, g, or t
  misc_feature (1300)..(1300): n is a, c, g, or t
  misc_feature (1305)..(1306): n is a, c, g, or t
  misc_feature (1309)..(1310): n is a, c, g, or t
  misc_feature (1314)..(1320): n is a, c, g, or t
  misc_feature (1322)..(1323): n is a, c, g, or t
  misc_feature (1325)..(1325): n is a, c, g, or t
  misc_feature (1328)..(1329): n is a, c, g, or t
  misc_feature (1334)..(1334): n is a, c, g, or t
  misc_feature (1336)..(1336): n is a, c, g, or t
  misc_feature (1340)..(1340): n is a, c, g, or t
  misc_feature (1342)..(1343): n is a, c, g, or t
  misc_feature (1348)..(1349): n is a, c, g, or t
  misc_feature (1352)..(1353): n is a, c, g, or t
  misc_feature (1355)..(1356): n is a, c, g, or t
  misc_feature (1358)..(1360): n is a, c, g, or t
  misc_feature (1363)..(1367): n is a, c, g, or t
  misc_feature (1370)..(1371): n is a, c, g, or t
  misc_feature (1373)..(1374): n is a, c, g, or t
  misc_feature (1377)..(1386): n is a, c, g, or t
  misc_feature (1388)..(1389): n is a, c, g, or t
  misc_feature (1391)..(1394): n is a, c, g, or t
  misc_feature (1397)..(1400): n is a, c, g, or t
  misc_feature (1405)..(1405): n is a, c, g, or t
  misc_feature (1408)..(1411): n is a, c, g, or t
  misc_feature (1414)..(1417): n is a, c, g, or t
  misc_feature (1419)..(1419): n is a, c, g, or t
  misc_feature (1421)..(1421): n is a, c, g, or t
  misc_feature (1423)..(1425): n is a, c, g, or t
  misc_feature (1427)..(1430): n is a, c, g, or t
  misc_feature (1433)..(1435): n is a, c, g, or t
  misc_feature (1437)..(1438): n is a, c, g, or t
  misc_feature (1440)..(1441): n is a, c, g, or t
  misc_feature (1443)..(1444): n is a, c, g, or t
  misc_feature (1446)..(1450): n is a, c, g, or t
  misc_feature (1453)..(1456): n is a, c, g, or t
  misc_feature (1459)..(1460): n is a, c, g, or t
  misc_feature (1465)..(1465): n is a, c, g, or t
  misc_feature (1468)..(1469): n is a, c, g, or t
  misc_feature (1474)..(1476): n is a, c, g, or t
  misc_feature (1478)..(1479): n is a, c, g, or t
  misc_feature (1482)..(1482): n is a, c, g, or t
  misc_feature (1484)..(1486): n is a, c, g, or t
  misc_feature (1493)..(1493): n is a, c, g, or t
  misc_feature (1498)..(1499): n is a, c, g, or t
  misc_feature (1505)..(1506): n is a, c, g, or t
  misc_feature (1508)..(1508): n is a, c, g, or t
  misc_feature (1510)..(1514): n is a, c, g, or t
  misc_feature (1516)..(1516): n is a, c, g, or t
  misc_feature (1520)..(1523): n is a, c, g, or t
  misc_feature (1525)..(1528): n is a, c, g, or t
  misc_feature (1531)..(1532): n is a, c, g, or t
  misc_feature (1534)..(1537): n is a, c, g, or t
  misc_feature (1540)..(1544): n is a, c, g, or t
  misc_feature (1546)..(1549): n is a, c, g, or t
  misc_feature (1551)..(1551): n is a, c, g, or t
  misc_feature (1555)..(1557): n is a, c, g, or t
  misc_feature (1559)..(1559): n is a, c, g, or t
  misc_feature (1561)..(1561): n is a, c, g, or t
  misc_feature (1563)..(1563): n is a, c, g, or t
  misc_feature (1566)..(1566): n is a, c, g, or t
  misc_feature (1572)..(1572): n is a, c, g, or t
  misc_feature (1576)..(1576): n is a, c, g, or t
  misc_feature (1582)..(1582): n is a, c, g, or t
  misc_feature (2280)..(2280): n is a, c, g, or t
  misc_feature (2946)..(2947): n is a, c, g, or t
  misc_feature (2950)..(2956): n is a, c, g, or t
  misc_feature (2960)..(2961): n is a, c, g, or t
  misc_feature (2963)..(2963): n is a, c, g, or t
  misc_feature (2968)..(2968): n is a, c, g, or t
  misc_feature (2971)..(2974): n is a, c, g, or t
  misc_feature (2977)..(2977): n is a, c, g, or t
  misc_feature (2980)..(2981): n is a, c, g, or t
  misc_feature (2983)..(2986): n is a, c, g, or t
  misc_feature (2988)..(2988): n is a, c, g, or t
  misc_feature (2990)..(2990): n is a, c, g, or t
  misc_feature (3666)..(4000): n is a, c, g, or t
tttnatnntnnnngncnnnnnnnnannganaganntnnnnnttannannannannnnnntnnccctnnnnnnnnntnnnnnnnancaannnnnntttnnnnnnnannannnncannnnnannannnnnnnannnnnannnntnnannnnnannantnntnnnntttcannntcnccannnncannnncatnnnnannnnnaagggaangnnnannnncatntnnnnnnnntnnnnnnnatnnnnatnnnnantnncantnnnntncnnnnncnnnannnatnaatannaannnnnnnnntnntnatnntnannnngnannnngnnntantnntantantnannnnnnnttnatnnntnnanntgaaantnannntantntnannnnnnnannnnaanannnnnnntcnannncnannnntannngtnnnnntnnnantnnaaannaaanannaannannnnnagnnnannnannnnnantannnatnnnnantcannnnnnnnnaataannanaatnannntnnnnntnnnaannnnnnnncangnannananntnnnnntnnnantaanannnnannantnnnnannantannnnnannnannatnannataannannatnannatcantatcantatnnnnatncnnatnnnnannntnnnnntttnnannnanannnnannnatannnnnaattnnaatngnaannnnnanaatnatantnatantnataannnnnannnatnnannnnannnnantntnattcttntnntnntaatnannnnanannnngnaannncnnnnannntnanaanaanaannannatnnnnnnnnnannnnnnnnnnnncanctnnnantnnnnnnnnnntnnannnnannnnanntnnnnntnannntnannntgananngaaannnanannnatnannntnannnnnannangaannnnnaantanaannnaaannnnaannntnnnnannnntnnnnntnnnganaaanannnnaannnnannnnaanttannatnattannatnnatatatatatanannnnaaanntnnnnnttttnttttnntttnntttnatnttnnnnnnncannaanantannantntnnnnntannantnntnattnntnntnattattattattattnttnttgttgttgttgttgttntnntnntnntaanannnnaanntnannnnantnnantntnnttnnntnnnnnnannnaaatanaaatnnnnannnnnannnntnnnnntccannnnnnncnnatnnnnnnnaaannganaatgnnaanntaannnnnnntnntnatnntaatnanaatnannatgannatnnanntnnntcnnnnncannannaannnnnnnnnntnntnnnnatnnnnatagnaannnnaannnnantnannntnnnnatnnnannannannannnnnaannnnaannataanaannataannntnntantnnnaataaanataannataatnntnannnnnangaannnnannnnaannannnnaannnnnannnntntttnnntntnantantattantatnattatnattattattattattattattattattattattattattatttaataattaattactaatcatgctaaacttttatactatatattttaaataaaagaaattataacaaattataattcaactacttcatccccaattcatcttacagttgatattaaaaatttaaaataccgagcacctactccaaaaaatattaaggaaggaaaatataaatcaatatcaccagatagttattttaatgagtattcaaataataaaaataatagtattgatagtgattcaactaaatataatacaagaaaattagaattaagtaataataaaaatattaaagaaaccgaatcaaaaatggagttttctcttaaaaagggtatttatttatttattttttttttttttttttcatagttatttcataattttatatagatcttaatttttatattaacattaatttatattttgattattataattataattttatttttattttattttatttattttattttaagaaataaaatctgtaattactacaagagaatcaaataaaacttcaattactaattcaaagttgatacagactccatccccaattaaagtaccttcagcagaaaaatatattccccctaatttgagaaataaatatggaattggtgataattctaatccaaattcaaatcttaattctttgnataaatctattctatcatctgatctatttaatgatgtaaacgataaagttaatcacaaaacatcatctaatataaacaaatcatctgtaaaaattcaaagtgaactcactaaagaaattcaagctcaacaatatttaacaagaaataaatcaccatttacaaatttatctttgcctgataacaatagtaatagcaataataataatactaaaaataatagtaataataactgtactagtaataatagtaataaaataattgagaataaggttaatgttattactaataaaaattcattattatttaattctagaagacataaattaaatccaaaaacgaatttaaataataattatgatacaatgaataatgaagattttatgaatgataattttattaattcaaatccaattaataaatattacattaattcttttaatccttcatcttttgaaaattttgacaataatagtgatagtttaactaattattacagaacatataaataactaataataaataaatatatatatatatttccatatatagtttttatataacttttttattttctccatatctattattagtaataaaatataaatattaaacacgaaaattactatgatgcaggttaaaatctattaaaaaaaaaaaaaaaaaaannttnnnnnnntttnntnttttnttnnnnttnttnnannnntnanaaaaaaaaaaaaaaaaactttatgtagattttattattttattactattattcagtcattaacaatagcaacaacaacaacaacaaaaaaaaaaaaaaaaaaaaaaaaaaaaaaaaaaaaaaaaaaaaaaaaaaaaaaaaaaattaataataaaacataataatgataataaagtactataataattacaaatgaaaaatagattttttatgattttagtttaaatatagattaaataaatatatattataatatattatttttttttttctagttattaaatgtagaatttttattattcatttactaacatagtacatttatgaatattaatcattaattatatttgttaacttcatatttattatactatattttttgaatttattttatatttaattttatatttttattaaattacattttattcatattctcatattctttattatttattttatttattttgtgatttgaataattattatttttaataaaaaagaatcattgtactaattttgctttattttattttattttattttatatacttgtacttttatattattacattcaatatctattttattttattttatatacttgtacttttatattattacattcaatccggttaacgcaatatatatttttttattcctagtctaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1216 - DNA, 4000 bp, Escherichia coli
  misc_feature (1988)..(1988): n is a, c, g, or t
  misc_feature (1997)..(1997): n is a, c, g, or t
  misc_feature (2278)..(2278): n is a, c, g, or t
  misc_feature (2280)..(2280): n is a, c, g, or t
  misc_feature (3018)..(4000): n is a, c, g, or t
gcaaatgagctgtgcgaaccttataagtttgatgagtttggcagcagagtttacacagaacttttgggcgctgttatcatttcaattactgtaattgttgttgccattccagaaggattacctctggctgttacgattgctttgagtgttgcaagtgcgatcatgtagaaagaaaacaacttggtgagaaacctaaagtcagctgaagtaatgggtcaagtgactcacctggtatctgacaaaactggaactttaactaagaacgaaatgaacacaatgactgtcatgacaggaaatagagtatttgctattagtggtaaatgcgatgatgcagcgaagaaaaagcttgttgaagagacaaaggactatcttggatctaactgggaagttcttgaacacggtgttctttggaacagtgatgcaaccagaattgaaaataagactgaaaaacaaatcaaggatgagatttctaatggtatcaacaatccaaataaaatggaattcaatggtaatgtgacagagaaaggtcttctcaaattcttccttgctctatacactacagatgtacttgatgacgattataaggcccttcaaaatgtaagagattaactcgaaccagaagatctcctagcttctttcagattcagttccgcaagaaaaatggcttcgatggccatcaagacaggtgatgatgaagtaactatattcgtcaaaggtgcaccagatatcatgttctaacgagcgacccatgttttagcttttgaagatggttcaccagttaccaaatcatgggatgaagaatgtgatgatgtcagtggtattgaaggctgcgaagaaggtgcaacttaccaacaaatgtacggacaatgtgtcaagaactttgctgatcaagcttacagaactatcttggtttcaagaaaagttctcagcatgggagagtgggagtaaatgaaagaagaaaatgacggatttgaaactcaagagagcatggtttgctttgaggaaaacctggaaattttgggcttgtttggtattcaagatccacttagagatgccattgttgattctgttaaaactgttaataaagctggtattaaagtcattatgtgcactggtgacaatttggataccgcaattgctatttcaaagaatgctaaaatcgtgactgatgatcaaattaacgccagtgaagattcgtagagattttcttgcatgactggatcagatttcagaacttatgtttatgacctcgacaaggaagatcccgattattctgcaaaacttgcaggatgtggatttggtgaacctttcgattaaagaaagttcaacatcatggcaaaatacttgagagtgatggcaagatctactccaatcgataagtagttactagtgaagggtttttagaaatctccatacactagtactgaacttattgatgatgataacgtaaacttatgcagtgttgccgttactggcgatggtaccaatgatgctccagctctcaagaaagctaatgttggatttgccatgaacgttggtacagatgttgcaaaggccgctagtgatatcattcttttgaaaaatgacttttcacatattgttactgctttaaaatatggaagaaatatctttgataacatcagaaaattcttgcaattctagttgaccgtcaatgttgttgccatgttcattgtcttctttgggtcagtgattcttaattcatcacccttaactgctgttcaaatgctatgggtcaacttgatcatggatacgtttgctgctcttgctcttgcaacagaacctccagataattccatcttactcagacaaccccaaccatcaagcactgctattactaccaaagtgatgtggagaaatgtcattggacattcaatttaccaaataattgttctcattttggtcatttttgtctcctaaggatgtcttctcccacattatgatatcaaatgcattggtgaaagagatgntaatggtcnttgcccaaaaggataattgaatccattctatgcagcaaatcgctatttctacttgaatactgaaaagtattggaaaacagaaaccgcattggcatggaccgtcgaagattttgaagctgatcttttcattcaatacaattgtgaaaagcttacataggagtttggacacgatgttaagcttaagaaagatttagatgactgtgagactttagatacagtaaaggatttggctaagttccctcttgatacatccgacaagagagccttttcaactattactnanacacctgacagcgttgagaagaaagtctataaagacagaagaagctcaaatgggttgtatatgccttaatacgaatctgcaggagctgatacccccatgttgcttcacatgacgtatctattctagatcttcgtatttatgcagcttttcaaccaattcaatgctagaatgctcaaagaagatgaatataatatcttcagaggctttttcaagaacaagtatttcgtgttcgttgcaatcatcaccttcgttgttcaaatgggaatggttgaagttggtggaaaaatcacaaagacttacccactcaacatggaatagaacggaatctgtgctctgattggttctggtgaactcatttggggtcttttccttaaattcttaccacttagttggttccaattcaaatgcttgcaattcgatgagaagccaatgactccagaggaagaatcaaaatctattaaaggcaaacttaaagcaagttctgttagatatgctggctctgagtcttagagaaagaaggttcaggagcagctctagcaaggtgtccaggatgcataccaaaaaggtaaatggtgagatctaaaccaaatcaaattttcttagataaatatgacaaaagttttcaatattgctgaaacatatacaagatactacattgaaaatatattcatttttctgaaaaattgatataaaaaacataaattttaaagccaatatatttaatatatagatgaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1217 - DNA, 4000 bp, Escherichia coli
  misc_feature (1989)..(1989): n is a, c, g, or t
  misc_feature (2543)..(2544): n is a, c, g, or t
  misc_feature (2579)..(2579): n is a, c, g, or t
  misc_feature (2611)..(2611): n is a, c, g, or t
  misc_feature (3239)..(3239): n is a, c, g, or t
  misc_feature (3871)..(3871): n is a, c, g, or t
  misc_feature (3978)..(3978): n is a, c, g, or t
gattttggccgggtctccagaagactctctgacgatccatcgctgcgctggctgggtccgcacaaaggtgtcgtacacctggcgctggcttcgattaccaacgcctgtttcgatctgtgggcgaagagccgccaggtgcccttgtggaaacttctcatcgacctcacggcggcggaggtggttcggctcctggatctgagctacttggaagacgtcctttgccaagcagatgctctcgaactcttgcgcgaaccgtttgggagccgtgccgagcggaaggggattttgaaaaccggatatccagggtatgacacttcagtgggttggatagcttacgacgacactaaggtaaaggaattaacggaacgcgccattgaaaacggattcaaagccttcaagctgaaagtgggttcggccgacgaaaatcgcgatttgcgccgggctcagatgttacgcagctcgatcggcggaagtgccgctttgatgtttgatgctaaccagcgctgggatcttaccaccgccattcgcatgtgccgcagcttgggggcgtttgagcccttatggatcgaggaaccgactcaccccgatgatattcacgcgcacgtggtactggccggagaaatcgctcctgtaaagattgcagccggagagcacattccgaatcgaattctgttcaagaatttcatgcaggccggagccctgcactacgtccaggcagattgcactcggctggccggagtaagtgagttccttaccgtgagctttcttgccaagaagctcgggtttccggttgtgccccatgtcggcgacatgggacagttgcatcaacatctgcttctgttcaatcatattgcgctggggcacgaggtcctgttccttgagcacatcccccacctgcgcaatcattttgtgtttcccgcgcgggtcaacgacggacgctatgagacgccacaggagccgggtgcatcgtgcgatctcaaggtgaccgtagggccgcgtaaagtcatatcttccctggcttagagtggttgcccgcctcgaaaggacttcttgtggacaccctgaaatcaaacctcgaccacgcagagattgccatctggaattcggaaaactggctgtatgaagattttgaggttggcaagcgcgcacgttcaattcgccgaactatatcggagggcgagagcatgatgttcaacgcgctggtactcgacatgcacccgtacgtggccgatgaagttttcgctcatgaggaaggcatttttggcaaacgcctggtagctggcgcaatggtgttcagtttaggtctggggctgatggcccacaacaacattcataccttttcttacggttatgacaagttacgttttatcaagccggtgtttattggggacacgatctacacgatccgcacccacaaagagaaatggccgaagtaccccgagcttggtatggtgcgggtttcctacgaggtgttcaaagtgccgggagaattagtgctttattgcgaacatttacaaaccgtaaagtatcgcaacccggcggcattcaaagatcaaatcgaacgcaaggcgacttgaacacggcccgttcaattttcgcgcttctccgcaggacactgaaagagtgtggctgcgtgaacatcgctcgcgcaccgcagcacactcgaatctcctcacagacatgaagggggaacatcctgcctacgcgtccccaccggaaccgggctctcttatgactagaatgactatgatgacctcaatgaggcttggcggattagttatgggctcgcaaagctggaccgtggctgaagccaaggcaaaattcagcgaaattatcgagaaagcaatgtccgaggggccgcagaccattactcggaagggccgcactgcggctgtggtcgtcggggcagaggaatggcaacgaaagacaaaacgcgttggcaacctggcagaattttttgccgcatctcccctgcgaggatcgggtctnaagctcctgaagcttcgtcggctgaaagagcggcctcggaagactaatctatgagtttctcctggatacaaacgcgatttcggaatgggtcaagccccgacccaatccgggcctcatcggttggatggagtcagctgatgaggatcggattttcatcagtgtggtctcgttagctgagatacgctatggcgtggaacacatggcggcgggaagacgtcggaaccggcttgaggattggctacaacatgaattgccgttgagatttgaagctaggattttgcccgtcgacaccaaagtcgcggatgcctggggtaaaacggtatcgcgcagcgaagcggcagggcgtccgataagcgcaatggatgcctttctagcagcaacagcagaaatccatcgcctaacgctggtgacccgtaatgtttccgactttccactgtttaaagaagtttctcaatccttggacttagactccgctcactgatctcagttcacccgattggttcttcccgattcaaatcctgcccggccagccacatgtgaatgaaagcggggcnngctagttcagtaggaagaacacggctctcataaanctgttgcgcatggttcgaatccatcgcgagcnaccatggagcgcctccggcgaggggcagcggcttatacccacttctccgcaggagggtcgctggcaggacgatcgcctcaggaggagcgctgcgcgacggcaaggactgccaatgcggccagaatgattgccatgccagcggccaggaagagcttgcttggcgctgagactccgtcccactcacccgtaacaaccccggccgcgttgctggtgataatgatcatgcccatcaacagcggccacccgattaccacgccgagattgcccatgtgagagattccaagaccatagagggcttgaccaccaaaccagaacagtcccatgagagcgccacaaaaccagccggtcctggccccttctccggcaaatttactcaaactgtggttctttcgcagaagatagccgcaatagatcagattggcgagaaatcctccgcttaccgcgagagccgtgacgactccggttgcccacaaactgctcgtaccgaattcgcgagcgtgctttaccgcctccccgccgaaggcgtaggaaaaattcagggtcgaggaaagcaagccggaaagacagcaaaccgtgaagcctacccaaaaggacgtccggggagaatcatttggtgcctggttcctgnccgcgtcccgcaacactcctgctcgtgcgctcaccgcgatacccaccaacataatggcggtgccgatcaggtatgtgtgtccttgtggggtgtgcaactgttgtggcgtcagaaccagcagaggtatgagcgaaccgaccgaggcacataagcccaggatgatcgccatccctaaaccgatgcccagcatggtgagccccaccccggtcagggttgcccccatcccccagcacacgccaaagccggcaatgctcaccagcgtttttgtcgaactggcggcataaacctgtccggtatgaggtaccgtcagtgtggtgaggagccatggcaagaacaccattcccgaaaggcaaaaggcgagccagatgttttcgtagctccatcgtcgagcatatttcatgggcacagcaaagacaccttgcaacaaccctgcgaggataacggcgcccaccgccagccagagctgtggggtcatcgcggggtcccagcggcaatttgtgccacacgctcatccgcctcctgcaacaaaacttccacgtttcgctctcctgagtttgcttctgacaccatggcatcaatgatgtggttgatctccggccaagtggtcagcgaaggaatttcacgggcattgncgtggagcgtttccaaatcgcgatagaagggaatcctttgattgatttccggatcttcccaggttgagcggcggcatccgatgccaccttccagggtaagcagcttntccatgcgtttgctggcacagt

SEQ ID NO: 1218 - DNA, 4000 bp, Escherichia coli
  misc_feature (266)..(266): n is a, c, g, or t
  misc_feature (272)..(272): n is a, c, g, or t
  misc_feature (290)..(290): n is a, c, g, or t
  misc_feature (368)..(368): n is a, c, g, or t
  misc_feature (377)..(377): n is a, c, g, or t
  misc_feature (443)..(443): n is a, c, g, or t
  misc_feature (449)..(449): n is a, c, g, or t
  misc_feature (564)..(564): n is a, c, g, or t
  misc_feature (603)..(603): n is a, c, g, or t
  misc_feature (1020)..(1020): n is a, c, g, or t
  misc_feature (1353)..(1353): n is a, c, g, or t
  misc_feature (1464)..(1464): n is a, c, g, or t
  misc_feature (1498)..(1498): n is a, c, g, or t
  misc_feature (1503)..(1503): n is a, c, g, or t
  misc_feature (1506)..(1506): n is a, c, g, or t
  misc_feature (1551)..(1551): n is a, c, g, or t
  misc_feature (1565)..(1565): n is a, c, g, or t
  misc_feature (1578)..(1578): n is a, c, g, or t
  misc_feature (1707)..(1707): n is a, c, g, or t
  misc_feature (2191)..(2191): n is a, c, g, or t
  misc_feature (3111)..(3111): n is a, c, g, or t
  misc_feature (3427)..(3427): n is a, c, g, or t
  misc_feature (3978)..(3978): n is a, c, g, or t
gtgcacttgatgatgccatgagtaaaatcaagaccaacattgatgcttggcttgagtttgatgttgatgtgattatttccagtgccagcggttgtggtttgatggttaaagattacgcatcaatatttgatgagtatgatccgtattatcaaaaggcgatcattatttcaaataaaacgaaagacattgctgaatttttagtagataaggatttaacgcaacttaatttagaaagaactaacgttgtttatcaagagccttgcacnatgcancacggtcagcaattaagnggcttggtaaattctattttgaccagtttgggctacacaactacaccagtggttgattcacacttgtgttgtggttcngcaggtacntattcaatttttcagccaaaattagcccaaactttgaaaattaataaattaaagcatttgcaggcntccaanccgcagatgattgttaccagtaatatcggttgtttaatacacctgcaaaaaggcactaaaataccggtcaaacattggattgagttgttaaatgggtagaagaagaaaaccaaangccaaaacctacgaattagaaatcgaatcgctttcacangaaggtcgaggtattgcgcattttgaagaaaaagtgatttttgtctctggtgctttaccgggtgaaaccgtgattgctgaccgtaccttttctcgtgctaagtttgaagaggcggatgtcaaggaagttcttaaagcggcgaataatcgcatcacaccaaaatgtgaagtatttggtatttgtggtggctgctcgtttcagcatttgtcgagcgaagatcaaatcatcgctaaaggtaaatggctaaaagatgctttgatgcaacaagctaagacagaacctataatttggctggagccgcttcaagttgagagttggggttatcgtcgcaaggcaagactcggtgtgcgttacgttgctaaaaaagaaaaagttttggtgggttttagagaaaaaaaatcttcattcataactaanatgagtcgctgtgaagttttgcatccttcacttggcgatcatcttgaagatctggcacagtgcattgaacaattgagcgtcaaatctcaagtgccacaaattgaagtggccattgctgaacaagacaccgtgttgattctacgacatttagaaccactgaatgctaaagatgagcagatattggcagactgtgcccatgatcttggctttacttggtacacacaaagtggtggtctggatactgttaagcctttaaataagtcagtagtattgacttattctcatcctaatcataatattgaaatggagtttttaccgactgattttactcangtgaattttaagctcaatcaaaagatgattaatttagcgcttgaattacttgaattaaatgaatccgatgaagtgattgatttattttgtggattgggtaactttaccttnccgattgcacgacacgttaaacacgtggttggtnttganggngatttaggtttgattgagcgcgctaaatacaacgccgatcaaaanaatataacgaacgntgatttttacaangctgacttgtttcaagaagtggatggttttgagtggtttaggggtaaaaattacaacaaagctttactcgatccagctcgatccggtgcactggaaattgttgaatttttaccaaaacttggtattgancgcttggtgtatgtatcgtgtaatccggccactttagctagagatacagcgcgtttaatcgagttagggtataaactacaaacagccggcgtgatggatatgtttccacaaacggcccatgttgaatccattgctttatttactaaatgattacaattaacatttcagaacaaacacttgagtacaaagataaatcttatttaatcagtagcgcgttaaatggtgtgggtgaagttgaaggttcttattgtacgccgatagggaagtttaaaatttacgctaagataggtcaggatcttcctgataattcagtattggtatcgcgccaagcaaccggcgagatttacaacaaagcattgtccatccaacatcctgatcgagactggatactaactcgtattctttggttagaagggtcggaagagcgcaatcaaaacaccaaggatcgatacatctacattcacggatcgccagacgaaaccanaatgggaaaaccaggatcaaaaggctgtattcgtatgcgcaataaggatgttgttgagttgtttgagaatgttcaaattggtgaagatgtcgttataatgaagtcatgagtcagttagtacaatacttgccaaaaaaagcctatgagcatttacaagaaaacgataatgcttttttgatagacgttcgcactgaagccgaaaacaagtttgttggtagaccgcttgattgtatttttgtaccttgggtggatgagccagattgggagccacacccacaagagttcattggtgcagtaaaacgttttattggtaagcgtgatcgtattttagacactgaaattattttgatctgtcgcagtggttatcgttcagacgatgctggaaagtgcttaatagatcatgggtttacaaatgtagcacacattgtgagcggctttgagggtgaccttgatgagagtgatcagcgtggtaatgtgaatggctggcgtcacgatggcatgccttggaatcaatgttagtgagttatctcgatagtattaagttgttcgttcatcctcgagtaataaccatgctatttttgggtttttcggctggaattcctattttgcttattttttcaacgttaggcttatggcttaatgaagcgggtgtagcaaaatccaccattacttacttttcatgggcagcactaggttactcctttaaatttgtttgggcaccattggttgatcgcttacctttgccttttttaacacactttttaggtcgtcgtcgtgcatggatgctggtttctcagctggccattatgggctctattttgttaatgtccacagtggatccaaaagccggtgtaagcagtttagagatacttgcctatggcgccgtacttttgggtttttcctcagccacgcaagacatngtaattgatgcttatcgcattgaatcggctgatcaagacatgcaatccatgctttctgccacttacattgcaggctatcgaatcggcatgttggtagcaggtgcaggcggtttgtttatggccagttatctgggctctaccaaagagttatacagttattctgcatggtctaatacttacgtcatcatgtctggtgtaatgctgattggagtgatcaccacgctgattgttagtgaacctaaatctgaacaaaaagaagtggaatacagcacacaagattacgctcgatttttcttattatttttatcggttgttnctgtttttattttgacttttgtatcaacatcagatttggtgaaagacttaaaaggatcattgagtgcggttttttccaataaacatttagccggttttattgtaggcagtttgcgcatggtattggctttagtgggtgcttacgttgctgcaagagtgttgattgcgtttaacattgtgaaccgatccatggttaatagtacttacgtggatccgattaaggatttctttaatcgttatgggttgaacgttgcgctgttgtttttagccgtgattggcttgtatcgaattagcgatattgtgcttggtgtggtggctaatattttttatcaagacatgggttttactaaagttgaaattgccacaatctccaagacattcggtttgtttatgaccattgccggcgggttttttggtggggtaatggcaatcagagttggtgtatttaaagtgttatttttaggtgcattactctcatcactgaccaatttattgtttattgttttagcaaatgtgggccatgacattacctggttgtacgttaccattacnatggataatctttctgccggat

SEQ ID NO: 1219 - DNA, 4000 bp, Escherichia coli
  misc_feature (3141)..(3141): n is a, c, g, or t
  misc_feature (3536)..(3536): n is a, c, g, or t
ggtgatgatcagtgggccgacattgtccgctggatttataatgcgactgtagcagctgaggaattaggtgtttcatcatcaaacgtggacagcatgaagggttccaataaccctgaaattctgcgtcttctcggtgttgaaggcagtcaaggcgaagagcttggaatgagcaaagactgggcttatcaggtcattaagcaagttggaaactacggcgaaatattcgagcgcaatatcggtacaaacacaccgattggcttggcccgtggtttgaataaccaatggactaagggaggacttcagtattctccaccattccgttaatttttattaattaacgtttttgtttttaagcgcacatgttcttttcaatgggactgtgcgcttttacatttgaaggaatcattttcactttttagttaacgggaagttacttacaatgtcctcagcatcagtaactgcaaatgaacccatgctcctgttacgtttgtggcgtaatcaggaataccgctcagtttttattcagatcatgactatgctgatcctgttcacatttttgggaatgatcggcaacaatgtcgcaaacaacttggagaaagcaggcaaagacttcagctttgcatttctaagttatcctgcaggttatgatattaccttccagcctttcatttctttttcacccacagacacccactttagagcagcaattgtcggcttattaaatacccttttagtagccgtttcaggagttattattgcgtcaattatgggtttcaccatgggaatcttgcgactttcgaataactggctggtcagcaagctagtttacgtttttcttgaattcacccgaaatatccctgtacttttacatattttctttgtctacagtatcttcctgtatgttctgcctgttcctaaaaaagcaatcagcctttcagatacggtctttttaactaaccgtgggttttttataccctcacctgtttttgaggacggctttggttatgtctggttagcgttgttgcttgcaattgtggcagttgttgtctttgtcatctgggaacgtaaaaatcaggatcaaactggagagaactatccggtgattacaatttctgcagctataataatcggcttacctctattgacttatttcatttcaggttctcctctgtcctgggaagttccagccattaagggtttcaactttaaaggaggatcctcgatcaagcctgagtatatagctttgacattcgcactggcctactacacttcatgttttatcgcggaaatagtacgcgcaggaatcttagctgtcagtggtggacaatctgaagcatcccatgcactgggattaagtcacggcaacactttacgtcttgtcgtaattccgcaggcactgcgtgtcatcattccgcctctggcgagtcaatatctaaatctgaccaaaaactcatctctggccattgccataggctatatggatgtggtggcaaccatcggagggatttccctgatgcaaaccggcaaagagatggaaacaatgattttcgtcctaatgacttatttaattatttcattaataatttctgcctttatgaactggttcaacaaaagaatgtcattagtagaacgctaaccatgattgaattgtgagtaaaaccgtacaacaagaatttgcaccggggactcatccggacttaccgcctcctgtcaacacgactgggattattggctggtcaagaaaaaatttattttcttctccgctaaatacaatcctgacattactggccatgttgttgttgtggaaaagtctgcctccgcttttcgaatgggcagttatcaattctgtctcaactgcagattcacgtgaacaatgctggaaccagatgtcttctcctggcgcaggagcgtgttgggcatttatcaaagaccgtgttgaacttttcacttatggattttatcctccacctttacgctggcgtgtaaatatttcttttgtactgcttgcattagcagtggttccggtactttatgaaaaattaccgtatagaaaatacggactgatttattcagcagttttccctttcattgcaggctggttgctggtcggaggatttggattagagcaagttgacaccgatcagtttggcggcattatgctcacgttgatcataggtgttacaggcatttcattttcgttgccgataggcgtcgcactggctcttggacgtcagtcgaatatgcctgtgctgaaaattttgtgtgtgcttttcattgaatttatccgtggagttccgctgattacattgttgttcgtcgcctcaacgatgctcaattattttttaccacccggtaccgtctatgccttgctggtgcgcgtcttaattatggttacactttttgcttcagcctacatggcagaagttatccgcggcggtttgcaggcaattgccaagggacagcatgaagcaggtgattctcttggacttacatactggcaggctcatcgactgattattttaccgcaggccatgaaaatttcaattcccggcattgtcagcactttcattggtctttacaaagatacgactctggtactgatcatcggcatgatggatattttgggactcggaaatgcttccttagcagacgcgaaatgggcaggactagccaatgaggtttatattttcgtagccttatattttttcatcagttgtttcagcatgtcacgttactcactttatcttgaaaagaaacttcacactggtcattaagagttaaatactcaactaaaaaatctcatgtctactacagccgatacaaaagaaaatgaaaatgaagtcatgatttcaatcaattccatgcataaatggtttgatgattttcatgtgctcaagaatatcaacctcgaagtaaagcgtggagaaaagattgtcatctgcggaccttcaggttccggaaaatccactctcattcgctgcatcaacaggttagaggaacatcaaaagggtagtatcattgtggacggtacagaactgacaggtgacctcaaacacattgaaattgtacgttcagaagtagggatggtttttcaacattttaatttatttccccacctgactgttcttgaaaactgcacgntggccatgatttgggttagaaaaacaccaaaagctgaagctgaaaaaatagcgatggaatatcttgaaagggtgaaaatcccggaacaggccagtaaatttccaggacaactttcaggtggacagcagcagcgtgtcgcaatcgcacgttcattgtgtatgaaccccagaattatgcttttcgacgaaccgacttccgcgcttgatccggaaatgattaaagaagttttagacgtgatgattgaacttgcggaaagtggaatgaccatgctcgtggttactcatgaaatgggttttgcgactgcagtcggtgattgtgttatcttcatggatggaggagaaattatcgagaaaaatgcgccgaaagagtttttcaataatcctcaacatgaccgnaccaagctctttttgagccagattctttaacactaattggaacggttcatggatgagctgaacatcgctccagcctttccggatattgcagtgtctgcttccgagttccaggttatgcacttcttccggaatatattgcaaaaaataccgacacttttagtcgcgttttttacagtatccctgttactcagtacagcttcacaaccccttcaggcgcgtcacaagtgtcctaaagttccggcacctccgggattgatgggtgttttcagtagttccactcttataccttctggcagcacgatggcagcagctcgttcctccgagacttccggatgtgagcatggtcatccctcagacaatttttacaaaccgaagaccaaacgtctagctttgttcctcaaagataatttcctgcagctaaaactggaaggtgctcagggtcagggtcagcatctggatgcact

SEQ ID NO: 1220 - DNA, 4000 bp, Escherichia coli
  misc_feature (27)..(27): n is a, c, g, or t
  misc_feature (66)..(66): n is a, c, g, or t
  misc_feature (69)..(69): n is a, c, g, or t
  misc_feature (340)..(340): n is a, c, g, or t
  misc_feature (584)..(584): n is a, c, g, or t
  misc_feature (612)..(612): n is a, c, g, or t
  misc_feature (732)..(732): n is a, c, g, or t
  misc_feature (3480)..(3480): n is a, c, g, or t
  misc_feature (3519)..(3519): n is a, c, g, or t
tcaactgttttaaacacatcaagtganagctttagaaaagcatttttaattcaatatccaagtaanggnatctgggttattgcttttcaatcgggtgactataaaggtgaggtagaaagcattattgggaaagatgttattaatttgtttgttccaacaacgccaaatccaacttcaggcttttttgtgatgattccaaaaaaagatgcagtcgagttacaaatgagtgttgaagaggcgtttaagctagttatatcagcaggtgttgtgacacctgaaaatttaaaaattaaggaaaaaaaatgaggacacatttttgtggtgaactaaataagtcagntcttgattcacaagtaaagctttgtggctgggtcaataggagacgagaccatggaggtgtaatatttcttgacgttagagataaaaaaggaatcgcccaaattgttatcaatccagatactgcagatacttttaaattggccgaaacgattaggaatgagtttgtccttcagataactggccaagttgttgctagggcgagtgagatggttaatagtaaaattccaactggtgaaatagaagtncttgcttcacacattgaaatattaaatncgtcaaaacccattccctttcaacttgattcgatggaaacttctgaggaggtgagacttaaatatcgttatttagacctcagaagagatgagatgcaaaagcgcttacgtctcagatcanaggtaacgcactttatgcgtgactttatggatagcaatgactttctagatattgagacgccttttttaactaaagcaacgccagagggagcaagagactatctcgttccatcaagaacacacgaaggtaacttctttgctcttcctcaatcgccacaacttttcaaacagctcctaatgatgtctggttttgaaagatactatcaaattgttaaatgcttcagggatgaagacttaagggcagatcgtcaacctgaatttactcagcttgacgttgaaacatcctttatgaatgaagatgaaattacctcactcatggaagaaatgataagaggacttttcaaagatgtgggcagtattgatctaccttcgaaatttccaacgattacctataaagaagccattaatctttatggtgttgataggcctgatatgagaattccacttcatatggttgatgtgaatgacatcatgaaagatgttgaattcaaagttttttcagggcctgcaaataataaaaatggaagagttgctgcgctcaaagttgaaggtggggcatcaatcagtcgtaagcaaattgatgactatacaaaatatgtaagtatatatggcgcaaagggtttagcttatattaaacttaatgaagatggcccttcatctcccattattaaattcctaggtgacgatgtcactcaaaaagtcattgacctaacagaagcaaaaactggagatattatcttttttggcgctgataaatctaaagtagtcaatgaggctcttggtaatttaagggaaaaacttggtcatgatttaaacctctacaataaagaatgggctcctatttgggttctcgacttccctatgtttgaggttgctgatgatggctctcttaatgccattcatcatccatttactgcgccaagtgttgactcaaaaacactgatagataaccccgaagaatcactctcaagggcatatgatttagttataaacggttctgaagttggaggtggatcaattcgtattcaccagagtgatatgcagaaaactgttcttacacttcttggtattgatgacgaagaagcaaaagaaaaatttggatttttacttgatgcgcttgactatggttgtccgccccatggtggtatagcttttggcttagacaggctagtcatgacccttagtcaaactgaatcgattagagatgttattgcattccctaaaacgcaaactgcggcatgtttattaactgacgccccctcaagtgtatctaaagcacagcttaaagatttaaacattaaggtgactcttccgactaaagtttaataatgcaaaacattgaaatagaacaatcgattgaaaattcaattaaagatgcacttaaggaaaataacgcaactttggttgcccattactacgtaagctctgatcttcagaccttggctgaagaatcgggaggtattgtctcggactctcttgaaatggcaagatttggtcagaatagtgatgctgatacaattattgttgcaggggttaaatttatgggagaaactgctaagattttatctcctgaaaagcgtgttctcgttttagatactgaagcaaactgctcactagatttatcatgtccaatagacgaattttcaaaattttgtgatcaaaactctgatcatgtcgttgttgtctacgcaaacacttctgcagaagtaaaagccagagcggactgggttgtaacttctggtagcgcactaaaagtggtccaaaagttacacgatgaagggaaaaaagttctctgggccccagataaacacctaggtcactatgtgcaatcgatgacaggtgtggagatgctcatgtgggatggagcttgtattgttcatgaagaatttaaagcagaaggactcaaaaggcttatggagatacatccagaggctggtgtattggtccaccctgaatcacccaaagaggtgatcgcacttgctgatattgttggatcgacaactcagcttatcaatgccgctgcatcaaggcctgaaaacacctttatagttgcaactgataacggaattttccataaaatgaaagaggcagcacctcacaaaaaatttattgaagccccaactatgggagagggagctgattgtgaatcatgtgctcactgtggctggatggcaatgaataaccttgaaaaatgcttagatactttaaatactggtaataatgaaatcctcatcaataatcaaattattgataaagcaaaaaattcaattcagcgccttctggactttactaagtaactataggagaaactttaagaaaatggcaggacacagcaaatggcacaatattcagcatagaaaaggtgcgcaagatgctaagcgtggaaaaatcttcaccaagctcattaaagaaattgttgtagcggcaaaaatgggtggcggggtcctagaaaataatccctctcttcgtgctgtaatagacaaagctctagcagcaaatatgaaaagagataccattgaaaatgctgtaaagcgaggctcgggtgatttagatggtgaaaactatgaagaaattcgctacgaaggctatggccttggtggcactgctattatggtagattgtctgactgataacaaaaaccgtaccgtttctgatgttaggcatgcattcagtaaacatggtggaaaccttggaacagacggctcagtatcctacatgttctccaaacaaggttttataagctttggtnctggggatgaggacacaattatggaaattgcaattgaancaggagcagaagatattatctctaatgaagatgggtcaattgatgttgtgacgactccagagaatttttttccagtcaaagatgcattaattgctaaaaaccttatacctgatcattcacagatcactatggagccagctaatagaatcgaactcaatcttgaggatgcagataaatttatgaagctaattgatagacttgaagatcttgatgacactcaggaagtctatcataatgctgatatttcagacgaaatactgtctgaactatgatcgcttttcatactggaattcaagcgcttagaaattttaaagtaaaagcacttaataagaaaattagtgccctcatccctaacattgagctaatctcttctgaatatattcactttattgaatcaaaaaatgatctcaacacttcaaccagatcttctcttgataaactcttaaattatgctccaaaagcgaatctactaaactcaaac

SEQ ID NO: 1221 - DNA, 4000 bp, Escherichia coli
  misc_feature (2329)..(2329): n is a, c, g, or t
  misc_feature (3303)..(3303): n is a, c, g, or t
aaatgatcccttatcgtcttgaaataggtttcaatcaacaggtttcgatcgatgcgctaaagcaatttttagtcgatgaggccggcgttgaaagggataaaattgagattgttgagtttttagctaaccatacccgtgttaatttgccggagggtatgccgaatgatatttttcagcacttgaagtctgcttgtcttaatcgcagagcattgaaaataacctgtttaggggtcagtcaaggaaccggaaaatcatttaagagccgacctaacaggcgctctaagaaacactggaataagggtaaaggtaatcctgttaaggaagaacggtagaaccccctgagtgcttatctacgagcgaattatagatcataaaatataggatataaatgcaaatacaatatattaatacccctgagaaattagcggttctttgtcaagacttagccggtgccccttggctggctcttgatacggagttcttacgggagaagacctattattctaaattttgtttgttacagatagcaacgccttcattggtcgcttgtgttgatccgttggcattagagaccattgataatctcttagatattatttataaccctgaagtagttaaggtttttcattcagcgcggcaggatttagaaattttttatcatttgcgaggttcattacctacgccggtatttgatacgcaagttgctgcacccttgttagggtttcaggataatcccggatatgcgatgttagtgtcaagttggttaaatgttaatttaacgaaagaacatacccgtacagattggagtagtcggccactttccgaaggtcagattgcctatgctgcggatgatgtgatttatttggctgaaatttatcaacgaatgcttaaaaagttaaccgatttaggtcgtttgacttggttgaaagatgattttgatcatttgagtgacgtgactgtttatcaggcaaatcctgagctagcgtggttgaaaataagaggcttaaagaagttaactaaaaaacaattatcggtcgctcaaagtttagcgcagtggcgtgaacgtagtgctcagcaagagaacaggccgcgaaattggttattaagggatgatttgattattgatcttgccagattgcagcctaataagattggtgagttgattaaggtacgtaaccttcacgaacgtacagtcaagcgtcacggtcatgagttatgcgcattgatacagcaggctgttcaggaagagcctgttccgagggtggcgacggtaactaatgcagataaaaatcatcatcatgatgccattgtggatgttctgaatgcggtcgttcgtatcagagcgaaagaaaactctataagccccagtgtattagcaagtcgtaaacaattagatgaattgctgcaaaatgcttctgaaagttgtttattgcaggggtggcgcgctagtatggtgggtaatgaattattggctattatttcaggggagttgtgggtcggtgttgctgcagatactattcaaattgcttcccctgaagaaattagtaacaaccctggtcagtaatggttaaagcggaacagccctcaatagaaaatgcatttaatgtagcgcaggttcggttaattaataacagttatacgcgggttttaggcgaggcattgttattcggttatcaaaatgaaagagcgttggcagaggcgctctttgaggccccctttgtagttatttcccatgatgttgccagcgatccggtgtttaattacggtaatcaaatggcgctttcattatttgaagtgacttgggctgaactggtgagtttaccttcacgcttttcggctgagtcggtagttcaagaagagcgatcagacttattagagcgcgtaaaaaaagacgggtttattgctgattaccacggtattagagtgtctaaaacagggcgacgttttcatatagacagggctgttgtctggaatctttttaatgatcaaggcgcttatcaagggcaagcggcttgttttaaagaatggcgatttcttgattaaaatgatctgttaggcagtaaatggtagggccataaaaaagcccggtaagaaaccgggcttttctggggatgagtcggctgtcaaacgtgactatcgctcaccgctgaatgcggctaataattgtaataaactcatgaacaagttaaaaatagatacatataaggtaaccgttgcgagaatataattagtttcaccgccatgaatgatggcgctggtttgaaataaaatcatacctgacatgagtaaaatgaacatgccggatactgcaagagagagcgcaggtatngagaacaccatggctccgatgcccgctagaaaggcaaccagtacacctaccattaaaaatccagacataaagctgaagtcttttcgggtggttagagcataacctgataagccaataaagataacacctgttccgcccaaagcggtcataatcaattcgtggccattactgaatgcatttaaatacatgttcaggattggaccgagtgttaggcccataaatcccgttagggcgaaaacaaaaatgattccaaggccgctgttacaaaatttattggttaaaaaaagtaaaccaaaataaccgaccaaggttatgatcattccagggtgtggtaaattaagcgccatcgcagcacctgctgtgccggcactaaaaagcaatgtcagggacaataacatataggtattacgcaatattttattggtagacagaatgctttcttctgaacgggttagggttgaatttaatctcattgctgtaattcctcttaaataatagtattgggtacaaaaaaatttgacagtattatcctacaagagtttctttggatatgtaaggagcctgtgtaaaaaataaccggatcaaggatctataatggattatagtcgttttttaagggtttattaaatgatcagttaataacattttcagttttcaaccgatcaaaagcggtttttacggtttctgttgttgctgatatttcaagctggctgtgttgaacaggtgcttggctagcacagagacagatcagtcctgattggttaattaactgtgcataatatgcgttttgggcgctgtcaccttcaagtactgttgcggcatgaccggtatcaaaaagtcttctttctaattgataggccagattggcatgattgttaccggttatgttgatggtcatcgcttgttgagaaaagcgggccgctttttctgccatactcaccggttggagttgatcattactgtcaatactctcngtaatcatacccgcacccacagtcacattgctaagtcgatcaataatgacaaaagcaccggtgctttgattcgttttataggtgtcaaaaacgatcggtgcattgatggctaaactacaagtgccaatttcatttaaatttaattgctcggcttctatttgtgccagtgtgttgacatcggtacggtggtgtattgatgaaatggagccagaaacactgcgcgatgcacatttgaagatgtattgttttcccgggatcatggcggtttcggtcatccagacaatttcagctttgaaatggtcgctgatagaggggctttgatcagataatacaatcatgtcgccacggctgatgtcgatttcatccgttaaggtcatggtgacagccatcggtgggaatgctttttctagttcgccgtcataggtgactatcgatttaattgtgctggtctttccagaagggagtgcggttatttgatcaccggtgttaaaaataccagacgcgactgtcccgcaaaaaccgcggaaatcaaggttgggtctgttgacgtactgaacgggaaagcgggcatctgtgaaattacggtcattagcaatttcgacactttctagggttgccattaagggcaggcctgagaaccagggcatttcggtgctccgatgaacgacattatcgccctttaaggcagaaataggca

SEQ ID NO: 1222 - DNA, 4000 bp, Escherichia coli
  misc_feature (227)..(227): n is a, c, g, or t
  misc_feature (2255)..(2255): n is a, c, g, or t
accgatggacgacgacgccaagccgaaatcgctgtggaagaagcgaaaagagcgagcaaagattcgggccgaggcgcgggggacatcggaggcgccgcatgggtatcacgggggcgcgcgggtgttgctcgtgggcgacggaaacttgtcctttgggttggcgttggcgacgctcttcgggaacgacgcgtctggactcgtcgtgacgtgtaaagaggcggagcatntggcgaagagggtgtatccatcgtgttctgataacgcggagacgctcgaggcgtgcggggcgacggtggtgttcggggtggagtgcgaagcgctcgccggggcggcggctgagttgcagcgaagcgtcggcggcgcgttcgatcgagtcgtattcaactttcccgatgccggtgtgggtaaggtgggcacgctgagcgttggtgtgcagagagcgctcatagcaagcttttttgagcaaggaccaaagcttttaaagcagaatggtgagctgcacttggcgacgcaaacctttgcgccgtgcgcagcgtggaacgtggagggactcgcagccaaggctgggttggtttttaaagcgtgcgtagagtttgatccgagcgagtttccgggatacgagtactgtcacacccctggggaggatgagacggaagaaatggtgccgagagaggaggatatcaccgcgggcgaatgcgtgacgtacgtcttcgtcaagccgcagcgttgattgagcgcttcctcaaggagacgcagagaacgatgcgaggaaaacgtttattagtaacagagaaagtagttgtgagattgatcctatggaggctcggtgttgtaaattaaaaatacctgaagattcgaggtgtttgccaataatttttgtacaaatacgtcgtcattttttatcgcggggttggttcggagttcagctttattcgtcaaagtccgggtcaccgacgacgtagccagcgtattggagcatcggtacgacgaaggagatgacgagcaagccgatgacgacgttggcgaagacgtcgcgcttttcgttggtttcggcgcgcgtcttgaagttgctaccctttgccgcttggtacttctccggcggacccggatcagccttaccctccaaaacggcggagatacgcttcaccgaggacaccaacgcttcgttgtacttttcttgctcgaggttaaccccgtagttgctcgtcaacacgctatcgatgagcggatcaccgacggctttaagaaacttgggcccgcccacgatggcgccatccttggtagacttgaccaacaaaaggttacccttgttcgtcccttcctccaccgtcgggtaccagttctccagcgctttatccccgaacgcaaacggatccgtttcgaacacgagcttacgcacggtgatgacgttcaggtgataccccgtctcgtcctccagctgcttgagctccttgttgatggcgctcgccgaggatcggctcatcaacccggcgtcatcgacgatgtacccctctgtcggtttcggcgtcgccaaaatttcaatctcacccgcgttcgcggcaccaccgctcaggcccatcgtcgccgcgagcgcgagtccaacgcacgtctttttcgccgcatccatcaggtcagccgcgatcggcatcgccggtttacgaaccgcagtcatcttcgccgcgtcaccgcggcggcgcgtcgccggcgctctcaccgagaggttcgcctttgtcgtcgtcttcgtcgtcaacatctctgcttgcgtccgtcgtccgtcgtgcgtcgcgcgctgacgacacgccgttcgaagggccgaccgagtcacctgagtcagacggacagaatggcttcggttgacgagtcattactcaaacaagttacacagggtcgacgaaccaccccttgtggatacgatttgtcttgcaaaaacacgtgcgttttgataggaattaaagttttcttggatggcatgagaaactaagattacaggatacgaatgtccgataaatatttagtagtggtctatataaatattattcggacgttcgacacataataatctatgtatcaagtggattgttgtacatgttgtaccctatctgtatttttgtgaacgatggatcgattggaacgtccaacacctcagtcgccgacgacgcctttgaccaggacgcgatgacgacgccgggcgttgtcgtcgcgaacgcatcgtcgtcactctcggttcgatgcgtcggaggggctgggggacgcgngcatcgtcggtgtcgtgggggtaatcgtaagcatcagtttggacaacgtctcgatgacgcgcaacgacgacacgggttgttcgcgcgtcgcgtgcacggcggaacgacgacgacgcgttggaatgattgtccgacgcacgttactttttcgtcgtcgtacgcggattcgccgacggctaacgatggatcgaggaacggggctgtcgaagagagcgtcggcgaaaccgcggcggagcgcgtcgtcgcgttcgcgacggattggaccaaggagaaaatgtcgaggtgggaaccgccaaagtttttgtggagaaccgcggcgacggcgttgttgttcgggagcgtgctgtttcggatgattcgggaaccgaagcgggtgaactgggagcagacgattcaacaaattgcgagaatcggtccgcagacgctcggggtgtcgttgttgacgagctcattcgtcgggatggtgtttacgattcagttttgtaaagagtttgccaaggttgggttgaagaatgcgatcggtggtctgcttggattggcgtttgcgagagagttgacgccggtgatttgcgccatcgtgttgacgggtcggattggaagttccatcgcagccgaattgggtacgatgcaagtgacggaacaagtagatcagctcaccgtgctcgggacggatccggtggattatctcgtcatcccgcgcgtcatcgcgtgcgcgttgtcgcttccgattctcagcttgatttcttttgcgcagtcattggcggcgagcatttttctcgccgacttgcgttacggcgtgacgccaaacgtcatcatcgacagcgccgccaagtacctcgaaccgagtgatatcggcatcatgacggcgaaatccatcgctttcggcgccgtcatcgctgtcatctcctgcgggtggggcacgacgactactggaggcgccaagggcgtcggcgagagcacgacggcgtctgtagtcatttctctcaccgcaatcttcgtcgtagactttgtactcagtctcatcttcttcaacaagtgagcagcccgcgggatcaatccatgggtcaatggagaacggcgcagccatcacggcgttttgatagtagaaattgtaactctagtctcatcacaacttcacttgccggctgcgctcatgacgaccgaacctcacccgccggtatgtcgccattacgcccgtcgaggcgcgtgcgcctacggcgacgcgtgtaaattcgcccacaccctcaccgacggtcccgcaaccgcggatgcgccgtcgacgacgcgtcgaggggcgcgaaagtcgcgcactcgtgctgggcgtcaaaaagtaaaaattttcgtgcgctttctgtgtcgcgcattcacgcccgaacagcgcgcgcgcgtcgtcgacgtcgccgggggtaacggaaagctcagtttcgagctcctgaacgccggggaaggggcgtcgacggtaacggtggttgacccgaggaagatgcgaggaagacggttggcggagcgtttcgctcgtcggttaaaacttcaggatgttcgtgaagtgcgagcgccgacgcacgcgagggtgtactggactgcggcaatgtgggatttcaaagatgaaagcgcgtgggaggacgcggtgggggcgtcgcggagcgcggcattggcgacgaggtggtcgacgagtggactcgtcgtcgcgaatgggaaatcggcggcgtacgaagacggagataaatcgcggcgagttcaagtga

SEQ ID NO: 1223 - DNA, 4000 bp, Escherichia coli
  misc_feature (233)..(233): n is a, c, g, or t
  misc_feature (347)..(347): n is a, c, g, or t
  misc_feature (435)..(435): n is a, c, g, or t
  misc_feature (566)..(566): n is a, c, g, or t
  misc_feature (642)..(642): n is a, c, g, or t
  misc_feature (725)..(725): n is a, c, g, or t
  misc_feature (1993)..(1993): n is a, c, g, or t
  misc_feature (2013)..(2013): n is a, c, g, or t
  misc_feature (2023)..(2023): n is a, c, g, or t
  misc_feature (2727)..(2727): n is a, c, g, or t
  misc_feature (3160)..(3160): n is a, c, g, or t
  misc_feature (3684)..(3684): n is a, c, g, or t
  misc_feature (3714)..(3714): n is a, c, g, or t
  misc_feature (3750)..(3750): n is a, c, g, or t
  misc_feature (3832)..(3832): n is a, c, g, or t
  misc_feature (3856)..(3856): n is a, c, g, or t
  misc_feature (3861)..(3861): n is a, c, g, or t
  misc_feature (3903)..(3903): n is a, c, g, or t
  misc_feature (3937)..(3937): n is a, c, g, or t
  misc_feature (3990)..(3990): n is a, c, g, or t
ggagaaatgaaatgaaagaaaaagttcaaactgccatagataattatgtattagcttacacaaataacgataaagaattatttactagtctttgggctccagatgctatttttgaagatccagtgggagcagagccatgtgttggcatagaagctatatctgctttttgggattttggtcatgttgaaggaatgactattttacctgccgatgttcaaacagttgtctgtggnagcgagggcattttaaaggctgtcatgcaggtacgtaatacttcagataactcaggtatgaatatctctattgtcgatcattttattgttaatgagcagggagaaatcactagnggccgagctttttgggatgaaaactctatcactcaaccagataacattaactcaatagagataaatgtagatgactttaaagataggnggtagtttttatctacaatgaatctaagtgttaatttaaataaaatagcccttttaaggaattctagaggctcaaacacaccttccttagaagcctatgccaataaagctatctcacttggcgtagatggnctaactttgcacccaaggcctgatcaccgtcatgccactagcaatgatgctctaaatattagcagtctctgcaaanaaaaatcattagaatttaatctggaaggaaatccattttctcagcctaaaaatgagtttcttggtttttatgagctatgtctncaagctaagcctgatcaaataacccttgtaccagatggagagggtcaactaacgtctgatagcggttgggagcctggatttcaagactccgaactaaagtcttttattgcaaaggtaaatgagctcaattgtaggaccagtttatttataaatgccgacatccattctgttgaatatgcctcagatatgaactttgatcgcattgaaatatacactggaccttttgctcaagcatgcttgctagataaaaacgaattgcagattaattgcgataagattaaagaggttatcaatagagctcagcacttaggattgggggttaatgcagggcatgacctatcactcgataatattcaactcttaaaggaatgtggtctaatagatgaggtatcaataggacatgcaattatgactgactcattgaaatatgggttcgacgccaccataataaaatatataaatattattagagagaaataatgtccattgaagaaaaaataaatgcccaacttacagataatgacatcctcatttatatgaagggatcaccttatgagcctaaatgtgggttttcagcaaaaactgttcaagcattaatcgattgcggagcggagttttcgtacgttgatatccttgaaaatcaggacattagacaaactctcccaagcatttccgattggccaaccttcccacaagtttttttaaaaggagagttaattggcggttgtgatattgtctccgaaatgcacgaagcaggggacctgcaactagccatagacaaagccctagttaaatagatccaaagtcttttaacatagcctttaactctaaggagtgctgctcttcttctccaattaggccacgagcgtactcctctaaatatatcgaggcatctgcaacgctagcaagtaatttcttgtataaggacaaagcatgcaattcgtgttctaacgcttcttcaagaatatctttaatggtatgtcgattggtttcttcaatttttgcaattttttgacttgggtgaccatcaagcccaacaataagttctccggcttgttgagaatgtaaaagagattcacttgcttgctctttaagaaaattaactattggcaatctataaggaccagtaaccattaaagatgagtgcgtatagcgaacaacgccagctaattcatattccataattgaatttaatattgcgcaaacatcctcattgtttatctctttcatctccattatgtgctccgttatagttgtgaatagtagtnaatatatgtgatttaatatntattgtaaancactgatataaggtatttatttaatgataatcattatcactatggtaattacaatcatttatgaaatcatagatattatgcaagttattaggggtgatagttatcaatcctgggtttattccagcgcatcagaccttatagttgtggacccatggttaacaagaaaacaggtcttccctattcttgagtggttgttatacagagattcagatcaatcatcatacctagagcagcataatcagatagatgcagttacacatataattattacagcgcacttttcagatcacctagatttagaaagtttaaaaaaatttaaagctgatattcctattttcactactgcagaagcagcaaaagttcttattaaaaatcattttacaaatactgttatcgtaaaacctcatcataaataccagcttggttcatttgagcttgaggtatacgaagctggaagtccctaccattcaacaacatttgcatacaccctaagagatgtcacgtcgattatatttcatgagtctcatatggttgacgcaaacttaagttttaaaaatcttaacgcatgtatcttgacggtagatcaggtgaaggtgcttggattcataaaggtatcgatgggaattgagcaggccaaaaagatgcaacaaaaacttaatgctgaatatctcctggcaacagggattgcaccaaacaagacaaanggtcttattacctggcttttatctattaaagaaaattatagctcgttaaaaggtgtgaactcagcatgcaacgaaactggcgattcattaatgctctaagcatagaagattatatcgaaggcaattctagagatatttttctagttaacttgattcacttaagaccaaagaattttgcacagcatcaaatgtattaatgatactgcaaaaaacttctgctgttactttagcgtcatatgcagcgctatgcgcttcgtcgttatcatagtcaatctcaagttccttgcagattctagcaagaacagtttgttgagtcgctaatacaccaagactaacggtatcaataagtgagaagggatgaaaaggagattttcttatgttatttcttttacaagcttcaagaataaaactatgatcaaaaaaagcattatgnccaactaggatagctcgcgaacaatcataaaaatttttatgcttattaattatcttgaataaatcatttaatgctgttttttcgtcaacggaaacccttaatggatgattcaagtcaagctttaaaaaatccaacgactcttgatttaattcgagaccctcaaatggatcgatatgatgtctgtacgactctccaagaacatattgatcatcagagaaatcaattaattggatagctatttctaagattggatttttttcacaatcaaaaccaccagtctcaagatcgactacaactggcaggaattttctaaatctatcttttaacatttttgccccttatgatgcctctataataaacgataaatcagtgcttacatgaagtttttagatatcacagacactctttttaacggcgtacaagcctcttcgcacattgaatttgatcatgaaaaaatcttttattgtgaggatgatatttctggtctgaaatcaattattgctattcacagttcgaaatcaggnccggccataggtggttgcaggttccgtcantaccaaacctatgaagagggcttaacagatgttctncgcttatctagaggcatgaccgaaaagaataatgctgctgacataccctttggtggcggcaaagctattatctttagtgacnagcccaaatccactgaattgcttntagcntttgcatcatttttaaaccaactcgaaggaatttactattcngctgaagacatgggtatttcactcgaggacattnagctggttggcaaacatactccttatgtatttgataatgttgaccccggatcntatacggcaa

SEQ ID NO: 1224 - DNA, 4000 bp, Escherichia coli
  misc_feature (2316)..(2316): n is a, c, g, or t
  misc_feature (2601)..(2601): n is a, c, g, or t
  misc_feature (2729)..(2731): n is a, c, g, or t
  misc_feature (2861)..(2862): n is a, c, g, or t
  misc_feature (2864)..(2864): n is a, c, g, or t
  misc_feature (2866)..(2866): n is a, c, g, or t
  misc_feature (2868)..(2868): n is a, c, g, or t
  misc_feature (2872)..(2873): n is a, c, g, or t
  misc_feature (2877)..(2877): n is a, c, g, or t
  misc_feature (2879)..(2879): n is a, c, g, or t
  misc_feature (2881)..(2882): n is a, c, g, or t
  misc_feature (2888)..(2888): n is a, c, g, or t
  misc_feature (2891)..(2891): n is a, c, g, or t
  misc_feature (2895)..(2896): n is a, c, g, or t
  misc_feature (2899)..(2899): n is a, c, g, or t
  misc_feature (2901)..(2901): n is a, c, g, or t
  misc_feature (2903)..(2903): n is a, c, g, or t
  misc_feature (2906)..(2906): n is a, c, g, or t
  misc_feature (2908)..(2908): n is a, c, g, or t
  misc_feature (2915)..(2915): n is a, c, g, or t
  misc_feature (2917)..(2917): n is a, c, g, or t
  misc_feature (2921)..(2921): n is a, c, g, or t
  misc_feature (2924)..(2924): n is a, c, g, or t
  misc_feature (2926)..(2927): n is a, c, g, or t
  misc_feature (2931)..(2931): n is a, c, g, or t
  misc_feature (2936)..(2936): n is a, c, g, or t
  misc_feature (2938)..(2939): n is a, c, g, or t
  misc_feature (2941)..(2943): n is a, c, g, or t
  misc_feature (2945)..(2946): n is a, c, g, or t
  misc_feature (2949)..(2950): n is a, c, g, or t
  misc_feature (2955)..(2955): n is a, c, g, or t
  misc_feature (2957)..(2957): n is a, c, g, or t
  misc_feature (2960)..(2961): n is a, c, g, or t
  misc_feature (2964)..(2965): n is a, c, g, or t
  misc_feature (2967)..(2970): n is a, c, g, or t
  misc_feature (2972)..(2972): n is a, c, g, or t
  misc_feature (2976)..(2976): n is a, c, g, or t
  misc_feature (2983)..(2983): n is a, c, g, or t
  misc_feature (2985)..(2985): n is a, c, g, or t
  misc_feature (2989)..(2990): n is a, c, g, or t
  misc_feature (2992)..(2992): n is a, c, g, or t
  misc_feature (2997)..(2997): n is a, c, g, or t
  misc_feature (2999)..(3003): n is a, c, g, or t
  misc_feature (3005)..(3007): n is a, c, g, or t
  misc_feature (3009)..(3009): n is a, c, g, or t
  misc_feature (3012)..(3012): n is a, c, g, or t
  misc_feature (3014)..(3014): n is a, c, g, or t
  misc_feature (3017)..(3017): n is a, c, g, or t
  misc_feature (3019)..(3020): n is a, c, g, or t
  misc_feature (3022)..(3023): n is a, c, g, or t
  misc_feature (3026)..(3026): n is a, c, g, or t
  misc_feature (3028)..(3028): n is a, c, g, or t
  misc_feature (3033)..(3033): n is a, c, g, or t
  misc_feature (3035)..(3035): n is a, c, g, or t
  misc_feature (3038)..(3039): n is a, c, g, or t
  misc_feature (3042)..(3042): n is a, c, g, or t
  misc_feature (3044)..(3044): n is a, c, g, or t
  misc_feature (3046)..(3046): n is a, c, g, or t
  misc_feature (3050)..(3053): n is a, c, g, or t
  misc_feature (3056)..(3059): n is a, c, g, or t
  misc_feature (3063)..(3063): n is a, c, g, or t
  misc_feature (3068)..(3068): n is a, c, g, or t
  misc_feature (3070)..(3071): n is a, c, g, or t
  misc_feature (3075)..(3075): n is a, c, g, or t
  misc_feature (3079)..(3080): n is a, c, g, or t
  misc_feature (3083)..(3085): n is a, c, g, or t
  misc_feature (3087)..(3087): n is a, c, g, or t
  misc_feature (3091)..(3091): n is a, c, g, or t
  misc_feature (3099)..(3102): n is a, c, g, or t
  misc_feature (3104)..(3104): n is a, c, g, or t
  misc_feature (3107)..(3107): n is a, c, g, or t
  misc_feature (3109)..(3109): n is a, c, g, or t
  misc_feature (3111)..(3111): n is a, c, g, or t
  misc_feature (3118)..(3119): n is a, c, g, or t
  misc_feature (3121)..(3121): n is a, c, g, or t
  misc_feature (3124)..(3124): n is a, c, g, or t
  misc_feature (3131)..(3131): n is a, c, g, or t
  misc_feature (3133)..(3133): n is a, c, g, or t
  misc_feature (3138)..(3138): n is a, c, g, or t
  misc_feature (3141)..(3141): n is a, c, g, or t
  misc_feature (3146)..(3146): n is a, c, g, or t
  misc_feature (3148)..(3148): n is a, c, g, or t
  misc_feature (3153)..(3153): n is a, c, g, or t
  misc_feature (3158)..(3158): n is a, c, g, or t
  misc_feature (3163)..(3164): n is a, c, g, or t
  misc_feature (3168)..(3169): n is a, c, g, or t
  misc_feature (3174)..(3174): n is a, c, g, or t
  misc_feature (3176)..(3176): n is a, c, g, or t
  misc_feature (3178)..(3181): n is a, c, g, or t
  misc_feature (3183)..(3186): n is a, c, g, or t
  misc_feature (3189)..(3189): n is a, c, g, or t
  misc_feature (3193)..(3193): n is a, c, g, or t
  misc_feature (3195)..(3195): n is a, c, g, or t
  misc_feature (3197)..(3198): n is a, c, g, or t
  misc_feature (3200)..(3201): n is a, c, g, or t
  misc_feature (3206)..(3206): n is a, c, g, or t
  misc_feature (3208)..(3208): n is a, c, g, or t
  misc_feature (3211)..(3211): n is a, c, g, or t
  misc_feature (3213)..(3213): n is a, c, g, or t
  misc_feature (3215)..(3215): n is a, c, g, or t
  misc_feature (3223)..(3225): n is a, c, g, or t
  misc_feature (3227)..(3228): n is a, c, g, or t
  misc_feature (3230)..(3232): n is a, c, g, or t
  misc_feature (3234)..(3234): n is a, c, g, or t
  misc_feature (3236)..(3236): n is a, c, g, or t
  misc_feature (3238)..(3239): n is a, c, g, or t
  misc_feature (3241)..(3242): n is a, c, g, or t
  misc_feature (3245)..(3245): n is a, c, g, or t
  misc_feature (3249)..(3249): n is a, c, g, or t
  misc_feature (3251)..(3251): n is a, c, g, or t
  misc_feature (3253)..(3253): n is a, c, g, or t
  misc_feature (3255)..(3255): n is a, c, g, or t
  misc_feature (3257)..(3261): n is a, c, g, or t
  misc_feature (3264)..(3264): n is a, c, g, or t
  misc_feature (3266)..(3269): n is a, c, g, or t
  misc_feature (3273)..(3274): n is a, c, g, or t
  misc_feature (3276)..(3276): n is a, c, g, or t
  misc_feature (3279)..(3280): n is a, c, g, or t
  misc_feature (3282)..(3283): n is a, c, g, or t
  misc_feature (3286)..(3288): n is a, c, g, or t
  misc_feature (3290)..(3292): n is a, c, g, or t
  misc_feature (3295)..(3295): n is a, c, g, or t
  misc_feature (3304)..(3305): n is a, c, g, or t
  misc_feature (3309)..(3310): n is a, c, g, or t
  misc_feature (3312)..(3312): n is a, c, g, or t
  misc_feature (3317)..(3318): n is a, c, g, or t
  misc_feature (3321)..(3325): n is a, c, g, or t
  misc_feature (3328)..(3329): n is a, c, g, or t
  misc_feature (3332)..(3332): n is a, c, g, or t
  misc_feature (3334)..(3334): n is a, c, g, or t
  misc_feature (3338)..(3338): n is a, c, g, or t
  misc_feature (3340)..(3340): n is a, c, g, or t
  misc_feature (3342)..(3344): n is a, c, g, or t
  misc_feature (3346)..(3346): n is a, c, g, or t
  misc_feature (3348)..(3348): n is a, c, g, or t
  misc_feature (3350)..(3350): n is a, c, g, or t
  misc_feature (3352)..(3352): n is a, c, g, or t
  misc_feature (3354)..(3355): n is a, c, g, or t
  misc_feature (3357)..(3358): n is a, c, g, or t
  misc_feature (3360)..(3361): n is a, c, g, or t
  misc_feature (3363)..(3370): n is a, c, g, or t
  misc_feature (3374)..(3375): n is a, c, g, or t
  misc_feature (3379)..(3379): n is a, c, g, or t
  misc_feature (3381)..(3382): n is a, c, g, or t
  misc_feature (3384)..(3386): n is a, c, g, or t
  misc_feature (3388)..(3389): n is a, c, g, or t
  misc_feature (3394)..(3394): n is a, c, g, or t
  misc_feature (3396)..(3398): n is a, c, g, or t
  misc_feature (3400)..(3401): n is a, c, g, or t
  misc_feature (3403)..(3403): n is a, c, g, or t
  misc_feature (3406)..(3407): n is a, c, g, or t
  misc_feature (3411)..(3411): n is a, c, g, or t
  misc_feature (3413)..(3414): n is a, c, g, or t
  misc_feature (3416)..(3416): n is a, c, g, or t
  misc_feature (3418)..(3418): n is a, c, g, or t
  misc_feature (3422)..(3423): n is a, c, g, or t
  misc_feature (3428)..(3432): n is a, c, g, or t
  misc_feature (3434)..(3435): n is a, c, g, or t
  misc_feature (3438)..(3440): n is a, c, g, or t
  misc_feature (3442)..(3442): n is a, c, g, or t
  misc_feature (3447)..(3447): n is a, c, g, or t
  misc_feature (3449)..(3450): n is a, c, g, or t
  misc_feature (3452)..(3454): n is a, c, g, or t
  misc_feature (3460)..(3462): n is a, c, g, or t
  misc_feature (3465)..(3465): n is a, c, g, or t
  misc_feature (3467)..(3467): n is a, c, g, or t
  misc_feature (3474)..(3474): n is a, c, g, or t
  misc_feature (3476)..(3477): n is a, c, g, or t
  misc_feature (3481)..(3481): n is a, c, g, or t
  misc_feature (3483)..(3483): n is a, c, g, or t
  misc_feature (3485)..(3486): n is a, c, g, or t
  misc_feature (3490)..(3491): n is a, c, g, or t
  misc_feature (3495)..(3498): n is a, c, g, or t
  misc_feature (3500)..(3500): n is a, c, g, or t
  misc_feature (3502)..(3503): n is a, c, g, or t
  misc_feature (3507)..(3508): n is a, c, g, or t
  misc_feature (3511)..(3511): n is a, c, g, or t
  misc_feature (3514)..(3515): n is a, c, g, or t
  misc_feature (3517)..(3517): n is a, c, g, or t
  misc_feature (3521)..(3522): n is a, c, g, or t
  misc_feature (3527)..(3527): n is a, c, g, or t
  misc_feature (3529)..(3530): n is a, c, g, or t
  misc_feature (3535)..(3535): n is a, c, g, or t
  misc_feature (3537)..(3537): n is a, c, g, or t
  misc_feature (3539)..(3539): n is a, c, g, or t
  misc_feature (3541)..(3541): n is a, c, g, or t
  misc_feature (3543)..(3543): n is a, c, g, or t
  misc_feature (3547)..(3547): n is a, c, g, or t
  misc_feature (3550)..(3551): n is a, c, g, or t
  misc_feature (3553)..(3553): n is a, c, g, or t
  misc_feature (3556)..(3556): n is a, c, g, or t
  misc_feature (3560)..(3560): n is a, c, g, or t
  misc_feature (3562)..(3563): n is a, c, g, or t
  misc_feature (3568)..(3569): n is a, c, g, or t
  misc_feature (3571)..(3571): n is a, c, g, or t
  misc_feature (3575)..(3577): n is a, c, g, or t
  misc_feature (3584)..(3584): n is a, c, g, or t
  misc_feature (3586)..(3588): n is a, c, g, or t
  misc_feature (3591)..(3592): n is a, c, g, or t
  misc_feature (3596)..(3598): n is a, c, g, or t
  misc_feature (3604)..(3604): n is a, c, g, or t
  misc_feature (3606)..(3606): n is a, c, g, or t
  misc_feature (3608)..(3609): n is a, c, g, or t
  misc_feature (3611)..(3612): n is a, c, g, or t
  misc_feature (3615)..(3615): n is a, c, g, or t
  misc_feature (3620)..(3620): n is a, c, g, or t
  misc_feature (3622)..(3624): n is a, c, g, or t
  misc_feature (3626)..(3626): n is a, c, g, or t
  misc_feature (3628)..(3629): n is a, c, g, or t
  misc_feature (3631)..(3631): n is a, c, g, or t
  misc_feature (3633)..(3633): n is a, c, g, or t
  misc_feature (3635)..(3635): n is a, c, g, or t
  misc_feature (3638)..(3638): n is a, c, g, or t
  misc_feature (3641)..(3641): n is a, c, g, or t
  misc_feature (3819)..(3819): n is a, c, g, or t
  misc_feature (3828)..(3828): n is a, c, g, or t
agggaaggagatcggttatttatttgggcagtacaagcggctgaatcaggggaactttgagggagtgctgacaggaaagtcagcggattggggggggagcaacatgcgaccggaagctactggctatgggtgcgtttttttcgcggaagaggccatgaaagatttgaggaagaaggaattgaaggtgagtggagtggggtggagtcagcacattacacgagctggacctggacctaacccttaagctacgctacgctaaaccttcgccaatgcagggaatgaagtgcgcagtgagcggcagcggtaatgtcgcacagttcgccgcagagatgttgctcaaagagggggctaccgttttaaccttttcagatagttccgggactatctacgagcccgatggcttcagcaaggaccagttgaggattttgatgaaattaaagcagaagtcacgtggcgctcgagtgtcagattactgcatcagttcaccgtctgccaaatactttgagaagcgcaagccttggggaatcgttgaaagcttggatctcgctttcccatgcgcaacgcagaacgagatcggagagagcgacgctcaggatcttgttgacaggggttgtatcggtgtcttcgagggcgctaacatgccgactacaccagagggagtgcacgtgctcgagtctaacaaagtagtctttggtccagcaaaggcagctaatgcggggggcgtggcagtgagcggattggaaatggcccagaatgcacagcaagttacatggagcagcaatgaggtcgagacaatgctgaggaaaataatgaaagacatatataaacaatgtgctgagtgcgctaagacctactgggaagcagatgatttgaaaagtggagcaaacattgccggatttttgaaggttgcagcagccatgcgagagcagggagctgtttaatatattagagaagcactgaaacacttttctgtatgtatttgtggagtcgacccgtattttacttctttcgattcaacaaacaaacaaagttaaggtagcttttcttcaaaaaagaaggcgagtttttacctttaaatcgtgctcctcctctccattccattccatcattcgtaacagaaaagtcacattattgtacaaatgtcatccttcccgacaactttcccatcaacgacatctccggtcttcacaggctggcaatcagtgaacagcagcggcgtgtccttgtcgaactcagcgaatagccagatatcgtcgctggctgtcccggtagggacggctttaccgctcaggcgatcaatgtgtaaatgaatctgccaaagtgtgatatggtgtcagaaaggagaagaaaaaaaagaagctgcgtagtaccaccttcctcaccttggcaatgtccttcttgagcttatccttctctttctccctccccttgatctcctcctccaatcgccccttctcgctcttgacgagctcgcatcccagcaaaaggctcccgctgagctgtttcgcctgtgttttcttttctgggtcggcaatagggtaccacttgttaccgctttcgcccattttctgcagctggacagtgacacagccaacaaaatcgtcgttcccaaaactctctgcatccatgaggttaaaagtgacagttgaaggtagagaggtgagggaggggaaggaaaaggaagcattgaagattggatttctcgagttgggaattactttcgttctcagagtagaaggagggtttggagaactgagtgaaattagttgtgttagttagcgtaaccacgtatcttcttattgacatgttctcttgcctgaactcaccagtctgctggactaacgagaatctccacgtaaggatcacacttcccactgtaccaatccatcttgggcaaatcctttccctcttgtatcatgagttccaatctcgcggtgctctccccatcttttgtcctccctatcccagatttatcgacagtgtcgctcgttctttttcctagatcggactgcagatctttcaatgccgcctcgcagttactcaaggcagactccttacttgaaagtaaaagagaaagctttttaatttttccatctttgtgtgggtcttctgcttctgcctgttggtgtttcccgccttccgatgtagtgcttgtcgtagaacctgttgcaggaggaggggacttctcaggggagggagaaggaccatctgaatccttctccagcttctccttctctttgcctacggccccagtcttccctttttttcccattctccgatctgttcttacttagacggtgcaggtatcctttttangccgcttgcagaacttgtctatatctttcttaaaggatttttaaacttttttatttaattttcatcttaaatattaacttaatactctgttagtttctcttggtaaactgtctctccagtagtctcgtagtctctgagtagtggagaacatagccgtcttcttaaattaatcacagacctcctcaaaacttgtgcgctgcggccctttcgatcacttcagacatatttccttctgtgatggcgtaagttgtatatatgttcgtctctaatgagtggttgtggatncttcgactgtggtataaatgctggggatacatcgaatgtggactatctcttgcaagatgtaagttgcatcttgattaaatcctgccatcatccatcaaaacaaaacaaaacaaaacaaaacaaaacannncagtcattttaacaaggtatcctttcaacgtgcacttctttttcttggttattttttcttacgagtggttccgtcttcgcttatggcccgtcattcctccctttttccctcgctttccacttgctgcccnntncntncctnntttntnanntttttntcncttnnccncnanctnanccccctngncccnttngnncccnttctngnnannnanntannttttncnggnnttnntnnnntncgcnctgcccngncccnngngggcntnnnnnannncnttnanctngnnannttntntcatntntgnnttntngnccannnnttnnnntttnttctngnntgcnttgnnctnnncncttncccttttnnnntnccncncncgcgccnngnccncctttgnantgggnttngaggngngtgtntgganttgcnntttnnttttngngnnnngnnnnggngggncngnnanntgggntntanantngcgcgtcnnntnntnnncnancnngnnagncaantntngngnnnnnttntnnnngaanngnttnnanntgnnntnnnccngcgccttgnntttnntntttcnnaannnnnttnnccnangcgngngnnncntngngngnncnncnntnnnnnnnncctnntttncnntnnnannggtgngnnnannanagnngggnanngngncctnntcttnnnnngnnggnnntntttcnanncnnnccttcnnnttntncgtggcntnncccntnanncccnntttnnnntntnngcgnnccnccnncncccnnttccntnncttcncncncntncccnccnncnccncctngnnttttnncntccnnncctcctntnnnttnnccgnnntcttcncncnngnntcntctcncnnnananntncnanccnttnatctgactccttcgttttcttggctttttttcgctcgttcctgtcacgtgccttcaggcgcttctcgtggcgcttctgcttgtctgtttttggcatgctgtttaagatagcttcggggtcaattttctgttttttgctttctctgctttctgactctggcgatgtcgacgcgtcgtcntcgttatcnccgtcgtcgtcactgctgtcgttatcatcgctgctatttaattcatctttgccgccatcttcatcatcgtcatcatcatcatcatcactatcatctctcttgatttgatcaaacaaaggattgctgaaccacctctgcgcctttacacttctcgcgtcgcctgcctttgtca

SEQ ID NO: 1225 - DNA, 4000 bp, Escherichia coli
  misc_feature (834)..(834): n is a, c, g, or t
  misc_feature (837)..(837): n is a, c, g, or t
  misc_feature (1279)..(1279): n is a, c, g, or t
  misc_feature (1282)..(1282): n is a, c, g, or t
  misc_feature (1975)..(1975): n is a, c, g, or t
  misc_feature (1977)..(1977): n is a, c, g, or t
  misc_feature (1980)..(1980): n is a, c, g, or t
  misc_feature (1988)..(1988): n is a, c, g, or t
  misc_feature (2000)..(2000): n is a, c, g, or t
  misc_feature (2007)..(2007): n is a, c, g, or t
  misc_feature (2228)..(2228): n is a, c, g, or t
  misc_feature (2324)..(2324): n is a, c, g, or t
  misc_feature (2327)..(2327): n is a, c, g, or t
  misc_feature (2429)..(2429): n is a, c, g, or t
  misc_feature (2542)..(2542): n is a, c, g, or t
  misc_feature (2753)..(2753): n is a, c, g, or t
  misc_feature (3044)..(3044): n is a, c, g, or t
  misc_feature (3162)..(3162): n is a, c, g, or t
  misc_feature (3175)..(3175): n is a, c, g, or t
  misc_feature (3209)..(3209): n is a, c, g, or t
aagaaagaacttttcgaccttcgtttccaagctgcagcaggtcaacttgatcaaactgcccgtttgaacgaagtgaaaaaacaaattgcacgtgttaaaactgtgcaatctgaaatcaaataatagattgggaaaggagcaattctaataatggaacgtaatcaacgtaaaacccttgttggacgcgtagtatctgacaagatggataaaacaatcacagttgtagttgaaactaaacgtaaccacccagtctatggtaaacgtatcaactattctaaaaaatacaaagcacatgatgaaaacaacgttgctaaagaaggcgatatcgttcgtatcatggaaactcgcccactttcagctacaaaacgcttccgtcttgtagaagttgtggaagaagctgttattatctaataaaactaaaaggagacaattgaaatgattcaacaagaaagtcgcttaaaagttgctgataatagcggtgctcgtgaaatcttgactatcaaagttcttggtggttcaggacgtaaattcgctaacatcggcgacgttatcgttgcaactgttaaacaagctacaccaggtggagctgttaaaaaaggtgatgttgttaaagctgttatcgttcgtacaaaaactggtgctcgccgtccagacggttcatacatcaagtttgatgacaacgctgcagtaatcatccgcgatgacaaaactcctcgtggaactcgtatctttggccctgttgcacgtgaattgcgtgaaggtggatacatgcgtatcgtatctttggcgccagaagtactttaatctgaattaacacaaacttagtcccctganatnttcagggtgcccattagggcgtaagaaataataggagaaatactcaaatgtttgtaaaaaaaggcgataaagttcgcgttattgctggtaaagacaaaggaactgaagcagtagttcttaaagctcttccaaaagtaaacaaagttgttgttgaaggtgttgcaatcatcaaaaaacaccaaaaaccatcagctgaaaaccctcaaggtgctatcgtggaaaaagaagcaccaatccacgcttcaaacgttcaagttcttgacaagaacggtgtagctggacgtgtaggttacaaagttgttgacggcaaaaaagttcgttacaacaaaaaatcaggcgaagtgcttgactaatcacgaaggaaaggagaaagtattaaatggctaaccgtcttaaagaaaaatacactaacgaagtaattccagctttgactgaaaaattnaantattcttcagttatggctgtgccaaaagttgataaaatcgttatcaacatgggtgttggtgaagctgtaaacaacgctaaaactcttgaaaaagctgctgctgagttggcacttatttcaggtcaaaaaccattgattactaaagctaagaaatcaatcgctggcttccgtcttcgtgaaggtgtagcgatcggtgctaaagttacccttcgtggtgaacgcatgtacgaattcttggataaattggtatcagtatcacttccacgtgttcgtgacttccatggtgttccaactaaatcatttgatggacgtggtaactacacacttggtgttaaagaacaacttatcttcccagaaatcaacttcgacgatgttgataaagtacgtggtatggatatcgttatcgtaactactgctaacactgacgaagaaggtcgtgaattgcttaaaggccttggaatgccttttgcaaaataatctaggaggtaaataaattggctaaaaaatcaatgattgctaagaacaaacgccctgcgaagttctctacgcaagcttacactcgttgcgaacgttgtggacgtccacactcagtttatcgcaaatttaaactttgccgtgtttgcttccgtgaattggcttacaaaggtcaaattccaggtgttaccaaagcttcttggtaaaaacatggtacantnaanttagtttnacctaatttgantgtattnaacacaatctgagcctagctcaatcattaactagcaagtgaattattcaaactactagtaagaggagaaaatataaaatggttatgactgacccaattgcagatttcttgacacgtattcgtaacgctaaccaagctaaacacgaagtacttgaagtacctgcatcaaacattaaaaaaggtatcgctgaaatccttaaacgtgaaggtttcgtaaaaaangttgaagttatcgaagatgacaaacaaggtatcatccgcgtattcttgaaatacggacaaaacggtgaacgtgttatcactaacttgaaacgtatntcnaaaccaggtcttcgtgtttactctaaacgtgaagatgttcctaaagttcttaacggacttggaatcgcgatcatctctacttcagaaggtcttttgactganaaagaagctcgtcaaaagaacgttggtggagaagttatcgcttacgtttggtaagaagctgatactaagcacttatctcaaatgatttgtgcgagtttcgttgattatattcnatgaaactcatccccgtgaaaactagtcactttgtggcttgataatctaacaggagaattaaatactatgtcacgtattggtaataaagttattactttgcctgctggtgttgaagtaacaaacaacgataacgttgttactgttaaaggacctaaaggcgaactcactcgtgagtttaacaaaaacattgaaatcaaagttgaaggcaangaagttacacttcaccgtccaaacgactcaaaagaaaacaaaacaatccacggtacttcacgtgcaaacttgaacaacatggttgttggtgtttctgaaggtttcaaaaaagaacttgaaatgcgcggtgtcggatatcgtgcgcaactccaaggaacaaaacttgttctttcagttggtaaatctcaccaagacgaagttgaagctccagaaggtattacttttgaagtaccatctgcaacttcaatcgttgtaagtggtattaacaaagaagttgttggtcaaacagcngcttacatccgtagccttcgttcaccagaaccttacaaaggtaaaggtatccgttacgttggtgaatacgtacgtcgtaaagaaggtaaaactggtaaataataggattttatccttntggcaattctttntggattgtctctttaccaaaagctctcatgagcnagcattataattaagaggtgaaaattgtgatttcgaaaccagataaaaacaaactccgccaaaaacgccaccgtcgcgttcgcggaaaactctctggaactgctgatcgcccacgtttgaacattttccgttctaatacaggcatctacgctcaagttattgatgacgtagcgggtgtaacgctcgcaagtgcatcaactcttgataaagaagtttctaaaggaactaaaacagaacaagccgttgttgtcggtaaacttgttgctgaacgcgcagtagctaaaggtatttctgaagtggtgtttgaccgcggtggatatctctatcacggacgtgttaaagctttggctgactcagctcgtgaaaacggattgaaattctaatagggaggacacttaataatggcatttaaagataatgcagtagaacttgaagaacgcgtagttgctatcaaccgtgttactaaagttgtaaaaggtggacgcaacatgcgttttgctgctcttgttgttgttggtgaccgtaatggtcgcgtaggatttggtactggtaaatctcaagaggttccagaagctatccgtaaagcagttgaagcagctaagaaaaaccttatcgaagttcctatggttggtacaactattcctcacgaagttcgttcagaatttggtggagcgaaagtattgttgaaaccagctgttgaaggggctggggttgccgctggtggtgcagttcgtgccgtcatcgaattggctggtgttgctgatgtaacatctaaatcactcggttcaaac

SEQ ID NO: 1226 - DNA, 4000 bp, Escherichia coli
  misc_feature (3093)..(3093): n is a, c, g, or t
  misc_feature (3252)..(3253): n is a, c, g, or t
  misc_feature (3256)..(3257): n is a, c, g, or t
  misc_feature (3260)..(3263): n is a, c, g, or t
  misc_feature (3266)..(3267): n is a, c, g, or t
  misc_feature (3273)..(3276): n is a, c, g, or t
  misc_feature (3281)..(3281): n is a, c, g, or t
  misc_feature (3284)..(3287): n is a, c, g, or t
  misc_feature (3290)..(3291): n is a, c, g, or t
  misc_feature (3294)..(3295): n is a, c, g, or t
  misc_feature (3302)..(3302): n is a, c, g, or t
  misc_feature (3306)..(3306): n is a, c, g, or t
  misc_feature (3310)..(3315): n is a, c, g, or t
  misc_feature (3318)..(3319): n is a, c, g, or t
  misc_feature (3325)..(3331): n is a, c, g, or t
  misc_feature (3335)..(3335): n is a, c, g, or t
  misc_feature (3337)..(3340): n is a, c, g, or t
  misc_feature (3342)..(3343): n is a, c, g, or t
  misc_feature (3348)..(3349): n is a, c, g, or t
  misc_feature (3354)..(3356): n is a, c, g, or t
  misc_feature (3361)..(3361): n is a, c, g, or t
  misc_feature (3364)..(3364): n is a, c, g, or t
  misc_feature (3367)..(3374): n is a, c, g, or t
  misc_feature (3378)..(3378): n is a, c, g, or t
  misc_feature (3381)..(3381): n is a, c, g, or t
  misc_feature (3384)..(3386): n is a, c, g, or t
  misc_feature (3389)..(3390): n is a, c, g, or t
  misc_feature (3393)..(3393): n is a, c, g, or t
  misc_feature (3399)..(3400): n is a, c, g, or t
  misc_feature (3402)..(3404): n is a, c, g, or t
  misc_feature (3407)..(3407): n is a, c, g, or t
  misc_feature (3412)..(3413): n is a, c, g, or t
  misc_feature (3415)..(3421): n is a, c, g, or t
  misc_feature (3425)..(3425): n is a, c, g, or t
  misc_feature (3428)..(3432): n is a, c, g, or t
  misc_feature (3437)..(3437): n is a, c, g, or t
  misc_feature (3442)..(3443): n is a, c, g, or t
  misc_feature (3447)..(3449): n is a, c, g, or t
  misc_feature (3452)..(3453): n is a, c, g, or t
  misc_feature (3459)..(3460): n is a, c, g, or t
  misc_feature (3463)..(3463): n is a, c, g, or t
  misc_feature (3466)..(3470): n is a, c, g, or t
  misc_feature (3472)..(3473): n is a, c, g, or t
  misc_feature (3475)..(3477): n is a, c, g, or t
  misc_feature (3480)..(3480): n is a, c, g, or t
  misc_feature (3484)..(3485): n is a, c, g, or t
  misc_feature (3489)..(3490): n is a, c, g, or t
  misc_feature (3492)..(3492): n is a, c, g, or t
  misc_feature (3495)..(3495): n is a, c, g, or t
  misc_feature (3504)..(3504): n is a, c, g, or t
  misc_feature (3509)..(3509): n is a, c, g, or t
  misc_feature (3512)..(3513): n is a, c, g, or t
  misc_feature (3518)..(3520): n is a, c, g, or t
  misc_feature (3522)..(3534): n is a, c, g, or t
  misc_feature (3536)..(3542): n is a, c, g, or t
  misc_feature (3544)..(3545): n is a, c, g, or t
  misc_feature (3554)..(3554): n is a, c, g, or t
  misc_feature (3560)..(3560): n is a, c, g, or t
  misc_feature (3563)..(3564): n is a, c, g, or t
  misc_feature (3566)..(3566): n is a, c, g, or t
  misc_feature (3569)..(3569): n is a, c, g, or t
  misc_feature (3573)..(3574): n is a, c, g, or t
  misc_feature (3576)..(3576): n is a, c, g, or t
  misc_feature (3581)..(3583): n is a, c, g, or t
  misc_feature (3585)..(3586): n is a, c, g, or t
  misc_feature (3590)..(3591): n is a, c, g, or t
  misc_feature (3598)..(3600): n is a, c, g, or t
  misc_feature (3602)..(3602): n is a, c, g, or t
  misc_feature (3604)..(3604): n is a, c, g, or t
  misc_feature (3606)..(3607): n is a, c, g, or t
  misc_feature (3609)..(3613): n is a, c, g, or t
  misc_feature (3617)..(3617): n is a, c, g, or t
  misc_feature (3620)..(3620): n is a, c, g, or t
  misc_feature (3623)..(3623): n is a, c, g, or t
  misc_feature (3625)..(3625): n is a, c, g, or t
  misc_feature (3627)..(3627): n is a, c, g, or t
  misc_feature (3629)..(3629): n is a, c, g, or t
  misc_feature (3631)..(3631): n is a, c, g, or t
  misc_feature (3634)..(3635): n is a, c, g, or t
  misc_feature (3637)..(3638): n is a, c, g, or t
  misc_feature (3640)..(3641): n is a, c, g, or t
  misc_feature (3643)..(3648): n is a, c, g, or t
  misc_feature (3650)..(3650): n is a, c, g, or t
  misc_feature (3652)..(3652): n is a, c, g, or t
  misc_feature (3655)..(3660): n is a, c, g, or t
  misc_feature (3662)..(3662): n is a, c, g, or t
  misc_feature (3664)..(3665): n is a, c, g, or t
  misc_feature (3667)..(3667): n is a, c, g, or t
  misc_feature (3670)..(3672): n is a, c, g, or t
  misc_feature (3674)..(3674): n is a, c, g, or t
  misc_feature (3677)..(3677): n is a, c, g, or t
  misc_feature (3681)..(3685): n is a, c, g, or t
  misc_feature (3687)..(3687): n is a, c, g, or t
  misc_feature (3689)..(3689): n is a, c, g, or t
  misc_feature (3692)..(3692): n is a, c, g, or t
  misc_feature (3694)..(3696): n is a, c, g, or t
  misc_feature (3699)..(3699): n is a, c, g, or t
  misc_feature (3702)..(3703): n is a, c, g, or t
  misc_feature (3705)..(3705): n is a, c, g, or t
  misc_feature (3707)..(3707): n is a, c, g, or t
  misc_feature (3710)..(3710): n is a, c, g, or t
  misc_feature (3712)..(3713): n is a, c, g, or t
  misc_feature (3715)..(3715): n is a, c, g, or t
  misc_feature (3717)..(3718): n is a, c, g, or t
  misc_feature (3720)..(3721): n is a, c, g, or t
  misc_feature (3723)..(3723): n is a, c, g, or t
  misc_feature (3725)..(3729): n is a, c, g, or t
  misc_feature (3732)..(3732): n is a, c, g, or t
  misc_feature (3734)..(3734): n is a, c, g, or t
  misc_feature (3737)..(3737): n is a, c, g, or t
  misc_feature (3739)..(3740): n is a, c, g, or t
  misc_feature (3742)..(3742): n is a, c, g, or t
  misc_feature (3744)..(3744): n is a, c, g, or t
  misc_feature (3746)..(3746): n is a, c, g, or t
  misc_feature (3749)..(3751): n is a, c, g, or t
  misc_feature (3753)..(3754): n is a, c, g, or t
  misc_feature (3756)..(3758): n is a, c, g, or t
  misc_feature (3760)..(3760): n is a, c, g, or t
  misc_feature (3762)..(3762): n is a, c, g, or t
  misc_feature (3764)..(3770): n is a, c, g, or t
  misc_feature (3772)..(3772): n is a, c, g, or t
  misc_feature (3774)..(3774): n is a, c, g, or t
  misc_feature (3777)..(3777): n is a, c, g, or t
  misc_feature (3780)..(3780): n is a, c, g, or t
  misc_feature (3782)..(3783): n is a, c, g, or t
  misc_feature (3785)..(3785): n is a, c, g, or t
  misc_feature (3787)..(3787): n is a, c, g, or t
  misc_feature (3790)..(3794): n is a, c, g, or t
  misc_feature (3796)..(3796): n is a, c, g, or t
  misc_feature (3798)..(3799): n is a, c, g, or t
  misc_feature (3804)..(3811): n is a, c, g, or t
  misc_feature (3813)..(3816): n is a, c, g, or t
  misc_feature (3819)..(3824): n is a, c, g, or t
  misc_feature (3826)..(3828): n is a, c, g, or t
  misc_feature (3830)..(3833): n is a, c, g, or t
  misc_feature (3835)..(3836): n is a, c, g, or t
  misc_feature (3838)..(3838): n is a, c, g, or t
  misc_feature (3840)..(3843): n is a, c, g, or t
  misc_feature (3845)..(3845): n is a, c, g, or t
  misc_feature (3847)..(3848): n is a, c, g, or t
  misc_feature (3851)..(3851): n is a, c, g, or t
  misc_feature (3855)..(3857): n is a, c, g, or t
  misc_feature (3859)..(3860): n is a, c, g, or t
  misc_feature (3864)..(3865): n is a, c, g, or t
  misc_feature (3867)..(3867): n is a, c, g, or t
  misc_feature (3871)..(3876): n is a, c, g, or t
  misc_feature (3879)..(3879): n is a, c, g, or t
  misc_feature (3881)..(3883): n is a, c, g, or t
  misc_feature (3885)..(3887): n is a, c, g, or t
  misc_feature (3890)..(3892): n is a, c, g, or t
  misc_feature (3894)..(3898): n is a, c, g, or t
  misc_feature (3901)..(3901): n is a, c, g, or t
  misc_feature (3903)..(3905): n is a, c, g, or t
  misc_feature (3907)..(3907): n is a, c, g, or t
  misc_feature (3909)..(3909): n is a, c, g, or t
  misc_feature (3911)..(3911): n is a, c, g, or t
  misc_feature (3913)..(3913): n is a, c, g, or t
  misc_feature (3915)..(3915): n is a, c, g, or t
  misc_feature (3917)..(3919): n is a, c, g, or t
  misc_feature (3921)..(3923): n is a, c, g, or t
  misc_feature (3925)..(3926): n is a, c, g, or t
  misc_feature (3929)..(3929): n is a, c, g, or t
  misc_feature (3932)..(3935): n is a, c, g, or t
  misc_feature (3937)..(3939): n is a, c, g, or t
  misc_feature (3941)..(3941): n is a, c, g, or t
  misc_feature (3944)..(3945): n is a, c, g, or t
  misc_feature (3949)..(3949): n is a, c, g, or t
  misc_feature (3951)..(3954): n is a, c, g, or t
  misc_feature (3956)..(3959): n is a, c, g, or t
  misc_feature (3961)..(3961): n is a, c, g, or t
  misc_feature (3964)..(3964): n is a, c, g, or t
  misc_feature (3966)..(3966): n is a, c, g, or t
  misc_feature (3968)..(3972): n is a, c, g, or t
  misc_feature (3975)..(3977): n is a, c, g, or t
  misc_feature (3979)..(3980): n is a, c, g, or t
  misc_feature (3983)..(3984): n is a, c, g, or t
  misc_feature (3987)..(3990): n is a, c, g, or t
  misc_feature (3992)..(3994): n is a, c, g, or t
  misc_feature (3996)..(3996): n is a, c, g, or t
  misc_feature (3999)..(3999): n is a, c, g, or t
tgctggccccttacatccaggtgggcctgatagtggggaaactgctgactcacctggccgaaggccagttcgtgggcgtaactatccgctacgagggcgagattgcccagcacaatacggcgatgctcaagtcggcggtattggccggtttgctgggaccggttaccggcgatcaagtgaacttgatcaacgccccattcttggcccaacaacgcggtctcagcctgactgaacagagcaacgaagcggccgcggaatatgtcagtatgatcaccgccacgctggacaccaccggaggccctatcaccgtcgccggcacatcgatgcgggacgaggcccacgtggtaaaggtgaacgactactggctcgacatcacgccatccagcccatacctgctgttcgtggacaaccaggaccagcccggattgatcggggcggtgggcaccctggccggacgccacaatatcaacatcagctccatggacgtcggacggctcaacccaaggggcatggccatgatggtcatcggcctggacgacccggtgccgcctgcggtgctggaggagatcaaggccctgccccagatcatcaacgcccgattggtctcgctgtagcggacagggtctggacactcggcaaccccaccgtcgccatacttgcgagatctttgcctctccactagtattaaccggccagcccctatgggctcggcacgccgaataatcgccaacagtccgaggccgcccgccgccgcctctgggcaggagtattaaaatgggtgacaagattggcatcatgggagccggcgcggtaggtagctacgtgggcgcctacttcgtcaaagagggcgaggacgtaaccttcatcgacatgtggccagagcacgtggaaaccatgcggtccaagggattgcgggccagcggcagccagggcgacttcacggtgccggtcaacgccatgcacctgaccgacgcccagaacatctacgatctgttcgacatcgctataatcagcgtcaagtcctacgacaccgagtgggccacccatttcatcaagcggtacgtcaagcctgaaggcttcttcgtttccatacagaactgctggaacgacccgaccatcggcgagatcgtcggtccggaccgggccttgggctgcgtggcctcccacatcgaggtcgctctctgggaaccgggccacgtgaaccggggcggcgaacccggccgcgatcacggccacaccgtcttccgggtgggggagcacaacggcaagatcacccccaagtcggagaagatcgccggcatgctggaccgtatcgacgccgcttacgccagcgacaatctgtggggagagcgctggtcaaagctgtgccagaactccatgggcaacgccatctccgccatgtccaccatgggttcccaggacctggccaaagacccccggacccggctgttccgcatccacctggccaaggaaggcactcaagtaggcttggcccagggcctcaacgtggtggatgtgggcggtaagcccgcccagatgtggtccgaggccgacaaaggcgacgtcttcgaagagctggacgacttcctgagcagccgcggcggcaacgttaactggctggcctccatggcccaggacgtccataaaggccgccactcggagatcgactacatgaacggcctcatctgccaaaaaggccgggaagtaggcgtccccacccccttcaacgacgccatcgttgaagccatgcacggcatcgacgacggctccatcaagcccgacccgtcagtggtggaccagatcatgaaggacgttgggcggtagaccacccttaaacaaactcaggaggaacgcagggctggagaagaatagcaacctagcgcctggatgtgccggacaaaaaataaccgccctcgaaggcggttggcctggtcaccagatgcgatcggcaaaaaaatcgcctcaacaatttgttgagactgccgagcattatagcatatccggagtaagcccgtcaagtttttcagcctaaatcgataaaaaggtcctcccataggcaatgctgccggtcccgttcgtcctgagcttgtcgaaggacccacacactgaggaacaaccggctaaaaccagtcgcagataaggcggtgccaacgtgttcataaaagtcgaacccgccgacttcttaatgttccgggtcatcatgacctttgacctggaaaaccccgactcggaagatcagcaagtccgcgactacctgacggatcacgacctagagcccaggtacacgaaccagggcgagtttgaagaacgccagtgcgagttcatgcagttcggcggctgctacctgggcaaccacctgcaaaacatctcccagatacaacgagtggccgtggaagtcgagcttctcaccgcggagatccgtgtccacctgaacatctcacccgatgccaccacgcccctagccaaagaccagcagaccaccatcgcccaactggtaaaagacttccaccgggattcatccttccagaccaacgaaaacggggaacttatcgcggtgttggacggtgacgaggtccgggcagccgccagccaactggcaagcgtctcttcggacgactaagcttcggctataaggtccgttcttgaagtggagcgggcgatgggaatcgaacccacatggctagcttggaaggctagagctctgccactgagctacgcccgctggttgagactaaatcctggcatttttcggcccaaaacgccactttttgggtcacctttccaggcacgtttttggtcacctaaaaatttccaaaatgccacattgatatgataactcaactggtcactggatggtagcgggggaccgacaaaaaggggtgccggccggcgacagagcgacggccaaggtggcaaatgtggtgggcggtaatggactcgaaccactgacctcttgcgtgtcgagcaagtactctaaccaactgagctaaccgcccacatttgaacggatgtgccttataggtcggggaaagatggttaggtattatgaagttaggtgtgttgacatcaggccaggtacccagcacactaacncgacatgaattcggaagatcgcggaggagagatacgaatagaattgttcaggagcatttacgactggcgattcagagggaggagttcggaggattttcttcgttagttatgcgatagataacgaggcaccaatcaacactctaactaaaaagggggggnnccnngannnnaannggtttnnnnttccnttnnnngcnnttnntttaatntttnttgnnnnnnccnnccaaannnnnnnggcncnnnncnnttaannaaccnnnaactntanaannnnnnnnaatnttnaannnggnnacncctttnntnnnaanttcanngnnnnnnnaagnggnnnnnccaantgtgnnaatnnngcnnaagggnnttnaannnnngnntnnnaancccnnggcnntntcncctttcctnttaanccnnccaannncnnnnnnnnnnnnncnnnnnnngnnccaaccggntttacnccnngnccnggcnntnttcgnnncnnggcnnggggggnnntngntnncnnnnncccnccnccngnanangnggnnanngnnannnnnntntnccnnnnnnananngnggnnncnaanggannnnnancnccncnnnttnttnngngngtntnngngnncnngngnnnnntgngnccncnnancnanaannngnntnnngngncnnnnnnngngnttntcncnnananctnnnnncngnnccccnnnnnnnntnnnnttnnnnnngnnngnnnngnncntnnnngngnnaanggcnnngnnaacnntncccnnnnnnggnannncnnnggnnncnnnnnggngnnntngngngngnannntnnngnnaanggnnnngnnngngtnnacanannnnannnngngtntncnnnnnccnnngnnaannccnnnncnnncnccnc

SEQ ID NO: 1227 - DNA, 4000 bp, Escherichia coli
  misc_feature (188)..(188): n is a, c, g, or t
  misc_feature (1714)..(1714): n is a, c, g, or t
  misc_feature (1717)..(1717): n is a, c, g, or t
  misc_feature (1991)..(1991): n is a, c, g, or t
  misc_feature (3448)..(3448): n is a, c, g, or t
  misc_feature (3863)..(3863): n is a, c, g, or t
  misc_feature (3871)..(3873): n is a, c, g, or t
  misc_feature (3892)..(3892): n is a, c, g, or t
  misc_feature (3919)..(3919): n is a, c, g, or t
  misc_feature (3925)..(3925): n is a, c, g, or t
  misc_feature (3934)..(3934): n is a, c, g, or t
  misc_feature (3953)..(3953): n is a, c, g, or t
  misc_feature (3975)..(3975): n is a, c, g, or t
  misc_feature (3977)..(3977): n is a, c, g, or t
agaactatcgtgaacttttcacactcttggagccaaatggctcggcaccgtttaatgctctacttgcgatggctaattcagaaagcaccgacgacccggaatacaaaaattttcgggacgagatgcctgagcgcacgctcaaaattaataatagcggtggctataacacaactgcaactgctctcgtngtcgattcggacgccaatacgaggttcgttgtaattggcgctctgttgaccaacctcaccactggcgaagtgatgcgtgcttctgctaactccaaccctgctgttctgacagctatcactgtcgagcggaatattggcggcacttcgcactctattgctgatgatgctgatctagctattatcggcttcgcggccgaggaaggggcaacaagtccaatcgcagtatcgtttgacgctgttgtcgtcagtaactattgccagattttccgtacggcattcaaagtcaccaatacgctgaaatcaacctacctccgcactggagataaggaagatgaggtgacgacgaaaggcttacggatgcacatgatggatatcgaacgtgcaatgatctggggcaagaaacacgaaacaggcggtacaaccgctcaacctacccgctacactggtggcttgctcaattccatcacgaccgtcattgatggtagcgcaggcgctcccggatatgtgaatggcgttatcagcgaagatcagtttgatcgtgaactgattgagactatctttgcgtttggtagcaagcagaaggtcgccttcataggcgctcgcgttgcaagcaacctacagaagataggcaaacaacggtggagtcccacgcaggttgaaggctcttacggagtctccatgacccgctacgccacctttgctggtgacctgcttgtccatgtacacccgcagttccgcatgattccgggcatggaaaactcgatgctgattgtcgatttcccattcacccgttatcgctacctcgccaatcgcgacacccagttactcagggatcgtcaagcgaacgacgaagatgcggtgaagcatgagtacctgaccgaatgtggtctggaactcctgcaagacaaggttcacgcctacatcaaaaactggagtgccctaacctaatagggacgacagttctcccgtaaagggttaaaaagagggggctgaaatgccccctttttctatggagaacctgatgtcaaataaaaaacaaaaagccagcccgaaaaccaaaacagccccgaaagaagaggccgtattacctgatgaaatagagatcgaattcaagtacgtctctaaagaaaaggaggggatgttcaaagttctttaccccggcggagggtggagaccatcaatgatgggcgatggccgacttatgtggacgataagcgcatccgagaaggatcgctttgaagcacatcaccatttccagattggaaggatcatccctcatcatggctgatgcccgtatttccacgccgcatattaaggacggcaatgctcaacttgaatccctgatcttctcagcattaagaaggtttggtgatttcgcgccagacacatcagacggtcacctgatgagcatgatgcttgagttcgcgaacctcactgttgatgaggttcgcaaccacccctactgggatgatacccaactggattactacaccgccgtttctgaatcaggcgctgtaccagacaanatnatgatcgctggcttactcacccaatacgcccttcagcaagcgtcagacaaagcgcagatgttcacgatgctttattacaaaacgcttaatcaagaattatggaaccgtctcaacaccaccaacaccacggatggtggcggtaatcgaagcccagcccttcaggtaagaccgatggactcacccataaaccagtccattattacgggacaagagaaagccacaacctaacatggctagtaagaccagttcgcctactggcattaataatactagnacggcaatctatggtacgttttccggcttagatacgtctaggcacgaaacatctcttgataccagcaagtcattgcacatgacgaaactggaaaacggatactgtgatttccaggggcagattgtcagagagtccacagcgcatttcaggaaaggtagttaccctatcgtccaaatgcggttcttggataaagaccatctcgtatgggctgagcaacgtggcgggggcatctacctaaataacgataatgaagacgaactcgaagcctacgcatcgaactctctggtaagtagcactacattcaatcgaaaggtgcatttcacatctcgattacaaagatcattcaactacgacggtatcgtttgggttcgcaaccaatcgttcgccatgaacgagatcatgcgtcccgcttactttagcgctgtccaaagaaggatggtcgccgctggtgtttcaggtaatgagcaaactgtttatctatctcatgtagataatcatgaagtgtgggcggatgatgaagcgccagatagtgctgacgccctgcgaggcggcaaaataaatatctctaatatcgttggctcagccggacgaatcacaggtatagccccattcgagcaaaccaagctcgccatctttactgaagacagaaccttcatttacgatatagatccagatatagctaaatggcttctcgataacagggcatccattaacattggctgtgtctcccacaacaccattcagtcggctggctccgaccttctctattgctctcgttctggtatccacacagtccatcgctcagaagataacggcatcttgttgatgagccaatctttaagcgacaaggtagaaattctctatcgatcctttctttcccaagtggatgatccagaaaccatcaatgctgtttttgatagagacaataagcaataccatgtttactttccaatttctggcggtattacaacgcaacgacttaccttaaatctcaacacagaagtaaaggagggaaggattaagtggtctacaggcacttatctaaacgcaagatgcggagcgttttacggagggcaactcgttgttggaaccgggggtggcgctttcaatgtagacaagccagaggatataaacccagattcagtggccccagagatgacggctgtgactccaattctatggctcaaggatatcgagaacacgaaagaatctcagagcctcacaataattgcatccggccccggcgaaataaaagtcgaggcgctgaatgaggaaaacaaacaattagcctcttgggtcatggagatcgatggcgacacggacgacaaccgctatatcggcgtgccattatccaagcaatatcatcgtcaatttaacgccagattcagaggcttacgacttcgctttacagcgaagtccaaagggctggttcggatcgttggcttcatcgtaaaaangaggtaatcgcatggctcgccttcgccaacagtacccaaacaactacctaacttcgggcaacatcagcaccgaatttgagaacctagtcaggtatctcaatgttggggaactcggcaacaaaacactcggagaacttttaactgtcctatttgatagtgatggtgtattccaaggcccaatcgaaatgcgccttgattccacactcggccttcaatacagggtaggcacctacgctggcgctgaaaccggatgggtcaccttatcagatatcgcatccttgcgaggaacaccaggtgcggatcttggtacgattggcgctccgatcttgtattctcggcaagacacaacagcaatagcgaaccagaccattgttgattacgcacatgtatcgacagatgaacttcttgtttatangaacggcnnnctaaaacgagaaggtagtngtcatgattacactaaaagccacacancaggancaggaggcncaggcgcagtaaccttcancactgccttactcgtcaatgananggtatcaatctacaaaatccgcg

SEQ ID NO: 1228 - DNA, 4000 bp, Escherichia coli
  misc_feature (2158)..(2158): n is a, c, g, or t
  misc_feature (3166)..(3166): n is a, c, g, or t
  misc_feature (3712)..(3712): n is a, c, g, or t
  misc_feature (3718)..(3718): n is a, c, g, or t
  misc_feature (3724)..(3724): n is a, c, g, or t
  misc_feature (3757)..(3757): n is a, c, g, or t
  misc_feature (3889)..(3889): n is a, c, g, or t
  misc_feature (3910)..(3910): n is a, c, g, or t
tttgtaccacttgaggatctcttataacaacacctgcgtaagctagtatccttaatataacttctgtttgttctatattagataattcaaattgagttgacaagggtttattgtaaatatattgacctaaagttccagtggtaaaaccccatacaacattattaggttttcttatataacttacagtcacatcactagctgtagttatagattcaggataaacatatatatgttgctgacctgtgtcattaccactagttcctatagttgattgttcatatgtgtaaatagggaaagtttcggaaggttttgttattggcgaaaggtttaaataaagaagttcatttctatcaactctttgtatttctttatctttaaatataacagtaccaattctatgtgtgtttgatggaggaagaaaatataatgatgtgttgattgaactcactgtagctgtagctaatgatcctggaccagtaacacctataacgtctccaacactatatccactaccgccgttatttacacttatattttgtatagcacctatactaggtgagcttaattttattgtacactgtgtacctgtttgtcctgcttgtactatggttaatatttcattaccattagcataacctgtaccaggttggtttattgttataccagtgatattaccactaacaccaacactatttatatttacagtcaaaccagttccaccaccacctgttgttgtagctaaatttacgccatttgtatagttttgacccgcgtttataactgaaaatcctggaactacagtttcaatatcaacagttaaaccactaccagctcccacatctgtggttgctctatttgtagctcctgaataaccagatccagcattagttatacttagtgatcttactaatcccacaggaacacttgttgtcgtgccgaactgtttaaatatagatattgctgtgttataatttctttgtctattaacgtattctgtatctgtttgtggtattcttaatagttgattatagtcctcaaaatagttttcgaatatttctaactgtacttgtgtagctaatttattaaactcatcaggcgttatgtatcctctttgttctttatttaaaatagacaagacagtcgtgtatactgtatttacgttaattgccataagttattattgtattaatattaggtgaccacacaagtgatcacctattattataatcacttgttaatttatttttttatctatagatttatatatctctacaccttcatcagtctttaaatatgcagcaaaagctgaatatggattttcgtcaaaaggaacggtcattaattttttaccgttagaaccccatgtgaaagttctttgatctgcagataatttaattatgtttatttcagttgcttttatagcaaaatttctaagttgaacattttcatcgttagctaaagctaggaaggtgcttggattttgtttagcaaataaaagtaaatctcttttaatttctttagagttcattttacctacttgactaccaagttctactcttaatatagcttcttgatgttctatatccatttgtttagctgagtttaaagcatctatttctaattcaatattagctaactcatctattgcaacttcaactttatcatgttctctgtatataccatttaacaaagggtggtatagtgataacattttttgtaagttctgttgattttttttaacagttaaaacaccgtctttaaaagttatgtgacccatagtggcttcacctaattgttcatctacaaaaacagaggattgatttgttgcataacgcaactctctttgcattcctttttgttcgtcgtaaaataataaagcgtgtttttttgtatgcttactaggtatagttaatgttaacggacttttgttacccgttaaataataatgtctatcctttatttcccagcctttttcagagctaaggatttctttagtttttttcataatataatataattaaataattttaataagggtaataattacccccgtcagtacaacgagggtaagaattacatttgttgaatcaattagatccctttgaataatacaaagttgtttctagcttgagttactaaacatctttcagataagaantttacttccattgcatctaatgaagatgtgaatgcaccaccaactgaaccagttaaccatgatttcattcttctgtcatcagcttgagaagctctatatcttacatgtaagaaaggacgtctaatgtttgtacctaagatttggtcataaacagttgaagtacctgcaggaactaatacaccttcaatagaagaaggaccagtaagtgcaccacgcgttgaagcgtcgtttaagtatttccaatctgttttatagaaatcgtaagaccctctacggaatccagagaatcctaagtttaatgccatttcttcagagttttcgaataaaccgaaagctacaccacctgcaaaacctccagagataccagctaacatatcatcaaaatcaagagcagtagctctgtttaagaataacatgttttcttcaatagctccttgagtgtcaaggtttttaagaatgtcatcaaatgaatctaaaccagcagcagcagtgaaacctacttcaacgttaccaccattttgaatagcagcaaataaaccttcagttccaggattagcagctggtacaccagcagcgcctgcattaagttcaccttcaaccattgccatttctaagtaatcttcaaatcttagtcttgtttcagactcagcttttagataccataaataacctccagtaccatcttcagtagaaacttctacccaaccgatctgagctgtgtcagaaccattaattgtgtattggcttcttaagattattggagagttagaaaaagtagtaaatgcaggatcaacagtaaccatagggttagcagctgacgctccaacattagcaccttgaggcgcgtttaatgtactacttcctttttgaaagtcagaaccgtatacaaagatcttaactggattaccgttaacgataccgctagcagcaaggttagcaccttggtaaggttcaactattaatcttcctggattaccaccaccaccggcagcgcgtgtatcagaagangtaactaaacattttacttcgtttccgaagccatccattacaacaatagttgatagtggagaaataacgtttagtattggcacagcagcgttagcagctgtaacagggattgtgatagttgcagcagcaccggcagcaccagcaactgtacagttatcgtatgaaatgtgtagtctgttttgttcagaccaaataacttgatcagatgtcatcggcatttctgctccaaccatacgtaaaaatcctgataacgttctgttaccatatctttctacctcttgctcataaagctcaggtaagtattgttgtgcgaaatcgttcgtgccattgtcaaattgtagataattactcgcaagagtttgttgagcttgcgatggtattatcgaaccaaattgaggagttaaagccataatttgtaattttaattagttaaatttttttgttttaatttttaattttgatgaatccaaaccactaattgattttacttttaacccgtttataaaaacatttccgtcagcaacttgcctaggtccgtcttttganggattnttaganctactaataacatttttaatgccatcagctttnccttgttcataaaaatgatgagctagtttatcagcattcatcgcagcatacattgctttatgataccctttttgatctacaatttgaccttcatcattagaaaatctactaacaaagttttgtacatcagantgagtttcgccaaccttagcnggatcttttacgccatatctaaattttttatctcctacattaaaatcaaaacctttgaagtctgaagaaaataattttttagtattgtct

SEQ ID NO: 1229 - DNA, 4000 bp, Escherichia coli
tgcaaatacagagaggataagttgagtaagtactctatagactccacttttattatacataccaggaagctcaatattattatcgataaagtattcaatagaacttgctaagccgtgcatagattcagatgacattggaggacttactgtattttttaaaataattaattgagcagctttggaggatctaaaaaatttatacatcacctcaaccgtctttaaaacaattacagaaacttgattagtttcaagtggggttaattcctctctaaatacattttcacaatctttaaaataacccttaatcatcattgcttttaaagagtcagttgtaggaaaaaatttataagtagaggttctctttaggcctgaatattttgcaatatttgctatcgttatagcttcaagaccatctctaagaagaattgattcagcagtttgaagaataagctttactcttttcttactcctttcttgcttggcaattaattccattattagattatggacaaatgtttagaaaagtaaaatacatattagttattcgtctattttatcaaggacatctttaatagaaacaaatttaaaattttgttttctaattgatccttcgccatcattacttccatcttgaaccaccaacatgcctttaggaaataatggccccaggttgttgtttacaacatcaactccatctgtatccgtaacagcatcaatagatccatttccaacaatattaaagctatttataaaattatatgggtatcttcggttataaatgtttaaagtactattaccttgagaggaaaggataacgaatccttcattagtgtttgatttataaattgttactccttcaggatcgccaacaatattgcctgatctggtatcaataataattggagcactaaaatcaagatttttattgattttgtaagctcttaaaatccctctatcttgttcctcagaaataaataaagttgaattatcagaatcataaacacaaccttcagattgtgtagcatcttggttgttaaatgtatgcaataattttaagttatcacgatatgaccataattgaactcttgatccctcgtcttcagtaatgaatgcaatattaccaaaatactcgtgatgtcctgaacagaccccatatacaatcatgtctgcataaccttttagagttgatttaactggaagcttaaatgtattagattctatatctgagttcattttattgttatctaaaacccaaagatctaaggagctatcatttctattagagccaaatagcaaagtagtttttgaaatgtcgtcagaaattatgtctatgttattaatatttcccgcaggagaaaaatcaagtgtttctgcttttagattatatgtataaataccattatatttatccgttccaaatactagtgaattattaatatttatattattaatccatattgcaggatcatcagcatctccatttatcttaacttggtctgtttcgtatattgatataacagagaatgcattcaattggtatatagaaaaaaaacataaaagatacaaagagtagatttttttaagaattgaatttttattcatagcctattatatgttgtggtactaacatatatataattttactattattatttatggtagttcatatttaacgtaatgttacattctagtgtcactttagtaatttatgaaactttgaagttaatcttttgaaaagagtgttattcacactatgagtaattcatttatatatggaataattgcattttttaacattaatcatataaaaataagcatgaaaaaaaatttttacaaaactcaaaaaagaactactcaatcaattaataatttttctctactttctttattaatttgcatgagtacttttaacttaactgctgctgatactgcgatttatggaaaaataaatttagatgttcttactacagaagcagactctaaatcctcctcggaaactaatagcaatgcatcaaggcttggatataaggcaaagtttaagttatcaaataaagtaaattttctaattcaaattgaaaatgaaatagatgtcacagacggaaaggcagataaaaataaagtacttaaacaacgtaatacatttgtaggtatttcaggtggttttggaaaactttttattggaactcatgatactgctttcaagaaatcacaattgaaagttgatttatttaatgacactaaatcagatataaaaaacctttttgtaggtgaaaacagatcccaggacttagttggctatacatcagcagagataataaaagggttgaaggttactcttaataatattaaaacatctagcaaaagttatcagtcttattcatttgactataacgcaaataattttaaatcatcatttggaatagattcaggtcttaagggttatgaaagtaaaagatttgctatattaaaaccaattaagaacagcacgcttggttttctatatcaagaatccattaatgcagaaacatctaacaaagaatcaggttatgttgttagcttaaaacataaattatcatcaaaatcttctttaatgtttcaaacatccgagtctgatattaagcttattggtggaaagcagaatgctattggatactcataccaatttaattcaatattgaggttatttacaagttactcaaaaagatctcaatcagatagtttaaaaaacaaaaaaatgattagtgtaggatttgagctgaagttttagatcctaaatcatatttcttaaggctcctatagagccttatttaattaactttgatataaagtttactatgtcttcagccaagacttcaggcttttccatggcagcaaaatgaccaccatcatactcattccactgaactacattatagattttttcagcccaaatttttggagggatcatgatatcctttttaaatatagcacctgccattggttgagagactttattaaatgaaaagccaaactccccattttctttatataaccgagctgatgaaggcgctgattctgtaaaccaatacaatgaaataatacttaaaacttcatcattcgtaacaactaatttattagttctttcatcaaaccaaccataaaatttttctgcaatccatgccgccagaccaataggtgagtcattaagactataacctatagtttgtggctttgttcgttgtatttcatagtaaccgtatccttgatttttgtatttattaaaattttctaataactctaattcattttgtgtaacgccttgcataggatcttgattatcaggagggaatgcaattacaagatttaaatgaataccaatacaattattagggtaaagctctgccatccacttactcacagttgctccccagtcacctccttgcactacatatttatcataaccaagagcacccattaactcatgttgaattcttgcaattttctctgaatccatacctttctcagtgggcttatcagaaaatccgaaacctggcatagaagggcatattatatctattgggatttttgattttttatggattataggaataatttttaaaaactcttgaatgctgcctggccacccatgagtcataataagtggaacggctccttctttatcagatttagaatgaagaaaatgaattttaagcccagaattggatttaaatttataactaccaattttatttaactcttcttcatgatccctccagttaaaggagttcaaccactcatttgataagttttttaaaaaactcattcctgttccatgtgaccaatattcatcatttatctcatcgggccaccttgtaagtgctattttttggtgtaatttatttatttcttcgtcagaaatatggatattaaatttttctatcatttttcaaatagtgattcttgttgaacatactatatgcgaaactaataattaaagtaaaatactctatataacctctat

SEQ ID NO: 1230 - DNA, 4000 bp, Escherichia coli
  misc_feature (72)..(72): n is a, c, g, or t
  misc_feature (759)..(759): n is a, c, g, or t
  misc_feature (898)..(898): n is a, c, g, or t
  misc_feature (937)..(937): n is a, c, g, or t
  misc_feature (3091)..(3091): n is a, c, g, or t
  misc_feature (3105)..(3105): n is a, c, g, or t
ggggcccagccaccgctcgacactgggaaaggccgacgcgacatgcagctggccccttaatattgccgttanttgctgtgcattgttcaatattgaatcgcagagcgccgatggctcgtcgtggctggcgtctacagcggcaatgatattcggccgttgggtccagttgatgggtgtgactaacattaccgggcaggtgctgtggcgcaacaggtgccagtcgctgggtgtgcgaataaacccaagggttgagctcgccatggatttgataatcagatcggcatcgatttgttcagcgatggcgagaatcactggccaatcccgtgtttgccagacgactgagcaagacatgctcacggtcttgggcgcgtcggcctgccacgcggcgatcatctccaagacctcgtcctcggcgtcgcgcaagaccgcgctcttgagtgcctcgcgggtctccacttcgtgtagggttaagtcggcaaaggtctcatgcaccactcgcaccacatgcagcgcggcgtcgaggctgacggcgatgcgcgcggccttggccagggtgatctcgccgtcgtcggtgctgtgaatggccaccagcaattgattagagattggcataagttgagcctcgccctcgttataggggccaaaaccattaatctaacggtttcgcggttcggcacccttgacccgagtcaagagcggctggcgagggcttatgttcatgcccttgccagatgcagggctaaacgtggcatactcatnttgagacccatattgagacccatattgaggctcaaattgatacccaaaacgcaacagcgacatgaatccaacaactcaggcgatgactatgcgcacaggcactttatccactcgaatatgtgaagagtatggtatcaantatcccatattcggttttgcccacagtgttgacgcggtnatcgccatcaccaatgccggtgggctgggggtcttcggtggtactcgatcgacacccgaggaaattgaggaagccatggtcaagattcggcgcgcggtcggtagcaagcctttcggcattgacctggtcttgccgccgggtatgccgcaagtagataaccgggcggccatagaggccgaactgcctgccgaacatcgcgagtttgtgcagcagatctataccaaatatgccgtgccgccggctacgcgcccgggcatgcgttcgcggtttgtgcgctccaccgaaatggaagatcggcagttagccgcgattatggcatcagatgttgatctgtttgcctgtggtatcggcgcgccacccagagccatcgatcaggcgaaagcgacgggtaaaaaaacctgtgccttggtgggcagcccccatcatgtagagcgcgcggtcagaacggggattgatttgattgtcgcccaggggtacgacgctggtgcccataccggtcctatcggcaccttctccctggtgccgcaaattgtcgatgccgccggcgatctgccggtgctggcggctggtggcgtggccacgggacggcacatcgccgcctctctggcgctgggtgccgtgggtgtctggattggcaccgcctggttgacaacgcaggagcaccaagatcacttgtcgccccttgagcagcagaagctattagccgcaaccggtgctgatacagtgatttcgcgggccgacagcggcaaaaccctgcgccagattcgctccgcgtggagccaggagtgggacaacgacaaggcgccgcgcccattgaagatgccgttacaggatattctggtgggtgatcttttgggcgccattgatgagcatggcattgaagcgctggtgcacagtccggcggggcagggcattggttggtttaatcagatcaccagcgtcaaggcggtggttgaccagctcgtcaccgagaccgagcaagccttgagtgccatgggcattccccgcgcctagattgcaagcgtcttcgaagcgcgctaggatattgaggatacttctgttgtcattgttgaataccatgccaaaacaacaagccacctgcgccatgtgccaattgatacgcacctacctgttgattgcggtgccgttgattgcgctgttctggtttcagccagaaatgaatctgctgaagggcatcagcctgactaacttggcatcagcttttttcggtgtcgcgttcctagtaacggttggctggaaggcttaccacgaattttggaaagaccgagaccgtggctaagcaaggtcctgattgttggcgctgccagcacttctttatcacctgggacagtcgtcatccatacggctgccatgatatgggtttcaaatcgaagatactgccggcgatggaagtctttactgtgaacggtacccattgcctgtcatttaagcctaaaccgacggatccagcggctaaaaacacgactgccagcggtcaccgccgggttagcaaggcgaacaagcatctcggtcaacatatcaatatcaagggctagcacctaagttggccataagccgttaaggcgtctagccgtcacggtctagtaccaataagaacggtaactcggtgttccgcgcctgccggcagtacatcgtgccttgaaacagataagtcgagcagcgtaatgaatcgtggctccaggtttcgctggaggtccagtagttgttgacctcaatgcccttgaagacgttggggttgaccgatgggctttggcaggctgattgctgaatagacagcatctcttcgttgttcgcgatccgccaggctttacctgatttttcagcaaattcctgggcataagccatggcgtcgtcccaagcaagtttggtcgggtcgccttgacagcgggcgccgctaaatcgctggcccgccgcgcagcgataccacagcgtatcggtcgctgtttgttttgccaggccattatcatcggtgataaagccgctgcggtcaccaggttcgaagtagtccaggcaagagggggcggtagcataaaagtcgcagcccgccagacccaggctgataaggacaaggcccagcaggtggcgaggtctgatgattgaaatcggcataatggacgtctcctgcaccaaacngattgttaggcgcnagctgttggctagtgtttcaccctgggaatagtaagtcgcgcaggatagcggcgcaacctaataacgcggagccctttttcccaggtatttgctggttgccggttgcacttggtcggattgcggtcattaattactgaacttttcggcgtatgtgtcgatagaccaagtaatcaaagcgggccgataactgcaggctattgctgctggctaaaaaaagttcacagaggtattgtcgcgtctgaggattgaattgcgacaggtaaggagaaagaaggatggatttagcgacgattattggcctgttgggcgcgttcgggttgatttttgcctcgattagtcagcctgcggcgtttattgatgtcccgtcgatcatgatcgtcgtgttagggtccatcatggtggtgatgttgcggtcttctctgggagagtttctcggtgccatggccgtcatgggcaaaacctttaaaaacaagctcgataagcccgatgaattgattacgcaaatcgtcgaactggccaccatcgcccgtaaagacggcatgatagccctagaaggccaggaaatacccaacccgtttctcgccaaagccatcggtatgctggtagatggtactgatcccgatatcatcaaaaaatccctggaaaacgaaattgatgccacgaaattgcggcacaagatgggccagagcattttttcagcttggggtgaagtggcgccagccatgggcatgatcggcaccctgattgggctggtacagatgctcggcaacatgtcagatcctaagtcgattggcccggcgatggcggtggcgctactcaccaccatgtacggcgctattcttgccaatgtcatttgtttgcccatggcgatgaagttgggcaatcaggccgaac

SEQ ID NO: 1231 - DNA, 4000 bp, Escherichia coli
  misc_feature (223)..(223): n is a, c, g, or t
  misc_feature (293)..(293): n is a, c, g, or t
  misc_feature (379)..(379): n is a, c, g, or t
  misc_feature (421)..(421): n is a, c, g, or t
  misc_feature (436)..(436): n is a, c, g, or t
  misc_feature (523)..(523): n is a, c, g, or t
  misc_feature (547)..(547): n is a, c, g, or t
  misc_feature (559)..(559): n is a, c, g, or t
  misc_feature (887)..(887): n is a, c, g, or t
  misc_feature (911)..(911): n is a, c, g, or t
  misc_feature (1133)..(1133): n is a, c, g, or t
  misc_feature (1989)..(1989): n is a, c, g, or t
  misc_feature (2405)..(2405): n is a, c, g, or t
  misc_feature (2573)..(2574): n is a, c, g, or t
  misc_feature (2591)..(2591): n is a, c, g, or t
  misc_feature (2597)..(2597): n is a, c, g, or t
  misc_feature (2621)..(2621): n is a, c, g, or t
  misc_feature (2630)..(2630): n is a, c, g, or t
  misc_feature (2672)..(2672): n is a, c, g, or t
  misc_feature (2715)..(2715): n is a, c, g, or t
  misc_feature (3239)..(3239): n is a, c, g, or t
  misc_feature (3271)..(3271): n is a, c, g, or t
  misc_feature (3286)..(3286): n is a, c, g, or t
  misc_feature (3317)..(3317): n is a, c, g, or t
  misc_feature (3400)..(3400): n is a, c, g, or t
  misc_feature (3517)..(3517): n is a, c, g, or t
  misc_feature (3616)..(3616): n is a, c, g, or t
  misc_feature (3649)..(3649): n is a, c, g, or t
  misc_feature (3997)..(3997): n is a, c, g, or t
ttttttgtaggtgcggcgcgcggatcgccacaggtcagcgacggattcgctggggtcgcgggtgaagcgctggttggtgcgggtcacggagctcatgcggtcggcgcggtaggtgcggatctcgccgtcgggaacctttcgaaccagcacataccagtgtgtaccagcgaaaatgaggcccaatggctcgcagcgtcgcaccgccgcgcgacctttaccgggnctgtagtccacgtcaacgatgtagtcggcggcgatggccaataacaactcccgcagcaccggtggggtgnccaggggctctctccaccccgtggggacaataagcagtcgatcctgaagtaagcccaccttgcggctttgggtggggttgaggcgngcgtcaattttgtgctgtgcgcggcgaaaatgctgggccagncccagttcctgcgcnacgtactcaccacccggcatcatgaacgcgagcagttcgctgtcggtcagctgctccatcggcggcaaccagcccggcaggatgganaccccgccatttgcgccgcattcngtcctgatgggnacgccacggcgctgcagctcctgcaagtcccgaagaatggtgcgacgcgacacctgcaggcggtccgcgagtatcgacgccgtgacctgtgcatttccacgcagcatgcggacgatttcagctaaacggtgctccttcacatccccatctcctcatataactgtgacaggtcctgacaccgttgacgcatagccttcagggtacgtgcaatcaaccacgaaggagaagagaagatatgcgcgacctacggcaagaacttttcggtgcccaggactgggtggctgagctgatcagcaacacaaagcccgagcagtactccctgcccacnccctgctctgagttcactgtgaangatctgttggaccactacatgtgtgtctgcgacaagattgaaagcttccctgtggatagaacccccgccgagacgcggacagtggatgactaccttcaagaatggaacgcctcgtcacaacgcgcccgcgccgtgtggactgacgaagccatgcacagggactacaccatgtcctggggtgcagtgcacagtggtcctgagaccgttggcctatacctgttngaaatggtctgtcacggctacgaccttgcctacgctacgggccagcccctcgaaggcccagaggctgtggcgcaagccgcactcgaagcagccatcgaaatcgtctcaaactatccccgtgaggagacaccttatgacccagaaactcgtgcccccgaaaatgcgggtcccactgttgcattagctgcatttctgggaagagacgtttcttaacctacaaatgctgctaacgtagtgaatatgctaagcgtattgctgttggatagcgttgactggtctcggcaaatccatatgtatggaaaggcaacggacacgccaacgcatctgcgggcgcttttaggaaacgacaccgaagcaatacacaaagcactacagcacctcgatagcgcaccgctgcatcaaggaaccgtcgcgcctgcggcggtgacctgcgcacagttcattgtcaccgcgctcaatgaaaaggcgatatcacagcaatgtgctatcaatggggtgctggaatggttgggggagctgggatcgtctatagactatgacgtccctgaagaaaagccacgggtggataacacgctgcttgaagaactttttcagatgaacgatgacgagatggaagagtttttcgactttcttgacgataacggcatggaactcatggacagcctttatgttcaatctcttcaagaacttcatgcctacgcgcccaatgtcgtggatactttgacccgatttggtgccactcaggaggcgcgcgccggatgggaaaaatacgcgcattaacggtcagcagtcgcagttgtggcgtggtaggtattttacctgttgctgtctgctaggttacactctagctaatagnacagtgagtcggccaagggaatctggtgtgaatccagaactggcgcgcagcggtcaggagagtaccgcccgcaggtagagattaagaccactggcgtggatcgcgctgggaaggtttctgtgggatggaatgatcctccgagtccgaaaacctgtcgactcagcggttatcctcccgcgcttcgcgtccaagcagcgggactggcaagaagtgcgtacatggtaaagaagttagctgcgcccacattgtgtgtggtgctgatggcgctgacagctgtgagctttgtggcgtcacttaccttcggctcggtggactacaacaatgctcaagtgtgggaggtcgttcaggctcaccttcaaggtggcaaggggcctaaccaggccgtggattcgattgtgtgggagctgcgcgccccncgtggtgtgttggcgttgattgtcggtgcgggcctgtcgctggcgggcgtcgctatgcaaaccctggtgcggaacccgctggctgatccgtatttgctaggggtgtcgtccggtgcgagcgtgggagccaccgccgtcttgacgtttggccttttcagcagccttggnntgtatgccctttcgggnggtgcncttatcggcgcgctggtcgccacngccaccgtntacgccatcaccatggcgcagggtgggctgaccccgttgcgnctgatcctgtcgggtgtggtgctgtcctcggcgttttcggcgntggcgagttttttggtgttcaaaggtccagatgcgcgtgcggcccagggcgtgatgttctggatgctaggttccgtggctggcgggcagtggaataaactgctgctcccagccgtcgtggtagccattgctcttgtagttcttgttgcgctgagtcgcccgatggatgcgctggctgcggggccggatactgccgctgcgctgggtgttcgcgtggggttgctacggcaggtgctgtttttcattcaggcgctgctggtgggggcgatggtggccattgcgggtggtattggttttgtgggcttggtgattccgcatcttgcgcgaatgatggtggggtcactacacctgcgactactgccgatcgccgctgtgctcggcgcattgtttgtgctgtgggtggacgtgatcgcgcgtatttcggcaccgccgcaagaaattccactgggtgtggtcacaggtgtgctgggtgcgccgctgtttctgctgctcatggggcgtaaccgctaccggtttgggggtcangattaatgtttgttgttgattccgtagctgcnggcatcggcaaaaanacgctgctccgtggagtttccttcaccgtcnagcgcggcaccatgaccgccatcgtgggtatcaacggcgtgggaaaatcaactctcctgcgcgccctcgggggcatcgcgaanccccatgctggccaggtgcttatcgacgccgcgaatgtccacaccatcaagccacggcaccgcgccaccctgatgacgctggtggggcaggaggaaagcccgcccggcgacctcacngtcgcggaaatggtggcgttagggcgcctgccctacctgaaatcctggcagctgggcagctcgaaggaaaaggacattattgcccgttcactagctacngtgggtatttccggcctcgccgaccgtccatgngaccagctctctggtggtcagcgccgccgcgcattgctagcccgtggctttgcccaggaaacagacctggtgcttctggatgaaccaaccaaccatttggatgtgcatcaccagttgcacctattgggtgtgctgcgggattcgggccgcaccatcattgccaccattcatgaccttgacctggccatgtcctatttcgaccaggttgttgtgctgcaccagggcggcatgttgtgtgccggacatccacaggacgtgttgatacccgacaacctgcggaaagtgtttgatgttcaggcgcttatcgcgcaacttccagaggcaaccaacccccacctcatcattgantca

SEQ ID NO: 1232 - DNA, 4000 bp, Escherichia coli
  misc_feature (1)..(88): n is a, c, g, or t
  misc_feature (512)..(512): n is a, c, g, or t
  misc_feature (519)..(519): n is a, c, g, or t
  misc_feature (549)..(549): n is a, c, g, or t
  misc_feature (561)..(562): n is a, c, g, or t
  misc_feature (570)..(570): n is a, c, g, or t
  misc_feature (572)..(573): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (594)..(594): n is a, c, g, or t
  misc_feature (596)..(596): n is a, c, g, or t
  misc_feature (600)..(600): n is a, c, g, or t
  misc_feature (604)..(606): n is a, c, g, or t
  misc_feature (610)..(610): n is a, c, g, or t
  misc_feature (612)..(612): n is a, c, g, or t
  misc_feature (626)..(627): n is a, c, g, or t
  misc_feature (629)..(630): n is a, c, g, or t
  misc_feature (633)..(633): n is a, c, g, or t
  misc_feature (636)..(636): n is a, c, g, or t
  misc_feature (642)..(642): n is a, c, g, or t
  misc_feature (644)..(645): n is a, c, g, or t
  misc_feature (653)..(653): n is a, c, g, or t
  misc_feature (670)..(670): n is a, c, g, or t
  misc_feature (672)..(672): n is a, c, g, or t
  misc_feature (674)..(674): n is a, c, g, or t
  misc_feature (681)..(681): n is a, c, g, or t
  misc_feature (685)..(688): n is a, c, g, or t
  misc_feature (690)..(692): n is a, c, g, or t
  misc_feature (696)..(696): n is a, c, g, or t
  misc_feature (700)..(700): n is a, c, g, or t
  misc_feature (704)..(704): n is a, c, g, or t
  misc_feature (717)..(717): n is a, c, g, or t
  misc_feature (723)..(723): n is a, c, g, or t
  misc_feature (750)..(750): n is a, c, g, or t
  misc_feature (762)..(762): n is a, c, g, or t
  misc_feature (765)..(765): n is a, c, g, or t
  misc_feature (772)..(772): n is a, c, g, or t
  misc_feature (774)..(774): n is a, c, g, or t
  misc_feature (776)..(776): n is a, c, g, or t
  misc_feature (789)..(789): n is a, c, g, or t
  misc_feature (813)..(813): n is a, c, g, or t
  misc_feature (824)..(824): n is a, c, g, or t
  misc_feature (861)..(861): n is a, c, g, or t
  misc_feature (866)..(867): n is a, c, g, or t
  misc_feature (870)..(870): n is a, c, g, or t
  misc_feature (881)..(881): n is a, c, g, or t
  misc_feature (888)..(888): n is a, c, g, or t
  misc_feature (891)..(891): n is a, c, g, or t
  misc_feature (951)..(951): n is a, c, g, or t
  misc_feature (953)..(954): n is a, c, g, or t
  misc_feature (960)..(960): n is a, c, g, or t
  misc_feature (975)..(975): n is a, c, g, or t
  misc_feature (987)..(987): n is a, c, g, or t
  misc_feature (990)..(990): n is a, c, g, or t
  misc_feature (993)..(993): n is a, c, g, or t
  misc_feature (996)..(996): n is a, c, g, or t
  misc_feature (1002)..(1002): n is a, c, g, or t
  misc_feature (1005)..(1005): n is a, c, g, or t
  misc_feature (1007)..(1008): n is a, c, g, or t
  misc_feature (1013)..(1013): n is a, c, g, or t
  misc_feature (1017)..(1017): n is a, c, g, or t
  misc_feature (1019)..(1019): n is a, c, g, or t
  misc_feature (1023)..(1024): n is a, c, g, or t
  misc_feature (1026)..(1026): n is a, c, g, or t
  misc_feature (1044)..(1044): n is a, c, g, or t
  misc_feature (1053)..(1053): n is a, c, g, or t
  misc_feature (1071)..(1071): n is a, c, g, or t
  misc_feature (1074)..(1074): n is a, c, g, or t
  misc_feature (1080)..(1080): n is a, c, g, or t
  misc_feature (1083)..(1083): n is a, c, g, or t
  misc_feature (1092)..(1092): n is a, c, g, or t
  misc_feature (1158)..(1158): n is a, c, g, or t
  misc_feature (1182)..(1182): n is a, c, g, or t
  misc_feature (1184)..(1184): n is a, c, g, or t
  misc_feature (1188)..(1188): n is a, c, g, or t
  misc_feature (1190)..(1190): n is a, c, g, or t
  misc_feature (1197)..(1197): n is a, c, g, or t
  misc_feature (1209)..(1209): n is a, c, g, or t
  misc_feature (1211)..(1211): n is a, c, g, or t
  misc_feature (1218)..(1218): n is a, c, g, or t
  misc_feature (1224)..(1224): n is a, c, g, or t
  misc_feature (1227)..(1227): n is a, c, g, or t
  misc_feature (1236)..(1236): n is a, c, g, or t
  misc_feature (1239)..(1239): n is a, c, g, or t
  misc_feature (1254)..(1254): n is a, c, g, or t
  misc_feature (1275)..(1275): n is a, c, g, or t
  misc_feature (1284)..(1284): n is a, c, g, or t
  misc_feature (1317)..(1317): n is a, c, g, or t
  misc_feature (1337)..(1337): n is a, c, g, or t
  misc_feature (1344)..(1344): n is a, c, g, or t
  misc_feature (1356)..(1356): n is a, c, g, or t
  misc_feature (1365)..(1365): n is a, c, g, or t
  misc_feature (1368)..(1368): n is a, c, g, or t
  misc_feature (1380)..(1380): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcaattgcgggcctttttttatggaataaattcacctaagctaaagacaaaagagattcaataatgtttaaattaattgagatttaatgtcaacagtagagattcaataatcatttcaattaattaagatttaatttcaacaatcgcgaatcacttttcagataataataagggcgccaaaaacttttacccaaaccgtcatacttccaaacaacttctccttgaacagatacttcccaataaccatagtcaccctcacaaattaaagtattgccgttagggagcctctgaagaccggagattttatcaaaatacatgtctgtattcgtaaatgaccattgcttcacgggagcaatataattttgcatactattcgttgagaaagtgggtaacaccaattcataggcaatagactgttctangttgctnccattattataaattagaaaattcccattnccaggataattnncaggcacnanngaaggntgntgnttgttaaananaaantgtnnngcantngtgttttcaaatanngnnggnttnccaaancnntacactangtctcctcccctattanantngcctccntgannnntnnnagcntctncagnagaagtactgtgntcaatnacccaaacctcagaataaaaattaacnctcatatagatnagntcagtancngnatcatagaaaatnccattggcatgcatccaatccccnttctctaaatnactgtgattaaggtcaattttattggggaaatcaganagctnnccntataaatcatngtcagcngcngtattttggaccatatgatcccaactcctccactgccaaacaatttcgttggtttgaggntnnacctcnattaatttctctaanaaaatatcatgnccnggnaantgaccngcngnntctanttgnanttcnntnattctttcccaaaccatnatcatcacntggccattgggcaattgngtngcatcntgntgggcaatntcattttcggtattcacctcataacgccacaattcctttccagtataatccatgagagacacgacncctccaaaaccaccaaaagtaatnanaggntntgaaganttaaaacaagcnantaaatcnccaganggngttatttcnatntcatttccaaaacgntcttcaaaagcccactctttnagcttttcnccctcatgattcaccaaataagcatttttttgnccgttttccatcataaaaanatacccnctttgatctatnccttgctcnttntaaagtacaatnttctgttgagcaaagcgctctaatggtataaagaaagcaacaacctcaatattattgctcaaaacaagttgcttagacacttctaatcccgtcaaagcaccctcccaatgagaaaatttataattaggtgctgccacagcagtaatggtaatattctggccagtttcgtatggaggattatcgctaaagacaatttcaccaccttcaataggcacagaagtagaaataacattataaaaatcagcctcttgcaattgattggtagagcaagatatcattgtcaaagacaaaaggaaaagaaaagatattttcattacatcaagttttatataaaggtaagttgtttaagaataaaaatatattcaaaaatttcgtttatcatttaataaaattttacccagaaagcaaaacaaaaaaaaagaaaaaccaataaatactaattatacagtaagcattagtgaaatattaactcttttattaataataactatggaaaaagatcaaattatctaaaaaaattaattttaaattaaaattttaaagaattctttacattaagattaattatgttaattattaataataataattaataaataatgcatttataagtaaaataattataatattaaattatgtgtaacaaaatattgtattaattgaatatttagtggatatttacccacttaatttaaaataaaaccaataatgaaaacaactttaaatgggattttgacactattattagtgttcgttgtgcaaatatcttttgcgcaagagaaaacaatttcaggtactgtttcggatcaaaacaatgttgtattaggtggggtgaacattttagttcaaggcacctctaatggaacacaatcagattttgatggaaactttactattaacgctagtgtaggacaaacattagtatttacttacattggaatgaaacaaactactgcaatagttggttctagcaatgtaatcaacattcaaatgcaagaagacgcacaagctttagaagaagtagttgtttctgcacttggtattacaagagagaaaaaagcactaggttactcacagcaaactgttaaaggtgaaaacttagtacaaactaaagaggtagatttgaatacagcactttctggaaaagtcgcaggggttcaaatgataggtgctccctcctctacatttgaccaaggtcttcttagattaagaggtgaaaccggggttttatatgtagttgacggtgtaaaagtatactctcaatcagatatcaacacagacaacatcggaaacatatccgtactaaaaggtgccgctgcaacagcactttttggggtagatgctagaaacggggttgttttaattacatctaaaactgctaaaaacggtgttggctcaatttctattgatcatacaacatctatgacttctgtagctttattgccaaagtatcaaaacgaatacggtggtggctactatcaagagtgggatacttttgaatataatccagacacagatcctgcagaatgggctgcttttgaaggacaaaaaacaccatactacggtgcagatgaatcttggggaccaagattagatggaacattagtaagacactgggattcttggattccaggatcagacacatttggagaattaagaccatggtcagctaatcctaataatattagagacttctaccaagatgcaatcactaataacacttcattaaactggtcaaagggtggtgatgattataaaattgcagctactgtgagaaacataagcactgaattaattttacctaattcagctagaaatcaaattgatattaacttgaatgcatcttataagcaatctgaaaaattagacttatatacttcggtaaactaccaaactagagttactgaaaacgaaccattacagggttacggtggactaggtgcaaactttaaccaatggtggcaacgtcaaattgatatggatcgtttaaaaaacaattatttccaaaatggcgaatactactcttggaacattcgttctccaagaaactcaagaccacaatattgggatgcgcctcattttatggtagataacaacaacactttacagcgcaaggatgtattatttgggaacttcggtgctaactaccaattaacaagtaatattaaagctaatttagaagcaagaagaagggtaaactcatatttctataattcaagagtagcctttggaggtttagatgtaccaagttataatgaaagtagtagccattacgagcaaaatgaattgtttggttttttaaactttgctgatcgttatatggatgacgctttagatattgatgtaaaagctggattccagttacaacaaaacagatctcaatcaacttctgctggaacagtaggtggattatcagttcctgatttctactcaattgctacttctgttgaccgtccatcttattcgcacaatttaactcaatctaaagtgaattcattattctcttctgtttcagtaggctataatagtactttttatattgatgcttcatatagattagactggggttctaccgcaaatacagcaaataacagattagaaacatatggtgtctctggtg

SEQ ID NO: 1233 - DNA, 4000 bp, Escherichia coli
  misc_feature (212)..(212): n is a, c, g, or t
  misc_feature (1363)..(1363): n is a, c, g, or t
  misc_feature (1971)..(1971): n is a, c, g, or t
  misc_feature (1973)..(1973): n is a, c, g, or t
  misc_feature (1976)..(1976): n is a, c, g, or t
  misc_feature (1985)..(1985): n is a, c, g, or t
aagacactttggtgtcattgtagataaaggtatcccgggtgtgatactggatcaccacaggacagtgtcgcaatttatgcagcttccttgcataaaaacgcaaggcacggtcacgaggatttcgccgtggaaaaaatattttcaccgtgcgctcgataccggtaccgcgctcacgtaccaggtagacctcaccttcccatcctgcacccagnaaagtaaccacctggtattttccagccagacagtcgccacaatggagattaaaactccagattctcggctgtgatttcatcaacgctacgtcgtcaacatccttcgtggtgtggcaccatctacagttttagtgcccatagaccgcttggtaaaagatcaaattaacggggtgtggtcatttattcgacgactgcccgttttgagttcaggcctgctgatcattaaggtccggcccagactcggcctctttggtctccttggatttgattatgcgtgaacagtacaaacccgcttcaaacagcaaccaaaccggcacggccagcatagtttgtgaaaaaatatcgggcggcgtcatcaccatacccaccaaaaatgcacccacaatgatgtaaggccgcttgctggccaaactatccggtgtagtcataccgaccttgaccatcaacacggttgcaaccggcacctcgaacgccaggccaaaggcgaaaaatagcttcagcacaaaactgaggtaggcattgatgtcggtcatcaccaacaccccttcgggtgcggtactggtgaaaaaagcaaaaataatcgggaaaactgcgtagtaggcaaacaaaattccgaggtaaaacaagatactgctggataccagcaggggtactgtcaaccgtttttcgtgacgatagagccccggggccacaaacgcccacaactggtacaacagatagggcatagcgaccgccactgctaacgcaaaagcaaacttgaacggtacgaaaaacggaccgtggggctcggttgagatcatactgttcccttccggcaacgcgtccatcagtggggccgccaagtactcataaagatcgtttgcgaagggtgcagcgatcagaaacacgatcaaaatagagcccccaccacgcatgatgcgattacgcagctccagcaggtgggacataaacgtcgttgcctcatctccgggtcgtgtgctcggttcagccatggtctaatcggtcaggacgtggggatctgcttttctttggtctgtgaagtgtctgtcgtgtcatccacgggagactcgttttctgccgactgagccgaatcgtcggctgctgtgacatcgctcactgacgattgaatatcatcggctgatttcttgatngactcgacgacagactccacgccgctgtcatcggcaacctccccagcagcactctgaaattcattttttacgtcactgatttcatcgcccaacttacgaaggtcagccaactcgctctcacgcatctcccgatcaatgtcggacttgacgtcagctaccattctgcgggctttcccgacccagaaaccgagcgtgcgtgcgactttgggcagccgttcgggacccaatatcacgagggcgataatcgcaatgattacgacctcggaaaatccgacgtcaaacatgatgcggcctcagataacgatcagactttttccgtcttcacgtcctcagtcgcctctacatcggcaagatcgtcctgggacgcttcagcctgctgatccgccgtctcgggatcttcgctgtcactgtcgctgtcaccacccttgacctctttcattgaactacggaaccctttgattgcgccgcccaggtcaccacccatgttgcgtagcttcttggttccaaacaacaacagcacaatgaccaatacgatcagcagctgccaaatgcttatgcctccaacacccatgagattctcctctttttgatctaccctcttgacaggntnacnacccacccnaacccaccgatggaacgccccctgatagttgaataataaccctttttcccaaaatccacgtaaatgtactcgtcaaacatctgcgcaaaacaggcacagcgccctactcagggcccagtaacccggatttcatcggtttcctatcgtcatttaacctaagtacctgcaccagattaagtggatattcttcaacgcccaaccctgactcacgccgatcatttcgtcgtgagccacgttgatgccgcagagaaatttacgatgtgtgcacggctgcgtggggataccgaccgctcgagattcgctggatacgggcaccacactgggcgagtttttcttcgatgcagtcatacccacgatcaatatgatagatacgatccacaaccgtctggcctttagcggccagtccggccaggaccaaacaggcagatgctctaagatccgttgccatcacctgggcaccacttaagtttttcacaccgcgcaccagtgctgtattaccacgcaactctatatcggcacccatccgctgcaattcctggacatgcataaatcgactctcaaatatcgtctccgttactgctgctgtaccctgagcaatactgttgaggagaatgaactgtgcctgcagatctgttggaaacccgggaaatggctgagttgtcaggtcaactgcctttaatcgacgcccatccacagacagggctatggtgtcctgatcaaccctgatcgagacacccatggcatcgagtttcaccagtacagcatcaagcaaattcgtttctatgccactaagttgaatctggcccccggttgcagccgccgctgcaagataagtaccggcttcaattctgtcgggcgcaactctatggtatgcgccacttaaccttgccacaccctctatttcgatctgaccggtaccagcaccactgatccttgcacccatcgcgaccaagcatttagcgaggtctacgacttcgggttctctggctgcgttttccagtattgtccgaccgtcggccagtacagctgccatcatcaggttttcggtacccgtcacagtcaccgtgtcaaaaacaatccggcacccctgtaaacgacccgccggtatgctggcccggatgtagccaccttctaccgtgacttgcgcccccatcatctcgaacccctggatatgtagatcgactggccgtgagccgatcgcgcagccaccggggagcgacacctcggcttcaccgaagcgcgttagcagcggccccagaactaaaacggaggcacgcattgttctgaccagctcataaggcgcccgatgactggtcaattcagccgcattaacgtctatcgccagcttatcgtcgacctcaattcgtaccccaaggtgaccgagcagttccagtgttgtcgtgacgtcctgtagatgtggcacattgctaacaaccaaattctgatcagtcagcagcgacgcaatgagaaccggtagcgctgcattctttgcgcctgagattcgaatctcaccctctagcggaatgccgccactgatcagaagtttgtccacgtgctaaaacatttgagtgctgtttacgccttccgttgattctggttcgagtggttacgcctgtccagttgttccgaccacaatcaagcaaaaggcgcccgcaggcgcctttatcaactcacggactcaaccccgagctgtcagtttgcgactgtctccagtttggcctgaagttcaccactttcatacatttctgtcacgatatcactgccgcctacaaattctccgttgatatagagttgcgggatagtcggccagttcgaaaaatccttaattccctggcgaatttggtcatctgaaagtacgtcggctgaggcgaattgcgccccgcacgcctgcagaatctgcacaagcctgccggaaaaaccacactggggaaagtcgggacttcccttcataaacagcatgacactgttttcctcgacaatatttttgatttgttcctgcacgttcattagcgtcc

SEQ ID NO: 1234 - DNA, 4000 bp, Escherichia coli
  misc_feature (131)..(131): n is a, c, g, or t
  misc_feature (984)..(984): n is a, c, g, or t
  misc_feature (1988)..(1988): n is a, c, g, or t
  misc_feature (1991)..(1991): n is a, c, g, or t
  misc_feature (2479)..(2479): n is a, c, g, or t
  misc_feature (2863)..(2863): n is a, c, g, or t
  misc_feature (2951)..(2951): n is a, c, g, or t
  misc_feature (3321)..(3321): n is a, c, g, or t
  misc_feature (3571)..(3571): n is a, c, g, or t
  misc_feature (3605)..(3605): n is a, c, g, or t
  misc_feature (3624)..(3624): n is a, c, g, or t
  misc_feature (3921)..(3921): n is a, c, g, or t
  misc_feature (3953)..(3953): n is a, c, g, or t
catgcccgggaaccgccgtgcgctcgccgcacccgaccgcaatcgctacaatgcgtcggtttgcgccaccacaatccggagcccccatgagcgaccagcccttgtaccgccgcatcctgctcaagctctcnggcgaggcgctgatgggcgaggccgactacggcatcgacccgaaggtgatcgggcggctggccgaggagatcatcgaggtacgcaaggccggcgtggaagtgggcgtggtgatcggcggcggcaacatcttccgcggcgagggcctggccgcgtccggcatggaccgcgtcaccggcgaccacatgggcatgctggccaccgtgatgaacgcgctggcgatggccgacgcgatcgagaagcacggcggctacgcccgcgtgatgagcgcgatccagatccacgacgtggccgaggacttcatccgccgccgcgcgatccgccacatcgagaagggccgcatcgcgctgttcgcggccggcaccggcaacccgttcttcaccaccgactcggccgccgcgctgcgcgcggtggagatcggcgcggacctgctgctcaaggccaccaaggtcgacggcgtgtacaccgccgatcccgcccgccatccggacgccacccgctacgaccagctcacctacgacgaggtgatccaacgcaacctcaaggtgatggacaccgccgcgatcgcgctgtgccgcgaccacaacacgccgctgcgcatctacgacatgacggtgccgggcaacctgctgcgcatcatgcgcggcgaaccggtgggcaccctggtgcgcaactgacgcgcccggggcgcgccgccggccgccacggccggcgctgctatactcgccggctagccagatccaccgggacacgcccatgatcaacgacatcaagaccgatgcccagacccgcatgggcaagagcatcgatgcgctcaagcacgagctcacccgcctgcgcaccggccgcgccagnaccgcgctggtggacggcatcaaggtgcccgcctacggttcggagatgccgctgaaccaggtggcctcggtcgccctgggcgattcgcgctccatcatcatcacgccgttcgacaagagcctggtcggcccggtcgagaaggcgatcctcgcctcggacatcggcatcacgccgaccaccgccggcaccgtgatccgcctcaacatgccgccgctcaccgaggagcgccgcaaggaattggccaagcacgtgtcgcacgagggcgagagcgcgaagatcgcgatccgcaacgtgcgccgtgacgcgttgcagaagctgaaggatctgctcaaggacaagcagatcagcgaggacgaggagcgccgcgccgacgacgagatccagaaactgaccgaccgtttcgtgaaggacgtcgacggcgtggtgaaggccaaggaagacgaattgatgtccatgtaatgggcgtcgcgacgaagccgcccagcaccgcgccagttcatctgccaactcccggaacgttgcgatgacgtcattcccgcgaaagcgggaatccatccgcttcgagcctctcaagccaacatggatgcccgctcgcgcgggcatgacggcccgaaagtccgaagcactgccttctcgccaaggggagaaggaaccagccacaggcactcatgaccatcccccgccacatcgccatcgtgatggacggcaacggccgttgggcgaaggcgcgccaccggccgcgcagcttcggccacaacgccggccgcaaggcggtgcgcgaggtggtggaaggctgcctgcgcgaaggcgtcgcggcgctcaccctgttcgcgttctccagcgagaactggaagcggcccgaggaggaagtcggcgcgctgatggcgctgttcgtgcgtgcgctggacaaggaaaccgacgagctgcatgcccagggcgtgcggctgcgcttcgtgggcgacctggccgcgttcgacgcgccgctgcgcgagcgcatgcaggcngcnatggcgcgcaccgcgggcaaccgcaagttgcagctcaatatcgcggtgaactacggcggccgctgggagatcgcccacgctgcgcgcgaggccgccgccgcggtggcacgcggcgagctgaccgtcgcggccatcgacgaatccgcgctcgaccgcttcatgtgcctggccgagttgccaccgctggacctgttcatccgcaccggcggcgaatgccggctcagcaacttcctgctgtggcaggcggcctatgccgaactgcatttcaccgataccctgtggccggacttcgaccaggcctgcctgcaccgggcgatcgaggactatggccgacgcgaacgccgctacggccgcaccggcgatcagatcgccacggactcccaggggtaagcatgctgttccagcgcgtcatcaccgccttgctgctcgcgccgctggcgatcctgatcatcctgctgctgcccacgccgtggctcgccgtggtcggngccgcgctgttcctgggcgcgctggaggaatgggcgcgcctcgccggcgtgcacaaggcatccatgcgcatcgccctgctggtggtcgccgccgcgctgttcgtgctgctgtggttcgcgcatgccggcgcgctggtgccgctgctgctggtgctgggcgtggcgtggtggctgctggcctgcgtatggctggcgcgtttcgcgttcggcgcggcgccgacgccggaaaaccgcgcgctgaagctcgcggccggcgccttcgtgatgttccccgcctggatcgccgtgatcgccctgcacggccgcgagccgcacggccacgggtggatgctgttggcgctgctcatcgtgtgggccgccgacatcggcgcgtatttcagcggncgccggttcggcaagcgcaagctggcgccgcagatcagccccggcaagacccgcgccggcgcctacggcgcgctggtggccggcaccntggtctgcctcgtcggcggctggctgctgggcgtgcgcggcggcgccctgctcggcctcgccgtgctggccgtgctcacggtggccgcctcgatcgtgggcgatctgctggaaagcctgatgaagcgccatgcgcaggtgaaggattcgggcacgatcttccccggccacggcggcctgctggatcgcatggacagcgtgttcgccgcattgccggtgttcgccctgggcctgtggctgctggggatatgaaaggccgggaatcggaaacagggagcagggaatcgaaccgcggtgcgcggctcgtgccgcgcgccagcaaactcgccaataatccgcttttcctgttccccattcccgactcccgattnccccgcaagagacacaggccatgaaacgcgtcgccgtcatgggcgccaccggctcgatcggcgccagcacgctggacgtgatcgcgcggcatccggaccgcttccgcgccagcgtgctcagcgcgcaccgcaacgtggatgcgctggcggcgctgtgcgccacgcatcgccccgaactggcggtgatcgccgagcccgcgctggaaggcgagctggcgcgccggctcgccgcagccggcgtgcgctgcgnggtggccagcggccatgacgcgctcaccgccgcngcatccggcacgttgtgcnacaccgtggtggccgcgatcgtcggcgccgcggggctggactccacgctggccgccgcgcgggcaggcaagcgcctgctgctggcgaacaaggaatccatcgtgctcggtggcccgctgctgctggaggcgctgcgcgccggtggcggcgaactgatcccggtcgactccgaacacaacgcgatcttccagtgcctgcccggcggtcgtccggagctggcgaagagcggcgtgcgccggctgatcctcaccgcctccggtggcccgttccgtggccgcacacgcgccgaactggcgncggtgacgccggaccaggcctgcaagcatccnaagtggtcgatgggccgcaagatctcggtggattcggccaccctgat

SEQ ID NO: 1235 - DNA, 4000 bp, Escherichia coli
  misc_feature (97)..(97): n is a, c, g, or t
  misc_feature (964)..(964): n is a, c, g, or t
  misc_feature (967)..(967): n is a, c, g, or t
  misc_feature (976)..(976): n is a, c, g, or t
  misc_feature (979)..(979): n is a, c, g, or t
  misc_feature (1156)..(1156): n is a, c, g, or t
  misc_feature (1168)..(1168): n is a, c, g, or t
  misc_feature (1174)..(1174): n is a, c, g, or t
  misc_feature (2725)..(2725): n is a, c, g, or t
  misc_feature (2916)..(2917): n is a, c, g, or t
  misc_feature (2919)..(2919): n is a, c, g, or t
  misc_feature (3034)..(3034): n is a, c, g, or t
  misc_feature (3716)..(3716): n is a, c, g, or t
  misc_feature (3795)..(3795): n is a, c, g, or t
atcgtaatgaatagatctaacctctgatacaaatttatcccctacgtactcagcgttcttggcaacataatcattaagttctttgattttgcttttnacatttttaaaaaactcttttttttgctcaacatctttttcagcgacagaagttttagaagtggcaacacttggggccattatgctctttttaacagtctttgagcgaccacagacgtaacaattaattaaattcttttttaataacttttcatattcattggaattttgaaaccagctctcaaaagtttcaccacaagaacattcgagattatatttaatcatacccttaatgtagtaacgttcgtcttaatttcaatacgttagtttttattgaagaacagaataaccttaccaagcgttattccaaattttgacatggttgcaatgttcactaagtaattattatcctgcaaaaacatccaatcatcgaaacttactttgtatttgctagagccaattggaagatcaaaatcatacttccagttaaacgcatttccagaagttgaacctgaagcaagacctataactccatctgcataaccttgatattggttggtaccaattttttcaagcttccactctctatactctttagttccatcatcataaataaagttttccttcataatgagatattttccgtcccaagtcccatcaatatcaactttgaaactctttttaacgtttccaaaacgatcttcaaatactcctcgtgcaacggttttacctttaaaatattcttctaatttaaattcaggcttattatttttaaattgttctaatttcatagacgaagaacactgtgttacactaaaaaaaataaaaaatataaataatattttaagatttttatttaaaaaatttgtaataattttcataaattctatcaaaaaccatctgacttcctggtaagaaattaaactgnttngtttgcttnctntttatccagtttaattgttgtttttctttaagtttaatctttccagaccaatattctaccagataaatcatcataacgattatattttttttataacgatgtgtaattaaatctatattttttaaatcttctttatttatattaactcctatttcctcatataactctctaacagcncaatcttcaaangactcnttattaaaaagttttccccctggaagctcccaaaatccacttaaaaatttacccttaggtctactggtaattaaaaccttattagattttttaagcaaacatgatgaaacgtaaattattttcatgaaaagaatttaacaaatttttaatattaacaaaattgacattcttgcctatgctacctatataacacttcaatctaattaaaacatatgccgacaatctttgataatttaaaaataggcaacctaacacttccaaatagaattattatggcgccgcttactcgtatgcgaagcaagcaacctggtaatattccttgggaattaaatgcaacttattattctcaaagatcatctgctggttttattataactgaggcgacacagatatcgcagcaaggtcaaggttatcctggaacccctggaattcacagcaaagaacaagtgcaaggatggaaattaattactgacgctgtacataaaaatggtggtcatatttttttacaattatggcatgttggaagaatttctcattcatctcatcaaccaaataatagtttgccggttgcaccttcagctattgctgcaaaaaattctggaacatttactgctgattggaaaccgactcctattttaaccccaagggcattagaggtatcagaacttcctggaattattcaagattatgtaaacgctgcaaaaaatgcaaaagaagctggctttgatggcgttgaagttcatatggcgaatggatatttactcgatgaatttttacaagatgaaagcaataaaagaaccgatgaatttggtggcactataaagaatagagttaaatttcctatgcaggtactagatgctgtcattggtgtttttggaaaagatagagttggcgtgagactttctccttatggaacgttcaatgatatgagcgactctaatcctgtagaattattcacttatgtaatagatcaattaaatcaaagacaaattgcatttcttgatatgattgaacctagagcaacatcagctggtggtggcgatgctgtagatactaacgctccttctactacaaaattatttagaaaaaaatttaaaggaatatttatttctgccggcggttatacacctgaagatgcaaaaaaagctattgagtcaaatgatgtagatgctgtagcatttggtagaatttttattgcaaacccagatttaccaaaacgtattaaaataaatgcacctttaaatccctatgaccgtgcaacgttttatggtggtaatgaaaaaggttatacggattatccagctttaagctaaattttaaacaggatcaatgtgagtcattaggtttaaaaccctagaactacgcatgactctatttcttgcctcaactgcaatatcatgaccttctgcaactgttaaagttcctttaactccaatatggacatctgcaataatgctatcaccaacttttcttgttcttaaatcatgaacattaacaacgcctggcgtttctaatattatttttttaattttttcaacttcatcagtatcngcggctttatctgttagagcatgaattgcttcataactaaaagtccatcccatttttaaaatcattacacctacaatgatcgcagcaattaaatcaaagctatgataaccgagaagattaaaaataattccaattgcaacaattaaggatgacgctgcatcagagcgcgcgtgccaagcattggccattannanacttgatttagctctttttgcaatatttaaaagataacgaaataataattctttaactactaaacaaatgattgaggcatataaagccataacatgtactgctacgatctgatcngaattttcaagcttcttacctgcgctccaaatcatcgcacatccaacaaacaataatagaactcctaagaataaacctacggcattttcatatctatgatgaccataattatgatcgtcatctggtggatttaaagatttcttgcttgtaattaaaacaattaaatctgaaagcatgtcagctaaggtatgaaagccgtctgctatcagtcctgatgatttagaaaaaaatccaacaactatctgaaaaataactagaaaaaaattaacaactacacttgtccatgtgctcttattcgcaatttttctttttctaatataattggttaaagaatctgacattcgttctgctgtataaaatatagaatatgtataagctattttatttagttgattaaataaagttcacctatatggtcttttttttattaatatttgaatgccaacaataattgattacgttttactgactgttatcacgatatttccagttttgagtcttggaataatgttatttttttcttttgtaattgcaccaactgttcacaaattcttacctactgcacaatctggtccatatattagaagactttttcctatttattatatcattaatgcagctcttgctttgggttctctaatcgcaattgcctctcttggcgtgtttaatataattttctacncaaatacaattattttggttttgtttgcgctttgttatttttatttaatgccagcaatcaataaacaaaaagtaaaaantaatcgcgcgtttaaaatcctgcacggaagttctattgcaataaattttgtccaaataattctgttaatactgattactgttattctgctagacttttaaaatccctttacttagcccttcgataaataatatcaaaaaccattggtgaaaaagttgcaagtaaaaaagaccaaaaaagcaaagaattggtaaaaatttcattaa

SEQ ID NO: 1236 - DNA, 4000 bp, Escherichia coli
  misc_feature (268)..(268): n is a, c, g, or t
  misc_feature (271)..(272): n is a, c, g, or t
  misc_feature (274)..(274): n is a, c, g, or t
  misc_feature (276)..(277): n is a, c, g, or t
  misc_feature (280)..(281): n is a, c, g, or t
  misc_feature (283)..(285): n is a, c, g, or t
  misc_feature (287)..(289): n is a, c, g, or t
  misc_feature (291)..(292): n is a, c, g, or t
  misc_feature (295)..(298): n is a, c, g, or t
  misc_feature (300)..(301): n is a, c, g, or t
  misc_feature (303)..(303): n is a, c, g, or t
  misc_feature (305)..(308): n is a, c, g, or t
  misc_feature (310)..(310): n is a, c, g, or t
  misc_feature (312)..(313): n is a, c, g, or t
  misc_feature (315)..(316): n is a, c, g, or t
  misc_feature (318)..(322): n is a, c, g, or t
  misc_feature (324)..(332): n is a, c, g, or t
  misc_feature (335)..(335): n is a, c, g, or t
  misc_feature (337)..(338): n is a, c, g, or t
  misc_feature (340)..(341): n is a, c, g, or t
  misc_feature (343)..(343): n is a, c, g, or t
  misc_feature (345)..(345): n is a, c, g, or t
  misc_feature (347)..(348): n is a, c, g, or t
  misc_feature (351)..(351): n is a, c, g, or t
  misc_feature (353)..(355): n is a, c, g, or t
  misc_feature (357)..(360): n is a, c, g, or t
  misc_feature (362)..(363): n is a, c, g, or t
  misc_feature (365)..(367): n is a, c, g, or t
  misc_feature (369)..(370): n is a, c, g, or t
  misc_feature (372)..(378): n is a, c, g, or t
  misc_feature (380)..(384): n is a, c, g, or t
  misc_feature (386)..(387): n is a, c, g, or t
  misc_feature (389)..(392): n is a, c, g, or t
  misc_feature (394)..(395): n is a, c, g, or t
  misc_feature (397)..(399): n is a, c, g, or t
  misc_feature (401)..(401): n is a, c, g, or t
  misc_feature (403)..(405): n is a, c, g, or t
  misc_feature (407)..(411): n is a, c, g, or t
  misc_feature (413)..(415): n is a, c, g, or t
  misc_feature (418)..(418): n is a, c, g, or t
  misc_feature (420)..(423): n is a, c, g, or t
  misc_feature (1506)..(1506): n is a, c, g, or t
  misc_feature (1992)..(1992): n is a, c, g, or t
agggatgacattttcgcgttgaccagggaagccgctgatgtttcagggatcaattatattatggattgggaaaatgagacatcagaagcaatactggacgcataactcttctaattaatagtacctgcaaattaagtataatataattttaaaggctgtataaggtattaaaaacctcatacagcctttttttataaactaagggttgctggccgagataaacagttaagtgtaaaacagaatttctatttcctttattataacttgnaannangnnaannannntnnnannttnnnntnntngnnnnantnnannannnnnannnnnnnnnaangnnanntnangnnttngnnnannnncnntnnngnnannnnnnnannnnngnnannnnannannntngnnntnnnnncnnnaancnnnncccatattgatattaactttgcccgcgtggctcaatggcagagcacgtcactcgtaatgatgagattgggggttcgactccccccgcgggcttcattaaatgttgagagtgtataaaccaaaagagacaaaagcctgttgaagtcgatactgacaggcaaagggagtttggaccggactaaaaatggataaaatggtaattgaaggtggtaatcccttgcagggaagggtcaggatcaacggtgcaaaaaacgctgcgttgcctattatggctgcatgcttgttgactaaaggtacgtcgaaattaaagggaataccaaaccttactgatgtaaaaaccctctgcaatatccttaatgagcttggtgtagatacaagaaaatgtccggatggttcacttgaaataactgttaaggaagagaaaaatataacagccccgtacgatcttgtcagaactatgagggcatcaatatgcgtccttggccctttgcttggaaagcggggtatggcaaaggtatctattccgggaggatgttccattggttccaggccaatagatattcatgtcagaggtattgaatcgcttggcgctcaggttgccgtaaaggatggatatgtcattgcaacagggaaaaaactgagagggagcgtagttgatctgggaggtccgtatggttctacagttttgggtacctgtaatgttatgatggccgccgttcttggagaaggaaggactattatagaaaatgctgcctgtgaaccggaagtgcaggatctggctaactttctcaataaagctggagccgacataagcggaatcggcgaaaagaaccttattatagaaggtgttgatgagttgaatgggattgaatacgagataattccggacagaatcgaagccggaaccttcatgattgcaggagccataacaggaggcagcatagtattggagaatggtatgtccagtcatatggctgcagttgtaaataaattacaggaaatgggtgttgatattcaggcttctgacggtaagcaagaatttaatggggtaaaaaatggagagtgtacagttaaaagtgatggncacatcaaacctgcaaatattacgacaatgccgtatcccggtatgcctactgacatgcaggcgcaattcactgcattaatgagtgttgcaaatggtacaagtattataacggagcggatatttccacacaggtttatgcatgtcgcagaacttaacagaatgggtgcaaatatcaggaatgacgatgctattgcatttattaagggtgtatcctcgctttccgggacaactgtgatggcctccgatttaagagcaagtgcctcactggtagttgccggactggttgccaaagggattacagagattagaaggctttatcatattgatagagggtacgaaaagctggaagatcgcctgaccaggctgggcgcaaagatatggcgggaaaaggagtaggggggggcgaaacggcacgggcaggcatgattaaacccctgaaaccgtcgtgggatatttaaattgaatatttgttcaatttgtattatnttacagtgtttgaataaatgcagggatatttgcctgataatgttccgccaatgagccggtcgggacgttatggctggaaaacagattgaaggattaacgaaaaggtaagaaatgtttgaatcgattacggacagtttcgaaacaatatttaataaattaagcggaaggggaagactgacagagcaaaacataaatgatggtttgcgtgaagtcagggttgcactcctcgaagcagatacaaactacaaggtcgtaaaggattttatacagagagtgacagagaaagctgttggagaggaagttcttaaaagtgtcaaaccaggacaacaaatagtaaagattgtacaaaccgagatggagcatcttatgggtccggttgattccaccataaagtataaggacggagatgttacagtaattatgcttgcgggattacagggaagcggaaagactacaacggctggtaagcttgctagcatgattttatcaaagggaaaaagccctatgcttgtagccgccgatgtgcagaggccggcggcaattgaacaattgcaggttatcgggaaacagcttaatgtccctgtctattctgaaaaagattctaatcccgttaagatatgtaaatgggcagtaaaacgtgccttccttgacaatcataatgtggttattattgatactgcgggcagacttcacgttgatgaagagttgatgctggagttggatcagataaagaagaagataaagccgacccagatattctttgtttgtgattcaatgaccggtcaggatgctgttaacagtgctaaggaattcaactcgcaactggattttgacggtgtgatcttaacaaaattagatggtgacactaggggaggggctgcattatcaattaaggcagttaccggtaagcctataaagtttgtaggagtcggtgagaaactagataaacttgaagaatttcacccggatagaatggcctccaggatcttgggaatgggggatgtcgtatctctggttgaaaaggctcaagatgttatcgacgaggacgaggctgtaaaattagaaaaaaagattagagcaaatacactgacgcttgaagatttcctttctcaattacaacaggtaagaaagatgggcccgatgaaagatattcttggtatgatacctggagtgggcaaaaagatgaagggaatggatgttgatgaaaatcaaatgaaaagagttgaggctattattcgttcgatgactcttgaagagcgaatgaacccggaaaaaattgaaggcagcaggaggcatagaatatctcgtggaagcggcactaactctcaggatgtcagccagttactgaaacagtttaaacaaatgaagaggatgttcaggtctctaagtggtacagaccccaaaagctttccaacagaagcgatgacaccagaggcaatgaagcttcccggaaccggaaagatcaggagtaagcgtaaaaaagtaaaaagaaaaaagaaaagataagctcagacagttaaacaagaatattaatacttaaattaagttaaggagaatgttttatggtaaaaattagattaaagaggatgggacggaaaaacagggcttttttcaggatttgtgcatttgattcacgggaagagcgcgatggaagaagtatcgaacagttgggaacgtatgatccaagggaaaaagatgaatcaaaaaaggtagtattaaagagagagaggatagagtactggcttagcgtaggcgctcaaccaaccgaaacagtagccagcattctaaaaaataataaaatagctgtaaaaaaataaattagcttactttagccacttgcttgttacgtcttaatcctgaaacggatttggaatcctcccgaaagggaggtaaccttgcttccccggacaaaaggcgccgaggacttttcgcaaggaatccaggatttatatataaattatgagaatagatatattaacactgtttcctgagatgtttcacaatgtat

SEQ ID NO: 1237 - DNA, 4000 bp, Escherichia coli
  misc_feature (1)..(3): n is a, c, g, or t
  misc_feature (12)..(12): n is a, c, g, or t
  misc_feature (28)..(29): n is a, c, g, or t
  misc_feature (34)..(34): n is a, c, g, or t
  misc_feature (41)..(45): n is a, c, g, or t
  misc_feature (49)..(49): n is a, c, g, or t
  misc_feature (51)..(53): n is a, c, g, or t
  misc_feature (66)..(67): n is a, c, g, or t
  misc_feature (70)..(70): n is a, c, g, or t
  misc_feature (75)..(75): n is a, c, g, or t
  misc_feature (84)..(84): n is a, c, g, or t
  misc_feature (87)..(87): n is a, c, g, or t
  misc_feature (91)..(91): n is a, c, g, or t
  misc_feature (108)..(108): n is a, c, g, or t
  misc_feature (110)..(110): n is a, c, g, or t
  misc_feature (117)..(117): n is a, c, g, or t
  misc_feature (120)..(120): n is a, c, g, or t
  misc_feature (123)..(123): n is a, c, g, or t
  misc_feature (128)..(128): n is a, c, g, or t
  misc_feature (136)..(153): n is a, c, g, or t
  misc_feature (157)..(157): n is a, c, g, or t
  misc_feature (159)..(160): n is a, c, g, or t
  misc_feature (162)..(162): n is a, c, g, or t
  misc_feature (165)..(167): n is a, c, g, or t
  misc_feature (174)..(174): n is a, c, g, or t
  misc_feature (176)..(176): n is a, c, g, or t
  misc_feature (178)..(178): n is a, c, g, or t
  misc_feature (189)..(190): n is a, c, g, or t
  misc_feature (194)..(194): n is a, c, g, or t
  misc_feature (198)..(199): n is a, c, g, or t
  misc_feature (203)..(203): n is a, c, g, or t
  misc_feature (207)..(207): n is a, c, g, or t
  misc_feature (209)..(209): n is a, c, g, or t
  misc_feature (215)..(219): n is a, c, g, or t
  misc_feature (223)..(223): n is a, c, g, or t
  misc_feature (240)..(240): n is a, c, g, or t
  misc_feature (249)..(249): n is a, c, g, or t
  misc_feature (267)..(267): n is a, c, g, or t
  misc_feature (305)..(305): n is a, c, g, or t
  misc_feature (318)..(318): n is a, c, g, or t
  misc_feature (327)..(327): n is a, c, g, or t
  misc_feature (350)..(350): n is a, c, g, or t
  misc_feature (354)..(354): n is a, c, g, or t
  misc_feature (393)..(393): n is a, c, g, or t
  misc_feature (413)..(413): n is a, c, g, or t
  misc_feature (431)..(431): n is a, c, g, or t
  misc_feature (441)..(441): n is a, c, g, or t
  misc_feature (462)..(462): n is a, c, g, or t
  misc_feature (470)..(470): n is a, c, g, or t
  misc_feature (506)..(506): n is a, c, g, or t
  misc_feature (525)..(525): n is a, c, g, or t
  misc_feature (541)..(541): n is a, c, g, or t
  misc_feature (543)..(543): n is a, c, g, or t
  misc_feature (561)..(561): n is a, c, g, or t
  misc_feature (606)..(606): n is a, c, g, or t
  misc_feature (612)..(612): n is a, c, g, or t
  misc_feature (618)..(618): n is a, c, g, or t
  misc_feature (636)..(636): n is a, c, g, or t
  misc_feature (645)..(645): n is a, c, g, or t
  misc_feature (857)..(857): n is a, c, g, or t
  misc_feature (1622)..(1622): n is a, c, g, or t
  misc_feature (1628)..(1628): n is a, c, g, or t
  misc_feature (1631)..(1631): n is a, c, g, or t
  misc_feature (1634)..(1634): n is a, c, g, or t
nnnggtagattntttttataatattttnnttttnttcttcnnnnnccangnnnaataatttttttnntantgtcnatcctcttnttnttanatttgataatgattatnantatcaanaanagnatatnttttttannnnnnnnnnnnnnnnnntttntnnanttnnntaatttngnangaatttataannaaanccannaaantcangnaaaatnnnnnttanaaaatatgaaactaacntcaaaaggnagatatgcagtaatggcnatggctgatttagcaaaaaataatgttaaagaaccaancagtcttacaganatttcattncgacaaggaatatccatatcttntttngaacaactttttttaaaactaagaaaaaataatttagtncaaagtgcaagaggtccttnaggtggatacgtattaancaaacctccngaggaaataaaattgttaagnataattantgcggttgatgaaaaaataaaaactgttaaatgtanaaaagaatcaaaaaaaggntgtaatggtaaatcantnaaatgtattactcacaanttgtgggatgatcttgaaactcatattaacaaattttttgaaganaatacncttaangatattctttttaaagangttaggaanaattcagaagaactaaaacaatgaaacaacaagagctagaaaaaagtaaagaatataaatacggttttacaaccgatatagaaagcgttagggcacccaaaggtcttaatgaagaagttattcgatttatatcaaaaataaaaaaagaaccagaatggatgttaagttggagacttaaggcctacagtagacttaaaaatgttaaagaaccnaattggcaaaaaccaaaatatcctaaaattgactatcaaaacttatattattattctgctcctaaaagtgctcaagacaaaccaaaaagtcttgatgaggttgatcctaaattattagaaacttatgcaaaattaggtatttctctaaaggaacaagaaaaactaagtggagtagctgtagatgctgtttttgattcagtatcggtagcaacaacattcaaagataaattaacggaaaaaggaattattttttgtccaatttcagaggcaatacagaaacatcctgatttggtaaaaaaatatattggttctgtaattccaattacagatcattattttgctacacttaattcagcagtttttaccgacggttcatttgtttatattcctgagggagttagatgtcctatggagctatccacatattttagaattaatgcttccgaaacaggacaatttgaaagaacattaattatcgcagacaaaggtagctatgttagttatcttgagggatgtacagctccaatgcgagatgaaaaccaacttcatgccgctaatgttgagttgatagccttagatgatgctgaaataaaatattctactatacaaaattggtatcctggagatgaaaatggtaaaggaggaatttacaattttgtaacaaaaagaggtgcttgcagaggaaaaaattctaaaatttcttggacacaagtggagactggttcagcaataacttggaaatatccaagttgtattttacaaggngataantcngtnggtgaattttattcagtagccattaccaataattatcagaaagccgatacagggactaaaatgattcatcttggaaaaaataccaaaagcaagattatatctaaaggtatatcagccgggcatggagataacacttataggggcctagttagaataagttctaaagcaaaaaattctcgaaattatacacaatgcgattctttattgatgggtaataaatgtggagcacatacggtaccctatatagaaaataaaaattcttcatccattattgaacacgaagcaacaacttcaaaaataaatgaagaacaacttttttattgtaatcaaagaggtttgaatcaagaagaggcgattagcttgatcgtaaatggtttttgcaaagaagtacttcaacaattacccatggaatttgctgtggaagcacaaaagttggttggaattagtttagaaggcagcgttggttaaatgttggatattaaaagtcttagtgcctcaatagatggcaaaaaaatattaaacggatttaacctaaaaattaaacctggcgaagtgcatgctatcatgggcccaaatggctcggggaaaagtaccttagccaatgtattaactggaaaaaatggctatgaaattaaaggacaagttctctatcaaggtaaagatctattagatttacctatagaggagagagctcaaaagggtttatttatggctttccaataccccctagagatagccggagttaacaccaataattttcttaagacttcattaaacactattcgtaaagttagaggtcagaaagaagtagactctttagattttttaaaactagtaaaaacaaaaacaaaaaatcttaaaatcgatgaaaaaatacttagtagacaattaaacgttggtttttctggaggcgaaaaaaagaaaaatgaaattttgcaaatgacaattttagaacccaaacttgcaattttagatgagactgactccggattagatattgatgctttaaggatagtttcagatggtgtgaatgctttaagaagcaaggagagatcttttttaattattacacattaccaacgtttgttggattatatcaaaccagattttgttcatgtattggttgatggaaaaatagcaaaaactggatgcggagaactagctgtagagcttgaaaaagttggctatgaaaaaatgggagcaaacaagtaagcagcagtatgattttaaattttgatgaatttcaaaaagccaatcaaagcggaagtgaactaaataatattagaattaaaaatttaaatatttttaaagaaaagggctttccatctaaaagagaagaaaattggaaatacacagatttaaaaacaatattatctaataatctaagcacactagaaatcccaaataataaaagaacttctcaatataatagcgaatggttattaaaagattttaaacacaatcaaatagtcttggtaaatggtgattttgttagttcagattttagttttgaagataaagaaaaaataaagataaaaccattaaaaattgttttaaatggtgaaaaagattttgaaaaaatcagagattattttactgatcaacaaaactctcttacctcattaaatcatgctttagtcaatgatggcatattcctagaaatagaagacaattattcatttaataaaccattaattatctacaattttttcaataaattttcagaaaacaaaataataaataataaaagttttatttcacttggaaaaaattccaagttaaatttattggaatactataaagctgaagacagtattaagtattttaataacactattcacaattattcaattcagaaaaatgccatgttgaaaaaatttagtatagatagcaatttggataattcttacggctatcatttaactaatgttaaaagttattctaatagcatatttgaaaattttttattttcctcaggatcaagttttgtgaaaaatgaaattcattgtaatttgttagaatcttttagttcatgttttgtgaatgcactaatgtttttgagtaatcaacaacaccatgagttaaaaaccaacattaatcataaaaacgaacattgtaaaagttcccaattagttaaaagtgttttgttggataagagtaatggcacttatcagggaaaaatttatgtcacaaaggatgctcagaagactgatggatatcaacttagcaaggcgttagtattgtcagaaaattctgcctttaattcaaaacctgaattagaaatttatgcagatgatgttaagtgctcacacggatcaacaactggtaatattgatcaaaattctatcttttatttgatgtcccga

SEQ ID NO: 1238 - DNA, 4000 bp, Escherichia coli
  misc_feature (1)..(1116): n is a, c, g, or t
  misc_feature (1463)..(1463): n is a, c, g, or t
  misc_feature (1465)..(1465): n is a, c, g, or t
  misc_feature (1467)..(1467): n is a, c, g, or t
  misc_feature (1469)..(1477): n is a, c, g, or t
  misc_feature (1479)..(1487): n is a, c, g, or t
  misc_feature (1490)..(1490): n is a, c, g, or t
  misc_feature (1492)..(1494): n is a, c, g, or t
  misc_feature (1496)..(1498): n is a, c, g, or t
  misc_feature (1751)..(1751): n is a, c, g, or t
  misc_feature (1775)..(1775): n is a, c, g, or t
  misc_feature (1851)..(1852): n is a, c, g, or t
  misc_feature (1856)..(1856): n is a, c, g, or t
  misc_feature (1991)..(1991): n is a, c, g, or t
  misc_feature (2533)..(2533): n is a, c, g, or t
  misc_feature (3638)..(3638): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgcaccataagcaagagtgcgccaagaattgaagcaatagcagggatgactactgcatatctagtggcagctaagatgcgattcatagcgataatggtagtgcctgagtgctagggagtggctgaactcttaggcacggtgattactagatcagtaagttattcaaaacttccaacttctccttccccgcaaccctccccaccaccaacacactcccattagggatttcatcccaaccatcttgattccaaccgctagatgccaccacaacctggccattacgtttggtgtatttaaggtggtagtaatcagtatcctctttaaacttttgtgggattttatcntngntnnnnnnnnnannnnnnnnnaangnnntnnngttaataatcatcatgtttatggatgagaatgcgcaattagcctttatataagaaaggcctgcctgaacaccttcgataaaaccatgtttttctatttgagttagtaggtagaggaagtaacgctctgaatctgtgtttccttttgctagttctaggtacttcttatcaattaaaggatcaagacaattaaaaggtgagatagagccgttatggataaaagtaatatcttcatatgtgaaggggtgggtgttnttctcattaacagccatgccctcngttgcccacctaaggtgaagaagtgctgcatttgatttatgagttgctagctcctcttttaaatgagcgctcttannagcngcaactggctctttatataaagaagcttttttgttttgggtagttgcaataccccaaccatcacagtgatcagtagataggtttataaactcatcaaaattagcacccactacctcagtgaaggtggtggcattnggggcggtgtaaccaagtaggcggcacatggtggtaagtctaattatttttctaccccacgcctgaaacgggtgattttcttaaaaaaaactggcaaaaaagggggttaaatccttccctactgctcagttcaggcgcaaaatagcggatgtgatctaaggcattacctggttttccccaccagctatttaaaagaagggtaataaatgagtctcaataacgattcagaatcacgcttactcgaatctcttggatataaacaagagtttaatagacgttggagtggattctctaacttcgcagtctccttctccatcatctctgttctctcaggttgcttcaccacctttggacaggcttggaataatggtggaccagtagcaatctcaattggctggccaattattgcaatgtttattttagttattggattttgtatgtcagagctggtctctgcgatgccaaccgctggtggtatttactactgggcatttaagttaggaaaacctgtccatggttggattactggctggcttaacctngttggtcaatttgcagttacagccggtgttacttacggctttgctaccttctttgtgacgacggcaaatctgtggagtgatttctgggatccaacagatcttaatcaggtatttatggtcttcttagtcgcaatctttcttgcaattgccctaaatgtttggggtgcaaagattattaacctgctacaaaacgttaacgtttactggcatgtgtttggtgtgacagctgtagttttgatcttggtatttatcccaactaagcatcagaccttagagtggatgtttaccaccacaaataacaactctggcttctctactggaatgtattggtggtatgtactacctctaggtttcttgcttactcaatacacaatcactggatttgatgcctctgctcacgtttctgaagagacctcaggtgcttcaaatgcagcagctaaaggtatttggcaatcaatcttgttctcagctattggtggctggttactactacttgccttcctatatgccgcaactgatgtggatgcaattaataaggcaggtggattctcaccagcaatcttcttaagctcattacctcttggctgggtgaaggtgctgttggtaattacttgcgtaggacagttcctatgcggaatgtcttgtattactgcaggctctcgtatgttgtttgccttctctcgcgataaggcagtaccaggacataagtactggacaaagttagacaagaatagaaacccatctaatgctgcatttggtattggaattcttgctgcgatcttaactctgcctgctctttgggcacctgagggaactgttgttccagtcgcattctttgccgttacctcagtaacagttattggtctcttcttatcgttcttaattccaatctacttaagatggagaatgggcgataagttcaagcaaggttcatggaatcttggcaataagtggaagtggatggcaccgattgcaatcgttgagattgttttcatcacgattgtattgtgtttgccaactacaccagctggtgtgccaggaaacgaagccttcacatggaaagctgtgcaatacgctccacttgcaatcttgtttgtaattggtncagcgatgttgtggtggcagttaagtgctaaaaagtggtttaccggtcctaagatcgtaaactaaaaaggcgcttaaactaaaataagtaaactcaaactagccctgttgcttgcaacagggctagtatttatttatggatcaggaatttaactatgagtaagggcagagttgcagaccgggtagcaattgttactggtgccggtagtggaattggtagagcaagtgcaattagattggctcaagagggcgccaaggttgtctgtgttgatattaatgaaagcgccgctaaagagtgcgctgatgagattaataaatcatccggtagtgcatatgcggttaagtgcgatatctcagattcca

SEQ ID NO: 1239 - DNA, 4000 bp, Escherichia coli
  misc_feature (414)..(415): n is a, c, g, or t
  misc_feature (1042)..(1042): n is a, c, g, or t
  misc_feature (1500)..(1500): n is a, c, g, or t
  misc_feature (1746)..(1746): n is a, c, g, or t
  misc_feature (1750)..(1750): n is a, c, g, or t
  misc_feature (1812)..(1812): n is a, c, g, or t
  misc_feature (2570)..(2570): n is a, c, g, or t
agttcggcgatctgccgttcgtccaggccaagagcgtcccgcaggacctcctgcgtatgctgccccaccgccggggccgccaccggatcggccatgggcgtggcggcgtagcggatcggcaagcgcacgttcggaacccagccgagcaccggatgggggatgcgggtgacgagttcgtggtcgcgcgcctcgggcgagcggatcgcctcgcccaccgtgcgcaccaatccgtagggcacgccggcggcgcgcatgcgagcctgccagtgcgcccagtcgtgccgcgcgaacgcttcgtcgaggaaggcgaacaggcgctcccgatgccggatgcgcaggggacccgtggcgtaatccgcatcggcggccacgtccggacgttccagcacctgccccatgagccgctggaagatnntgtcgttgccgctgttgatgtagaaggtgcggtcgctggcgcggaaggcgcccgaggggcaggtgtcgggggcggtgttgccgctgcgttgcggctccttgccggtgaacagcgactgcatggtcgcatagcccgtcatcaggacggccgtgtcgaacagggacacctccacccgctggccgcggcccaggcgctcccgggccagcaacgcgccgagcacggcgttgcccaccatcatggcggtgctgatgtccatcaccggcgagagcgcccgcacgccttcgcggtcgggataaccgttcatggaaacgaagccgctttcggcctgcgcgatgggatcgaagccgaagcggtcggcgaaggcgccttcgcggctgtaggcggccaccgagcagtagaccaggcgcgggttcagggcaaggcaggtctcgtggtccagccccaggcgacgcatcacgcccgaggagaagttctcgaccagcacgtcggcgcggcagacgaggtcgcgcgccagcgccagcccctgcggggacttcaggtccagcgcgatgctcttcttgttgcggttgctccagacgaagggtgcgccctggtccagttgcgggtgcatgggcggatagcggcgcncgtcgtcgccgcggaccggcgcctcgaccttgatcacctcggcgcccatgtcggccaggatcatggtcgccagcggccccgcgatgaagtgcgagaagtccaccacccggatgccgtccagcgcatggggtgcgccggaggcccgtcgcttgtgctccggaaagtcggcttcgaggttctccaacatgtcctggccgcctgcctgcatcggagaaccgctcacggcgtgtacccgaagcccttgccgagctccgccttcatgtagtcgcgtcccagttccatccagtcggaaccggcggggatggtgacggagatggcccgcatcatgaaggaagacggcttcgcggcggagaccggctcggcgccctccgccagcttcttcgcgctctccaggagcagccggcgcacgcgcacgatgcctgcatcggtggagcccaggtgctcctgcgaacggtcgnagatggtcgccacgcccgactggcacgcggcatcctccagccacaggccgggcatgccggtctggtagtcgtagttgtaggcgttgccccggttgaaccggctccagtaccggtgataaggcaccgtcaccggcctggcctcataggcgccatgcgaatggtggccggtctcgcggcccttgtagccgtccttgaacagcttgcgcgacttctcgtagaagggctggtccggcgtgtacgagaacntgantgccagggtgtggtggtcgtcgatgggcacccaggcatggccgctcagctcggggtactgcntctgcggcggcaccaaggtccagaacggcatcaggaactggttgacccgcacgtagttgtgctcggtgccgtccttgcgccgcgccgcgatgctgatgccggcatcgtgcggctggacctcgaacttgggcgacaggtcctggccctgccgccactgcgcgatcgtgctgccgttgcggcggccatgcaggatggcggcatgcgcggagtcgatttcaccttccagtgcctgcagccagttgcactcctgcacccggacggtgacgacggagtgcgactcgggcaccatgttccattcgagctcaggcagcggcggcggcgtctcgcgcttcgggcccatgtaggtccacagcacgccgttgcgctcgcgcacgggataggacttgatggtcatgcggctggtcatggcactgcccgggggttccgccggggtctcctggcactgccccgtcacgtcgaacttccagccgtggtagatgcagcggatgccgccctcctcgttgcgggcgaacaccatgggcgcgccgcggtgcgggcaggcctggtccaccaggccgacctggccctcgctgtcgcggaacgcgaccaggtcctcgcccagcaggcgcacccgatgcggctggccgtcgcgctcgacatcggcggacgcgaggaaggggatccagtacagccgcatgagctggcccatcgcggtaccggggccgacgcgaacgagcgtctcgttgtcttgggaattcagcatggccttttagggtgantggttgaaccgaacatcgattcgcccgattctaggcagtgccggccggcgcgtgattcgaaaggccgccgcggtattgagaaaccggaattgagctggccccacagtggtggcagcggccttcaggtccagtagggctcgatgagcgactgccggctcgcgtcggcgccaatgccggcggaagccaccgtcagcagttcgaggaaccgctgctgggcccgcgtgaggcgccagctcttgcgcatcgtggcgccgaccgtcggcctgcttcccgccagcggtgcgccgatgcagctgagcaggccggtgcgcacctgcagcgccacctggtccggcatggcgagcgtcagcaggtcgctggcggtcagcaggcggccgatgatcatgatcgagccgcactccaccggcgcctcggggcggcgatcggcgaagaggcgctcccattcggcacgcagcggcgagttctccggcgcgatgatccaggggtaggaagccagcatctgcggcgtgcaactgcgccgcgtcgcgagcggatgctgccgccccgccaccaccaccggggcttcctcgtaaagcgggtgcgtggccaggtccggcgctgcgtcgtcggggatctcgccgacgatgatgtcgatcacaccgtccctgagcgcctccaccagttcgccccagctgccttcgtgcacgcggaaccccgcgggaaaccgttccgccaccatcagcgccatggcctcgggcacgaggaagccacgtgccaggggggtcgtgccgagagcgatggtggggttgtgcgggtcgcgcccgagctcggagaacgccgcctggagttcggccagcgcgagcctgcaactgcgggcaaaacgccgaccggcaaagttgacgtgcactccgcggccgcggcgctccaccagcttgcgtcccagcgcctcctcgagttcgcgcacggcccggtgcactgccggctgagacagcccaaggtctgcggctgcagcggagatgctgccggcccgcaccagcgccacgaaggcgcgcagttgcgtcatgctgagccggcgatccggttcgaacgccgtgccgcccacctggcgggtgcccgttgccaggtgggccaggcaggcccgcgcccggtccaccaccagttccccggccgccgtgggcacgatcccgtccgggcgccgctcgaacagcacctctcccatcagcttctccagcttcaggatgccctgcgtcagcgccggctggctgagccccaccgcgccagcggccgcactgatgctgccgtgctcgtgcacggccgtcaggccgcgcaagtggcgcaggttcagctggaaggccgcctgtgccgcgccgggctgcgcgtccggcggagactgcgcgtggttcatggtcgccaaggaagaggaagctggccaggcaccactataaagcgca

SEQ ID NO: 1240 - DNA, 4000 bp, Escherichia coli
  misc_feature (1613)..(1613): n is a, c, g, or t
  misc_feature (2037)..(2037): n is a, c, g, or t
  misc_feature (2058)..(2058): n is a, c, g, or t
  misc_feature (2070)..(2070): n is a, c, g, or t
gagcaggacttttatgacttgacttgggcatatttattaaagtgtaaagaacaaaatgttttacatgttgagcctttctttgaccctcaaacacacacagatagaggtgttccatttaaagttgtaattaacggcatttcagacgctcttgcggacgctgaagagcgacttggaattacatctaagctcattatgtgcttcttgaggcatttggatgagacgagcgcaattgaaactttaaaaacttcatcagaatatactgactacatatatggtgtcggcctagatagctctgaaaagggtaacccacctgaaaaattttcaaatgtttttaatgctgcaaaagatatgggctataagttagtagctcatgcaggtgaagagggcccagcaagctacatatggagttcactggatattcttaaaatagaaagaattgatcatggaataagagctattgatgatccagagctaatgctgcgattaatcaataatcaaataccactgactgtttgcccgctatcgaatgtcaaattaaaggtctttgaggagatgtcaagccacactattctagagatgttagagcaaggggtatgcgtaactgttaattcagatgacccttcctattttggtggctatatgactgaaaattttatttcgctttatgacaatcttggcctttcaaaaggccaggcattaaggcttgtcaaaaatagtattgatgctagttttgcgccaaagaaaagaaagaaagggctctatagcatattggatgaatttgcagctgagtagctaaaaaggtttctatttattttttatcctgtttcccaacaacactttcgttcatttcatcttctatttggtccatcatttcattgtgagatttactcccccagtcttttggtttgtcagaaggggtctgagatacaggtttttggttattacgaatcttaaaaaaaccagaaaagactaggccagcttcaaatagaagccagataggaatagcgataaggaattgtgatatgacgtctggaggcgttaatatcattccaagaacaaacgaaccaataatgatatacgagcgattctttttaagtttttcagctgtggtaatgccaaagataataagaagaattgtcacaactggaacctcgaaggcgacaccaaaagcgaaagacactttaagaataaaatctaaataatattgaatatcaggcgcaaaattaacagactcagggccgactccagctaaaaaaccaaagatgactgggaaaacaacatagaaagagaataccagccccacataaaataggattgttgaagaaatgacaaggggcagtatcagcctcttttcatgtcgataaagtgctggcgccacaaacatccagagctgataaagtaggaagggcattgcaatatagatggctaatatcaaggacattttcaaaggcgttaaaaagggggagataaccccaattgcaatcaaattagagcctggtattgcttggacaataggtgcagcaataaagttatagatttcatctgcaaaaggaaatagtatcaaaaagaaaatagcaatcgctattaccgatctaagtagtgatcttctaagntcaatcagatgctgaacgagtggaagtttttcagaaggatttttttgctgagacatttatttttttaagtcttctttcgagagaaaattatcttcttcaagagaatgaatgctggaatgcacttcctccgctacttctgaaagcgatattttttcttgatccatggagagttgctctttgagctcatccacttttagctcttcattgatgtcagatttaattttatttaaaaacttattaaatttaccaaagtagagacctgcttttcgagcaagtgagggcattttctctggacctacaacaattagagtgatgatcccaattattgcaatttcccagaagccaaaatcaaacatcctagtttaatacttcagaaaacgtttattttttatcagacgagtcatcttcagcttctacctttgcntcaatgatgtcttctttgtcntctttttcagantctttcatagatgatttgaagcctttaatagcgcctccaagttcgttaccaatattttttagccttttaccaccaaaaataagaagcacaatgactagaataataatgagttcgaatggtcctggcatacccatgatatttatctcctataaatgaatattgccattttacactttaatagattatttttttcagaaggtgatattgttgaatttactatgttttttttgacaagtttcatataatggaacaaggtactaatagttggacaaatatattcacatgtattcatatttatgtatactaactattgatttgtcatatttaggtgaatttcatcacaacaagtatgtaatcaataagaagtttacttttttaaataataggagataaaaagtgaaaaaaatttttaaaaatcaaatagctttagcgctagctggaatcctggctggtacttctgctgttgctggaacactcgtcatcaatggtgacacgtcagatccagcaccaaaagctgctttccaggctgttattgatggatttgaagctgaaaacccggacgtagatgttgtttataacctttttgatcatgaaggttacaaggctgcaatacgtaacttccttagtgctgatgcacctgatattgctttctggtatgcaggaaatagaatggctccatttgttgaagctggtctttttgctccaattgatgatgtatgggctgaccaaggtctatattcattgatggcttcttcagctccaggtatgactatggatggccagaaatggggtatcccttacacttactacaactggggagtttactaccgtcaagatatctttgaagatttaggtattgctgttccaactaattgggacgagtttatagctgctggtgaaactttaaaagctaacggcattacaccaattactattggttctaaatatttatggactgctggcggtgtatttgactacttaaaccttcgtacaaatggatatgaatttcatatggcattaacgagtggtgacattgcttggactgatgatagagtgcgcgctactatggcaaactaccaacagctgattgatggtgattttttcctcgaaaaccatgctgcacttagctggcaggaagctttagctccaatggctagtggcgaggctgcaatgtatattatgggtaactttgctgttgctccattaaaagagttaggcttagatgatagttctctaggtttgttccagttccctgcaattactccgggagttccaatggctgaggaagcacctactgatacgattcatctaactgctggcgctaaaaacccagttgatgctaagcgtttcctagcatatgctgcacgtcctgatgttcagacggcttggaataaagcgttaggtcagctgcctacaaatgctggcgcaggtgtgactgatgacaagttcctaaaccaagcgttcaatatgcttaataatgacgcacctggtggtgttgctcagttctatgatcgtgacacaaaagcagaaatggcttcaattggtatggaagcttttcaagagttcatggttaagccagagcgtttagagaaaattctagagcgtctagaaaaagctcgtcaaaaactttattaatcaataaggttttactatgtcccgtgttcaagtattcttgacacgggacttttttttaatatttttaatattgaatctgcatgtattcttactggaaaaataaccaactgaagatagcgccttggatttttttagctccagggatattcatgttttctctgtatgttattttcccaattttccaatcaatcagtttaagcttctatcaatggaatggccttggaacaaagacctatattggtgttgaaaactatattgagttgatggatgatgagtacttttttgtttcattaaa

SEQ ID NO: 1241 - DNA, 4000 bp, Escherichia coli
  misc_feature (81)..(81): n is a, c, g, or t
  misc_feature (320)..(320): n is a, c, g, or t
  misc_feature (1057)..(1057): n is a, c, g, or t
  misc_feature (1988)..(1988): n is a, c, g, or t
  misc_feature (2587)..(2587): n is a, c, g, or t
  misc_feature (3466)..(3466): n is a, c, g, or t
  misc_feature (3807)..(3807): n is a, c, g, or t
tgattctgccgtgctgcgtctcgggggtgagcgcggtggcgttgtcccacatcgtcacggctggctgcgcgtttgcgtggngacgcagcaggtcatcaagttcggtacgcggcatggctgagccagtagtgccaaacggcgatgtcggccagggtgcggtgacggagccgccgaagccgtggagtttcaacccacgtgacgtgtagcgagaggtgatgtcgtgggcgacacccagagcggcaagttcgtgcatggcacggggagtgagaccatcgccgcaggttttgtcgcggggaaaggtggcggcgtcgataagcagnacgtcgtagccacggttggcggcgtgaaacgctgcggcggaaccggcgggaccagcgccgactatgaggacgtcacaggctgtatatggggctgcgggtggaggagtcacagtgttcattgttgtctattggtaccgattgtgtcgcagactaggtgaaaagtgggctacggtaataccctagcgaggaaaacaactgtaaccatgaattgagagaaacgacgtatgagccacggcgagacttctaccacgccgactccccaggtggatctaggcgacccacagctcaccgccacaatcaacgacggattgagccaggtcgagcagctgctgcgtgctgaactgtctggaggcgaggactttattaccgataaagtccagcacttggctgtcgcgggcggtaaacgattccgccccatgtttgccctgcttgcgtcgcaattcgggccacattggcagtccgataaggtagtgcaggcggctgtggtggtggaaatgattcacctggctaccctgtaccacgatgatgtgatggatgaggcagacaagcgccggggtgtgcccagcgccaacgcccgctgggataattccatggcgattctcgctggcgattttcttcttgctcaggcatcccggatcatggctgagctggggacggatacagtgtcgcattttgcggatacctttggcaccttggtcacgggtcagatgcgggaaaccgtgggggctggcgacggngatccggtagagcactacatgaacgttattcgtgagaaaaccggtgtgcttatcgcctctgctgggtatttagggtcgttgcatgccggtgctgatgccgcgactgtggaggcgctgcgccgctatggttacgccatcggcatggtgttccaaatcgtcgatgacatcattgatattttctccgacgcgacgcaatcagggaagaccccaggtaccgacctgcgggaaggtgtgtttaccctcccagttttgtatgcgctggccgaggacagtgccgtcggcgaacagctgcgtgccttgctgaccggaccactcactgaggatgctgaggtggagcaggcactggatttgctcgcgcagtccacgggcaagcagaaagcgcttgacgacgtccatcactacctcgccgaggccgaagcgcagctggatctcctcccggacggtaaggcgactcaggcgctacgcagtttgtccggtttcacggttagtcgcgtgggctaatcacgttcctatgctgcggatttgcctttgttattggtgttcgtagtaaagtgtgtaacgcaccatgacgtgtggtgcacgccaggttgcccgagcggccaaagggagcggattgtaaatccgtcgcgcaagctacgttggttcgaatccatcacctggcactctttttgtttcttatataagaccccgccggaggcactgcttccggcggggtctttttcttgttaaaaacaccattgacctgctgatttgtgttaggtagtggcttcgggttaatctttgtgaggcttcaacggcgcaggaccttatagaaggtgctgataatgacgaggctgtgcccccttagctcagtcggcagagcgtttccatggtaaggaaaaggtcgacagttcgattctgtcagggggctctgttgtttttctccgttgtncggggaagagcaacataatttggcggtgtagctcagtggtagagcaaacgactcataatcgttgtgtcgcgagttcaattctcgccatcgctactgagatttgtgatgaaatctctggttcacgccatggttgggtagaactgttacggaagttggatctgataacttttctgctaatatggtccagtgttgtgccagcccggcggtatttccggatgtggcgcgatgcgcataggggcgtagctcaattggcagagcagcggtctccaaaaccgcaggttgcaggttcaagtcctgtcgcccctgcaaaacaaccttcaacgtgatctcaaggagcactgtgaccgagcacaagagaccggataatgcagtagccactgcacgcccaaccggtaaacgccaggtgacgggggccgccacaaacagtgaggcgtacaaggctaagcaggccaggggtaaggaatcctctgatgaacagcacggcggcggtgttgccgcgtttttccctgaagttgtgcaggagatgcgtaaagtcatttggcccaccgcgcgccagatggtggtatacaccagtatcgtgtttgcgtttttgattatcnccaccgcacttgttgctggtgtggatttccttgcaggcatgggagttgagaaggtgctcacgcgctgagtaaactaaagtccgcgcttttcccgccgaatccgcccaggaatcggcgggttgttttgtgaaaccaggtagcatggtgaacatagcgtggtgaacaggctcaacatagtcacatggagtagaaaacatgagtgaagaaaccagttctgaagttattgaagaaaccgccgtcgttgaggaagctgccgcagcgttgggtgacacggagctgtccgaggaagaggcggccctggccgaatacaaaacccgcctgcgtacctacattcgcgagctgaaaaaactccccggcgactggtacatcatccagtgctactccggctacgaaaataaagtgaaaactaacctggatatgcgcgcccagaccttggaggtggaggactccatctacgacgttgtggtgcccattgaagaggttgtggaaatccgcgaaggtaagcgcaaactggtgaagcgcaaactgctcccggggtacgtgttggtgcgcatggacatcaacgatcgctcctggtctgtggtgcgtgacacccccggtgtgacttcctttgtgggaaacgaggggcatccgacgccggtgaagcaccgcgacgtcgccaagttccttatgccgccagagactgctgcggaaaccagcgaggcagagaaggctgttgttgctgatggggagaaggttgtggccagcccgacacccagcaccgcgaacaccattgaggtggattaccaggttgatgaagtggtgaccatcctcaccgggccgtttgcgtccatttccgccaccatttccgagattgatgcccagggcgggaaactgacnggaatgatttccttcatgggtcgtgaaatgccggtggagctcaccttcgatcaggtggaaaaaatcaactaggtattcgtgagggtgttcgtgtaggattgtcactcgcgtgttttcacgcagatacgacaatcatccccggtggccgggttacacgaacatcctcattgttgtgagatagtggggcccggcatccggacggcgctggttggggcacatcgaacccgccagccgccggtaacaaggaagcaggtatatcgatgcccccgaagaagaaggtctccggcctcatcaaactgcaaatccaggctggtcaggctaacccggctccgccggttggncccgccctgggtgcccatggtgtgaacatcatggaattctgcaaggcatacaacgctgctactgaacagcagcgcggcaatgtcatcccggtggaaatcaccgtgtacgaagaccgctccttcaccttcaagctgaagacgcctccggcagccaagctgctgctgaaggccgctggcctgcagaaaggatccg

SEQ ID NO: 1242 - DNA, 4000 bp, Escherichia coli
  misc_feature (274)..(274): n is a, c, g, or t
  misc_feature (286)..(286): n is a, c, g, or t
  misc_feature (289)..(289): n is a, c, g, or t
  misc_feature (358)..(358): n is a, c, g, or t
  misc_feature (898)..(898): n is a, c, g, or t
  misc_feature (1687)..(1687): n is a, c, g, or t
  misc_feature (1725)..(1725): n is a, c, g, or t
  misc_feature (1995)..(1995): n is a, c, g, or t
  misc_feature (1997)..(1997): n is a, c, g, or t
  misc_feature (2001)..(2001): n is a, c, g, or t
  misc_feature (2006)..(2006): n is a, c, g, or t
  misc_feature (2049)..(2049): n is a, c, g, or t
  misc_feature (2160)..(2160): n is a, c, g, or t
  misc_feature (2192)..(2192): n is a, c, g, or t
  misc_feature (2202)..(2202): n is a, c, g, or t
  misc_feature (2238)..(2238): n is a, c, g, or t
  misc_feature (2266)..(2266): n is a, c, g, or t
  misc_feature (2330)..(2331): n is a, c, g, or t
  misc_feature (2557)..(2557): n is a, c, g, or t
  misc_feature (3298)..(3298): n is a, c, g, or t
  misc_feature (3820)..(4000): n is a, c, g, or t
gttgttcgggaagctggtgggaagatcggccacatcggcgaggtgcccccgggcgttccaccagaactctatggtctggatctgatcgttggggcacctgcgatctttgacgagatgcaacaggtgttgcgctctgcctgatcaggcgaagcagctgtacatcttctgaaccagcgcctggttgtaaccatgagaggtcatgttggccaccacccgaccacgcagtggatagcccagcaggaacaggtcaccaatcagatcaaggatcttgtgncggacaaactcntcngtaaagcgtagttcggtgttgatcaccttgccgtcatagatgatgatgtgcgagttgagatagccgctnccgaccttgcccatcttctgagccatgtcgatgttctgaaaggtgttgaaggagcgggctggcgcaatttcattcaggaaggaatcctgctctgcgttgaaggtcagttgttgttccaggatcggtggtgggtagttgacccgcatcgtcacttcgaaaccatcatagggttccacgtagagatacttctggtccgggtcttcttcaccgatgctgagtttttcgcaaatcaccgcttctgtcacctcggcgtcctgatccacggttccggcttcgtcaagcaatcgggcaaaatcgagagccgagccatccacatttgggatctcctcgtcggccttgatcaacacgttgtccagcccagccatcgacaaagcagccatcaggtgctccaccgtgcggacacgtcgattctcccgggccagcaccgtagagttggcggtaaaactctgctggctctgtgcatgctggtaatcttccaggctggtgatccggccaggaatggagatgccgtcgagggtttgaaactgaatcccactgttnggaggagctggactgagaatgatgcccgtgttgcgaccactgagcagacccgtgccattgaggaccacgttgtcgccaagagtacactggggacgtccggacttgcgtagctccacggattgccggttggttgcaggctggtagggtgctgtctcgatccgggtgtcggaaggcagaatcgcttcctcgtctggttgagcggcccgcaaggcaccagtgatcttgtccaacaacacatccaggtgcagtggcttttccagaaagtctcgggctcccagcttgatcgcactgacggcagcttcaatcccggcgtgtccgctcatcatgatcacgggtagctcgggctgttcgttgcgtaggttcttgaggatcgccatgccgtcttctccgggaagccagatgtcgaggagtaccagggacattggctgctctttcagagcgtcgtagagttctcgtgcatgtgcgcagcagcgtacggggtagccttcatcttcgagtacggcggccagactactacgaatcgccggttcatcatcaacgaccacgattggattcatgcgactcctgcaggaaaggataacaaggcggatggaattgtcggctagtgtgcactcatcataccgggctttggcagaaatagggcaagaaaatctgcaaatcttgatcatttgctggaaccaccacgcatgagcgagaattgtccttcacaagatgctactgtgcttcaagtggatcaactgacgcttgaatttggcggattgcgtgccctggacaacctgagctttcagntccagtcccaggaaattctagcgctgattggtcccaanggtgctggcaagactacctgctttcagtgcataacaggctttcttcctccaaagcttggtgaaatccacctatatcctccccatcatcaaacacaacaactgaatggactcaagccctaccagatcgctcagttgggtgtcgctcgtacctttcagagcatccgcctatacgaaaaacagagtgtgctggagaacgtgatgatggggcgtcagatccgcaccaaaactagtatgttgggtgtgctcctgcgagatcgacgcacccgcgcngnagancagcngattcgtgaggattcctttcaactgctaaagcgtatggaactngagcagtatgctgaggcaactgcagacagcctaccctatgcagcccaacggcgtttggagattgctcgggcgctggctaccgagccctttctattattgcttgatgaaccngcagctggtttgaatcggcaggagacagaagnactggacganctgctggtagagcttcggaaagaatttcagctgacnatcctgctgatcgagcatgacatgcagntggtgatgaagatttcagaccgaatcatcgtgctggaccatggacgcaagatcgcagaaggtcnnccgcaggaggttcgccagcaccctgaggtgattcgagcttatcttggggaacagaccgtctcatgatgctggatctacgcaacttggtgagtgcttacggcaacatcctcgctctgcagggcatctctcttcatgtgaagccgagtgagatcgtaaccatcctgggcagcaatggcgctggcaaaaccaccctgttgatggccatcgccgggctggtgcctccccnccagggagaagttctgtgggaaggaagaccaattcagcaactgactccagatcagatcaaagcgctgggcattgggctggttcctgaaggacgacgcatcttcccagaattcaccgtgctggaaaatctgcgaatgggagcctacctgcgtcgcgatcgggaacacatccgagaggatttggagcgaatgatggagctctttccgattctgcaccaacgacagtcacagctcggaggaaccctcagcggtggtgagcaacaaatgctggcgatcgctcgggccctgatgggaaacccccggctactgctgcttgatgaaccatctctcggactggccccgatgattgtccagcaaatctttgagatcctgcgtcaaatccaccagcaacaacaaacgaccatcctgctggtcgagcagaacgcccgcctggctctccaactcgcagatcgaggctatctcctagaaaatggcaaaattcaattgaccgatacagcggcaaacttgctggataatgaggctgttcagcgggtctatcttggtgggtgaggataacccaaaagatcaaatgaatcgttgactgtttcaaggaagacttccaaaaatctcctcaaagaaccccaattcctctacaagcccaggaatcctgtttgttcttctcccccagagagaaagtagccaaaggccggatgagggaattcccgcaagttcctaattttttctaaacttcatcactgtctctngcggttccctgtcaaagaattcagcttacaaaaaaagagcatctgacatcgaaatggggcctatttgattgatcatctaaaaaattatgggcatctttatgaagaaaaccaattcttgatgacctgatattggatttagccatgaatgttgccgtacatcaactcaaagccaatctgtctcgactgttagcgagggcgcaatctggagaagtgattgaggtgacctcacatcggaaacccatcgcccgcattgtcggtgtccccgaaccaactggagtacccctcgattctctgaggtcttctggagcgctgagttggaatggcaaaaaacctgtgcttgaagagcctcttaccttgactggcgctggcaaatccatcagcagtttgatcttggaaaatcgccggtgatcctgttttgtgacacttctgcgctgatcaagctctatgttcaggaggagtggagttcggcaatgcgaggagctgtcaacgaagcctcggtggttgcggtttgtcgggttgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1243 - DNA, 4000 bp, Escherichia coli
  misc_feature (556)..(556): n is a, c, g, or t
  misc_feature (885)..(885): n is a, c, g, or t
  misc_feature (887)..(887): n is a, c, g, or t
  misc_feature (983)..(983): n is a, c, g, or t
  misc_feature (998)..(998): n is a, c, g, or t
  misc_feature (1155)..(1155): n is a, c, g, or t
  misc_feature (1223)..(1223): n is a, c, g, or t
  misc_feature (1622)..(1622): n is a, c, g, or t
  misc_feature (1991)..(1991): n is a, c, g, or t
  misc_feature (2435)..(2435): n is a, c, g, or t
  misc_feature (3559)..(3559): n is a, c, g, or t
  misc_feature (3580)..(3580): n is a, c, g, or t
tcatgggcgcgtctacgcggcgtaaaattaatagaataccaaaataatacaataattagaggtttaacgaacagagacatctggtcaactgaacgagataattttttgtccaagcccactttaaagaagccatatataagacctattgatgcggagctttctgaaatttcaactaagatgaaatttaaaggcagtactgttttaaaaaataaacaaataggtggttcagaaaatggctggagatatttggaaagttttttggagggacgaggaaatcattacagagttgaaatgtcttctcctcttttagctgagagagcctgctcaagaatttcaccctatctagcctatggaaatttatcagttagagaaatttttcagtttttacatgaaaatcatcctaaaataaaacaaatgtctccctcaataaaatcgtttaaatcgcgtctggcttggaaagatcatttcagtcaaaagcttgaagatgatttttcaattgaaacaacatgtttacataagtcctttgaaaatttgcggccattagttccagatcatnttctcttatctgcttgggagaacggagaaactgggtttccattcttagacgcatgtatgcgttatttgagagcaaccggctggatcaattttagaatgcgagctatgcttatgtcttttgcttcttatcatctttggttggactggcgggcatctggtcaaattcttgcgaaattttttacggactatgatccaggcattcattggcctcaagtccaaatgcagtcgggaactaccggcataaacacggtcaggatgtataatccaataaaacaaggaattgaccaagaccccaatgcaacttttatccgtaaatgggttcctgagctngntcatctttcaactgccgaaatacataaagttggcaccgaaaattttaatgcagttaattttgaaacacattaccctagacccgttgtggacttagntaaggcaggaagggnggctcgagaaaaagtatgggcagtcagaagattgcatggtttcaaaagtcaagcaaaacagatagtcaaaaaacacggtagtcggcaaaataggtcaaaggatttcgtaaacgatcgcctagaaataaaacctaaagccagggttaacattcagaanagctttgaattctgatggcaaaaatgcaaaagaaatcggatctaccaaaaaaaatatgtaaaatatgnggcctaccattcgcctggaggaaaaagtgggagagagactggacagaaattaaattctgcagtgagagatgtaagagagcaagccgtttaaaaaaaattggtaaaaataaataaccaattattgactttcctaatttagcgtttaactgaacagtagcagtataccgaggtagacagatgattcagttggctgaaaaattaggaatgaaaatttcgacaaattttgttgactttattgagaaagaagttttgccaaatactaacgtcacagctgagaagttttggcacggccttgcaacattggttaatgagttgactccgcaaaacaaagcgttgcttgacaagcgaagatatttacaaaaacaaattaatgagtggcatgagctaaatagcaataangatcttgatttagctgaatataaggagtttttatactcaatcggatatctcgtacccaaaggcgaatccttttccatcgatacagataaagttgatccagaagtttctcaggtcgcggggcctcagctagttgttcccgtcatgaacgctcgtttcgctttaaatgcagcaaatgctagatggggttcgctttatgacgctctttatgggacagattcaataagtggcgaaaataaaacaacttcttacgatacggaaagaggaaaaagggtaattgaatggggccgaaatttccttgatgaaacgtttcctcttaatggtatttcctggaaagatgctactcttttaacaataaacaacggcacgctntgcgtctcaggcaataatttgaaaaatgaaaaaagctttgtcggttattctggaaaagtcgaagagccaaattgcattgtattacggaacaacaatttgcacgtacgtttagaaattgacccaatcagtgaggtcgggtcgtctgacttggccggaatatcggatattatacttgagtccgcgatttctacgataatggactgtgaagacagtatcgctgcagttgatgcgtctgataagattgttgcttatagaaactggctcggtttgatgaagggtgacctttctgaacaagtaacaaaaaaaggtaaaacgtttataaggaccttgaacgaagacttctcttataaaactccaagtggcgaagtgagcactctcaaaggaaagagtttgatgttggtaagaaatgttggccatttaatgactacaccgacagtccttgancaaaatgacgaagaggtatttgaggggcttcttgatgcgctgtgtacggttacaattgcattgcatgatgtgagtcgtgagggaggaaattcctcctgtggttcaatttatgtagtgaagcccaaaatgcatgggccagaggaagtggaatttgcgtgcagaacctttagtcttgtggaggaaatacttggtctgcccttaaatactgtaaaaatagggataatggatgaggaaaggcggacttctgtaaacctttttgagtgtattcgtgctgctaaatcacgggtcgccttcattaatacggggtttttagatcgaactggcgatgaaattcacacaagcatgaaagctggggtgatgctttgtaaaagtgaaatgaaaacctctaaatggatcgaagcctatgagaatggaaatgtcgatataggcctagagtgtggattgcaaggaaaagctcaaatagggaagggtatgtgggctatgcccgatcaaatgtcagatatgcttgaacaaaaaatacagcacccaatggcaggcgcaaattgtgcctgggttccctcaccaactgctgcaactttgcacgcaacgcattatcacaaaatcaacgttcaaaaacgccaacaagaaattaaagcccttggctctagaagttgtttggacgatttattgcaggttccacttcaatcaagcgatgcactaactgaaagtgaaaaagaacgagaaattgataacaactgtcaagggattttggggtatgttgttcgctgggtagatcaaggtatcggatgttcaaaagttccagatattgataatattcagttaatggaggacagagcaacttgtagaatatcttctcaaagtttaagtaactggctttgtcacaattacgtaaaacacgatcaggttttgaggtctttgaaaaaaatggctgctgttgttgatgcgcaaaacgccgatgatgaaaattacagagccatgtctcctgattttaatactgaggcctttctagcagcctatgatttaattttcgatggcgaagctcagccttcaggttacacagagcctattcttcataaacggcgattagaaattaaaaataaagtttaagcgatattatttcagtngcctaattttttgtcgctttnttttattagatgattatttttctaaaataaaagtagtgctccgtttacggacaacttcaaatgtgtatatctatcatcatagggggctctggtgatgtcacgtccagttattggtataatgggaaattattacctgattaatgatcagtatcctgcacatgctgctggaacaatgaattgtgaggcaatcgttgatctctgcgatgctactcctctaatcataccaggcgatccaaattttgtgaaagtagatgagcttatgaggatctgtgatggttttttattcaccggtggtcggccaaatgttcatccatcagaatatggaattcaggcaacagaagctcatggggaatttgacagagcacgtgatgctgtaagtttatcactcataagatcttgtgtaaaattaggacagcctat

SEQ ID NO: 1244 - DNA, 4000 bp, Escherichia coli
  misc_feature (59)..(59): n is a, c, g, or t
  misc_feature (61)..(62): n is a, c, g, or t
  misc_feature (67)..(67): n is a, c, g, or t
  misc_feature (69)..(77): n is a, c, g, or t
  misc_feature (79)..(84): n is a, c, g, or t
  misc_feature (86)..(89): n is a, c, g, or t
  misc_feature (91)..(94): n is a, c, g, or t
  misc_feature (96)..(97): n is a, c, g, or t
  misc_feature (99)..(99): n is a, c, g, or t
  misc_feature (101)..(101): n is a, c, g, or t
  misc_feature (103)..(105): n is a, c, g, or t
  misc_feature (108)..(108): n is a, c, g, or t
  misc_feature (110)..(112): n is a, c, g, or t
  misc_feature (114)..(123): n is a, c, g, or t
  misc_feature (126)..(134): n is a, c, g, or t
  misc_feature (136)..(137): n is a, c, g, or t
  misc_feature (140)..(141): n is a, c, g, or t
  misc_feature (143)..(149): n is a, c, g, or t
  misc_feature (151)..(152): n is a, c, g, or t
  misc_feature (155)..(156): n is a, c, g, or t
  misc_feature (158)..(159): n is a, c, g, or t
  misc_feature (161)..(164): n is a, c, g, or t
  misc_feature (166)..(170): n is a, c, g, or t
  misc_feature (172)..(176): n is a, c, g, or t
  misc_feature (182)..(183): n is a, c, g, or t
  misc_feature (185)..(187): n is a, c, g, or t
  misc_feature (190)..(193): n is a, c, g, or t
  misc_feature (197)..(198): n is a, c, g, or t
  misc_feature (201)..(202): n is a, c, g, or t
  misc_feature (204)..(221): n is a, c, g, or t
  misc_feature (223)..(229): n is a, c, g, or t
  misc_feature (231)..(232): n is a, c, g, or t
  misc_feature (234)..(237): n is a, c, g, or t
  misc_feature (239)..(241): n is a, c, g, or t
  misc_feature (245)..(249): n is a, c, g, or t
  misc_feature (252)..(253): n is a, c, g, or t
  misc_feature (255)..(255): n is a, c, g, or t
  misc_feature (259)..(259): n is a, c, g, or t
  misc_feature (261)..(271): n is a, c, g, or t
  misc_feature (273)..(281): n is a, c, g, or t
  misc_feature (283)..(292): n is a, c, g, or t
  misc_feature (295)..(297): n is a, c, g, or t
  misc_feature (301)..(305): n is a, c, g, or t
  misc_feature (308)..(314): n is a, c, g, or t
  misc_feature (316)..(322): n is a, c, g, or t
  misc_feature (325)..(326): n is a, c, g, or t
  misc_feature (328)..(330): n is a, c, g, or t
  misc_feature (333)..(342): n is a, c, g, or t
  misc_feature (344)..(345): n is a, c, g, or t
  misc_feature (347)..(350): n is a, c, g, or t
  misc_feature (352)..(358): n is a, c, g, or t
  misc_feature (360)..(362): n is a, c, g, or t
  misc_feature (364)..(364): n is a, c, g, or t
  misc_feature (366)..(366): n is a, c, g, or t
  misc_feature (368)..(368): n is a, c, g, or t
  misc_feature (371)..(380): n is a, c, g, or t
  misc_feature (383)..(385): n is a, c, g, or t
  misc_feature (387)..(387): n is a, c, g, or t
  misc_feature (389)..(392): n is a, c, g, or t
  misc_feature (395)..(395): n is a, c, g, or t
  misc_feature (398)..(407): n is a, c, g, or t
  misc_feature (409)..(410): n is a, c, g, or t
  misc_feature (415)..(416): n is a, c, g, or t
  misc_feature (418)..(418): n is a, c, g, or t
  misc_feature (422)..(423): n is a, c, g, or t
  misc_feature (425)..(430): n is a, c, g, or t
  misc_feature (432)..(433): n is a, c, g, or t
  misc_feature (437)..(444): n is a, c, g, or t
  misc_feature (446)..(446): n is a, c, g, or t
  misc_feature (449)..(458): n is a, c, g, or t
  misc_feature (461)..(461): n is a, c, g, or t
  misc_feature (463)..(463): n is a, c, g, or t
  misc_feature (465)..(466): n is a, c, g, or t
  misc_feature (469)..(469): n is a, c, g, or t
  misc_feature (471)..(474): n is a, c, g, or t
  misc_feature (477)..(477): n is a, c, g, or t
  misc_feature (479)..(481): n is a, c, g, or t
  misc_feature (485)..(485): n is a, c, g, or t
  misc_feature (487)..(487): n is a, c, g, or t
  misc_feature (489)..(498): n is a, c, g, or t
  misc_feature (501)..(502): n is a, c, g, or t
  misc_feature (505)..(511): n is a, c, g, or t
  misc_feature (514)..(515): n is a, c, g, or t
  misc_feature (519)..(519): n is a, c, g, or t
  misc_feature (521)..(526): n is a, c, g, or t
  misc_feature (529)..(532): n is a, c, g, or t
  misc_feature (537)..(538): n is a, c, g, or t
  misc_feature (540)..(542): n is a, c, g, or t
  misc_feature (545)..(551): n is a, c, g, or t
  misc_feature (553)..(556): n is a, c, g, or t
  misc_feature (558)..(558): n is a, c, g, or t
  misc_feature (562)..(562): n is a, c, g, or t
  misc_feature (564)..(565): n is a, c, g, or t
  misc_feature (567)..(569): n is a, c, g, or t
  misc_feature (571)..(576): n is a, c, g, or t
  misc_feature (580)..(581): n is a, c, g, or t
  misc_feature (583)..(586): n is a, c, g, or t
  misc_feature (588)..(590): n is a, c, g, or t
  misc_feature (596)..(598): n is a, c, g, or t
  misc_feature (601)..(604): n is a, c, g, or t
  misc_feature (606)..(607): n is a, c, g, or t
  misc_feature (609)..(612): n is a, c, g, or t
  misc_feature (616)..(616): n is a, c, g, or t
  misc_feature (618)..(624): n is a, c, g, or t
  misc_feature (627)..(628): n is a, c, g, or t
  misc_feature (630)..(632): n is a, c, g, or t
  misc_feature (634)..(634): n is a, c, g, or t
  misc_feature (637)..(638): n is a, c, g, or t
  misc_feature (644)..(645): n is a, c, g, or t
  misc_feature (647)..(647): n is a, c, g, or t
  misc_feature (650)..(650): n is a, c, g, or t
  misc_feature (652)..(653): n is a, c, g, or t
  misc_feature (656)..(659): n is a, c, g, or t
  misc_feature (663)..(663): n is a, c, g, or t
  misc_feature (665)..(665): n is a, c, g, or t
  misc_feature (667)..(667): n is a, c, g, or t
  misc_feature (671)..(675): n is a, c, g, or t
  misc_feature (678)..(680): n is a, c, g, or t
  misc_feature (682)..(689): n is a, c, g, or t
  misc_feature (691)..(692): n is a, c, g, or t
  misc_feature (694)..(696): n is a, c, g, or t
  misc_feature (698)..(713): n is a, c, g, or t
  misc_feature (716)..(717): n is a, c, g, or t
  misc_feature (721)..(722): n is a, c, g, or t
  misc_feature (724)..(725): n is a, c, g, or t
  misc_feature (727)..(728): n is a, c, g, or t
  misc_feature (731)..(732): n is a, c, g, or t
  misc_feature (734)..(734): n is a, c, g, or t
  misc_feature (737)..(738): n is a, c, g, or t
  misc_feature (741)..(741): n is a, c, g, or t
  misc_feature (743)..(746): n is a, c, g, or t
  misc_feature (748)..(749): n is a, c, g, or t
  misc_feature (751)..(751): n is a, c, g, or t
  misc_feature (753)..(754): n is a, c, g, or t
  misc_feature (758)..(760): n is a, c, g, or t
  misc_feature (763)..(768): n is a, c, g, or t
  misc_feature (770)..(770): n is a, c, g, or t
  misc_feature (773)..(779): n is a, c, g, or t
  misc_feature (781)..(783): n is a, c, g, or t
  misc_feature (786)..(788): n is a, c, g, or t
  misc_feature (793)..(797): n is a, c, g, or t
  misc_feature (799)..(800): n is a, c, g, or t
  misc_feature (803)..(804): n is a, c, g, or t
  misc_feature (807)..(808): n is a, c, g, or t
  misc_feature (810)..(810): n is a, c, g, or t
  misc_feature (813)..(814): n is a, c, g, or t
  misc_feature (816)..(822): n is a, c, g, or t
  misc_feature (824)..(824): n is a, c, g, or t
  misc_feature (827)..(829): n is a, c, g, or t
  misc_feature (831)..(832): n is a, c, g, or t
  misc_feature (834)..(837): n is a, c, g, or t
  misc_feature (840)..(843): n is a, c, g, or t
  misc_feature (846)..(850): n is a, c, g, or t
  misc_feature (852)..(857): n is a, c, g, or t
  misc_feature (860)..(863): n is a, c, g, or t
  misc_feature (867)..(877): n is a, c, g, or t
  misc_feature (879)..(883): n is a, c, g, or t
  misc_feature (887)..(888): n is a, c, g, or t
  misc_feature (890)..(892): n is a, c, g, or t
  misc_feature (894)..(896): n is a, c, g, or t
  misc_feature (898)..(900): n is a, c, g, or t
  misc_feature (902)..(902): n is a, c, g, or t
  misc_feature (904)..(907): n is a, c, g, or t
  misc_feature (909)..(910): n is a, c, g, or t
  misc_feature (912)..(912): n is a, c, g, or t
  misc_feature (914)..(914): n is a, c, g, or t
  misc_feature (918)..(922): n is a, c, g, or t
  misc_feature (925)..(925): n is a, c, g, or t
  misc_feature (930)..(931): n is a, c, g, or t
  misc_feature (933)..(935): n is a, c, g, or t
  misc_feature (938)..(943): n is a, c, g, or t
  misc_feature (946)..(953): n is a, c, g, or t
  misc_feature (955)..(957): n is a, c, g, or t
  misc_feature (959)..(961): n is a, c, g, or t
  misc_feature (963)..(967): n is a, c, g, or t
  misc_feature (971)..(971): n is a, c, g, or t
  misc_feature (974)..(974): n is a, c, g, or t
  misc_feature (977)..(979): n is a, c, g, or t
  misc_feature (981)..(981): n is a, c, g, or t
  misc_feature (983)..(989): n is a, c, g, or t
  misc_feature (993)..(994): n is a, c, g, or t
  misc_feature (996)..(997): n is a, c, g, or t
  misc_feature (999)..(1002): n is a, c, g, or t
  misc_feature (1005)..(1012): n is a, c, g, or t
  misc_feature (1015)..(1015): n is a, c, g, or t
  misc_feature (1017)..(1019): n is a, c, g, or t
  misc_feature (1021)..(1028): n is a, c, g, or t
  misc_feature (1032)..(1032): n is a, c, g, or t
  misc_feature (1035)..(1041): n is a, c, g, or t
  misc_feature (1044)..(1044): n is a, c, g, or t
  misc_feature (1046)..(1046): n is a, c, g, or t
  misc_feature (1048)..(1048): n is a, c, g, or t
  misc_feature (1054)..(1054): n is a, c, g, or t
  misc_feature (1056)..(1061): n is a, c, g, or t
  misc_feature (1064)..(1066): n is a, c, g, or t
  misc_feature (1068)..(1071): n is a, c, g, or t
  misc_feature (1073)..(1073): n is a, c, g, or t
  misc_feature (1076)..(1078): n is a, c, g, or t
  misc_feature (1080)..(1080): n is a, c, g, or t
  misc_feature (1082)..(1082): n is a, c, g, or t
  misc_feature (1084)..(1087): n is a, c, g, or t
  misc_feature (1089)..(1090): n is a, c, g, or t
  misc_feature (1092)..(1099): n is a, c, g, or t
  misc_feature (1104)..(1108): n is a, c, g, or t
  misc_feature (1110)..(1114): n is a, c, g, or t
  misc_feature (1117)..(1121): n is a, c, g, or t
  misc_feature (1124)..(1126): n is a, c, g, or t
  misc_feature (1129)..(1134): n is a, c, g, or t
  misc_feature (1136)..(1136): n is a, c, g, or t
  misc_feature (1139)..(1140): n is a, c, g, or t
  misc_feature (1142)..(1150): n is a, c, g, or t
  misc_feature (1154)..(1154): n is a, c, g, or t
  misc_feature (1156)..(1157): n is a, c, g, or t
  misc_feature (1167)..(1168): n is a, c, g, or t
  misc_feature (1171)..(1171): n is a, c, g, or t
  misc_feature (1292)..(1292): n is a, c, g, or t
  misc_feature (1705)..(1705): n is a, c, g, or t
  misc_feature (1742)..(1742): n is a, c, g, or t
  misc_feature (1745)..(1745): n is a, c, g, or t
  misc_feature (1758)..(1758): n is a, c, g, or t
  misc_feature (1760)..(1760): n is a, c, g, or t
  misc_feature (1787)..(1787): n is a, c, g, or t
  misc_feature (1794)..(1794): n is a, c, g, or t
  misc_feature (1797)..(1797): n is a, c, g, or t
  misc_feature (1813)..(1813): n is a, c, g, or t
  misc_feature (1817)..(1817): n is a, c, g, or t
  misc_feature (1825)..(1825): n is a, c, g, or t
  misc_feature (1839)..(1839): n is a, c, g, or t
  misc_feature (1849)..(1849): n is a, c, g, or t
  misc_feature (1852)..(1852): n is a, c, g, or t
  misc_feature (1963)..(1964): n is a, c, g, or t
  misc_feature (1995)..(1996): n is a, c, g, or t
  misc_feature (2003)..(2003): n is a, c, g, or t
  misc_feature (3557)..(3557): n is a, c, g, or t
  misc_feature (3577)..(3577): n is a, c, g, or t
  misc_feature (3756)..(3756): n is a, c, g, or t
  misc_feature (3789)..(3789): n is a, c, g, or t
  misc_feature (3807)..(3807): n is a, c, g, or t
  misc_feature (3823)..(3823): n is a, c, g, or t
  misc_feature (3974)..(3974): n is a, c, g, or t
atcaaccggaataattcctttatatttacccttaggggatttttccagtaattctctancnntattnannnnnnnnnannnnnnannnngnnnnanntnanannncantnnntnnnnnnnnnnatnnnnnnnnnannttnnannnnnnncnnaannannannnntnnnnntnnnnntatctnntnnnttnnnncctnnagnnannnnnnnnnnnnnnnnnncnnnnnnncnntnnnnannngaannnnnatnntnactncnnnnnnnnnnngnnnnnnnnntnnnnnnnnnnagnnntttnnnnnctnnnnnnnannnnnnnganntnnnaannnnnnnnnnannannnntnnnnnnntnnntnanantannnnnnnnnnaannnanannnntanaannnnnnnnnnannatttnntnaaanntnnnnnntnnaaannnnnnnntnccnnnnnnnnnnatngnannatnannnnttntnnntaananannnnnnnnnnaannttnnnnnnnttnntttntnnnnnnttnnnnctttnntnnnaannnnnnnannnncntttnanncnnnannnnnnaaanncnnnngnnnaaaaannnagnnnngnncnnnnaaantnnnnnnnccnnannntnaannaaaaanngnaantnnttnnnnaggngntnttgnnnnnttnnntnnnnnnnnannannncnnnnnnnnnnnnnnnnggnnaaanntnntnnaanncnttnnaantnnnntnntncnnaaannnaannnnnnanggnnnnnnntnnnttnnnaaaannnnnannaannaannanttnngnnnnnnngnaannngnncnnnnccnnnnaannnnncnnnnnnttnnnnaaannnnnnnnnnnannnnncttnntnnncnnngnnncnannnnanntnanaaannnnnttnctttnnannnccnnnnnnttnnnnnnnnannngnnntnnnnntttnccnaannnantnnnnnnnaaannanntnnnnaannnnnnnnagnannnannnnnnnntttnggnnnnnnnccnantnttttcntnnnnnnttnnngnnnnanttnnnancnannnncnntnnnnnnnnacccnnnnntnnnnnaannnnnttnnnttnnnnnntnaannannnnnnnnnaatngnntatggaaaannctnttttaaaatttgaatgacttctttatctaccactccaacagtgacatatttatcggttttttgctgattaatatcaatgtaaacgccgctttctataaatctgagctgtgatggtttaagngctaatagatcagaaaccctctggcctacataaagcccaatcagtatccattttctagcattttcaagagtggaaggtaaatttctaatcgcttttatcttttttatttcttcaaatgaaatggtttgtaaaacgcgatctttacttttttgagtaaacgattctatgtgtctggtatatggatttacattaatactcattctttcagcttctttacaaatcatttttagaagctttaattgaaggccagcgttattaagtgaatattcttttttagttaaaagccactctttaaacgcattaactaacatgtgatctattgtatctaacatgatcgattgaccaaaatcagattcaaattcctgaattaaatcataaaatcgttttagattcctgatagaattattggacanaccaagtgagccacttcttttaagtcttcttagaggngcntgttttatatagntngagatctgagtgagtaataccccttgntctctancantagcaactattttatngttntaatcacncattttttattgtntaattttcanatnatttgtgaatattataactaacttcaaagttcatttaacattttaaataaaatattctaacgtaaatttgcttaaaatttacatttaaatatacgttattttttatgttanntaacatataaagtcaataaatacagggcctnncaaagantagttttgaaataactacgggctgtagtcaaaataaaaatcttttaatacaaacagaaaaccttcttatctttaaaaaaatttacacatgaaagccattctccttgccggcggcacaggatccagactcttcccagtcacactaggtgtttctaagcagttattacctgtctatgataaacctatggtgtattatcccttgtcggtacttttgcaggcagggattcgagaagttttagtgattagtactccagaagatttggggcagtatgaacggttattgggcgatggaagtcaatggggaattagtttgcaatataaagctcaaccaaagcccaacggattggcagaggcctttctgttgggagaagaatttattggagaggaagcggtttgtctgatattaggagataatattttttatggtgtagatttttcaaaacaactagaagcggtcaaacaaagaacaagtcttggttcgaaggcgactatttttggatatactgtcaatgatccccaacgttatggagttattgaatatgatgatcaagggaaagccacctctattgaagaaaaacctgaaaatccaaaaagtaatgaagccgtggtaggcttgtacttttatcctaattctgtcattgaaattgcaaaacaaagcacaccttcagagcggggtgaactagaaatttcggctgtaaatcaaaaatatttggaagatggaaatcttcaggtagaagttttgggtaaaggtttcgcttggctggatacaggaacacatgagtctttattggaagcgggacaatttattcataccattgaaaaacggcaaggtcttaaagtaggatgtcttgaagaaatagcttttgaaaaagggtttgtcacaaaagagcaacttttggaaggtgcagaaaaaatgaaacaaacagaatacggaatctatttattaaaaaaatacagcgataaatcataactttaagcttcaattaaacgatccatcatgaatatcaaaactactcctttcaaggaggtttttattttaaagcccacccttcacttagatgaacgaggctcttttatggaaagttttaatgaacgagaagttgaaaaagttttagggaaaaaaacaatgttttgtcaagacaatcttacccattccaaaaaaggagttttaaggggcttacattatcaattacccccctttagtcaaacaaaattagttagtgtgattcaaggaagcgtattggatgtggttgtggatatacgtaaaggatctcccacctttggacagtattttagttttgaattaagcgcagaaaatcagttacaactttttatccccagaggatttgctcatggatttataacgttaagtgagacgtctatttttatgtataaagtagatcaatattataattttgccagtgaaggaagcattaccccagatgatcctgctttagggatagattggcaaataccccaatcacaatggattcaatctgagaaagataaaaagcatcctacccttgcagaggctaccctttttgattataatttngacctttatgcctagttatntagtaacaggtgggtcaggtcaactgggacaatgctttcatgcggttgctaaagaatcacctgcgataaatttattttttacttctagaaacgaagtagacattacacgatcggaaacccttgcaaatttttatagcaaaaatccttttgatggcattatcaattgcgctgcctacatnaatgttgatcaggcggagaaagaggaagaaagngcgtttaaaatcaatacngaaggacttcaaaatntaattgactttgcagaggagaaaaaactttcgattatccatttttctacagattacgtttttgatggaaattcttctgaaccttatcctgaggaggcggcaacaaatccaatagggatttatggaaactcaaaattgaaaggggaagtacntctttcaaaaagcagttgtaagaatg

SEQ ID NO: 1245 - DNA, 4000 bp, Escherichia coli
  misc_feature (62)..(62): n is a, c, g, or t
  misc_feature (131)..(131): n is a, c, g, or t
  misc_feature (140)..(140): n is a, c, g, or t
  misc_feature (377)..(377): n is a, c, g, or t
  misc_feature (639)..(639): n is a, c, g, or t
  misc_feature (785)..(785): n is a, c, g, or t
  misc_feature (877)..(877): n is a, c, g, or t
  misc_feature (934)..(934): n is a, c, g, or t
  misc_feature (956)..(956): n is a, c, g, or t
  misc_feature (1156)..(1156): n is a, c, g, or t
  misc_feature (1210)..(1210): n is a, c, g, or t
  misc_feature (1249)..(1249): n is a, c, g, or t
  misc_feature (1435)..(1435): n is a, c, g, or t
  misc_feature (1438)..(1438): n is a, c, g, or t
  misc_feature (1525)..(1525): n is a, c, g, or t
  misc_feature (1643)..(1643): n is a, c, g, or t
  misc_feature (1752)..(1753): n is a, c, g, or t
  misc_feature (1847)..(1847): n is a, c, g, or t
  misc_feature (1860)..(1860): n is a, c, g, or t
  misc_feature (1883)..(1883): n is a, c, g, or t
  misc_feature (1937)..(1937): n is a, c, g, or t
  misc_feature (1979)..(1979): n is a, c, g, or t
  misc_feature (1991)..(1992): n is a, c, g, or t
  misc_feature (1994)..(1994): n is a, c, g, or t
  misc_feature (2021)..(2021): n is a, c, g, or t
  misc_feature (2046)..(2046): n is a, c, g, or t
  misc_feature (2051)..(2051): n is a, c, g, or t
  misc_feature (2750)..(2750): n is a, c, g, or t
  misc_feature (2753)..(2753): n is a, c, g, or t
  misc_feature (3264)..(3264): n is a, c, g, or t
  misc_feature (3266)..(3266): n is a, c, g, or t
  misc_feature (3338)..(3338): n is a, c, g, or t
  misc_feature (3405)..(3405): n is a, c, g, or t
  misc_feature (3410)..(3410): n is a, c, g, or t
  misc_feature (3431)..(3431): n is a, c, g, or t
  misc_feature (3510)..(3510): n is a, c, g, or t
  misc_feature (3560)..(3560): n is a, c, g, or t
  misc_feature (3587)..(3587): n is a, c, g, or t
  misc_feature (3983)..(3983): n is a, c, g, or t
gtcagcttaatatgctcgtagacaccatattggcttcttttttacctacgggtagcccaacntggttgtatgtttctgacaggttaatgcagttaccgcttgggatttttgctattgccataggtactgtnttacttccncggctttcttctttgcatcaaactgatgataaggaaggattctcgagaacaatggactggtctataagattagttttgttaattggggttccttcaattataggtttagttctcttatcagaaccaatcattcttaccttatttgagcgaggggagtttattgcatcagacacgagacaggcgtcttttagcctcatagcacttgcattaggcttgattgccttcatgctgattaangtgttgacccctggcttttttgctcgtcagaaccctaaaacgcccttgaaagttgctgcagcctctatggtagttaacgctgttttagcttggttactcgccttttatttaggtttcaatcatgttggtttagcaatagctagttctattgccgcgtattttagtattactatattgctctttattctcttaaaaaataagatttatcaagttcaaaaaggatggatcatttttttaggaagaatatttgttgcttcttttnttatgactgtaatagttaatctaatgaatgtagagacatttgcatggagagagttagatcaagtggtccgttttatgcagcttttgcttataacctttagtggcatagcttcctatcttgctgtgttgtggatttcaggacttagnttaagagatttaaaaggttaactatgtatttgattcgaggaacaaataatatagaacttttcagatccaattttcctgagatctctactgtngcaaccatcggaaactttgatggccttcatcttggtcatcagcagatattaaaaacnatgcaggaagaagcggatattnacgggcttaaaaggctaataatctttactgagccacacgctcaagaatttttttctgaagcagcaggtttggagacttcaaagcctcctcgaatttttccatggcaagaaaaagtgaggaagatgagggagttcggtgttgaatttgcttttttcttgaaattcaataatcaattgagatctatgacgcctgaagacttnttaaataaaattttgttaaggcttcacattaaaaaattagtaataggagatgantttagatttggggccaaccgagaaggagatttcagtctncttaaaaactggggaactcagaattcgatagaagtttctaacaccgagacttatgaaattgatggggaaagagtaagcagtaccagaataagggaggctctaacagaaaacaattttgaaaaggccaataaatttttgggcaggcctttcacttattctggaaaagtagtttatgggaaccagttnggnggtcaacttgggattcctactgcaaatttatggctacctaagaataaattacctatttctggtgtttacattgttaaagctttgctngataaaaagaaattaagaggcatagccaatatgggaataaggcccactgtggggggagagtcgcctgttttagaagtacatctattaaatttttccaaaaaaatttatggcaaaaggntaactgtagaatttttgaaaaaagtaagagatgaaaaaaaatttgaaaatttaaatgctttaaaagaccaaatttttaaagatatttctacagctgagagttatttcgnntaaagtgcaaaaaattaacatgaaagactataaagaaactcttaatctgcctaaaacagagtttgcaatgaaggcaaatcttcctaataaagancctgagttattgnaatattgggaagaaatagagctntataaaaagttaaaaaagaaagggaaagggaaggataaatttgtacttcatganggtcctccctatgcaaatggggctattcatattggccacgcngtaaataaaacnntnaaagatattgttgttaaatctcaaacnctaagtggtaaatactccccttacnttccnggttgggattgtcatggcctccccattgaattaaatgttgaaaagaagttaggcaaggtaggcgataaagtaaccgcaaaagtgtttagagaagcttgtcgaaattatgctaaagaccaaatagaaatacaaaaagaggagtttaaaagactgggggttttgggagattggaaaaatccctacctgacaatggatagtcaatttgaagcaggtatagttcgttctttgggtcaaataatctcaaaagggtatgtaaatagaggagataagcctgtccactggtgtgttgattgtggctctgcactggcggaagcagaagttgaatatcaagacaagatttcaccctccatagattttggattccctattgagattgaaaaaataaactctattttcaatctagacttggatatgtctatttatgtttcaagttggactaccactccttggaccgtaccagggaatgtagcacttacagttaatgccgaatttgattattgtttagttcaaataaaagaaagctcaaaggattatggccttcttataggtaagaagttaatagaacctacacttgaacggattggtgtaaaaaacttcgaagttttagcttcttgtaaaggtataaaattagagggattagaagccaagcatccttacttaaataggccttcaaaattagtattaggcgatcatgtaacnacngaggttggaactggaatcgtccatacctcgccagggcatggtcttgaagactacttagtagccaaagagtatgatttagatgtactaagtccggttaagaacaacggaacttttaattctgatgaagaacatgtagggggtctattcgcttttaaggctaatgaaaagatcattgaagtactaaaagaagagggtactctttttgcactagctgactatgaacatagttatccgcattgttggaggcataaaacaccactaatgtttagagccactcctcaatggtttataggtatggataaaggttctttgcttgcaaatgctaataaggccatcaaggaagtaaactgggagccttcttggggtgaaaccaggatgtccagcatgttggatagacctgattggtgtatatcgcgtcagagagcatggggtgttcctatcccccttctaattcataaggaaacaagagagttacatccggacaccaatcaattaattgaggagattgctnanaagatagaaaagcagggaatagagtcctggcacgaagtcaagatagaagaccttattaaagattcatcaaantatgaaaaaataactgatatcctggatgtgtggtttgattcgggtgttacgcatgcttgcgtcttgnccgangaagaattgcagttcccggcngacctttatctggagggctcagatcagcaccgagggtggtttcagtcatcgttacttacgagcatggccataaatgacncacctccttataaaggagttttgacacatggttttgttgtcgacgctganggaaaaaagatgtccaagtcccttggnaataccatttcacctcaagaaatatggaattctcgaggagcagatgtcttaagggcatggatagcttcaaccgattataggaatgaaatggttatatctgataccagattacagggagtttcagatacatacagaagaatcagaaataccataagatttttattgggaaatgttcatgatttcgattcggcgagccgtgtaaaagaaaatgaattaacagaaatagatagattcatggagattaaaactcaaaacctccaaaaagaattaatagaagattatcaaaattatcaatttcacctagccttcaacaaaatacacaatttttgttccaatgatttaggcgggttttatttagacattctcaaagatcgtctttatacctgtggcaaagantctttagccagaagatc

SEQ ID NO: 1246 - DNA, 4000 bp, Escherichia coli
  misc_feature (1)..(1): n is a, c, g, or t
  misc_feature (3)..(5): n is a, c, g, or t
  misc_feature (7)..(8): n is a, c, g, or t
  misc_feature (10)..(10): n is a, c, g, or t
  misc_feature (12)..(14): n is a, c, g, or t
  misc_feature (17)..(21): n is a, c, g, or t
  misc_feature (23)..(24): n is a, c, g, or t
  misc_feature (27)..(27): n is a, c, g, or t
  misc_feature (34)..(35): n is a, c, g, or t
  misc_feature (37)..(39): n is a, c, g, or t
  misc_feature (45)..(46): n is a, c, g, or t
  misc_feature (48)..(51): n is a, c, g, or t
  misc_feature (57)..(59): n is a, c, g, or t
  misc_feature (61)..(63): n is a, c, g, or t
  misc_feature (66)..(66): n is a, c, g, or t
  misc_feature (68)..(69): n is a, c, g, or t
  misc_feature (71)..(71): n is a, c, g, or t
  misc_feature (73)..(74): n is a, c, g, or t
  misc_feature (76)..(76): n is a, c, g, or t
  misc_feature (229)..(229): n is a, c, g, or t
  misc_feature (247)..(247): n is a, c, g, or t
  misc_feature (305)..(305): n is a, c, g, or t
  misc_feature (314)..(314): n is a, c, g, or t
  misc_feature (334)..(334): n is a, c, g, or t
  misc_feature (337)..(337): n is a, c, g, or t
  misc_feature (350)..(350): n is a, c, g, or t
  misc_feature (446)..(446): n is a, c, g, or t
  misc_feature (500)..(500): n is a, c, g, or t
  misc_feature (502)..(502): n is a, c, g, or t
  misc_feature (599)..(599): n is a, c, g, or t
  misc_feature (694)..(694): n is a, c, g, or t
  misc_feature (1987)..(1987): n is a, c, g, or t
  misc_feature (2679)..(2679): n is a, c, g, or t
  misc_feature (3733)..(3733): n is a, c, g, or t
  misc_feature (3739)..(3739): n is a, c, g, or t
  misc_feature (3741)..(3741): n is a, c, g, or t
  misc_feature (3744)..(3744): n is a, c, g, or t
  misc_feature (3748)..(3748): n is a, c, g, or t
  misc_feature (3753)..(3753): n is a, c, g, or t
  misc_feature (3757)..(3757): n is a, c, g, or t
  misc_feature (3759)..(3759): n is a, c, g, or t
  misc_feature (3762)..(3763): n is a, c, g, or t
  misc_feature (3766)..(3767): n is a, c, g, or t
  misc_feature (3769)..(3772): n is a, c, g, or t
  misc_feature (3781)..(3781): n is a, c, g, or t
  misc_feature (3783)..(3783): n is a, c, g, or t
  misc_feature (3785)..(3787): n is a, c, g, or t
  misc_feature (3789)..(3790): n is a, c, g, or t
  misc_feature (3792)..(3793): n is a, c, g, or t
  misc_feature (3797)..(3799): n is a, c, g, or t
  misc_feature (3802)..(3805): n is a, c, g, or t
  misc_feature (3811)..(3811): n is a, c, g, or t
  misc_feature (3813)..(3819): n is a, c, g, or t
  misc_feature (3821)..(3823): n is a, c, g, or t
  misc_feature (3825)..(3828): n is a, c, g, or t
  misc_feature (3830)..(3837): n is a, c, g, or t
  misc_feature (3839)..(3839): n is a, c, g, or t
  misc_feature (3841)..(3841): n is a, c, g, or t
  misc_feature (3843)..(3843): n is a, c, g, or t
  misc_feature (3845)..(3852): n is a, c, g, or t
  misc_feature (3855)..(3855): n is a, c, g, or t
  misc_feature (3857)..(3857): n is a, c, g, or t
  misc_feature (3859)..(3868): n is a, c, g, or t
  misc_feature (3871)..(3874): n is a, c, g, or t
  misc_feature (3876)..(3876): n is a, c, g, or t
  misc_feature (3878)..(3883): n is a, c, g, or t
  misc_feature (3885)..(3885): n is a, c, g, or t
  misc_feature (3887)..(3887): n is a, c, g, or t
  misc_feature (3889)..(3889): n is a, c, g, or t
  misc_feature (3891)..(3891): n is a, c, g, or t
  misc_feature (3893)..(3893): n is a, c, g, or t
  misc_feature (3899)..(3900): n is a, c, g, or t
  misc_feature (3905)..(3905): n is a, c, g, or t
  misc_feature (3907)..(3908): n is a, c, g, or t
  misc_feature (3913)..(3914): n is a, c, g, or t
  misc_feature (3920)..(3921): n is a, c, g, or t
  misc_feature (3926)..(3926): n is a, c, g, or t
  misc_feature (3928)..(3943): n is a, c, g, or t
  misc_feature (3945)..(3947): n is a, c, g, or t
  misc_feature (3949)..(3949): n is a, c, g, or t
  misc_feature (3951)..(3952): n is a, c, g, or t
  misc_feature (3954)..(3957): n is a, c, g, or t
  misc_feature (3959)..(3959): n is a, c, g, or t
  misc_feature (3961)..(3966): n is a, c, g, or t
  misc_feature (3968)..(3968): n is a, c, g, or t
  misc_feature (3970)..(3970): n is a, c, g, or t
  misc_feature (3972)..(3978): n is a, c, g, or t
  misc_feature (3980)..(3992): n is a, c, g, or t
  misc_feature (3995)..(4000): n is a, c, g, or t
nannntnncngnnnaannnnngnnttnaaaaaannannntttttnncnnnntttttnnngnnnaancnnantnnanctattattgatgcgagccatccatttgacaaatacacaacagaaatttgtgtaaagattgctgagctagaaaatataaaatttagaaagtttatccgaccttcttggaagccaaaacctaatgataattggataacattaccgactttgaatnaggcagagaaaataattncgaatggatccaatgtgttcatagctactgggcgaagtggcttggaaaaattttctanacttactanttgtaaattttacataagangantgggtgacagaanagaacagtgttcgctaaaaaacggcgaattcatttatggagaccctccattttcaattgaacatgagataagtttatttgaatgccttaatatagntgttttgattataaaaaatgttgggggcaacggaagttttgcaaaagttgaagnancgcgcgcgatgaatattttagttttgatgatagataggccgcaaaggtctaatgcacttgtaatttcgtcagttttcgaaatattgaagtgggtggntactaatcaatgacggataaaattcttatagagactgatgagatactggtacaagcaattgatgcccttactttgcttgaaccccggtttgcacntgtcatagaacacactggcctgcccaagctacgttcaaggccagatggattcaaaactttactacaagcaattataagtcagcaggtttcagttgcagccgcaaatgccatttggtcccgattggacgttgagaatctgacagatcctaataaaatcctcaaagccactgaggatcgtctgaaaaaggctgggctcagcaggcaaaaaattaggtattcaaaagccttggccgcagcgaatttagattatgtagatctgagacaaaaaagtgatgatgaagttattaatatcttaactgaagtgcctggtattggagtttggacggctgaaatttatgcaatgtttagtttgaaaagggccgatatttttgcagcgggcgatcttgcattgaaggaaggggcaagactattattttcctttgacgaacggcccactgaggctgagctgagaaatctttcaaaaaagtggtcgccatggcggtctgttggggcacttctcctatggaattactatggttttaaaaaaaatagggaaggcgttgtatgacacgtgtattaaaatctaagcgtaccgaaccaaagtcaggtgatatacgctcagtcttggtttttctccatggatatggagcaaatggggatgatttattgggattagcagagcctttatctgagcatcttcctgacacactgtttgtttctccagatgctccagaaaattgtgcgggcagtccgatgggatttcaatggtttccaatcccttggatagatggatctagtgaggaggagagcaaaaagggcatgatctctgcagtggatgatttgaatgcgtttctcgacgccctaatggtcgatgaagacatattgccggaacaactcgctttgtttgggttctctcagggaacaatgatggctttgcatgtcgcgcctcggcgagaagatcctattgctggtgttgtcgcaatttcaggcagactgttagaaccagaacttcttgttgatgaggcagtaagtcacatgccagttatgtttgtgcatggggacgaggatgatgtcgtcccgccacaatcaatgccacagggagtggaaggattacaggccgcaggcttcaaagatgtttatgctcatattcaaaaaggtactgggcatggtattgcacctgatggattaggtgtttctttggcctttttgcgtgatcagttaggcttttaaatggtggaaatatatttttgaattttaaataacgtgccacaaaatgggggttgtcacgagctcaactcaatatatagttataanagactgataatgattgcttgagggacactggtatggaggcagactttaggaatgaatttgtaagacatcctacatctaccaaaaacaacccggcattggttctgaacgctgattatagaccgctttcatactatccactttcattgtggtgttggcaggatgcagtaaaagccgcgtttatggatagggttgatattgtggcagagtacgatgattatgtgcatagtccctcaataagtttaaaaatcccttcagtagtagtcttgaaagactacgtaagacctcaaaaaaaagttgctttcactcgtttcaatctttttttgagggatgagttttcatgccaatattgcggttccaagggtgatttgacgtttgatcacgtggttccaagatctcaagggggtacaactaattgggctaatgttgttgcggcgtgtagcccatgtaatttaaagaagggatcaaaaagccttcaaaattcgggcttgcatttaaggcgtaagccggtacgccctgagcctcatcaaatgatgaatgtcggaagaaagttcccgccgaattttttgcatgaaagttggatggactttttgtactgggacgctgagttggatgcataacaagttttattttctccttgctataagataggttaattaaaaactaatacggtaatatattaccattattgtaanctattgtttttattaatttatatttattcaaatactcttgacctcagtaatattggcgatataagcctttaattaagtttagaaaaataatgaaatcaggtggtattttaatgaagacatatactgcgacccctgcagatatcgaaaaaaaatggatattagtcgacgcagacggaatagtactaggccgattagcttcgatcatagcaatgcgtctgcgcggcaaacataaaccctcttttacacctcacatggactgtggggataatgttatagtcataaatgctgaaaaaattcagatgactggaaaaaagagagaagaaaacttctattggcacactggccatccgggcggtataaaatccagaactaaacaacaaattttagatggcgcccacccagagcgtgttattactcaggctgtcaagcgtatgctaccgggtaataaattgagccggcagataatgacaaatctcagggtatatgctggatctaatcatccccacgaagcacaagatccaagtgttttggacgttaaatcaatgaattctaaaaatacacgggtgacaaactaatgagcgaagatttaaaatcattaagcgatctggatgtaagtccatctgacgatactacggctgttgaaattgcagcccctagagttgctattcgtgatgatctgggtaggtcttacgccactggtaagagaaaagacgcagtcgcgcgcgtatggataaagccggggtccggtaagattgtggtgaatgacaaagagatgaatagttatttcgccagacctgtgcttcaaatgatccttaggcaaccttttcaggttgcaggagttgaagaccagtttgacgtaagtgcaactgtgaaaggtggcggcttatctggccaagctggtgcggtaaagcatggtatctcaaaggcattgcaattgtatgagccatccttaagggctgcactaaaatctgctggatttcttacacgcgatagtcgcgttgtggagcgcaaaaagtttggtaagcgaaaagcgcgccgctcctttcagttctcnaagcgntnatntttnacatncacntntannaannannnnaaaaaaaanancnnntnncnnaaannnagnnnntttttntnnnnnnncnnntnnnntnnnnnnnntntntntnnnnnnnngtntntnnnnnnnnnngcnnnntntnnnnnngngnananantatatnnttttntnnaaaanngtgtgnnatatntnnnnnnnnnnnnnnnntnnnananntnnnntntnnnnnntntntnnnnnnngnnnnnnnnnnnnnacnnnnnn

SEQ ID NO: 1247 - DNA, 4000 bp, Escherichia coli
  misc_feature (701)..(701): n is a, c, g, or t
  misc_feature (830)..(830): n is a, c, g, or t
  misc_feature (854)..(854): n is a, c, g, or t
  misc_feature (1302)..(1302): n is a, c, g, or t
ttgatgaaaaattccaagatcaggtcaaaaaaggatacatagaaaagattgacattaaaaaagaaaatatttatcgaaaggacagttactttctcagttattttccagtagtcaatagaacgaaagacacctcaagtcttagaattgtatttgatgcaaaagctaaagacaagagtggaagttctatgaatggagcaattgagaaaggtccaaatagattaaatgacttgtttgcaattctgttaaggttcagaagatttcattatgcttttacagctgacatcagtgaaatgtttcttaggatcagattaactgaagctgataaaagataccatagattctggtggaatgaaaacttctggcaatggaacagaattttatttgggaacagggctagcccagatattagccaaaaagtcattacaactcatgctttaaaaatgaaagagagttatcctgaagcgagtagagctctaatcgaagacacatatatggatgacacaattgtcagccgtcctagcgaggaggaatgtgttaagattgtagagacactgccaaaggttacagaaggaatggatatgaaaatccagaaattctattctaactcgagattagctcttaaatctcttcctgaaaatttgttgagcacaaaagtccactttagcgataaagaggaaatttttgattcaaacaaagttttnggaatggtttgggatgctaatacagatctgataacttataatgccaagtataagaatgcagatcagtttatagaagcaatgagtttgaaaaaagtctctaaaggagattggactaagagattaattttncggcttagtgcaaccgtgtacgancctttgggtctaatctcaccattcaccattagagctagaacaattttgcaagctttatggggagaaaatttagaatgggacactccagttccagaaaaatttatatctctatggaaagcttggctagaagaattgtttgaactaccaaattttatcaagatacccaggcatttaggattcggaatcaataataagattgaattgcatgtgtttgttgacgctagcactaaagtgtttgcggctacagtctatgcaagaatcttagagatgcgagaacctaatgatcttgataatggtgtcactgcaaggggggaaaatcagaatcattgtattgcagtaacactcattacggcaaaagccagagttgcacctaccaagacagagtctgttagccgccttgagttagcagcatgtgtcattggtacaagattaggattgacagttgctnatgctttggacttagataaaagcactatcacattttggacagattccacaaattgtttgtattggataaattccccatccagcaatttaaaaacatttgtttcaaatagagtaggtgaagtccatacgcatagcaatcctaatcaatggaagcatattccaactgatataaatccagctgatattccaactagactaccaaagatctcagacttagctgataattcactttggtggaatgggccacgcttcttgtctgattccatgacaagttggcctaagccatttgttccaccaactgaagtggacgatgaagcaaagaatgagttcaaaaaactgttcattggcaatatagacatagctcaactaggtctattagatccatgcagatacagtgtaggaaaagtttggaatggctttgatcaacttataagtttggcatcagaaatatttaagctagcaaacccaaggagagattttcctagggccaataagttagcattacaatttctgataaggagatcacaagctaatagtttggatttacaagaaattatgcatcaattaaggactgagaaacagatttctaaaccgtatagaagtttcttgccattcatagataaagcaggtattctaaggtcaaaaagtaggctagcaaatgttgactacttagactacgaggttaggtttcctgcaatccttgatagacaagatccttttactagactcatgattcgctcttttcatttcaagtttgcacatacagtagggaatgactgttgcaaagcagaaataagcaaaggctatgtcatgataggtttagaaaactatcttaaaacagtaaaatcaaaatgtctcgtctgtcagagatatttagcaattccactaagacaacaaatgtcagcgctgcctagttggcgctttcagaagcctttacgggcgtttgcaaagtgtggcttagattttgctggtccttttgaattaaaagcaataggtagaggtaaagctagaccgaaaacttaccttttactatttacttgtctgcagactcgagcagtacatttggagttgactgaggcaatgtccatgtcagctactcttaatgcgatatcacggtttgtcgatattaggggtatgccaacatccattctctcagacaatttctctactttcgtttctaaggataaggatttagaaaattgggtaagaacaatacagttagatgatctaatctctactactaaagccaaagttcaatggcactttatccctcccaggggacctcatcatgggggtgtgtatgaacgtatggtaggggtagctaaaagagctctggaaagtctgtgccactattcagacctaactgtggatgagtttcggactatggcttataaagtggcaaatttagttaacagtagaccactgagtagactttcacttagtgagggggatctcatccttaccccaaatcactttctttttggaaatcttggtggtagtgtaactgttgaaaatattacctcacattcccaaaggtggcataagatttgcgaacttttagaccaattttggagtatcttcttggaaaagactttattggaacttaggaataccaaaaagtggcaagtagaacagactcaattggcagaaggagatctagttgtagaaattgattctacccagccaagaggttgctggaagctagctgttgttgagcaggtccatccttctgatgactctaaagtacgcaaagtcacaatacgtaacagtaagggtcagtacatcagacccattgtgaacttaataccacttaaacaaaaagttatttaggggctctgctgaagtagctaattgtaacccgctaaatagcgctagatagaacataaagttcctaattcttgttttatctagataagcaaatttcatctttgcattttttaatttactttaaattactgcaaagctagaactcaggcgttcgcgccgtaggctgggttttagcttgctaagcttctgtgtgatcatttcaattttttgtctcttgacaataaactgacatgacataacagaaggagatgaaactttgcattcagccaaaaatctgtgacattaatttagaataagttagagaagttgccaagctacaatggcaactacgggaagcttattctcagaaaattaattttggctttatatttgcagatgtcggatcagcagtcctctccgcaagaggggccaggatcaaggcgaaagccgtggacctatgggcgtccatggacctaccacccaggttactggggtcctacggaaccctggaaggcaccttattatgagccttacggcccacaatggggacctcctcccagagttccaccccctaattacaattaccaatattatcagggtaatcaagctcagagcgctagtcatgggaagcctcaaacacagatcgctcctaagagctcagctcagtctgggcctaagaagcgaaaagtggctgaagttgctttggtgtcacagcctaaagcaggttcagcaaagacttccagccgtcctatcaagtctggcaagcaaaatcctccgccacaggctgtacaagtacaggctgcaaagaggatggagtcttttgccaaacttaatcggaaggctcaactttaccaagcagctatggaacgctttcggcgaagtctggtttacca

SEQ ID NO: 1248 - DNA, 4000 bp, Escherichia coli
  misc_feature (525)..(525): n is a, c, g, or t
  misc_feature (3909)..(3909): n is a, c, g, or t
actgtctcttttaggccgtgatcaaagcactacgtgcttcatcgagcatcgcccgaggttcacacagacattgtttgatgaatcgtgctttgaaactgcaccggtcgtcaccgttacaaaactgggcttggcgcaagaatggagtgtctctatcgccttccggctggcatggtcactgcaccaaagtccacttttagaggaagccattccatcattgaaagtcttcgatgaaggccaagatcttggtgttggactttcaaaactcaccgttttttcatggaatacttcctatgcacttgaattgaaaccccttgttttcgaggacctgaccttgccaattggctcaaccgaggggcatcatttctgggttcatcgcaacgatgtccttcacctgagtgttgaactcgttcacgccggaacaaacatcgcggcagaatacacgccgaatcaaatttccattgacatcgtgctttccgatggggaacggtccatttcatcgagcgtcacagtggaccagtctggcantggacaccaatccattcagctcaatgaaacgatcgttaagcacaacttgggcttcattgatgtgattgttgacaatgattttattcagcacgatgaacggtttaattttacaatcgatcggtattcacctcaactcactgtgcctccgggaacgttggccattgttgactctgacatgctgagcgctcaagacatcattgttatcctcagtgatcaagagggtctcggtcagcatccagtcacaatgcactggacctttttgcggctggggcaacccattgaaggcagtgaaggaagcgcagaagttcctctatccgcaggcactgggaccaccaacacttactcaggaacagtggatatgcgtccaaatggttcagttgcccttgaacgaactgaccggttatcggtttggttttcagcttcagatctcgcaggaagggatgtttccgggtttggaacgagcagtattccattatcacccgccttccgttgggtcgctttcgagccacggtttgacaacattgtcgtgactccttacaggccgattgttggggaaaacatctcaatttttgttcgagtggccaatgaaggtcttgtcaatgggagcgtgacagttcatcttgtagacgcagacggtcgaattttggaatcaaacacatctgaactcgtaccaggttcctgggcggaacacacatggagtctagaaccatggacgacagggcggttaggactgagtgttgttcttgttgatgtgacaggaaatattcctttaccaatgggtgaggttcaggctcaaccagattcgcgcaggggtggcctagacagccttggatttgcagtgctggtcgtcattcttgccgctggcgtcttggcctttagcgtataccgccgccaagaaaagatggcagactacacccgaaaacaggtggatgccgttctattcgctcagaatctccccccgccaaggcccaaagatcttgaccactttgatgaagagcaatagtcaagaacaggaggtccgagcgtgggacacaagccggggttcccgagcggtcaaagggggtggactcaagatcctctgcgtaaagcttcgcaggttcgaatcctgcccccggcactctcttctctaaacgtcacactgcgttggataatattcaacaatgagggtccttttacgagattcttttttcgaaacaaagactgccaattaacctgcttcagcgattcacaagggcgttttgatccccattgcccgtacgacacaccagcctgcgcgggcttcaaagattgagaaagcgcctcctgcgagagcaccaacagaagcaatccaccaaaatgaaccgcttattgttccacttgctacgacgccgagcaacaatgctcctccagcaacggcggctataccgcctgtgaggcgggctacttttcctttagcgtcaatgttgcattcgagtgccatgacaacaactcaatcctgtggatatatcaagggatgttttttcaaatgggcaagaaacccttacttttttgctaaaatcgcatcaacgagaggagtgaatgttgcaccatgcggatggggcgaaaccacgtctgcggcctccttgacttgttcaaaagcgccacccaccgcaaccgaccagtgggcgaattcaaacataggaagatcgtttggggcatcaccaacgcacaacacatcttcagcagcccagcccatcttttcgaacatgacctccaaaccggttccttttgacaagtgtggctccatgaggtgaattgcaaatccagtgcgaactacagacaaatgggaccattgacttccagcaatacattgttgaaccgcttcgaggtcttcatcaggaaacagacaccactcactttcccgccaagtgttggtttcaattcctgcaggatcaaggccttcgatttgggtcgagagccattctgccgccatcttggcttcttttccatcagctctcacaattggtcccccccaggctttgtgccacagaacaccaccgttttcgcagcatataggtccagagagtttgagaaacctccacaaaccgtaggtgatggctcgaacgtttcccgtcgctaaaacaacaggtattccagcgtcttctaacctccgtagcgctttgattgccccagtgtcgagttgtttatttccatcggtaagggttccatcaatgtcgacggccacgaccttaggacgccaaccttgggggagccactgcataaccttgcgaagaaggaagttggcgtaaagattggcgttcttcgtgaatatggctgagcatattgtaggtctcaaagggcaggcattatttgtgtagggcttaacccattcatatggtcgaaggggcggaagacgaattctttctctcccttgaggaagatgaacccgcagccaaggttgtgaaatcaaaaccaacccctcaaaaaaagaaaaaaccaaagaaaagcgctccaaaagcggaagtcgccccccccactcttacagccgaacttgtcgacacctctgtggtcgaacaagcgacggggacctacgaactcggctggccattgcttggaatggactgtcctgattgcgccagcaaggccacgcgggctttggacaccttacaccaagcgaacgacatccatgtctctgcaacagcagggacggtccgtttcaaaattgaccttgagtacggccatgtggccgaggtctcttccgttcttcgttcccttggtcacgcaccagacgttgattaccttgaattggcgggagcgaaagcaacaaccatcgctcgccgaaatggaatcgatcgccgaaaattaaccaaattgtttcgccaacagccgggtgttcttgatgtggaaatcagcgacgatgaccggattatcctccagttggctccagatgccacgcctgaattgtttgataagcgcaatcgggcattggaacatatatcgggaatgaaggtcaatctcgttccgactcaatccaatcgaattcgtcccgaccagtggcgtttgatcggtggaggcattgcattacctcttctcgcccttgtgattattggggagcttttaggatggcctcattatgttcttggtatcattgccttacctggtttgctgattggaggcatgcagatgttcaaagaagcattagcaagtcttgccaatcggcaaatgggattccaagtgctgacaagtcttgccgtcattggcgctgccatcttaggcatgtgggaagaagcgttgattgtcgctattttggtagcgttcaccgcccatctcgaaggggatgcgctcttgcaagcgcgcaaagctatgcaaggcggacttgaccgcttaccgcgcaaggctcgaaaactcacaggtgcttcaactccntcagtaacaggcattgaatcagccgtcaaagccggagcattttcgctcacaatggcggcccctgccccactcataggtgcagatggctgtg

SEQ ID NO: 1249 - DNA, 4000 bp, Escherichia coli
  misc_feature (1985)..(1985): n is a, c, g, or t
  misc_feature (1989)..(1989): n is a, c, g, or t
  misc_feature (2011)..(2011): n is a, c, g, or t
ctgcttatgggcaatggctatctgaaaacaacaaagggcccttaactgtcgtcactggtcgtgatgcccgcatttctggacctatggtacattccttggtcaatcaaactctactagggatgggaataaatgtgattgatttgggtctttctaccacaccaaccgttgctgttgctgttccctgggaaaaagctaatggtggcattatactaactgcaagtcacaatccaaaagaatggaacgcgttaaaactcttgaacgctgatggtgaatttattaatgcgactgcaggagctaaagttctagaatacgcagaaaaagaagctttcaattatgctgaagtggatcatttgggcacactcaaagaacgctcagattatattgaaaaacatattgaggctacgttggcaatagatcatgtaaatcttgagggaataagaaagcagaaatttaaagtagtagttgatggtgttaattcctctggaggtattgccattccagagctgttaaatgcgcttaacattgaagtagttaagatacattgcgaacccaacggacatttcccacacaacccggaacccttaaaagaaaacttaactgacttatgcaatgctgttattgagcacaagtcaaattttggaattgcagtagatcctgatgtagatcgtttggtgtttgttgatgagaaaggggagttgtttggagaagaatatacccttgtggcttgtgccgattatattttaagtaaaacccctggagctaccgtctcaaatctatcttcgacacgcgctttagccgatataacgcaaaaacatggatgtagctatactgccagtgctgtaggggaagtaaatgttgtcactgaaatgaaagcggttcaagccgttattggaggagaaggaaatggtggtattatttatcctcctctgcattatggaagggatgctttggtgggggttgttttgtttctatctcttttagtagaaagaaaagtaaccgtttctaaacttcgagctgcctacccaagttattttatgagtaaaaataaaattaaactgaaagagggcatggatgtagacctactgttagatcaaataagagagcgttatgcaaaagaacgtatatcaacaattgatggagtaaaaattgattttgatgcagcctgggtacatctacgaaaatcaaatacagagccgattattcgaatatacacagaggctaaatccgaactgaaagctgttgaattagcaaatcgatttgtaaaagaaattaacagtttgctttaagaattttttgcgtgcttaaaccttttatgagtccaaaaatattgagagggatcttcttttatttgagattctaaccactctgtataagtatcagttatggcgttaggtggcaattggttgggagtatctgtcaataatttaaattccacttcatagtatcctcgtttaattctattcatttttccaaaaacaacaggaatatcaaactctcttgccatccgttctgcaccagtataaacagggacatgaacccccatgaaagaacgccaataggctaggggttttgggcgtggggattgatcactggcaaaaccaaatacaccacgctcattattatcctccatctgttttatctttttcgaagcagttctttgtgagatcataaaagcatcgtgtctgcttcttatttttcggattaaatcatcaaaatatggattactaataggagtataaattccataacccttatgcttcatatgatatcctaaagacatcatccattcccaacttgcgtaatgaccgcacattagaaatacggaacgattttggctttcaaattgcgttagcacttctatgttttttacatgaaagcgttttatcatttcatctttagacattcccattgattttatgatttctaaaaacaaatcacataaatgggaataaaacttacgttcaataaacatcaattcagagtcngtanaagaaggaaaagctcgttttanatttgaacgaactactgattttctgtacccaaaaacacggtacaaaataaaacaaaccaaatcagacaacttataaaatagaggaaatggcaatcttgaaatcaagaaaagaatagggtaggctaaataatatattaatgcattcacagtattatttaattattgatcaaaattacttttttctatttaaatctgttgataaatacctttaaaaagaaattcatttcatttatatatataacaaaattgaatacttttgttatatatataacataataatcttaaactttaatttaatgaaaaatattttagtcctcggaatggggaaggtgggaagcctggtaggcgttttactaagcaggaattttgaagttacagcattagatcaaaaaaaaccacattatgattacaacttgccttttgaatgtatcgaaggcgatgtaaccgatataggattcatgaaaaatctaatgaaagattacgatgccgtagtttccgctttaccttactttttaaataaagaaatagccattttagcacatgaattagaattacattattttgatttaacggaagatgttcctaccactcattttattcaagccctcagtgaaacttcaaaaaaagtaatggctcctcaatgtggattagctccgggactgattggtattgtaggtaaagatttaacgtcaaattttgacacgttacgggatatagaattacgagtgggtgcgttaccccgctatcctaatggacagttagcttattcattcacatggtctccccatggtgttattaatgaatatttgaatgacgcagaagcaattcataatggacaaagaaaaaacgttccttcattagaagggtttgaatacatcaatattgaaggacaagaatttgaagcctttacaacctctggaggacttggaactctttgtgaaacttttgatggaaaagtagataccttaaactataaaaccattcgctatcctggtcatggaaaattaatgaagtttttgatgtacgagcttattttaaaagatgacaaagaacaattagaacaaatattgagtaatgccaaaccgcctgtagaagaagacgtggtatatgtatatgctgttgtagagggctggcaaaacaaaactctgtcacgtaaggaatattacaaagctttttaccctattgaaattgaaggtaaacaatggagagcaatatcctggactacggcagcatctctggttgcagttgttgaaatggtcgccgcagggacgctattacaaaaaggttttttgaaacaagaggaaattccatttgataaattcttaaaaactcaaacaggaagcttatttttatgacaaataatttacaatgaaatttaatacctcaacaacaatgacgaaaattttggacgcgctcttcactgtttattcagagcgtgtgccagatgtaaaaaaaatcacttctgagatggttaataaaggtatggttaaggatcaaagtgagatcatcaatgaccacattgcttttaggactatgggggttaaaaatttaggtattgcttcttttgaaaaaatatttttagcccatggttacgaaaagaaggattactttcattttgaggttaaaaaacttgatgcgcactggtatgcaccgcctacacctgatttacctaggatttttataagtgaacttaacgttagtttactctcaaataagactcaggaaattatcagaaaatataccgacaccgtaagttctgaccctgttgatcaactaaatttaaatgatgtagaagtagtttcaaaattctttcaaacccctctttggccattacctaacattgaagattacgaagccttactgactgagagtgagtatgctgcatgggttatttacaatcgatattatctaaaccattacaccatcagtgtccatgatcttcccgacgcttatgcaaaactggaaccgtttaatgactttttaaagtct

SEQ ID NO: 1250 - DNA, 4000 bp, Escherichia coli
  misc_feature (3549)..(3549): n is a, c, g, or t
  misc_feature (3579)..(3579): n is a, c, g, or t
  misc_feature (3789)..(3789): n is a, c, g, or t
  misc_feature (3826)..(3826): n is a, c, g, or t
  misc_feature (3910)..(3910): n is a, c, g, or t
cattggtattagcctctgcctcctctttgctctgaaaccggggagtgcccttgtaacacacctgggtgaattaggaatcatgcgaatcattacgatctatatcatcctaatccgtctgtgtgcatgctctcttgattgggcaaaatgaattagaattagtcaaatattaatccagacagctttatctcaaagccaactacttttgttcttatcctaaaattttcaagaaccttagaatctaactctccgatataaccaactgtctttttgttagcaacaatttctgcaactctgccttgagaaaaaagcgtatgctttgagagtgtcttcgtttcacacttgatgttaaaaccaattcgcaagagcgattgtaacactgccttcatttctgaaaagtttgtctcctccgaggcggtgacgcacgcaagacttgttgtttccttgattggtgaaccttttgaaaaagctatacctgactcgaaaaatttttggggatatgtttcatgtatgttttttgacaggttctccaacagaccaggcagtatagagtctctaaggattgtatgctcctgacttttcgaacttgtgacagaaattatctgtgacgaatccctgtttgtcatttcgtgtaaaattcgttggcttgttaacgtgtaatttagagtttccataaaaccaaaaccagtcattagtctgctaatggagtcaagtttctcagacgttgcatttttctcaccaatgtgcacagatgctggccatgctggttttagattatcaattccataacccagtgcaacctcctcaacaatgtccattccaccaaagatatcaaacctgtatcttggaattgtacactgtatttttttgcctttcattactgcatccagcctgcattttttgagacacgatacaagcatcgagccggagatgctcagtccaagaattttattcacagggtcggcatcaaacgcaatggttcttgtcgcaaagcttggcgtcgagttcttcgagccagaaactttcatctgtgagaattggaatcctgcgccttggagtatcataacaacaactgataacatatcctcagctgactgcttgtctatgccagtgacttcgactagaatgtttttggtttttgttgttaccgttgtcaacgaagcgttgatgattggaggaaatgatattgtttgtccctttgcatcaataattataggaaccttggtagattgtccaagtattgatccatagtcccttccaacttctgaatcctgaagaatttctgagattgagctctctttagtagagtttaacggaacaaacctatggtcacgagaagttgttgtatacttgagcgggaatgatattctgtctaggtcatgaattccaattgatgatttttttctcttcctacctaatccaaaatgcaaatcctcctgcatgttaataatctgcttaactgcttcatcgtcaagcgagccatttcttgcaattatcccggtaacaaacggcctaatcttgctcgttgaactgtcaaccttgatttcataatttcccttctttcttatgttcaatcgtagcattcccttgcttactcccaagatgccttgtaatcctaatgcaatgccaaagtcagtggaatagtctggtctgttgggactgtattcaactcttacaatgttgcgtcccaacgattctatatcaagaccaagaaatggcaggctgtcaagtatttgcttcttgtttgtattttttcctataagtttctgaagcctgctaagactcagctcaactactggcatttcgtagcagtcctcaaccaacttagattgttattgtaaaattcccttacgtcgtctaatccaaattttaacattgcaattctttcaatgccaccaccccaagctagaacgggttttgtaattcccaatggttttgtaacttctggtctaaatattcccatgccaaagagttcaatccattttccaagcttctcattgtaaaccatagattgcaacgagggctcagtataaggaaaaaatgtaggccaaaactttactttagtgagaccaatcttgcgataaaattccttttgtattcccatcaagtctcgtagtgttatgtgctttcctacaaccacgccctcaacctgattgaattcagctaaatgcttgaaacttaatttttcattgcggaaaactcgtcccaatgaaaatatcctagcctcatctggttttttgtctgcaagatgttttatggtaacacaagtagtatgtgttcgcaggaccattttttttgcttcctgtatatcccaatagtatctccacccctttttgtgggcatttgatacattcttaatttgagttggtgttgcaagctgttttgcattaagatctttaagataaaatgtgtcttgtagttctcgagcaggatgatcctgtggagtaaataatgcatcgaagttccaaaaacttgactgtgacaagtttccagtaatttctgtgaatcctagatggacaaaagtatccctgatctcatttattgtgtcctttagtggatgtatccttgcggcatgtacatgaggtacgtcagcctcaacatcgattgctccactatctaatttttcaagatcaatatgtttaccagtttcagaaagagagactgtttttgtcttttcttcgtgcttaattatgaagtctggcctttctatcagggagttgattgttccggtatagtgcagacgttctgcctcttcagcagagacttttttttcgccaataaaatcgattgtatttgggaaagtattccaagtagaatttcctataggattttgctttaatgaaatctttgatccagtgtccgttttttctatatttatccagtcattcttttttgcattggcaattgccgcgttaaagtcaagtccatgcaaactgcttcgtatctcatcaaatgtttttggaccatcctgaacaagtgtcacaagtcttcgttcaggtaagccatttttcagagaatctaagccattttttccaaggctgtaagaaatgttagtagtgtcagttacatctgcaagttttttctgacgaagccactctactccacgcctaatttgatccattgagagtgtagctttctgggataactgttcctcagtcaaatttggagttgactgcaaaagcttgacaatttgtttttcaatgtcatgtagaacatgggacaatagttcatcattccaaaaagacttaattaaattagtaggacaattgttgcagtttttttgattagaaagtgatcataagaatgagataagactttttaacattaaatcaaagtcaactttgaatgccagcggatgattttgttgtcacaccttggaacgttgagggtgatattgattatgacaaattgatcaaaagatttgggacacaaaaaatcactccagctcttttatcaaaaattgaaaaattcaccaacgaatcacatttcatgctaagaaggggaatttttttctcacatagagatttgaacaggcttttggatgactatganaaaggcaagcaattctttctatacactggnagagggccttctggtcatacgcatattggccatctagtcccatgggtttttgcaaaatggcttcaagacaagtttggagcaaaaatgtattttcagcttacagatgacgaaaaattttggtcaaaaaaagacatgacgttagaaaaaacatcccagtttgcgcttgaaaacgcacttgatttcatagcattgggtttcaagccagaaaanactaaaatcattattgatacaaaaaacataaagacgntatatccaattgcggcagaagttgcaaagagaataaatttttcaaatacaaaagcagtttttggatttgaaaatgaaactaatnttggaatgatattttacacttccttacaatctgctccatgctttatagaagatatgcctgttttgattccgtttggagttgatcaagatc

SEQ ID NO: 1251 - DNA, 4000 bp, Escherichia coli
  misc_feature (1)..(1): n is a, c, g, or t
  misc_feature (3)..(4): n is a, c, g, or t
  misc_feature (9)..(9): n is a, c, g, or t
  misc_feature (11)..(12): n is a, c, g, or t
  misc_feature (15)..(16): n is a, c, g, or t
  misc_feature (20)..(22): n is a, c, g, or t
  misc_feature (24)..(28): n is a, c, g, or t
  misc_feature (33)..(35): n is a, c, g, or t
  misc_feature (37)..(41): n is a, c, g, or t
  misc_feature (43)..(43): n is a, c, g, or t
  misc_feature (45)..(52): n is a, c, g, or t
  misc_feature (54)..(57): n is a, c, g, or t
  misc_feature (59)..(59): n is a, c, g, or t
  misc_feature (61)..(64): n is a, c, g, or t
  misc_feature (66)..(74): n is a, c, g, or t
  misc_feature (76)..(76): n is a, c, g, or t
  misc_feature (79)..(79): n is a, c, g, or t
  misc_feature (82)..(82): n is a, c, g, or t
  misc_feature (84)..(90): n is a, c, g, or t
  misc_feature (94)..(95): n is a, c, g, or t
  misc_feature (98)..(100): n is a, c, g, or t
  misc_feature (103)..(106): n is a, c, g, or t
  misc_feature (108)..(109): n is a, c, g, or t
  misc_feature (111)..(111): n is a, c, g, or t
  misc_feature (116)..(116): n is a, c, g, or t
  misc_feature (118)..(119): n is a, c, g, or t
  misc_feature (121)..(123): n is a, c, g, or t
  misc_feature (125)..(125): n is a, c, g, or t
  misc_feature (127)..(127): n is a, c, g, or t
  misc_feature (129)..(129): n is a, c, g, or t
  misc_feature (131)..(136): n is a, c, g, or t
  misc_feature (138)..(139): n is a, c, g, or t
  misc_feature (141)..(141): n is a, c, g, or t
  misc_feature (144)..(151): n is a, c, g, or t
  misc_feature (157)..(157): n is a, c, g, or t
  misc_feature (159)..(159): n is a, c, g, or t
  misc_feature (162)..(165): n is a, c, g, or t
  misc_feature (168)..(169): n is a, c, g, or t
  misc_feature (171)..(172): n is a, c, g, or t
  misc_feature (177)..(177): n is a, c, g, or t
  misc_feature (179)..(181): n is a, c, g, or t
  misc_feature (185)..(186): n is a, c, g, or t
  misc_feature (189)..(194): n is a, c, g, or t
  misc_feature (196)..(196): n is a, c, g, or t
  misc_feature (198)..(198): n is a, c, g, or t
  misc_feature (201)..(204): n is a, c, g, or t
  misc_feature (206)..(212): n is a, c, g, or t
  misc_feature (214)..(217): n is a, c, g, or t
  misc_feature (219)..(220): n is a, c, g, or t
  misc_feature (222)..(231): n is a, c, g, or t
  misc_feature (234)..(242): n is a, c, g, or t
  misc_feature (244)..(244): n is a, c, g, or t
  misc_feature (247)..(251): n is a, c, g, or t
  misc_feature (253)..(256): n is a, c, g, or t
  misc_feature (260)..(262): n is a, c, g, or t
  misc_feature (265)..(265): n is a, c, g, or t
  misc_feature (268)..(271): n is a, c, g, or t
  misc_feature (273)..(274): n is a, c, g, or t
  misc_feature (276)..(277): n is a, c, g, or t
  misc_feature (280)..(282): n is a, c, g, or t
  misc_feature (284)..(284): n is a, c, g, or t
  misc_feature (286)..(286): n is a, c, g, or t
  misc_feature (288)..(288): n is a, c, g, or t
  misc_feature (292)..(294): n is a, c, g, or t
  misc_feature (299)..(299): n is a, c, g, or t
  misc_feature (302)..(302): n is a, c, g, or t
  misc_feature (306)..(309): n is a, c, g, or t
  misc_feature (312)..(312): n is a, c, g, or t
  misc_feature (314)..(317): n is a, c, g, or t
  misc_feature (320)..(321): n is a, c, g, or t
  misc_feature (323)..(323): n is a, c, g, or t
  misc_feature (325)..(325): n is a, c, g, or t
  misc_feature (329)..(329): n is a, c, g, or t
  misc_feature (334)..(335): n is a, c, g, or t
  misc_feature (337)..(341): n is a, c, g, or t
  misc_feature (343)..(344): n is a, c, g, or t
  misc_feature (349)..(350): n is a, c, g, or t
  misc_feature (354)..(355): n is a, c, g, or t
  misc_feature (357)..(365): n is a, c, g, or t
  misc_feature (367)..(369): n is a, c, g, or t
  misc_feature (371)..(372): n is a, c, g, or t
  misc_feature (375)..(375): n is a, c, g, or t
  misc_feature (377)..(378): n is a, c, g, or t
  misc_feature (380)..(385): n is a, c, g, or t
  misc_feature (388)..(390): n is a, c, g, or t
  misc_feature (392)..(393): n is a, c, g, or t
  misc_feature (396)..(398): n is a, c, g, or t
  misc_feature (400)..(400): n is a, c, g, or t
  misc_feature (402)..(403): n is a, c, g, or t
  misc_feature (405)..(407): n is a, c, g, or t
  misc_feature (409)..(409): n is a, c, g, or t
  misc_feature (411)..(413): n is a, c, g, or t
  misc_feature (415)..(416): n is a, c, g, or t
  misc_feature (419)..(421): n is a, c, g, or t
  misc_feature (423)..(424): n is a, c, g, or t
  misc_feature (426)..(430): n is a, c, g, or t
  misc_feature (432)..(432): n is a, c, g, or t
  misc_feature (434)..(434): n is a, c, g, or t
  misc_feature (439)..(439): n is a, c, g, or t
  misc_feature (441)..(445): n is a, c, g, or t
  misc_feature (448)..(448): n is a, c, g, or t
  misc_feature (450)..(455): n is a, c, g, or t
  misc_feature (457)..(461): n is a, c, g, or t
  misc_feature (463)..(469): n is a, c, g, or t
  misc_feature (471)..(477): n is a, c, g, or t
  misc_feature (479)..(481): n is a, c, g, or t
  misc_feature (483)..(484): n is a, c, g, or t
  misc_feature (486)..(486): n is a, c, g, or t
  misc_feature (488)..(490): n is a, c, g, or t
  misc_feature (492)..(492): n is a, c, g, or t
  misc_feature (494)..(499): n is a, c, g, or t
  misc_feature (501)..(502): n is a, c, g, or t
  misc_feature (504)..(508): n is a, c, g, or t
  misc_feature (510)..(521): n is a, c, g, or t
  misc_feature (524)..(530): n is a, c, g, or t
  misc_feature (532)..(532): n is a, c, g, or t
  misc_feature (535)..(536): n is a, c, g, or t
  misc_feature (538)..(539): n is a, c, g, or t
  misc_feature (541)..(541): n is a, c, g, or t
  misc_feature (543)..(547): n is a, c, g, or t
  misc_feature (550)..(553): n is a, c, g, or t
  misc_feature (555)..(558): n is a, c, g, or t
  misc_feature (560)..(562): n is a, c, g, or t
  misc_feature (564)..(564): n is a, c, g, or t
  misc_feature (566)..(568): n is a, c, g, or t
  misc_feature (571)..(571): n is a, c, g, or t
  misc_feature (573)..(573): n is a, c, g, or t
  misc_feature (576)..(585): n is a, c, g, or t
  misc_feature (587)..(588): n is a, c, g, or t
  misc_feature (590)..(593): n is a, c, g, or t
  misc_feature (595)..(595): n is a, c, g, or t
  misc_feature (597)..(604): n is a, c, g, or t
  misc_feature (606)..(606): n is a, c, g, or t
  misc_feature (609)..(613): n is a, c, g, or t
  misc_feature (615)..(615): n is a, c, g, or t
  misc_feature (617)..(618): n is a, c, g, or t
  misc_feature (621)..(622): n is a, c, g, or t
  misc_feature (625)..(625): n is a, c, g, or t
  misc_feature (627)..(627): n is a, c, g, or t
  misc_feature (632)..(637): n is a, c, g, or t
  misc_feature (639)..(640): n is a, c, g, or t
  misc_feature (643)..(649): n is a, c, g, or t
  misc_feature (651)..(653): n is a, c, g, or t
  misc_feature (657)..(664): n is a, c, g, or t
  misc_feature (666)..(673): n is a, c, g, or t
  misc_feature (675)..(676): n is a, c, g, or t
  misc_feature (678)..(679): n is a, c, g, or t
  misc_feature (681)..(687): n is a, c, g, or t
  misc_feature (690)..(695): n is a, c, g, or t
  misc_feature (697)..(698): n is a, c, g, or t
  misc_feature (701)..(701): n is a, c, g, or t
  misc_feature (705)..(706): n is a, c, g, or t
  misc_feature (708)..(712): n is a, c, g, or t
  misc_feature (714)..(726): n is a, c, g, or t
  misc_feature (728)..(730): n is a, c, g, or t
  misc_feature (732)..(733): n is a, c, g, or t
  misc_feature (735)..(735): n is a, c, g, or t
  misc_feature (737)..(738): n is a, c, g, or t
  misc_feature (740)..(748): n is a, c, g, or t
  misc_feature (751)..(755): n is a, c, g, or t
  misc_feature (757)..(757): n is a, c, g, or t
  misc_feature (760)..(763): n is a, c, g, or t
  misc_feature (765)..(772): n is a, c, g, or t
  misc_feature (774)..(775): n is a, c, g, or t
  misc_feature (777)..(782): n is a, c, g, or t
  misc_feature (784)..(788): n is a, c, g, or t
  misc_feature (791)..(792): n is a, c, g, or t
  misc_feature (794)..(801): n is a, c, g, or t
  misc_feature (803)..(815): n is a, c, g, or t
  misc_feature (818)..(819): n is a, c, g, or t
  misc_feature (821)..(821): n is a, c, g, or t
  misc_feature (823)..(823): n is a, c, g, or t
  misc_feature (825)..(841): n is a, c, g, or t
  misc_feature (843)..(843): n is a, c, g, or t
  misc_feature (846)..(850): n is a, c, g, or t
  misc_feature (856)..(856): n is a, c, g, or t
  misc_feature (860)..(865): n is a, c, g, or t
  misc_feature (867)..(867): n is a, c, g, or t
  misc_feature (869)..(870): n is a, c, g, or t
  misc_feature (873)..(874): n is a, c, g, or t
  misc_feature (876)..(880): n is a, c, g, or t
  misc_feature (882)..(883): n is a, c, g, or t
  misc_feature (885)..(891): n is a, c, g, or t
  misc_feature (893)..(893): n is a, c, g, or t
  misc_feature (895)..(898): n is a, c, g, or t
  misc_feature (900)..(903): n is a, c, g, or t
  misc_feature (906)..(908): n is a, c, g, or t
  misc_feature (910)..(911): n is a, c, g, or t
  misc_feature (913)..(917): n is a, c, g, or t
  misc_feature (921)..(927): n is a, c, g, or t
  misc_feature (930)..(931): n is a, c, g, or t
  misc_feature (933)..(933): n is a, c, g, or t
  misc_feature (935)..(937): n is a, c, g, or t
  misc_feature (939)..(939): n is a, c, g, or t
  misc_feature (942)..(943): n is a, c, g, or t
  misc_feature (947)..(954): n is a, c, g, or t
  misc_feature (956)..(957): n is a, c, g, or t
  misc_feature (960)..(960): n is a, c, g, or t
  misc_feature (963)..(967): n is a, c, g, or t
  misc_feature (971)..(976): n is a, c, g, or t
  misc_feature (979)..(979): n is a, c, g, or t
  misc_feature (982)..(987): n is a, c, g, or t
  misc_feature (989)..(992): n is a, c, g, or t
  misc_feature (995)..(995): n is a, c, g, or t
  misc_feature (997)..(997): n is a, c, g, or t
  misc_feature (999)..(999): n is a, c, g, or t
  misc_feature (1002)..(1003): n is a, c, g, or t
  misc_feature (1005)..(1006): n is a, c, g, or t
  misc_feature (1009)..(1019): n is a, c, g, or t
  misc_feature (1021)..(1027): n is a, c, g, or t
  misc_feature (1029)..(1029): n is a, c, g, or t
  misc_feature (1031)..(1032): n is a, c, g, or t
  misc_feature (1034)..(1035): n is a, c, g, or t
  misc_feature (1037)..(1037): n is a, c, g, or t
  misc_feature (1039)..(1040): n is a, c, g, or t
  misc_feature (1043)..(1046): n is a, c, g, or t
  misc_feature (1048)..(1048): n is a, c, g, or t
  misc_feature (1051)..(1053): n is a, c, g, or t
  misc_feature (1055)..(1060): n is a, c, g, or t
  misc_feature (1063)..(1073): n is a, c, g, or t
  misc_feature (1075)..(1085): n is a, c, g, or t
  misc_feature (1087)..(1087): n is a, c, g, or t
  misc_feature (1089)..(1091): n is a, c, g, or t
  misc_feature (1093)..(1096): n is a, c, g, or t
  misc_feature (1098)..(1103): n is a, c, g, or t
  misc_feature (1105)..(1111): n is a, c, g, or t
  misc_feature (1113)..(1121): n is a, c, g, or t
  misc_feature (1123)..(1125): n is a, c, g, or t
  misc_feature (1128)..(1133): n is a, c, g, or t
  misc_feature (1135)..(1138): n is a, c, g, or t
  misc_feature (1140)..(1143): n is a, c, g, or t
  misc_feature (1146)..(1148): n is a, c, g, or t
  misc_feature (1150)..(1155): n is a, c, g, or t
  misc_feature (1158)..(1159): n is a, c, g, or t
  misc_feature (1161)..(1161): n is a, c, g, or t
  misc_feature (1163)..(1175): n is a, c, g, or t
  misc_feature (1177)..(1178): n is a, c, g, or t
  misc_feature (1180)..(1181): n is a, c, g, or t
  misc_feature (1183)..(1184): n is a, c, g, or t
  misc_feature (1186)..(1189): n is a, c, g, or t
  misc_feature (1191)..(1192): n is a, c, g, or t
  misc_feature (1196)..(1196): n is a, c, g, or t
  misc_feature (1198)..(1201): n is a, c, g, or t
  misc_feature (1203)..(1205): n is a, c, g, or t
  misc_feature (1207)..(1208): n is a, c, g, or t
  misc_feature (1210)..(1219): n is a, c, g, or t
  misc_feature (1221)..(1224): n is a, c, g, or t
  misc_feature (1229)..(1237): n is a, c, g, or t
  misc_feature (1239)..(1247): n is a, c, g, or t
  misc_feature (1249)..(1268): n is a, c, g, or t
  misc_feature (1270)..(1270): n is a, c, g, or t
  misc_feature (1273)..(1276): n is a, c, g, or t
  misc_feature (1278)..(1284): n is a, c, g, or t
  misc_feature (1286)..(1286): n is a, c, g, or t
  misc_feature (1289)..(1298): n is a, c, g, or t
  misc_feature (1300)..(1300): n is a, c, g, or t
  misc_feature (1303)..(1312): n is a, c, g, or t
  misc_feature (1314)..(1314): n is a, c, g, or t
  misc_feature (1316)..(1322): n is a, c, g, or t
  misc_feature (1324)..(1325): n is a, c, g, or t
  misc_feature (1327)..(1331): n is a, c, g, or t
  misc_feature (1334)..(1336): n is a, c, g, or t
  misc_feature (1339)..(1346): n is a, c, g, or t
  misc_feature (1350)..(1366): n is a, c, g, or t
  misc_feature (1369)..(1370): n is a, c, g, or t
  misc_feature (1372)..(1382): n is a, c, g, or t
  misc_feature (1384)..(1388): n is a, c, g, or t
  misc_feature (1390)..(1390): n is a, c, g, or t
  misc_feature (1393)..(1393): n is a, c, g, or t
  misc_feature (1395)..(1395): n is a, c, g, or t
  misc_feature (1398)..(1400): n is a, c, g, or t
  misc_feature (1403)..(1408): n is a, c, g, or t
  misc_feature (1411)..(1411): n is a, c, g, or t
  misc_feature (1413)..(1413): n is a, c, g, or t
  misc_feature (1416)..(1422): n is a, c, g, or t
  misc_feature (1424)..(1424): n is a, c, g, or t
  misc_feature (1426)..(1430): n is a, c, g, or t
  misc_feature (1432)..(1438): n is a, c, g, or t
  misc_feature (1440)..(1440): n is a, c, g, or t
  misc_feature (1442)..(1442): n is a, c, g, or t
  misc_feature (1444)..(1444): n is a, c, g, or t
  misc_feature (1446)..(1449): n is a, c, g, or t
  misc_feature (1452)..(1453): n is a, c, g, or t
  misc_feature (1455)..(1455): n is a, c, g, or t
  misc_feature (1459)..(1459): n is a, c, g, or t
  misc_feature (1463)..(1470): n is a, c, g, or t
  misc_feature (1472)..(1472): n is a, c, g, or t
  misc_feature (1474)..(1474): n is a, c, g, or t
  misc_feature (1476)..(1477): n is a, c, g, or t
  misc_feature (1480)..(1485): n is a, c, g, or t
  misc_feature (1487)..(1487): n is a, c, g, or t
  misc_feature (1490)..(1491): n is a, c, g, or t
  misc_feature (1493)..(1495): n is a, c, g, or t
  misc_feature (1498)..(1498): n is a, c, g, or t
  misc_feature (1501)..(1503): n is a, c, g, or t
  misc_feature (1505)..(1506): n is a, c, g, or t
  misc_feature (1509)..(1509): n is a, c, g, or t
  misc_feature (1511)..(1512): n is a, c, g, or t
  misc_feature (1514)..(1514): n is a, c, g, or t
  misc_feature (1517)..(1522): n is a, c, g, or t
  misc_feature (1524)..(1528): n is a, c, g, or t
  misc_feature (1531)..(1531): n is a, c, g, or t
  misc_feature (1534)..(1543): n is a, c, g, or t
  misc_feature (1545)..(1549): n is a, c, g, or t
  misc_feature (1552)..(1555): n is a, c, g, or t
  misc_feature (1557)..(1558): n is a, c, g, or t
  misc_feature (1560)..(1561): n is a, c, g, or t
  misc_feature (1564)..(1565): n is a, c, g, or t
  misc_feature (1568)..(1568): n is a, c, g, or t
  misc_feature (1570)..(1572): n is a, c, g, or t
  misc_feature (1575)..(1575): n is a, c, g, or t
  misc_feature (1577)..(1580): n is a, c, g, or t
  misc_feature (1582)..(1587): n is a, c, g, or t
  misc_feature (1589)..(1591): n is a, c, g, or t
  misc_feature (1593)..(1593): n is a, c, g, or t
  misc_feature (1597)..(1598): n is a, c, g, or t
  misc_feature (1600)..(1600): n is a, c, g, or t
  misc_feature (1603)..(1603): n is a, c, g, or t
  misc_feature (1605)..(1615): n is a, c, g, or t
  misc_feature (1617)..(1617): n is a, c, g, or t
  misc_feature (1619)..(1619): n is a, c, g, or t
  misc_feature (1621)..(1623): n is a, c, g, or t
  misc_feature (1625)..(1625): n is a, c, g, or t
  misc_feature (1627)..(1629): n is a, c, g, or t
  misc_feature (1631)..(1631): n is a, c, g, or t
  misc_feature (1633)..(1638): n is a, c, g, or t
  misc_feature (1644)..(1650): n is a, c, g, or t
  misc_feature (1652)..(1652): n is a, c, g, or t
  misc_feature (1655)..(1655): n is a, c, g, or t
  misc_feature (1658)..(1661): n is a, c, g, or t
  misc_feature (1663)..(1669): n is a, c, g, or t
  misc_feature (1671)..(1672): n is a, c, g, or t
  misc_feature (1674)..(1674): n is a, c, g, or t
  misc_feature (1677)..(1677): n is a, c, g, or t
  misc_feature (1679)..(1681): n is a, c, g, or t
  misc_feature (1683)..(1687): n is a, c, g, or t
  misc_feature (1690)..(1696): n is a, c, g, or t
  misc_feature (1699)..(1701): n is a, c, g, or t
  misc_feature (1707)..(1710): n is a, c, g, or t
  misc_feature (1717)..(1720): n is a, c, g, or t
  misc_feature (1723)..(1730): n is a, c, g, or t
  misc_feature (1733)..(1738): n is a, c, g, or t
  misc_feature (1742)..(1744): n is a, c, g, or t
  misc_feature (1747)..(1755): n is a, c, g, or t
  misc_feature (1758)..(1758): n is a, c, g, or t
  misc_feature (1761)..(1762): n is a, c, g, or t
  misc_feature (1765)..(1768): n is a, c, g, or t
  misc_feature (1834)..(1835): n is a, c, g, or t
  misc_feature (1839)..(1839): n is a, c, g, or t
  misc_feature (1865)..(1865): n is a, c, g, or t
  misc_feature (1987)..(1987): n is a, c, g, or t
  misc_feature (2008)..(2008): n is a, c, g, or t
  misc_feature (3035)..(3035): n is a, c, g, or t
  misc_feature (3037)..(3043): n is a, c, g, or t
  misc_feature (3046)..(3047): n is a, c, g, or t
  misc_feature (3053)..(3055): n is a, c, g, or t
  misc_feature (3057)..(3063): n is a, c, g, or t
  misc_feature (3065)..(3076): n is a, c, g, or t
  misc_feature (3079)..(3080): n is a, c, g, or t
  misc_feature (3082)..(3084): n is a, c, g, or t
  misc_feature (3086)..(3088): n is a, c, g, or t
  misc_feature (3090)..(3093): n is a, c, g, or t
  misc_feature (3095)..(3095): n is a, c, g, or t
  misc_feature (3097)..(3099): n is a, c, g, or t
  misc_feature (3101)..(3101): n is a, c, g, or t
  misc_feature (3103)..(3109): n is a, c, g, or t
  misc_feature (3112)..(3118): n is a, c, g, or t
  misc_feature (3120)..(3121): n is a, c, g, or t
  misc_feature (3124)..(3128): n is a, c, g, or t
  misc_feature (3130)..(3130): n is a, c, g, or t
  misc_feature (3132)..(3133): n is a, c, g, or t
  misc_feature (3136)..(3137): n is a, c, g, or t
  misc_feature (3142)..(3142): n is a, c, g, or t
  misc_feature (3144)..(3150): n is a, c, g, or t
  misc_feature (3153)..(3153): n is a, c, g, or t
  misc_feature (3156)..(3157): n is a, c, g, or t
  misc_feature (3159)..(3163): n is a, c, g, or t
  misc_feature (3165)..(3166): n is a, c, g, or t
  misc_feature (3168)..(3175): n is a, c, g, or t
  misc_feature (3177)..(3178): n is a, c, g, or t
  misc_feature (3180)..(3186): n is a, c, g, or t
  misc_feature (3189)..(3189): n is a, c, g, or t
  misc_feature (3191)..(3192): n is a, c, g, or t
  misc_feature (3194)..(3196): n is a, c, g, or t
  misc_feature (3198)..(3198): n is a, c, g, or t
  misc_feature (3200)..(3202): n is a, c, g, or t
  misc_feature (3205)..(3207): n is a, c, g, or t
  misc_feature (3209)..(3212): n is a, c, g, or t
  misc_feature (3214)..(3214): n is a, c, g, or t
  misc_feature (3216)..(3216): n is a, c, g, or t
  misc_feature (3220)..(3229): n is a, c, g, or t
  misc_feature (3231)..(3231): n is a, c, g, or t
  misc_feature (3235)..(3235): n is a, c, g, or t
  misc_feature (3238)..(3238): n is a, c, g, or t
  misc_feature (3240)..(3241): n is a, c, g, or t
  misc_feature (3243)..(3243): n is a, c, g, or t
  misc_feature (3245)..(3245): n is a, c, g, or t
  misc_feature (3248)..(3250): n is a, c, g, or t
  misc_feature (3252)..(3253): n is a, c, g, or t
  misc_feature (3257)..(3259): n is a, c, g, or t
  misc_feature (3261)..(3261): n is a, c, g, or t
  misc_feature (3263)..(3267): n is a, c, g, or t
  misc_feature (3269)..(3271): n is a, c, g, or t
  misc_feature (3273)..(3274): n is a, c, g, or t
  misc_feature (3276)..(3278): n is a, c, g, or t
  misc_feature (3282)..(3283): n is a, c, g, or t
  misc_feature (3288)..(3288): n is a, c, g, or t
  misc_feature (3291)..(3291): n is a, c, g, or t
  misc_feature (3294)..(3294): n is a, c, g, or t
  misc_feature (3296)..(3300): n is a, c, g, or t
  misc_feature (3302)..(3303): n is a, c, g, or t
  misc_feature (3305)..(3305): n is a, c, g, or t
  misc_feature (3308)..(3308): n is a, c, g, or t
  misc_feature (3310)..(3310): n is a, c, g, or t
  misc_feature (3313)..(3316): n is a, c, g, or t
  misc_feature (3318)..(3321): n is a, c, g, or t
  misc_feature (3324)..(3325): n is a, c, g, or t
  misc_feature (3327)..(3328): n is a, c, g, or t
  misc_feature (3331)..(3334): n is a, c, g, or t
  misc_feature (3336)..(3337): n is a, c, g, or t
  misc_feature (3339)..(3340): n is a, c, g, or t
  misc_feature (3346)..(3352): n is a, c, g, or t
  misc_feature (3354)..(3355): n is a, c, g, or t
  misc_feature (3357)..(3360): n is a, c, g, or t
  misc_feature (3364)..(3365): n is a, c, g, or t
  misc_feature (3367)..(3371): n is a, c, g, or t
  misc_feature (3373)..(3374): n is a, c, g, or t
  misc_feature (3376)..(3377): n is a, c, g, or t
  misc_feature (3379)..(3380): n is a, c, g, or t
  misc_feature (3384)..(3384): n is a, c, g, or t
  misc_feature (3386)..(3390): n is a, c, g, or t
  misc_feature (3395)..(3395): n is a, c, g, or t
  misc_feature (3398)..(3398): n is a, c, g, or t
  misc_feature (3400)..(3401): n is a, c, g, or t
  misc_feature (3403)..(3404): n is a, c, g, or t
  misc_feature (3406)..(3408): n is a, c, g, or t
  misc_feature (3410)..(3410): n is a, c, g, or t
  misc_feature (3412)..(3419): n is a, c, g, or t
  misc_feature (3421)..(3421): n is a, c, g, or t
  misc_feature (3425)..(3425): n is a, c, g, or t
  misc_feature (3427)..(3427): n is a, c, g, or t
  misc_feature (3430)..(3432): n is a, c, g, or t
  misc_feature (3435)..(3435): n is a, c, g, or t
  misc_feature (3438)..(3438): n is a, c, g, or t
  misc_feature (3440)..(3440): n is a, c, g, or t
  misc_feature (3442)..(3443): n is a, c, g, or t
  misc_feature (3447)..(3450): n is a, c, g, or t
  misc_feature (3453)..(3454): n is a, c, g, or t
  misc_feature (3456)..(3461): n is a, c, g, or t
  misc_feature (3466)..(3469): n is a, c, g, or t
  misc_feature (3471)..(3473): n is a, c, g, or t
  misc_feature (3475)..(3475): n is a, c, g, or t
  misc_feature (3480)..(3484): n is a, c, g, or t
  misc_feature (3489)..(3489): n is a, c, g, or t
  misc_feature (3493)..(3493): n is a, c, g, or t
  misc_feature (3496)..(3498): n is a, c, g, or t
  misc_feature (3502)..(3504): n is a, c, g, or t
  misc_feature (3506)..(3506): n is a, c, g, or t
  misc_feature (3509)..(3509): n is a, c, g, or t
  misc_feature (3513)..(3514): n is a, c, g, or t
  misc_feature (3517)..(3517): n is a, c, g, or t
  misc_feature (3521)..(3522): n is a, c, g, or t
  misc_feature (3525)..(3528): n is a, c, g, or t
  misc_feature (3537)..(3538): n is a, c, g, or t
  misc_feature (3540)..(3540): n is a, c, g, or t
  misc_feature (3542)..(3542): n is a, c, g, or t
  misc_feature (3544)..(3544): n is a, c, g, or t
  misc_feature (3546)..(3547): n is a, c, g, or t
  misc_feature (3549)..(3549): n is a, c, g, or t
  misc_feature (3552)..(3552): n is a, c, g, or t
  misc_feature (3554)..(3555): n is a, c, g, or t
  misc_feature (3557)..(3558): n is a, c, g, or t
  misc_feature (3563)..(3569): n is a, c, g, or t
  misc_feature (3573)..(3574): n is a, c, g, or t
  misc_feature (3578)..(3583): n is a, c, g, or t
  misc_feature (3586)..(3588): n is a, c, g, or t
  misc_feature (3590)..(3592): n is a, c, g, or t
  misc_feature (3594)..(3595): n is a, c, g, or t
  misc_feature (3601)..(3609): n is a, c, g, or t
  misc_feature (3612)..(3614): n is a, c, g, or t
  misc_feature (3616)..(3623): n is a, c, g, or t
  misc_feature (3626)..(3627): n is a, c, g, or t
  misc_feature (3629)..(3632): n is a, c, g, or t
  misc_feature (3634)..(3637): n is a, c, g, or t
  misc_feature (3639)..(3641): n is a, c, g, or t
  misc_feature (3643)..(3643): n is a, c, g, or t
  misc_feature (3645)..(3645): n is a, c, g, or t
  misc_feature (3647)..(3648): n is a, c, g, or t
  misc_feature (3651)..(3653): n is a, c, g, or t
  misc_feature (3655)..(3656): n is a, c, g, or t
  misc_feature (3658)..(3658): n is a, c, g, or t
  misc_feature (3660)..(3660): n is a, c, g, or t
  misc_feature (3663)..(3665): n is a, c, g, or t
  misc_feature (3669)..(3671): n is a, c, g, or t
  misc_feature (3674)..(3678): n is a, c, g, or t
  misc_feature (3680)..(3682): n is a, c, g, or t
  misc_feature (3684)..(3684): n is a, c, g, or t
  misc_feature (3686)..(3690): n is a, c, g, or t
  misc_feature (3692)..(3695): n is a, c, g, or t
  misc_feature (3698)..(3700): n is a, c, g, or t
  misc_feature (3702)..(3702): n is a, c, g, or t
  misc_feature (3705)..(3710): n is a, c, g, or t
  misc_feature (3712)..(3712): n is a, c, g, or t
  misc_feature (3714)..(3714): n is a, c, g, or t
  misc_feature (3716)..(3719): n is a, c, g, or t
  misc_feature (3722)..(3723): n is a, c, g, or t
  misc_feature (3726)..(3727): n is a, c, g, or t
  misc_feature (3730)..(3731): n is a, c, g, or t
  misc_feature (3733)..(3736): n is a, c, g, or t
  misc_feature (3738)..(3740): n is a, c, g, or t
  misc_feature (3742)..(3744): n is a, c, g, or t
  misc_feature (3746)..(3747): n is a, c, g, or t
  misc_feature (3749)..(3750): n is a, c, g, or t
  misc_feature (3752)..(3753): n is a, c, g, or t
  misc_feature (3757)..(3759): n is a, c, g, or t
  misc_feature (3761)..(3772): n is a, c, g, or t
  misc_feature (3774)..(3775): n is a, c, g, or t
  misc_feature (3778)..(3779): n is a, c, g, or t
  misc_feature (3782)..(3784): n is a, c, g, or t
  misc_feature (3786)..(3796): n is a, c, g, or t
  misc_feature (3800)..(3800): n is a, c, g, or t
  misc_feature (3804)..(3814): n is a, c, g, or t
  misc_feature (3816)..(3816): n is a, c, g, or t
  misc_feature (3818)..(3818): n is a, c, g, or t
  misc_feature (3820)..(3822): n is a, c, g, or t
  misc_feature (3824)..(3825): n is a, c, g, or t
  misc_feature (3827)..(3827): n is a, c, g, or t
  misc_feature (3829)..(3837): n is a, c, g, or t
  misc_feature (3839)..(3839): n is a, c, g, or t
  misc_feature (3841)..(3843): n is a, c, g, or t
  misc_feature (3845)..(3847): n is a, c, g, or t
  misc_feature (3849)..(3854): n is a, c, g, or t
  misc_feature (3856)..(3864): n is a, c, g, or t
  misc_feature (3866)..(3876): n is a, c, g, or t
  misc_feature (3879)..(3879): n is a, c, g, or t
  misc_feature (3881)..(3884): n is a, c, g, or t
  misc_feature (3886)..(3887): n is a, c, g, or t
  misc_feature (3889)..(3891): n is a, c, g, or t
  misc_feature (3893)..(3894): n is a, c, g, or t
  misc_feature (3896)..(3899): n is a, c, g, or t
  misc_feature (3901)..(3913): n is a, c, g, or t
  misc_feature (3915)..(3925): n is a, c, g, or t
  misc_feature (3927)..(3928): n is a, c, g, or t
  misc_feature (3931)..(3932): n is a, c, g, or t
  misc_feature (3934)..(3935): n is a, c, g, or t
  misc_feature (3938)..(3949): n is a, c, g, or t
  misc_feature (3951)..(3956): n is a, c, g, or t
  misc_feature (3958)..(3971): n is a, c, g, or t
  misc_feature (3974)..(3975): n is a, c, g, or t
  misc_feature (3977)..(3981): n is a, c, g, or t
  misc_feature (3985)..(3987): n is a, c, g, or t
  misc_feature (3989)..(3995): n is a, c, g, or t
  misc_feature (3997)..(3999): n is a, c, g, or t
ngnnggcgntnnccnngccnnngnnnnnggggnnngnnnnngngnnnnnnnngnnnnancnnnngnnnnnnnnncncgnccncnnnnnnngggnnggnnngcnnnngnncnccggncnncnnncngncncnnnnnngnncnccnnnnnnnngggcgngngcnnnntcnncnnccccngnnncctnnggnnnnnngngnggnnnngnnnnnnngnnnncnncnnnnnnnnnnccnnnnnnnnngnccnnnnntnnnngggnnnggnggnnnncnncnncgnnngngngngggnnntcttntgngggnnnngcngnnnnggnncncngggngggcnncnnnnngnnggcgnngggnncnnnnnnnnngnnncnngcncnncnnnnnncgnnngnnggnnngngnncnnngncnnngnngtnnncnncnnnnncncnccccncnnnnncgncnnnnnngnnnnncnnnnnnncnnnnnnngnnncnncncnnncntnnnnnncnncnnnnncnnnnnnnnnnnnccnnnnnnncnccnncnncncnnnnnccnnnncnnnngnnncncnnnccncntcnnnnnnnnnntnntnnnncncnnnnnnnncncgnnnnncncnnggnnccncnccccnnnnnncnnccnnnnnnncnnngcgnnnnnnnngnnnnnnnncnncnngnnnnnnnccnnnnnncnnggncccnncnnnnncnnnnnnnnnnnnncnnncnncncnncnnnnnnnnnccnnnnncnccnnnngnnnnnnnncnncnnnnnncnnnnnccnncnnnnnnnncnnnnnnnnnnnnnccnncncncnnnnnnnnnnnnnnnnncnccnnnnnccccgngccnnnnnncncnnggnngnnnnngnncnnnnnnngncnnnngnnnnccnnngnngnnnnngcgnnnnnnnccnngngnnngncgnnggcnnnnnnnngnncgnggnnnnncggnnnnnncgnggnnnnnntnnnnggngncncgnngnnggnnnnnnnnnnngnnnnnnncngnngnncngnnggnnnncnggnnncnnnnnncgnnnnnnnnnnncnnnnnnnnnnngngnnngnnnncnnnnnncnnnnnnngnnnnnnnnngnnnccnnnnnngnnnncnnnnccnnngnnnnnnccnncncnnnnnnnnnnnnncnngnngnncnnnncnngggngnnnncnnncnngnnnnnnnnnncnnnncgggnnnnnnnnncnnnnnnnnngnnnnnnnnnnnnnnnnnnnncnggnnnncnnnnnnncnccnnnnnnnnnncncgnnnnnnnnnngncnnnnnnngnngnnnnnggnnnccnnnnnnnncccnnnnnnnnnnnnnnnnnccnngnnnnnnnnnnncnnnnncnggngngcnnncgnnnnnngcncngcnnnnnnngngnnnnngnnnnnnncncncncnnnncgnngncgcnccgnnnnnnnngngncnnctnnnnnngnganngnnncgncgnnncnncgncnncnccnnnnnngnnnnnccnggnnnnnnnnnncnnnnnggnnnncnncnngcnnccncnnnccncnnnngnnnnnngnnncngggnnanggngnnnnnnnnnnncncncnnngncnnncngnnnnnngggggnnnnnnngnaanggnnnncnnnnnnncnncngcncnnntnnnnntcnnnnnnnccnnngggccnnnnggaaccnnnnccnnnnnnnnttnnnnnngggnnnggnnnnnnnnnggnggnnccnnnnggcctcccacaggcgtggaagcaaggcgtcggcgatgtcgtggaactgatataagcttgcctgcannatgnccgcgccggccatgggcagcgcgccncccgcgcgcacatcgaaggcgcgcacgtcgacgccgcgccggcgggcgcgacgagggcgtggcgcggaccgtagtccgtcccgtagccgacgcgcatcgcgagccggtagaggatggggaancggtagatggtcggcatgacnagcgacagtatggtgtccgtcgtcgtcccgctctgcaacgaggaggcgaacctccccgagctacgcgcccggctcaccgcggcgctcgcgcatcacgagttcgagtgcatcctggtggacgacggctcgaccgacgccacgtccgccatgatccgcgacgtcgcgcgcgaggatccgcgcttcaaggtcgtgagcctctcgcgcaacttcggccaccaggcggcgatcttcgccggtctcacctttgcccgcggcgcgtgcgtcgtcgtgatggacggcgacctgcaggacccgcccgaggtgatccccgagatggtgcgcgcgtggcggaagggcgccgaggtggtctacggcgtccgcaccgcgcggaaggaaggttggttcacccgcgcgacggcagcggccttctaccgcatccaggcgcgcctcacgcggaccaggatgccgctcgacaccggggacttcgcggcgatggaccggcgggtcgtggacctgatcgtcgcgatcagcgagcgccacccctacgtgcgcggcctcaggagctgggtcggctttcgccaggtcgcgttcccctacgagcgcgaccggcgtcaccggggcaggcccaagtacacggtctggaagctcctcgatctggccgtctcggggatcgtgccgttctcggtcgtcccgctgcgactcgtggccctctcgggcgccgcgatctcggcgctcgcgctcgcggcgggactcggcgtgctcctcggatggatgccgttcgtcgccggcgtggtggcggcgctcgcgttcctcttcggtctccagctcctcatcatcggcctactcggcgagtacgtcggtcgcgtcctcgaggaggtgcagaaccgcccgatcttcgtcgtcgacgaggtcgtcggggtggatccggcccaggcgacgggcgaccggaggcgcggcgccccgcgcacgagctagccagggatttcccgcccggcaatcctgtaatcacccgatggtcacccgcggtcgaacgacgcgaccatgggcncnnnnnnnccnngggggnnncnnnnnnncnnnnnnnnnnnnggnngnnncnnncnnnncngnnncngnnnnnnnccnnnnnnngnnggnnnnntngnnggnngattncnnnnnnntgntgnncnnnnngnngnnnnnnnncnngnnnnnnntcngnncnnncncnnnccnnncnnnntncnccgnnnnnnnnnngngggncangnncngngcnnngnncttnnncntnnnnncnnngnngnnntccnngctcncgnggngnnnnngnngnggntnggnnnngnnnnggnngnnggnnnncnngnngggggnnnnnnncnncnnnngctnnannnnngnntnnanngccngnnnnnccccnggnanntnntnnncntnnnnnnnntnggcntncgnnnggnccncngnntcgnnnnccnnannnnnntcggnnnngnnncncgcgnnnnncccgngggnttnnngggnnngntcnttcnnggnccgnnccnnnnccggccccnngncngncnncnggncnncnnccccnnnnnnncccnngggnnnnnnccnnngnnngnngggggnnnnnnnnnggnnngnnnnnnnnggnntnnnnannnncnnncngncnnggnnntnncngnccnnntccnnnccnnnnncnnngnannnnntnnnnttnnngnaannnnnntncngnnnnggnnttnnccnngnnnncnnncnnngnngnntnngggnnncnnnnnnnnnnnngnngcnnggnnngnnnnnnnnnnngcgngggnnnnnnnnnnncngncnnngnngncnnnnnnnnngncnnngnnngnnnnnngnnnnnnnnngnnnnnnnnnnnccngnnnncnnannncnngnnnngnnnnnnnnnnnnngnnnnnnnnnnngnnaanngnnccnnnnnnnnnnnngnnnnnngnnnnnnnnnnnnnnggnngnnnnngggnnngnnnnnnnannnc

SEQ ID NO: 1252 - DNA, 4000 bp, Escherichia coli
  misc_feature (891)..(891): n is a, c, g, or t
  misc_feature (984)..(984): n is a, c, g, or t
  misc_feature (1074)..(1074): n is a, c, g, or t
  misc_feature (1551)..(1551): n is a, c, g, or t
  misc_feature (1795)..(1795): n is a, c, g, or t
  misc_feature (3024)..(3024): n is a, c, g, or t
  misc_feature (3556)..(3556): n is a, c, g, or t
aggtcgccccggctccgaagccggccccagccaagaaggtcgccccagccaagaaggtcgccccggctccgaagccggctccggccaagaaggcggctctctctgtccctcctgcgccaaagaggccgacggtaggtccctatgccaaggagcccaagtttctcgatgagcagcgggtgttgctaatcgaagagcgcatcgtttgccagggtcaggctgaggatttgcgagccgaagccgactcgctggctcaggaacgtgagcccggcgacgtacagtttgatgccgagggtggcgaagggggaacggcagctgtcgaccgcgagcgcgacctggccctctcggcccaggcccaggccgcagtggaagagatcgatgatgcacttgggcgaatcacccgaaagacctatggcacctgcgagcgctgttaccagtccgttcccaaggctcgactccgtgcgcttccctatgcccggctgtgtgtggcctgcaagagcggggggctgtcgcgacgctgaccggcactaccgaatcgaacacggttcgacgggttgtgctggctggcacaaccctccgattagtgagtgccgtgtcagttgccgctctggcggtgctggtggatcagttgaccaagtggtgggctctcgaccgcttgtctcgtgggccgatccatgtgatcgggaccctcgatctcgggctgacccggaacagcggttcggcgttcagcctgtttcaggggtttgccgcggtgctggtggcggtggcggtggtcctggtgggcgcgttgctggtgatggtctatcgagcgccgtcactgtcccgcgctgcagtgtgcgggttgatcatcggaggagccatcggcaacttgtccgatcgcatgtttcgtaacgnacacggcgccgtggtcgacttcatcgatctccacttctggccgacgttcaacgtggctgatgcatgcattgtgattggttgtctgctgctggngctctctctcctacgcaggactcccggatcgtgagtgatctgtccctatcggtgcccccgtctctcgacggagtccgagtggatcgagcngtggcgttactggcagatatctcccgttccgccgtcgacggcctgatagagggtggttgggtgcaggtggatggtgtgaccgtccatgctcggagccgcccacttcgggagggcgagctcctggccgtggagcttggtgaggaggaagtggttcctcctcctcaagccgatgagtcagtggtgttcggcgtggtgtacgccgacgccgacatcgtcgttgtggacaaacctgccggcttggttgttcaccccggagccgggcatcgaaccggcaccctggtaaatggggtactttcccaattccccgacctggctacgttggctgatgaggtgggcgccgatcctgaacgccccggcatcgtgcaccgcctcgatcgcggcacgtcgggtctgctggtggtggcgcggaatgccggtgcctaccgctcgttggtggcccagctgggtgaacgcacggtgtcccgtcgataccgtgcnttggtgttgggtgaggtcgatggtgagtcgggggtcgtggacgcccccatcggtcggtcgatcacgtcgcctactcgaatggcggtctcgcgcaagggaaaagaggcccggacccgctaccgggttgaacagagattcaccgagccggtcccggccaccctgctggaggcgacgctcgaaacaggccggacccaccaaatccgcgttcacctatcggcgatcggccatccggtggtgggtgacngggtctacagccgaggtcgaacgttgcccggggtcacagtgagccggccgtttctccatgcctacgccctggcgttcgaccacccggtgaccggggagcggatggagtggtcgtcgccgctccctgctgatctcagggcagaactcgaacgcctgtcgcattgacgggtaccggcgaattcttctcgccggtacccgtcaccgtcaggctgcttcgtgagccgcctcgagagcctcgctgtcggccaggatccccagagcctcggcttcggcttggcgtacctttcggacacccacccctagccgttccgctgtcgtctggagcgatgcggggtcagagccatcgaatccaaaccgattgcggatgaccgctcgttgcaagtcggtgagccggtccagggcgttgcgcaccatcccgaacgtgagctcggaggcgacctcgtcctcgaactcgttgctgtcggtcgacaccaaatcacccagcgtggaggtcgagtcggcggtggccggctggtcgaggctggccaccacccgggcgacccgggtgaggtcatcccgcacgtcggcggtggtattggtggcatcatccagctcggcgtcagtaggcggacgctgtagttgatgggtgagttcccaggtggccgcctcgacttgctgattgcgctcggctacctccatcggaaggcggatggtccgaccatgctgttggacggctcgctgtaaggcctggcggatccaccaggtggcataggtggagaaccggaagccgcgttcccagtcgaacttgtcgacagcccgcatcagaccgaaggtgccctcttggatgagatcgggaaggtcgaccccgcggtcctgataccgccgggcccagtggatgaccaggcgcaagttggccgccgccatctcccggcgggcatcctcgtcaccggccgccacccgtttggccaattcggtctgtgcttcatggtcgggaagcgggtgatggtcgagatcgcggaggaagaggcccaggctgtctgcatcggctccgcggctgcgcgccgcggtcggcgaggtggcggcgcgccccttccccgtgccggtcggggcgttcgtcttattctgaccgttgctggtggtcaacgtgcgggttgtcatgcctggtttcacccttctcatgtgggttgcactactctcaacgcccggggagcgccggacattcctgcagtggcatggcgcatgcgattctcncggttgaataactacccgtttcccggccggtttgcacatctacgtccgaaatggtcggtcagcacaatgaattaccaggataatcggtgtttcgtggtacgtcacggtgaaacggagtggagcctccatcaccggcataccgggcagaccgacctgcccctcttgcccacggggacggttcaggccgaagcgctgcagacaccgctgtcctcccatgagttccactcggtcctgaccagcccattggcccgggccagggaaacctgccggcttgccggactcgggaacaaggcggaaatcgaacctgatcttgccgagtgggactacggctccttggaagggctgacgacggctgagatcttgagggaaaggccacaatgggatctcttcaccgatggcgctccgggtggcgagacgattcaggaggtggcggcccgggttgaccgggtcatcgagcggatccgggccaccgatggcgatgtggtgtgtttcgcccacggccacgtacttcgggtgttggccgcccgctggnttggcctcgacccgagggaagggaggtgcttcgccctcgatccggcttccatcagcatcctgggctgggagcgtgccagtccagtggtcgtgcgctggaacctcaattgatctcgcgagccgcccctccgggccggcggtcgattgggcgatcgggtgaaagcgactctccgcggaacatccggcgtgggcccgaccagcgggcgggaggggcatcgaggatggccgccagggcgtaggccacgctctcatagttgacccgccacccccggaaatgggcccaggcatcgtcgacctcacgtgagatcgggtacccgatttcgtggaggcgcatgtaggcggcgtcgaattcctggcgcggcagcgcgatgtcgtcatccgggtttggatcggggttaaacgggatgccgatcacctgggcgatgtcacggagacaggtgaagcc

SEQ ID NO: 1253 - DNA, 4000 bp, Escherichia coli
  misc_feature (216)..(216): n is a, c, g, or t
  misc_feature (405)..(405): n is a, c, g, or t
  misc_feature (422)..(422): n is a, c, g, or t
  misc_feature (425)..(425): n is a, c, g, or t
  misc_feature (545)..(545): n is a, c, g, or t
  misc_feature (1118)..(1118): n is a, c, g, or t
  misc_feature (1253)..(1253): n is a, c, g, or t
  misc_feature (1826)..(1826): n is a, c, g, or t
  misc_feature (1991)..(1991): n is a, c, g, or t
  misc_feature (2120)..(2120): n is a, c, g, or t
  misc_feature (2385)..(2385): n is a, c, g, or t
  misc_feature (2444)..(2444): n is a, c, g, or t
  misc_feature (2453)..(2453): n is a, c, g, or t
  misc_feature (2492)..(2492): n is a, c, g, or t
  misc_feature (2789)..(2789): n is a, c, g, or t
  misc_feature (2841)..(2841): n is a, c, g, or t
  misc_feature (3011)..(3011): n is a, c, g, or t
  misc_feature (3036)..(3036): n is a, c, g, or t
  misc_feature (3062)..(3062): n is a, c, g, or t
  misc_feature (3113)..(3113): n is a, c, g, or t
  misc_feature (3133)..(3133): n is a, c, g, or t
  misc_feature (3175)..(3175): n is a, c, g, or t
  misc_feature (3188)..(3188): n is a, c, g, or t
  misc_feature (3384)..(3384): n is a, c, g, or t
  misc_feature (3513)..(3513): n is a, c, g, or t
  misc_feature (3516)..(3516): n is a, c, g, or t
  misc_feature (3599)..(3599): n is a, c, g, or t
aattgttaaatagtaaatatttatcaattctattattaatttttttaaccacagttactgttaatgcagaagacgaaccaattgatatatggaatattgatcaaaataaaattgaagaaaactcatcaagtaataatctaaataatttagagaccaattctggtgatgctgagattacacaacctagtatttttgaacttcaatcagaaaaagaanttgaaacagtccaagttagttcagacttaaattcacaagaaataaaaattatcgggctttacgatcctgaagattatgatcttaaaattgatttgtggtcaaattcaaatggcgaccaattgaagtatcttttttcaaatattaataaaatgcaattatctaaagatgcatcagaattattaaacatanttttattaacaaatgcntanaatccagaacaaaatattaccaatgaagagtttttaaaaattagatctaattggcttattaaaaacaatgatagagaattaattgaggaatatttaataaaaaaccaaattttaaatttncacccagatttaagtaaatatttaattgatgaatatttatcagaagcgaatattgaaaaagcttgcgaattatttttaaagaattcagaagttatcagtgacgattatctttcaaaatttaatctatattgtttaattaatgcaggtagagctgaggaagctcaattaattttagacctaaaaaaagagctaggttttaaagatgaatattttgagaaaaagctcaattatttgtttgggtacacaaaagatccagaacaagcaatttctgaggcttccatattagattttcaccttgcacaccgaactaatccagattttatttttgaacctaaaaaaaatacagataaaaaaatatggaaatatttatcagcatcaaatttattatataacattgaggagattgatattgctgaagaagaaaaaatttctttaattgaaaaagcaacacatgacaaaaattattctgagaaagatttattttctttatataaaagatttcagttcaatattaatcaattattaaatgcatccgagtcttataaatctctatcgaacatagaagctagagcnctagtttatcaaagatctttattagagtctgatactgaaaaaaaattagaatttataaaacttttgaaagatctatttactaaggatggatattcaaatgcatttgatgctgagctaaaagaaatgttagaaaanattgaacctaacgatgtaccatctaactttactactttttattcaaataatttaaaagaagagaagcaagagttaaatgatattaagttcaataatgatattttacatcaatcaagactagtaaattattttaatggagattttgcaaaatctaaagttgaaaaagatttagataattttttaaaaaaaattaagaaagacaagaaatattatctatccaaaaaagatataatgttaatcgagtcaattaaatctgatggtatcgagatttcaaaaaaatatgaagacctctatgaaattaatgagtctgaaatgccaacagatattcaggttatgataaataataatgaaattggatcagttgtattaagaattattgaagttattggacaagatgatcttaacaatttggatgaggatacgttatattttgtaattagcgcgttaaatcaactagatatcgattacattcgaaataaaattttattaaaagttctgcctttaaaagtctaaaaaattaattaaaatatacctatcatggcagtaaaacctattcttacagagcccaacaanttattaagacaagtttctaaaccagttgaaaaagtcacaaaagacgagcaaaaattaatggatgatatgctggatactatgtatgcagctaatggtatagggcttgctgctattcaaataggtgtacccaaaagaataatagtaatggacataggtagagacccngagaagaaagaaccaagatattttgtaaatccagtaatcaaaaataaagatccagaaaaagcaacttacgaagaaggttgcctgtctgttcctaaccagtttgctgaaatcgatcgacctagtcaatgngatgtagaatatttagattataatggagagaaacaaattttacatgcaagcggattgttagcaacatgcattcaacatgagatggatcatttagaagggattttatttattgattacttgtccaaattaaaaaaatcaatgattataaaaaaactatcaaagcaaaagtctaatcagatagttatttaattaatgcaaaaaaaaattgtgtttatgggaacacctgagttttcagttcctattcttaaatcaatttatgaaaacngtttttctattgaggctgtttatactcagccaccccaaaaatcgcagagaggacaaaangttaataantctccaattaatgatttagctgataagcttggaattaantgcagaactccagctagtttaaaaaacaataaagaggaattagaatttctaaaaaaagttgatccagatattgtaattgtagttgcatatggtcaaattattccaaaagaatttttaaatatttgtaaattaggttttatcaatatccatggatctattcttccaaagtggcgtggggcagcacctatccagcgatcaataatgaatttagacaatgaaacaggaataagtattatgaagattgaagaacaattagattcaggtcctgtttgtgcagtttataaaattaatttaaanccaaataataatgctgatgagatctcaaaaaaactatcattattagcatcanaaaaaataataattgaaattaataatattttagatggaaaagcaaagtttattgaccaaaaacatgaattagcaacctatgcagcaaagataaataaatctgaaggacttataaactggaacgatgatgcaaaaaaaattcttggaaaagtgaatggattatttccaatnccaggtgcattttttatttataaanatgagagatacaaagtattgaaagcngaaatagtaaaaaatcaagggaatataggagaagttttgacaaacgatttngaagttggctgtggagatantcaatctttgaaaatattagaaatacaaagacagggaaaaangcctcaaaagatngaagaatttattcttggctctcaaattaaaaagggtgctagtttaataaatgcataaatatcaaatcttaattgagtatgttggtacaaattatagaggctggcaaatacaaaaaaaaggtcaaacaattcaaggtgttcttcaagataaattgtcaaaacttttaaaagaaaaaataattattattggttcaggnagaaccgatgcaggtgtgcatgcaattgctcaatctgctcattttgaaagtaaaaatataattgaagataaagataaatttttaaaatctattaatcattttttaaaaaataaaatgatagctattctnaangttagaaagagaaatcaaaattttcatgctcgatattcagcaaaactaagagtttatgagtatgttatttataatagagttgncccgtcggtaattaaccaagatagaggatggcatataatgaaaaaacttgatcttaaagagatgaagagaggagcaaaaaaattaattggaactaaagatttttcaacatttagagcctcaagttgtaatgctaaaagtccgataagaacaattaagtcagttaagataaaaaatcaaaataataaaattacaattgaatttaaatctcaatcttttctacaacaacaagtgagatcaatggttggttgtttaaaatatttaggtgaaaaaaagtgggatctaaaaaaatttgaaaaaattattaaattaaaaaaaagagagaattgtgcaccaccagcacctgctaatggtctttttttatctagagttttttattagattttctttattactcattgca

SEQ ID NO: 1254 - DNA, 4000 bp, Escherichia coli
  misc_feature (1517)..(1517): n is a, c, g, or t
  misc_feature (1957)..(1957): n is a, c, g, or t
  misc_feature (1989)..(1989): n is a, c, g, or t
  misc_feature (1992)..(1993): n is a, c, g, or t
  misc_feature (2745)..(2745): n is a, c, g, or t
  misc_feature (3972)..(3972): n is a, c, g, or t
  misc_feature (3989)..(3989): n is a, c, g, or t
agttttttatagtcattcgccatcactggcaagaaaaaagtcccctccattctattacaaatacttaattatgtttgaaaagctagaagaagtagaaaaaagatatgactatttgaatggccaaatgagtgaccccaagatcattgctaggcagcacgaatttcaacaatatgctcgcgaacaatccgaattagctccagttatagccgagtatcgtgcgtacaaaaaaaatcaagatgaactgaaagaaaatcaggaaattttggaggaggaggcggacgaggaaattttagttatggtacgtgaggaaatcacaggtctacagacaaagatgacagggttggagcaaaagataaaaataatgcttttgccaaaagattccagagacgaacgaagtgttattatggagattcgcgctggtacggggggtgaggaagcttcattgttcgctctggacttatttcgaatgtatacccgctatgccgaagcaaagaaatggaaatctgaaattctgagccagagtgaaacgggtaaaggtgggtttaaggaagttatcttcaatattcaaggcaagggagtatatagtaaattaaaatatgagggaggaactcaccgagttcagcgagttccagaaacagagacccaagggagagtgcatacctcggcggtaaccgtagctattatgccacaggttgacgatgtcgatatcaaaatcaatccgtctgatttgaagatagatgtgtttcgatcctcagggccaggtggtcaaagcgtcaatacaacggactcggcagttcgtattacccatgtgccgagtgatttgacggttacttgccaagatgagaagtcgcaacacaaaaataaagataaagccatgaaagttcttcgtgcacggctatatgatcttgaacaaagtaaacaacaagatgaactcgctcgtgagagaaaacagcaggtcgggtcaggagaccggagtgaacgtatccgaacttataatttttctcaagagcgaatcacagaccaccgcattggtttgaccttacataaactgacgctagttctccagggtgaacttaatgaaattattgatgcgcttacggtttattaccaagcggaagctctaaagaagggtaattaaccttccctccgagttaattataagtgatatagactgaagtagataatcaatgaaagaatttcttaactggtcaataggtcgcttaaaccaggcaggaattgattctccacgcatggaggccgaagtgctttttgccggagccttaaaattatgccgtgaagaaatttatcgtaggccagatcggattctcactgaacctgaaaaagctattatatgtgattttgtagatcggcgggttctccgggaacctgtagcctatattatagagcgaaaagagttttggtctttagattttaaaatcacaccggacgttctaatcccgcgaccagaaacagaaacccttattgaaactctgcttttactaaacagtaaaaacccngataagttgccgctacgtttgctggagatcggaactggatcaggagctatcgccgtggtcgcagcgcaggaaattcctggttgtcgagtgacagcgaccgactattttttaggggcgttagctgtggctaggttaaatgctgaaaaccacgtagtcgctgacaagattgattttgttaagagcgatatttttttagatctaccgatagttctttatgactgtatcgtgtccaatccaccttatatacaaacttcaagtttaaataaacttatggcagatgtgattaattttgaacccagaagtgcactcgatgggggtaatgacgggttaagtttttataagcgaataattccagaggctctgggctatctaaaaaaaggtggtacggttgttcttgaaattggagaaacacaagcaaaggcggtaactaggttatttgntcaggaaggtcagtacaaagaaattaaagttnttnnggactatagtggttatgaccgcgtcgtatccgcgagaaaaaaaatatatggataaaatagttatagaaggaggaggacgtcttgaaggcgaggtagagattagtggagccaagaatgcagctctgccgattatggcggcaatgattttaaccacagggaaaaacaggcttgatggtgttcctcaagttcgggatgtaaccaccatgcttcacctattaaatgacttgggtggctgcactgaagaatttaattcgggtcgtatcttttttgatgcaaccggtataaataattttgaggcaccctatgagcttgtttctacaatgcgagcatcttgtcttgtgttgggtccgcttctagcgagattgggtcgagctaaagtatcgcttccaggagggtgtgctataggagcacgaccactagaccttcacataagaggtttggaaggtatgggagcaaagatacgtttagagcagggatatatttatgcggaagctaagcgtcttcatggggtaagatattatttcgatacagttacagtaacaggaactgctaacttgataatggccgcgaccttggctgatggagaaacagttcttgaaaatgttgctaaggagcctgaagtagtgtttctagcagatgtattgaataaaagtggggcaaaaataaaaggtcaagggacagaccttgttacaattcaaggggttcagtcactaaaaccaattaattgcaatattttcccggatagaataganacgggtacctacatgattgcttctgcgatcacgaggggtgatgtcaagataaccaactgtataccaaaacaagtagagtccttaactttaaaactcaggcagtctggattgatcgtagaagaaggtgaggcaagccttcgtgtaatttgtgatagccaattgaacggagttaatataaagacacaacctcacccaggttttgccacagatttgcaagctcaattcatggctttaatgacacttgctcaagggaaaagcattattctggaaacagtgtttgaaaacaggtttatgcatgtggctgaactgaagcgtatgggcgcagatataactatacaaggcagaacagctgttgtgagtggagtcaaagaattaagtggggcacccctcatggcgactgacttgcgggcaagtgcttctctcgtgttagctgccttggcggcaaaaggaaagtctgtcatatctcgtgtctaccatattgaccgagggtattctgatatagaacaaaaacttaatagattgggtgcgaaaattcgtcgggaaaaataatgaatttgatttatccaaatcataaaaatttatgcaagacaaagctatatttaataaaaaagaaattttccatattgtagtgtggatgcctagttggattggtgatgtggtgctagctcttcctgcactgcaggctttacgtgatatttatccaaagactaggatcactgtcataacaaaatttcctactggtcaattattatctaatcacaaggcggtcatagataccgttttacagtttccgaaaaataaagaagatggttacattaagcaatatagttatgcgctaggattaagaaaatacaaatttgatcttggaattgtttttcctaattcgtttcatgctgcatttatgttgatgctcacgggagcaagggttcgtattggatatcgaacagatgggcgccaacagttgctaacgcactctattcctgttactaaagaagaaaaaaaaactctatatcgtgtcaactattttcacaaaattctttctccaataaattcagaattagcccccgatcactacgattctaaatggactaacagtcgtatggtttcgaagaatattctccgcgtagtggggctggatagagaagatttatttataactattcacccgggggcatcaaaaattgagcgtgcttggcatgctgagcgcttcggtatactttgccaaancctcatcaaaacttacncggtaaaaatt

SEQ ID NO: 1255 - DNA, 4000 bp, Escherichia coli
  misc_feature (1189)..(1189): n is a, c, g, or t
  misc_feature (1192)..(1193): n is a, c, g, or t
  misc_feature (1196)..(1196): n is a, c, g, or t
  misc_feature (1202)..(1203): n is a, c, g, or t
  misc_feature (1206)..(1208): n is a, c, g, or t
  misc_feature (1211)..(1211): n is a, c, g, or t
  misc_feature (1214)..(1214): n is a, c, g, or t
  misc_feature (1221)..(1222): n is a, c, g, or t
  misc_feature (1229)..(1229): n is a, c, g, or t
  misc_feature (1374)..(1374): n is a, c, g, or t
  misc_feature (1455)..(1455): n is a, c, g, or t
  misc_feature (1458)..(1458): n is a, c, g, or t
  misc_feature (1468)..(1470): n is a, c, g, or t
  misc_feature (1488)..(1488): n is a, c, g, or t
  misc_feature (1493)..(1495): n is a, c, g, or t
  misc_feature (1503)..(1503): n is a, c, g, or t
  misc_feature (1507)..(1508): n is a, c, g, or t
  misc_feature (1520)..(1520): n is a, c, g, or t
  misc_feature (1523)..(1524): n is a, c, g, or t
  misc_feature (1529)..(1530): n is a, c, g, or t
  misc_feature (1533)..(1533): n is a, c, g, or t
  misc_feature (1537)..(1537): n is a, c, g, or t
  misc_feature (1544)..(1544): n is a, c, g, or t
  misc_feature (1550)..(1551): n is a, c, g, or t
  misc_feature (1570)..(1570): n is a, c, g, or t
  misc_feature (1573)..(1573): n is a, c, g, or t
  misc_feature (1582)..(1582): n is a, c, g, or t
  misc_feature (1585)..(1585): n is a, c, g, or t
  misc_feature (1593)..(1593): n is a, c, g, or t
  misc_feature (1598)..(1598): n is a, c, g, or t
  misc_feature (1603)..(1603): n is a, c, g, or t
  misc_feature (1605)..(1605): n is a, c, g, or t
  misc_feature (1607)..(1608): n is a, c, g, or t
  misc_feature (1611)..(1612): n is a, c, g, or t
  misc_feature (1619)..(1619): n is a, c, g, or t
  misc_feature (1624)..(1624): n is a, c, g, or t
  misc_feature (1626)..(1626): n is a, c, g, or t
  misc_feature (1629)..(1630): n is a, c, g, or t
  misc_feature (1634)..(1634): n is a, c, g, or t
  misc_feature (1637)..(1637): n is a, c, g, or t
  misc_feature (1641)..(1642): n is a, c, g, or t
  misc_feature (1644)..(1644): n is a, c, g, or t
  misc_feature (1650)..(1650): n is a, c, g, or t
  misc_feature (1801)..(1801): n is a, c, g, or t
  misc_feature (2012)..(2012): n is a, c, g, or t
  misc_feature (2759)..(2759): n is a, c, g, or t
  misc_feature (3680)..(3680): n is a, c, g, or t
  misc_feature (3713)..(3713): n is a, c, g, or t
  misc_feature (3722)..(3722): n is a, c, g, or t
aaaaaatgtcagcagagttattcgtagtaagagagtcgtttccgttggtgttgatctctctctctctcaacacgcaattcaaagaacattaccgcgcgcttcttcttgcgtataaatatacacacacatcgagaacaagaacaacaacagcacatcacgctttcgcacgcgcgcgataaaaaggagagagagagagagagagttaaagagagagttcagagttcaaaagtatgcgtacccgtccgtaataatcgtactggcaatcgtgaatctgatccccgtgtccggtgtcgaactgtttttgtggtggttgattcgtttgatgggaggaaggagaagaatactgttgttgttgttgttgttgttgcgccatcatcgttattctctcttcttatcgcaaataaagggggtttaaatgtcttctgaaaagagtcgttaaacacttacgctttaaacgtcttttctgaggacgaaatttgggacgaaaattgcgccgagaaaaactcacacgcggtctgtgtcgttacaaaatttttgcccttggaaccctaaatatgaaagggcaaaacccaagcgaaaaaaaaatgtgaagaaagataagctcacccccctttggacttcacttatttctttgaaaagacacacgtcacacaacacactcttatatactaaaaatgttttctgtcactcaaactgttactcaatccgttcgcttgaacgcgactgtttccaagagagacgtcacccgcaggtacgaagaagttcttcttcttaaagtgttttctgcgtgtgttggatcgttcatccattttgttcttttttcctcttttcggtacacgtcattttttccattattaaacgcgcgaatgctttcgggcgcgcgcgcgcgcgaaggagaacgacgtcttcattcctctcgactacaaacaccattcgccgtgaaagcttcttttgttccctcctttcgtcgaaaagagagcgtaaataaagtatggtatctttcgcgacgagatatggataattggaaagagtgaaagagagatatcgcgcgagtgctcaactgtccaataactgtgaacacgtttttgctccaaaaaaggacacgtcaacaaccatcgcacgcgaagaggacaaaaaacaacaaacacttttgaagaagaagaagaagagaaaagagaggaaaaaaaanttnnttntttttnnaannngtngtnttttttnntcttttntgtactcactctgtcgcgctctcttttgttctattctttttaaacagatctggcggcaacttctccgcccctcccagagatgattcggaaacgttcaaaacgtccgtcgcgggccaatcgaactggaacgcctacgaaggttccngcgagaaagaactcacgccggaggagaagaaggccaaggccaaggcggaggaggacgcgtccaacgccagaagagccgccnccncggcgaagannnaagccgaaagagaaaaanccggnnncaaagggnccannttctaatttccnatnnttttnnatngtgngagaaanatctcnngagagagagagagagaganaanaagagaganaanaagagagngtgtnttttngncnntcnngaagtantatancnaannaaanttntttnnanaaaacnttctccttcataaaaaaaaaatcgacacttttgtacaccctaaatactcgtccttttctccctctaaaaatggcggcagaaatcaccacaaaacgaagaagagagaagaagaagaagacaaaggaagagaacaagagagaagaagaagaanaacgaccgagaatcacccgagatttgaactggtggttttggttctttttgtccccgtgagtttatttaaaaagatgtccgaagaggaaccgaaaacggagaagcaactgattcgccaagcggagaaggagcggaaaaagaaggaaaagttggagaaagaactgaagaagaagagagaaggtttagcgtcgtcatcgggaggaggaggctcngttgtaacggtgcacgcgtcgcaaacgcctccggttcacttggatgccgtctccggcacgcgagacttcttccccgaggagtttcgattgcaaacgtggttgtttgagaaattccggaaatgtggtctcagagcagggttcgaggagtacgacgcgccggtgttggaacggcaagagttatacaaacggaaagccggggaggagatcacgcaacagatgtattcgttcgtggataaagacggggtggaagtgacgctgagaccggagatgacgccgacgttagcgaggatggtgttgtcgagaggcgcgtcgatgattttgccgctgaagtggttttcgataccgcagtgttggaggtttgaagccacgcagagaggaaggaaaagagagcattatcagtggaacatggatattattgggtgcaaggaaataaccgcggaggtggagttgttgagcgcggcggtggagttttttaagagctgcgggattacgagcgcggacgtcgggattaaagtgaattcgaggaaagtcatgcaatcgatgttgacgattaacgacgtgccggacgagattttcgcgccgacgtgcgtgatattggacaagctagataagattggcgccgaggcggtggtaaaggagttgacggagacgttggggttaccgagagaaaccgcggagaacgtggtgaagacgttgagttgtaaaacggtcgaggagttggaggaaatggccagagaggcgatcgangtaagtagcggtggtgatgatggtgataatactaatagcaatacgaaagccgtggacgattcatccatacgcgagttgaaagaattgttcaaactggcggaggagtacggtttcggcgactggctccaattcgacgcttccgtcgtgagaggattagcgtattacaccggcgtcgtctttgaagcgttcgataaagccggcgagttgagagcgatcgccggtggtggtagatacgataagttgttatctttgtacggagcgacgacgccggtaccggcgtgcgggtttggtttcggcgattgcgtcatcgtcgaacttttgaaggagaaaaatttactcccaaacgtccaaaaaagggttgatttctgcgtctgcgcgtataacaaagacatgcaaggcaaggcgatgaaagcggcgggtttgttgaggcagacttctcctccttcgaatggtagtggtggtggtggtggtggtagtagtagtaacgatgatgacggagatggaaacattaatagcgccgacgaaaacaaaagactcgtcgtcgtcgacgtcctcctcgaaccgaaaaaaaaagtcgcgcaaaccttcgattacgccaaccgcatcggcgcaagatacgtcgtcttcgtcgccccttcggagtgggaaaacggatgcgtccgcataaaagatttacgagcggaagagtacgccgaagacgacgccgataaacaagtcgacgtgaaaatcgaagacttatggaacgctttagagcagatgcgagagaatgaaaatcgcgtgcgagcgaggagagggttcgcttccctttagcagagagagagagagagattcctgatcgatcgatcgaacgcgctttttacagcagacttttcttcataattttaactgttttcttcattcattcacgaacgaacgaacaanaatactaagcatcaccgaacaatcgcttcattnataacactnttcccataataatggcgagaatcagagacacctcgtacgacaaatccgtcgtctacgagccgagcgaagactccttcctcctcgccgatgccgtcgcggaggagatttggtctcgggaaaagaggaaggaatcgaacgcgttgagacgactcgatgacgacgatgaaaacgattttgatgatgaaaacgacgaggaggaagaagaatttgtcagcgtggaaatcggcgtcggttccgggtacgtgctgtgttcgcacgcgatgcggttttgcgaagaa

SEQ ID NO: 1256 - DNA, 4000 bp, Escherichia coli
  misc_feature (1)..(4): n is a, c, g, or t
  misc_feature (6)..(6): n is a, c, g, or t
  misc_feature (8)..(8): n is a, c, g, or t
  misc_feature (10)..(11): n is a, c, g, or t
  misc_feature (13)..(19): n is a, c, g, or t
  misc_feature (22)..(22): n is a, c, g, or t
  misc_feature (24)..(24): n is a, c, g, or t
  misc_feature (27)..(27): n is a, c, g, or t
  misc_feature (30)..(33): n is a, c, g, or t
  misc_feature (35)..(35): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (47)..(47): n is a, c, g, or t
  misc_feature (49)..(49): n is a, c, g, or t
  misc_feature (52)..(52): n is a, c, g, or t
  misc_feature (54)..(55): n is a, c, g, or t
  misc_feature (57)..(57): n is a, c, g, or t
  misc_feature (61)..(61): n is a, c, g, or t
  misc_feature (65)..(66): n is a, c, g, or t
  misc_feature (68)..(68): n is a, c, g, or t
  misc_feature (71)..(71): n is a, c, g, or t
  misc_feature (73)..(74): n is a, c, g, or t
  misc_feature (78)..(79): n is a, c, g, or t
  misc_feature (83)..(83): n is a, c, g, or t
  misc_feature (86)..(86): n is a, c, g, or t
  misc_feature (92)..(92): n is a, c, g, or t
  misc_feature (95)..(95): n is a, c, g, or t
  misc_feature (99)..(102): n is a, c, g, or t
  misc_feature (104)..(104): n is a, c, g, or t
  misc_feature (107)..(107): n is a, c, g, or t
  misc_feature (110)..(110): n is a, c, g, or t
  misc_feature (112)..(112): n is a, c, g, or t
  misc_feature (114)..(116): n is a, c, g, or t
  misc_feature (119)..(119): n is a, c, g, or t
  misc_feature (122)..(123): n is a, c, g, or t
  misc_feature (125)..(125): n is a, c, g, or t
  misc_feature (127)..(127): n is a, c, g, or t
  misc_feature (129)..(129): n is a, c, g, or t
  misc_feature (131)..(134): n is a, c, g, or t
  misc_feature (136)..(136): n is a, c, g, or t
  misc_feature (138)..(139): n is a, c, g, or t
  misc_feature (142)..(147): n is a, c, g, or t
  misc_feature (151)..(154): n is a, c, g, or t
  misc_feature (156)..(156): n is a, c, g, or t
  misc_feature (158)..(159): n is a, c, g, or t
  misc_feature (162)..(162): n is a, c, g, or t
  misc_feature (164)..(166): n is a, c, g, or t
  misc_feature (171)..(171): n is a, c, g, or t
  misc_feature (173)..(173): n is a, c, g, or t
  misc_feature (175)..(175): n is a, c, g, or t
  misc_feature (178)..(178): n is a, c, g, or t
  misc_feature (180)..(180): n is a, c, g, or t
  misc_feature (183)..(183): n is a, c, g, or t
  misc_feature (188)..(189): n is a, c, g, or t
  misc_feature (191)..(191): n is a, c, g, or t
  misc_feature (193)..(193): n is a, c, g, or t
  misc_feature (195)..(202): n is a, c, g, or t
  misc_feature (204)..(204): n is a, c, g, or t
  misc_feature (206)..(208): n is a, c, g, or t
  misc_feature (211)..(212): n is a, c, g, or t
  misc_feature (214)..(215): n is a, c, g, or t
  misc_feature (217)..(217): n is a, c, g, or t
  misc_feature (219)..(222): n is a, c, g, or t
  misc_feature (224)..(224): n is a, c, g, or t
  misc_feature (226)..(228): n is a, c, g, or t
  misc_feature (230)..(230): n is a, c, g, or t
  misc_feature (232)..(234): n is a, c, g, or t
  misc_feature (236)..(239): n is a, c, g, or t
  misc_feature (241)..(241): n is a, c, g, or t
  misc_feature (244)..(244): n is a, c, g, or t
  misc_feature (246)..(246): n is a, c, g, or t
  misc_feature (251)..(251): n is a, c, g, or t
  misc_feature (253)..(253): n is a, c, g, or t
  misc_feature (256)..(257): n is a, c, g, or t
  misc_feature (259)..(259): n is a, c, g, or t
  misc_feature (261)..(262): n is a, c, g, or t
  misc_feature (265)..(265): n is a, c, g, or t
  misc_feature (273)..(273): n is a, c, g, or t
  misc_feature (275)..(275): n is a, c, g, or t
  misc_feature (278)..(278): n is a, c, g, or t
  misc_feature (281)..(282): n is a, c, g, or t
  misc_feature (284)..(285): n is a, c, g, or t
  misc_feature (287)..(287): n is a, c, g, or t
  misc_feature (291)..(292): n is a, c, g, or t
  misc_feature (295)..(295): n is a, c, g, or t
  misc_feature (297)..(298): n is a, c, g, or t
  misc_feature (301)..(302): n is a, c, g, or t
  misc_feature (305)..(305): n is a, c, g, or t
  misc_feature (310)..(310): n is a, c, g, or t
  misc_feature (312)..(312): n is a, c, g, or t
  misc_feature (316)..(316): n is a, c, g, or t
  misc_feature (319)..(319): n is a, c, g, or t
  misc_feature (321)..(321): n is a, c, g, or t
  misc_feature (324)..(324): n is a, c, g, or t
  misc_feature (326)..(326): n is a, c, g, or t
  misc_feature (329)..(331): n is a, c, g, or t
  misc_feature (335)..(335): n is a, c, g, or t
  misc_feature (339)..(339): n is a, c, g, or t
  misc_feature (341)..(341): n is a, c, g, or t
  misc_feature (344)..(344): n is a, c, g, or t
  misc_feature (347)..(347): n is a, c, g, or t
  misc_feature (350)..(353): n is a, c, g, or t
  misc_feature (355)..(355): n is a, c, g, or t
  misc_feature (358)..(358): n is a, c, g, or t
  misc_feature (360)..(360): n is a, c, g, or t
  misc_feature (365)..(365): n is a, c, g, or t
  misc_feature (369)..(370): n is a, c, g, or t
  misc_feature (374)..(374): n is a, c, g, or t
  misc_feature (382)..(382): n is a, c, g, or t
  misc_feature (1981)..(1981): n is a, c, g, or t
  misc_feature (1986)..(1987): n is a, c, g, or t
  misc_feature (1995)..(1995): n is a, c, g, or t
  misc_feature (2465)..(2465): n is a, c, g, or t
  misc_feature (2645)..(2646): n is a, c, g, or t
  misc_feature (2648)..(2650): n is a, c, g, or t
  misc_feature (2723)..(2723): n is a, c, g, or t
nnnnangntnncnnnnnnnttngnaanaannnnanaaananttnttnanaananncnaaanaaanncnttngnntttnngaanttnaaaaanaanattnnnntnggnaanantnnnttnttnnantncncnnnntntnnccnnnnnngaannnntngnncanannngaaangnanaantnaanttttnnantncnnnnnnnnangnnncanngnntntnnnntngnnntngnnntnnnntnttngngtttngnaanngntnnaanaaaaaaananttntanntnncncaannggntnnggnnaanagagncnaaanaantntananaannngggngttngngtnaanaannnnanaananatttntaanntttnttcttctntccagacctaccctctcccctatagttactacttttttacttttacattttaagggatataggagattcatatgagaagtgccagagagatagttagccttattcgtaccgttcttatggaacacgaagaatactatgagcattgcagaccagaattaaaaaaatataaaaattcttatgagaataagttttgggaagataatttatataatgatggaatgattcgtgttgagacagcggattgtttttcttatgttgaaggatttatagcttcccttttttcgcgttctcctgctgttgtggtaggtaaagaccctgctatgacttcgggtaattctgacatggctagagaggttgtaaatcgttttttatttgagaagcgtgagcagatagagatagcttctagacttgctcttatttatccaaattcttttttaaaaatatctccaaaggaatctgaggatatgttggaaaaggttgacatccgtgcgatacctccttgggagattatttgtgatatggatgctacttcttgggattctcagagattttgcggtcatgtttattatttaacaatggctgaagccaaagctaaatttggtgctaaagatttttctcctattgcaaagcaagattattttgatacagaaagaaataattattatggtggaaagattgatgatttgcctgatgattatctttacattcaggttgtggaattttacgatttaagttatgataagttatatttctggacaccgaattggaaagacggtgagcagctattggaaaaaattcaaatacctctcaggacttatgatgatagacctttatctcctatttgtcctttatattttgctcgtaaacccgagcgtccaatgcaaggtttgtcggctgtcgcccgtgtatatgatcagttttatgaaaaaaatattcttagaacttattgggctaatgctgtgcgtcgtgattctcgtcagtatttatacaaagaaggtgcgttggacgaagaagccttagctaaagtttctgcaggtattgatggtgcaatggtagctgttgatgctcaatctttggaaggaataattaaacctttagatgttcctgctatatcttctaattttgatagatatcttggtcagattgaagctgatataaacagaggttctattttggctccattctctcgtggtgaagccacaaaggctaccgctacagagattacagccttagctcaatattctgcatctgagataggtaagatggcaagagaaaaagattcttctttagaattattggcaaaagtttatttaagagctatatctttgatggctgaagataatgaaaaagcaaccatagagattgatggttatcctcgtgtaattacagtaaaagatttggatgcaaagtttaaaattgtagctttagatcaagcctcaacacctctttcagattctataaagaaaaataacttggttcaaatggctggtacacttatacagcttggtgttcctcaaaagaaaattaaagatgaaattattcgtttatttgattttccaaaagattttgttgaggaagttgagcaaccacctcaacctnaagcnnaacaaggnatacctcaaacacctgaaggtgatgtgggacagcctgctggcgatatagggccatctggagagctacctgctgaacaactagctcagaatctattgcaaagacgtggagggtctatataatgcctatttatgaattcaaatgtggtcattgtaatcacaaacaatctggcttattttcttcttttgtttcatttgatgatagaaaactggaagattcatgtgaaagttgtcaaagttgtgattggcagccagcaatttctttgcctcaaaagcattcttcttgggaatccacaggaaaatggggtgtaaacggttatttttctggttctttgggtagatttgtagataatcctgccaaagaacgtgccattatggaaaaaaagggttttattgctgaatctgatttgccaaaaaactggtggagcgataaaactaaccaacaaaaagaaaaaattcaaaaacaagaccanttagccgaccaatatttggaaaaagttaagtctggtaagacaaaagaagaggctgtggccgaaacctggacagcaaaagatgctgtttctggtgaattagacaaaatttacgatacatcaataagtaaggagaattaaatgcctgataaaaaaataaatgctggaatgaaagaatttgannannnaagaatggaagacgaaatggccttttctgaagatatggctatgggaatgcctactggacagcctgaagaaacngaagttatgattatgatggccgaaggtgagcaatctgatgatgaaatgttcgctcaaatggctccaactggagacttttcaaagaatgctatgaatagattggtagatgcaacaaataaattgcttcctcttttcgaccaaacccctgattatccttcatttcctgatggtgtgcagcaattccctacagattttgttcgtgttttgggaatgtttcaaggagctattaacatggctgttgatgcaggcgagattcctgaagagatggatttcaacatggaagatatccaagatgacagaagcataatgatgcttgctggaaagatttctgctcttgcaaaaaataaagattttaaaagattcttggaaaatcctccaatggaagaagaagatcagatggaagaggaaatgactgaagaagaagaaatgggcgatgatgaaatggatgctctttttgcttctagggtttaattatgccaataaggatttctggcgctcagacaaccgttcctggagagattcttggttatgttataggagaccctaacacggtatccacacataacgtaacgacttcatatacggattttttgaatgaagtaacttttactgctgatagacgagctgcaattgttcaggctcagttttggattgaaaaaacttcttctggtgtcgaagaaataattatgaaattaaaagaagatggaacagatgtttctggatcggaaagaatgtttcatctttttcctgatccttcatattctggtcaggtaattacagcgcagtggattgttcagatgactgatggtgaagaatattcttttaaaatacaaattaagaaaacccaaaacgaaactgttagggtaagagctggacaaagttatcctccttatattttgcagataataggattataaaatgacaccaaatttattaacgcttttttttggagggtgcggacccgaaggttgcaagccaaaagataaaaaaagaaaagaaaaacccgaacctatgatgtctcgttccgaatttaaggaaacccaaaaatatacgcttgaaggacctcaagagcatgacatagcttatgagcagtataggtctaattggctgcgtagaaataaagaatacgagcaggaacaaagtcaaatggaagaagatgagacttatagaaggtctcaggaaagaaaacaagagcttgatgctttggagattccaagtttgcccacatccttaacaaaagaagattttaattctccaagatttaattctaagattct

SEQ ID NO: 1257 - DNA, 4000 bp, Escherichia coli
  misc_feature (66)..(66): n is a, c, g, or t
  misc_feature (270)..(270): n is a, c, g, or t
  misc_feature (408)..(408): n is a, c, g, or t
  misc_feature (672)..(672): n is a, c, g, or t
  misc_feature (692)..(692): n is a, c, g, or t
  misc_feature (741)..(741): n is a, c, g, or t
  misc_feature (769)..(769): n is a, c, g, or t
  misc_feature (783)..(783): n is a, c, g, or t
  misc_feature (809)..(809): n is a, c, g, or t
  misc_feature (979)..(979): n is a, c, g, or t
  misc_feature (1094)..(1095): n is a, c, g, or t
  misc_feature (3989)..(3989): n is a, c, g, or t
ggccgagcgcccgcgattgcgaccggcgtaaagctttcgaaccctgaattagatgtatgggtggtnaccggggatggagatggtctgagcattggcggcaatcacatgctgcatgtcttgcgccggaatgtggatctacaaattttgttgtttaacaacgaaatctacgggttgaccaaaggtcaatactcgccgacctcccaggttggcacacgctcaccgtcgacgccggatggatcggttgatttgccactgcggccctgcaccttngccttgggtgctggcgcaagatttgtcgcccgaacgatcgataccgaggccaagcatatgacgcccgtgctcaagcgagcgcacgcacataaaggcgcctcttttgtcgagatttatcaaaattgcccggtctataangacggcatcttcgactatattaaggataagaagtccgccgcggattcaagattggtgttggcgcatggcgagcccatgttatttggggttgataaccaaaaaggcctgcgattgaacacggccaccttgcaattagaggtcgtaacgctcggagaagcggacgtaaccgttgatgatattatggtgcacgatgagaccaatttggtcttggcccagatgttggcagcgctttcgacgccggactttccagaggccgttggcgtnctgtattgcaagcaagaagngtcttatgaaagttcagtttatgagcagattaaaacggttcgtgcaaanaagggtgtggtcgactttaatgaggtgntgcgtcggggtcanacttggacggtaagctgagcaaatgntttgagtcaataaaggccagcgcaagctggctttttattgtctcgaaattcgatctgtaaagggttgccagacagccggatactggaatgataggggttctaaatgactgattttaaagcagaagataatactggtaccgtgcctgtacaagcccgtcactatgtcgatntagaggcgctcaccgcgtttatgatggcatcggttgcgggctttcaaggccccatgagtattgaagaatttgcaggtgggcaatcaaacccaacgtatctgctaacaacccctgnncggcgatatgtgttgcggcgcaagcccccaggggagttgctcaaatcagcccatgcggtggatcgtgagtacaaagtgctcacgggtcttgcggatgcggatgtcccaacggccaggacttttgccttgtgcaccgatgattcggttatcggaacctggttttacgtaatggaatatttggatggacgggtgatatgggatgcaacgcacggtccttacgccccgcaagaacggtttgaaatctgggacgcggccaaccttgctgtcgccaaattgcacagcgttgattataagcaagtcggcttgagcgactttgggaaggaatctgattatatagcgcgacaattatcgcgatggggtggtcagtacgagtatacgaaaaccgttgataatccttacatggataacctgcttgcgtatttgccggccaatataccaagcagtaatgattgcaccatcgttcatggtgaccttcagattgcgaacatgatgatgcataaagatcgcaacgaagtgatcggtattctggattgggaactcagtaccctagggtgcccgatcgccgattttgcgtacctgtgccggccttatcgagatgctttgcggggcgtcgatgtcgcggccttggggatcccgtccgaggaggccttcgttgaggcttattgtgcgcggaccgggcgcgctgggatagccgaatgggattattatcttgcctttaacatgttcaaaatggcggcaatactacaaggcatcgccaagcgcgtgctggacggcacagcggccagtcagcatgccgaagctgccggcgctggggcgtttaatatggcgaaattggcctgggcgcaaattgactcgtctgtgaacctcgatgacctcgactaagcccgtctcattacttcatgacgggcaggtctggatccaactgaacgccaaaggtatttaaggccatcgacaccagctggtattgcccgaccgtaaagacgagatccatgagttgctgctgagagtagtggctggccagggcctgccaagttcggtcggtgacaaaggcgtcggctctgagttcgtccgcggcggtcaacagccaggcatcctgtggtccccagcttgggtcagttgggccgactttgatggcctcgatctccaaatcgctgagtccggctttctgcccgatgagcacgtgttgcccccactcgtagccagattggcatagccaaccgactctcaggatcagaatttctcgatcgcgcggggacaattttgacttgtggaggatgtggtttgcaaaaaccatccaacgtttggccaatgcttcatgattggccagggtcaaaaaaatattttggacgcgtccgcgcatgacctgaggcgccagcaacgctctctgggactcggtccagtcagattcctcaacaggattgattctcggttcggttaaacgcatgctaggtccttcttttgatgtgcgctctatactagcgcgaaagtgtcaaggtgtggcgcgcgacggcgccaccgtttactcaggagttgttatgccagattttattctccatcaatatgcgggatcgccgttctcagagaaagtaagactattgatgggctatcttgatttgcccagtcaacaggtcgaaatacccgtgattatgccgcgtcctcagttgatgcccctgacgggcggttatcggcgaacgcctgtcttacaacgcgggcgcgagatgtattgtgacacggcgctgattgcgaaaattctgatcgcccaaggcgaggggcaggcattgttgccccaagcgcaacgcgcggtgattgaaacggttgcctattgggcagacacatttttatttcgcgttgtcgtcgcggtggccttccagccgaaagcgctttccggtaatccgcttttcgaaagcgacgccgaggcggctgcttttatggcagatcgcgcagaattctcaaaggggtcaacggccttgcagatggatttggccgttgcgttgtcgcatttcgatctttggttacatcaaatgaacagtcagctgggggcccaagcctttttgtttgggcaggccccaacccttgcggacttctcggtttaccattgtctttggtttattgcggaacgcccggcgcttgttgccgacctggcggtctttccagaggtgatgcggtggttcgctcagatgacggcctttggccatggccgggttcagccaatgggcgcagaggatgctttgcagcttgcggcatcagaaccgtttttggcgaaacaaaaagtgctgtcgcccagcgtttcggtttgtccaatcgattacggcttgcaaccggttacgggggcgttggtcgaagccgagcatgtgcccgatgcctattctgttttaagagatgagccggggctgggtgaggtattggtgcatttcccgcggttagggtttcggtgcgtagatctttaatcccaacgctggataaattggttaatcacccttttaagacgatggggttgctcctcccaaatcgcgtggctggcgtctgggatttcatggaatacgccctgaggcagtcgcttggcgtatcgtgcgccggtttttggcgtggcctcgtcgtgctcaccgcaaacaatcaaggttgggcaatggacgtcttgaagacgatgggtttgatcaaagtcggcgagggtgccggttgctgagaattcgctgctaccccacatatgttgatagatggcggcgccccgaggattttttcgagccagcatcgcttttagcttcttgggtcgtctgaggacatggcggctgtaatacaaagcaagcgcctcttggtagaccaacgcatcggttgcgccaacggcttggcaggcttgaatcacgcgttgcgtgtctttgggtaaggctttgatcaancggttggcatc

SEQ ID NO: 1258 - DNA, 4000 bp, Escherichia coli
  misc_feature (604)..(604): n is a, c, g, or t
  misc_feature (883)..(883): n is a, c, g, or t
  misc_feature (937)..(937): n is a, c, g, or t
  misc_feature (1832)..(1832): n is a, c, g, or t
  misc_feature (1991)..(1991): n is a, c, g, or t
  misc_feature (2543)..(2543): n is a, c, g, or t
  misc_feature (3194)..(3194): n is a, c, g, or t
  misc_feature (3284)..(3284): n is a, c, g, or t
  misc_feature (3353)..(3353): n is a, c, g, or t
  misc_feature (3605)..(3605): n is a, c, g, or t
  misc_feature (3608)..(3608): n is a, c, g, or t
  misc_feature (3779)..(3779): n is a, c, g, or t
  misc_feature (3803)..(3803): n is a, c, g, or t
  misc_feature (3908)..(3908): n is a, c, g, or t
catttgtttgattttattttttctcatgatctatatttttaatcccatgtgtgtgtatttgacattcaagtaatctttaattgcacccgatccaccttcacgtccataaccagtttgttttattccaccaaaaggtgcctctgcaacagcaactgctccagtattgacagcaacacaacctgactctaacatttcagatcctctattagcctggtccattgaatttgtataaagataactgcataaacctaaatcgttatcgttagctctttctataacttcgtcaaaagttttaaatgttaaaactggaactagcggtccgaagggctcttctttcatgatagtaaaattatctttaacatcatcaaatacagttggttcgtaataatatcctttattgaaaccagaaggtctttttccacccattaaaactttagctccttcacttttagttgtttcaactagcttttctatttcttccagtctctttgcggtagaaagaggtcctaattctacaccttcgtccataccattacctatttttaatttttttgctctttccataaaagcacctacaaattcatcttttctactttcttgtatntaaaatctattaggagaaatacaaacttgtccattatttctaaatttagctgtaattgctatatcagctactttattcatatccacatcatcacaaacaataaatggtgagtggccacttaattccatagtcactctttgaactttatcagcagctttttttaaaattattttaccaactctagttgatcctgtaattgatacttttttaattatatcagactccattaattcatttgaaatttcagctggatctccagataaaagattaactactccntcaggtataccggcttctttacaaatatttactaactccataacagcaccaggngtaattacatctggtttacaaattacagaacatcctgcagctaatgctgtagaaatttttctagcagctaaaatgattggaaaattccaagggactaatgccgcaactacacctacaggctgataatagatatgagcccttgtatcaggaaatcttgtttgaacagtttgtccataaattctttttgtctcttctgcattccactcaaaaatatctgctccgccaccaacttctccgacaccttctgctaagggttttccaacttcaagcgttaaccattttgcaagaacatcttttctctctctcattaaatccgcaacttttcttattttgtaagatctctcccatggagttgtgtttttccagatctccaaacctttttcagcagattttaaagctttttgaacatctaacgaagatgcttttgatgcttttccaatcacttcctcagttgcaggattgattacgtcatatgtttcttttttttctgcttgttgccatttaccatcaatgaattgtccaaatttttcgtacatagattttttatttttaagtttacttaattaggttttttaatttataaatatatttatatataaacattacacacaatcaaagttaaacttaatttatgaaaaaaattacccttacatgtgcgcacgcgatagttaaatatttaatttctcaaaaaatattaattgatggcaagaaagaacctttgtttccaggtgtatttgggatatttggccacggaaacgtagcatgtctaggacaagcattagaagaaaatcaaaatgaacttccaacatatagaggtcatcatgaacaaaatatggctcttaccggaattggctatgcaagagcaaaacgaagacaacaaatttttgtagccacntcatcagttggacctggtgcaacgaatatggtgacagcagctggagttgctatgagtaatagactgccgattttatttttacctggtgacacttatgcaaatagaatgccagatccagtgcttcagcaagtagaacattttaataaccctggcattacngcaaacgatgcatttaaacccgttacaaggtattttgatcgtatcactagacctgagcaaattattcaatcatttccagcagcagttcaaacaatgttagatcctgctgattgcgggccagcatgtattgctttatgtcaagatattcaaggtcaaactttcgattatcctgaagaattcttcaaagaaagagttcacacaattagaagacctaggccagatgaatttcaagttaaagaagcagctgagaaaattaaatcttcaaaaaatccaataattatttctggtggaggagtattttattcagacgcaatggatgaattaagtaagtttgcaatcaaacataatatacctgtaacccaaacagttatgggttactcaacaatgaaaagagatcattcacattatgcaggccaaataggtgggttaggtggcaaaaatactaattcactcgctaagcaaacggatcttgccattgctgttggtactaagcttgcagattttaccactggttcttgggcaaattttgaaaatgaaaattttaaacttgtntcaataaatgtttcaagatttgatgcaaacaaacatttagcacaagcagtaattggagatgcaaaagtttctttagctgaattatctcaagctttgggtgattggaaagctggtgaagagtggaataaaaaatctcaaactgaacttaaagcttggaatgaagaagttgataaagcaagtgctccttcaaatcaggagataccaagttatgttcaggtaataggtgctgtctataaaaattctgatccctcagatatagcagtaacagctgcaggtggacttgtaggagaggttgttcaggtttggagacctagagaacttaacacacatgagacagaatggggctttagctgtatgagttatgaaatttcaggtgctcttggaattaaaatggcaaacccagataaagaagtcatttcatttataggagatggatcatacttgatgaataatactgatatctattcttcagttataactaacaacaagcttataattgttgtttgtgataatggaggttttgcagttattaataggcttcaattatttaagggtggtaaagaatataataatctactcaaaagttctaaaacaccaggtcttgttgacgttgattttgcaaaacatgcagaaagtatgggcgctaaatcngaacatgtaaactctatatctgaactggaagaagcatttaaaagagcaaaaaaatctgatgttacttatgtgatatcaattaagacacangcatatcaatggttggaaggttctgcattttgggatagcccaaccctagaaattccaacaacagaaganaataaagaagctataaaactttatcaagaaggtaagagcaaacaaagacaaggcgtataactttttatgaacaaaatatttaaagttggccttattggatgtggtcatatttcagaaacttatttcagagctgaaaaatattttaacaatattaaaatcattaagtgtgcagatatcaaccacagtaatgcagttagatgtgcaaaaacttataaaattaaggcattaactgtaaaagagcttttaaaaganaangaggttgaaatcattcttaatttaaccattcctaaagcacattatcaggttgcaaaacaagctttgataaatggaaaacatgtttactctgaaaaaccattggcaattaattttaacgatggaaaagatcttcttaaaatagcaaaaaagaaaaaactttatattggaaangctcctgatacttttttaggtggnggtattcagaaatcaaaagaattagtcgataaaaaaataataggaaaaataaatttaggaaatgcaatttttgcttttcctggagttcaatcttaccatccaaanccagaaccatggtttgctaaaaaagaaggtgggccagtaattgatatgggtccatactacttaaccgctttagttaatctattaggaccagc

SEQ ID NO: 1259 - DNA, 4000 bp, Escherichia coli
  misc_feature (234)..(234): n is a, c, g, or t
  misc_feature (301)..(301): n is a, c, g, or t
  misc_feature (326)..(326): n is a, c, g, or t
  misc_feature (358)..(358): n is a, c, g, or t
  misc_feature (373)..(373): n is a, c, g, or t
  misc_feature (381)..(381): n is a, c, g, or t
  misc_feature (1649)..(1649): n is a, c, g, or t
  misc_feature (2017)..(2017): n is a, c, g, or t
  misc_feature (2723)..(2723): n is a, c, g, or t
  misc_feature (2744)..(2744): n is a, c, g, or t
  misc_feature (2829)..(2829): n is a, c, g, or t
  misc_feature (2859)..(2859): n is a, c, g, or t
  misc_feature (2862)..(2862): n is a, c, g, or t
  misc_feature (2891)..(2891): n is a, c, g, or t
  misc_feature (2898)..(2898): n is a, c, g, or t
  misc_feature (2902)..(2902): n is a, c, g, or t
  misc_feature (2939)..(2939): n is a, c, g, or t
  misc_feature (3066)..(3066): n is a, c, g, or t
  misc_feature (3114)..(3114): n is a, c, g, or t
  misc_feature (3237)..(3237): n is a, c, g, or t
  misc_feature (3563)..(3563): n is a, c, g, or t
  misc_feature (3570)..(3570): n is a, c, g, or t
  misc_feature (3598)..(3598): n is a, c, g, or t
  misc_feature (3855)..(3855): n is a, c, g, or t
  misc_feature (3942)..(3942): n is a, c, g, or t
ttgggcgcgcggccacggcatcggtcgccgcatcgtcagcgaaatcgagcaattggcgcgcgagctcggtctcctcgtcctcaatctcgacctgcgcgatacccagcgcgcggcgacccatctctatgagacgctcggctaccgccgctggggcagccacccgttttacgcgctggtcgagggcgagttcgtgcccggccattattattataagcgcctcgacgaggcctctancgggcgccccgcctgacctcaatgtgaattctggtggaacagcgctgtgcgtccttcgactgctcgntgcgctcgcgctcaggatgaggcgncgcctctgatgccattaataatgtacttcatnctgagcagcgcccgnggcgcagnccgcgcgcgtgtcgaaggacgctggttggttatgccggcgagcctcgtccggtgatcctgtaccccgcgatcgatctgaaaggcggcgcctgcgtccgcctggtgcgcggcgagatggcgagcgcgaccgtcttcaacaccgatccggccgcgcaggcccggcatttcgccgaggcggggttttcctggctgcatgtcgtcgatctcgacggcgccttcgccggccattcggtgaatggcgaggcggtgcgtgcgatccgccaggcaatcgatctgaagatccagctcggcggcggcatccgcgaccgcgccgcgatcgacaattggctcgagctcggcatcgaccgggtcgtgctcggcaccgcggccttgcgcgatccgacactcgtgcgcgaagccggcgcggcctatcccggccaggtcgccgtcgcgatcgatgcgcgggacggccatgtcgccgtcgaaggctgggccaagacgagcgatatcggcgcgatcgctttggcccagcgcttcgccgatgctggggtcgccgcgctcgtctacaccgatatcgggcgcgacggcgccctgaccggcgtcgatgccgcggcgatcgccggcttcgcccgcttcgccggcctgccggtcatcgcctcaggcggcgtcgctgggctcgccgatatagaggcattgcgggaatacgagagagacggcgtcgccggggtgatctgcggccgcgcgctttacgacggccgcctcgacgcgcgcgccgcgttgcgcctggttgaagagggcgccaaaggggcatcagcatgctgaagatgcgcgtcattccttgcctcgacgtcaaggacggacgcgtcgtcaagggcgtcaactttgtcgatctgaccgatgccggcgatcccgtcgagcaggcgcgcatctacgatcgcgaaggcgcagacgaactctgctttctcgacatcactgcgagccacgaaggtcgcgacacgctctacgacgtcgtgcgccgcaccgccgagcaatgctttatgccgctgaccgtcggcggcggcgtgcgcacggtcgaggacatccgcaaattgctgctcgctggcagcgacaaggtatcgatcaacaccgccgcggtcgcgcaccccgaattcgtgcgcgaggcggccgagaaattcggcagccaatgcatcgtcgcggcgatcgacgcaaaggcggttgcgcccggtaaatgggaagttttcacccatggtggtcgccggccgaccggtatcgacgctgtcgaatgggcntgccgcctcactggttacggggccggcgagatcctgctgacctcgatggaccgagacggcaccaaatccggcttcgacatcgcactgacccgcgccgttgccgatgcggtgcgcgtgccggtcatcgcgtcgggcggagtcggcacactcgagcatcttgccgaggggattcgcgacggccacgccaccgcggttctcgccgcctcgatttttcacttcggcacattccgcatcggcgatgcgaagtcttatctcgccgcgcatcgaattccggtgcgcatgtgacgcgctgagcttgcgattctttgagattcgcgcttcgttgctaccggcggtctcgccagaaatgtgttctcttttaggttcgngcatttaagccgcgttaataattctgtgccgaatatctgagcgaattgacacttatgcagatgccgcccagactgatttcggctctgctcctgtaaaggtattgaggacgatggtggctgatcgccggattattgagtccgatcggcggcgtgccgccaaagcctcgctcggcgacagcctagagcagctgtggcgcatcatcgattcccgccgcaatgccgatcccgacacctcctacacggccaagctgctgatgcgcggccgccgcaaggcggcgcagaaactcggggaggaggcggtcgaggcggtcatcgaggcggtgcgccacgacaatgccgcgctgatcggcgaaagcgccgatctgctgtttcacctctttgtgctgtgggcctcatgcggcgtcacaccctctgaggtcgccgccgagctgatgcgccgcgaagggacttccggtcttgacgagaagcgcaaccgcaagaaataaccgccggcgccgcctcagacagacagcgcgtaattgacgagcttcttcgtcaaggtcgggaacgcaaatttcttgaacgcttccggccgcgcccagatgccgtccggcggcacattcgtccgcccggtcataagcgccagttcaagacggaaatgcgtaaagccgtgctgcacggtgccgggcaacgctgtccattccgttgcggccggtgccgcctcgancgcctccgcgtcgccccacgncaactcgcgccacggtgtcgagggtagttcgatcatgccgccgaggaggcccctctccgggcgtcgccgcaacatgaccgcgccntcctcgcgctcgagccagaacacgacgccntancgcagcggccgctccggtttctccacccncgccggnaggntctcctggatcccggtcgccgcggcggcgcaatcgcngcgccacgggcacaggacgcaacgcggtcgccgcggtgtgcacagcaccgcgcccagatccatcatcgcttgcgcaaaatcgccagcgcgctcctgcggcacgagcgccatcgcgagcgcccgcaanctcggcttcgcctgcggcaagggctcatcgaccgcgaatagccgcgcnacgacccgctcgacattgccgtcgacggccgcgctgcggtgatcaaaggcaatcgccgcgattgccgccgctgtatagtcgccaatccccggcaacttgcgcagcgccgccggatcctccggnaaatccccgccatgccgttcgacgacaaggcgggcgcaggcatgcaggttgcgggcccgggcgtaataaccgagcccctgccattcgtgcagcacctcatcgagattcgccgcagcgagcgagcgaacatcgggccagcgcgccacaaatcgggcaaaatagggagccaccgtgacgacggtcgtctgctgcagcatgatctcgctgagccagacgcggtacggatcggcggtctcgcccggtaatgcccgccagggcaattcgcggcggtggcggtcgtaccaggcgagcagtgctgccgcgtctgggagcgccgcgaatcgctnctgcgangatggttttgttatcggtgtgctggttnggatcggcgacatgaacgaggaacaggagaaagccgacgccaccctacccgcgagggacagccaagacgagcgccgcccagacgagagacgccccgacgagagacgccccgacgaacgccgccccggattgcgcgcggtcggccctctcgcctcgcggctcgccgccccggtcgtcgcgcggcatggcggcggcatcctcgcccggctgaaggcggattggccggccgtcatcggcgccgatatcgccgccgcgacntggccgcaggcgttgggccgcgatggcgtcctgaaattgcgggtcgccgccgcgacagcgctcgaactgcagcaccgcgcgccgctnctgatcgagcggatcaatgtctatctcggccggccggcaatatcgcggctcgtctttg

SEQ ID NO: 1260 - DNA, 4000 bp, Escherichia coli
  misc_feature (691)..(691): n is a, c, g, or t
  misc_feature (1684)..(1684): n is a, c, g, or t
  misc_feature (2636)..(2636): n is a, c, g, or t
  misc_feature (2803)..(2803): n is a, c, g, or t
aatcgcgtccattcttcgtaaagcgcactcgcgcgttctcacaatcgagcaagcaccccacgacgtcacctttcgtgaatgtttcgccgtaattttcaaaacttttattatgactcttcttcccggtgccaccgtagccgtacgaatgcgcatccgcgcctaaaccgtcgagcgccgcgaaccgactgccgaacccgacgcgacacaacccctcgtcccgcacttcaatctcataacacaccttaacgcgcgcgttctcgcccgacgagtctcgcacgcgcacaccgtacgtcccacgcacgcctgcccacgcgtgcgcggcgcgcgattgcatgaccccggtcgaaacgtcgcacgccgccgacgccgaccgcgccgtcgagctccacgcgcacctcttcccgagcgcctcatcgtcgttcgccacctcgcgcgcggcaaccacgcgcccgcggcgactctccacaatgctctcgtgcacgagctgcagcacgggcgcgccgaacgcgaacgttttccccgaaccagtctccgcgctcgccaatacgtcgccgccagtgagcaccagcggcacggcttcgctttgtatcggcgtcggaagcgtgaacgacgcgcggtcggcggcggcgatgagttcagggcataacccgagttcttcaaacgccgccatgtcgaccgcgcggcagtcagncagtcaggcgacagtcgcgcactgaagatagtcgacggcgttgagcgtgtttcagttcatcagtttcaactacaacctacgagcgccgacgcgaacgtctcgcttcttgtgctatgcgtgtgtgtgagtataaaatctacgtcaaatatcgtcatcaaccttgacgttggattcgttaaggatcgaggacgacgcgttcgatgacgtcagccgcctcgtccccgacgttcgcgcccttcccaaacgtcaaccgcatgttatacgcatcttcaccatccgcgtaatacttagcctcagtatccacgcactcgtactctaaaacatccctatacaaatgtatcgccgcttcgttgctcacgcgcacgtgtaaactcacgcacgtcgcgccgtagcattcgtccagggctttatgcgccgcgcgcatcaacgtcgccgccaacccaagcttacgatgcgtgcgcacgaccgcgagcgaggtaatatgcccccgcacctcatccgtgcactcctcatcgagcttggccaacacgtaccccaccaccgcgccgtccacgtccgcgacttgtaacaacgatggccagctcaacgcgtggtacaagtagtacttcatctgatagttttccggtaaacacagcaagttgcatcgctgcatggcccacaagtcatccaccgtagccgcgcgcacgcacacccccatcgttcgtcgtcgtgtgtcggcggcggcgtcgcacagtgccgcacatcgaggcgcaccgcccattcgcatcgccatccggtgctccatgcgtgcgtcgtgaacgcgccgcgcgtgtgcacagagctcgcgatgccgccgcacccgccgtcattgtcgtcgtccacgtcgcgcgcgtggcacacgctcgccgcggcgtgcgtcgtcgtcgtcctatgcgcgctgagttacgcgagcgatgatgggagcgcgcgcgtcgtcgtctcggtgctcgcgaaacctccacccgtggcggtgcncgcgtcgccgatctcgtgtgcgtccacggtggttgcgatcgatccgtcgtcggtgacgtcgccgtcgcgattcgacgtcgtcatcggtggatacgagttcttgactcgcgacgacgtggcgaaacatcacgcgtgggacttgaacttaccgctcgcgacgattgtgttctatcgtcgaacgcgggcagaggtgaaggcgagggcgtggcgatgcgcgagcggtatgacggcgatcgagcggttgatgtttccgaattacgggcgagatgcgtcggcgttctgggattgggcgatgtttcgttacgacgcgccgcctcgagcggtggcgtatttgcacgggcacggcgcgttggcgtggcatacgtcgtgtgagacggtgtttacgcgcataaagacgtattatgacgatatgttgcgcgtgcatggcgacgacgatggtggtgcgtatagtcgtaggattggtgggaataacgtcacggatgtagacgcggccgacgacgtcggctacgcgccagagtccatggtgacgctgtcgttcgcccgcgggcgacgagagacgccgttcgcgccgctagaatggaacggcggtcgtcggcgattgctgacggcgcgcacgaatagcgatgactcgtacgatgccgtggagacggcgaagtgcgtggatgtcttgcgaagcgtcaacgtgacgttaaagcccgccacggtgcggtcgtgttgtgggacgttcatcatgcctgggagattcattcgcggttacgcactcgaggtatacaaagcgttgtatgactccatcatggaccagtccatggatgacagcatttccgcgcgcgcgtgttttgagttcatcgtctacggcatgttctctgcgaataatctccccgcgcacgtcaaagcgccggatgtaaacctcaccgcgctctcgacgtggttcgaccgcgcgcacgcgcgcacncgagagttgaaaccggcgatgaaatcgtgcgaacgcaattataagtcgagcatgtttccatttctgccttatttgggagacgcccatcgacgcgtcttctttaacaaaatttggtttccagcccggcgatacgtgcaaggcgacgtgccgccgtgatgaaacgaaangaacactgtacaccatagcaccattcgcacgagcgccggtagtagcgatagcccatagcccgtagcccgatgcctcgttgaaatattcttctgttcaaatttcacccactcagcccacactctcccacgcgcacgcgcacgcatgcgcgccgccacgtcctcggcgcgttgcgacaccttcaccgcgctcgcgtcgacatcacgcgcgtcgtgctcgagccgacgccgcgcgcatcgtccgcgcgctcgccgtccgctcgcgtcctcagcctcgagtcctggatatgacgctcaagacgttgtcgacgctgacgacgacgtcacgcgcgacacgacggagatgactcgcgcgacgacgtgtgcgaggctgagtaatttcatatataagggcgcgtccacgccggcgtggttcaatggggatgggtttgaagttttagggagcggggtcaccggcgccacggcgtggtgcgcgtgcgagcgacggaacgaaagatacatcgttatacgcggcgcagcgtggagtcagcccgacacggataggaataagttgagttggcagattgccaaggtgtggccgatggcgctgaaacgaggcgtgcccgtggtggcgcatcaaggggtgatagagatggtggatgagttttggagagatgtggcgccgttcatcgaggatgagacttttacggggaagttttcatttacggggcattctttaggaggatctatggcgcttattatcgccgcgcgatgtcgtttagagctcggtattgcggaagaacgtatcatgcccgtgcgcacgtttgggtcgccaccagtattggcgtacgaccgcttgagcagccgcgggacggatgagtgcgcgggaacgatggatgacattttacgcctgtgtgggttttctaaaggatcgtccatggttcgccagtacgttctcgccaaagatatcattcctcgcatgtggcttagcgctgatccagtgtttagcgcggcgacaaagatggattttattgggtcggtgctcgattggcgagagcaaacgtttggcggcggcatgtttacgcgcaaccggttcttgtatcaaacgtgtggagatttgtactggttggagtatcaggccggagtggaggctaagcctttgctcacgcgccacactggcgaggatgtgctcgagaagctgcaaatggaactcgaggaagt

SEQ ID NO: 1261 - DNA, 4000 bp, Escherichia coli
  misc_feature (1992)..(1992): n is a, c, g, or t
  misc_feature (2596)..(2596): n is a, c, g, or t
  misc_feature (2607)..(2607): n is a, c, g, or t
  misc_feature (2612)..(2612): n is a, c, g, or t
  misc_feature (2619)..(2619): n is a, c, g, or t
  misc_feature (2640)..(2640): n is a, c, g, or t
  misc_feature (2650)..(2650): n is a, c, g, or t
  misc_feature (2652)..(2653): n is a, c, g, or t
  misc_feature (2655)..(2655): n is a, c, g, or t
  misc_feature (2659)..(2659): n is a, c, g, or t
  misc_feature (2662)..(2662): n is a, c, g, or t
  misc_feature (2667)..(2667): n is a, c, g, or t
  misc_feature (2681)..(2682): n is a, c, g, or t
  misc_feature (2686)..(2686): n is a, c, g, or t
  misc_feature (2688)..(2692): n is a, c, g, or t
  misc_feature (2694)..(2696): n is a, c, g, or t
  misc_feature (2698)..(2699): n is a, c, g, or t
  misc_feature (2702)..(2702): n is a, c, g, or t
  misc_feature (2708)..(2709): n is a, c, g, or t
  misc_feature (2711)..(2711): n is a, c, g, or t
  misc_feature (2721)..(2721): n is a, c, g, or t
  misc_feature (2723)..(2725): n is a, c, g, or t
  misc_feature (2727)..(2728): n is a, c, g, or t
  misc_feature (2732)..(2733): n is a, c, g, or t
  misc_feature (2735)..(2735): n is a, c, g, or t
  misc_feature (2737)..(2738): n is a, c, g, or t
  misc_feature (2742)..(2742): n is a, c, g, or t
  misc_feature (2744)..(2744): n is a, c, g, or t
  misc_feature (2747)..(2748): n is a, c, g, or t
  misc_feature (2751)..(2752): n is a, c, g, or t
  misc_feature (2756)..(2758): n is a, c, g, or t
  misc_feature (2760)..(2762): n is a, c, g, or t
  misc_feature (2767)..(2768): n is a, c, g, or t
  misc_feature (2770)..(2771): n is a, c, g, or t
  misc_feature (2774)..(2775): n is a, c, g, or t
  misc_feature (2780)..(2780): n is a, c, g, or t
  misc_feature (2782)..(2783): n is a, c, g, or t
  misc_feature (2790)..(2792): n is a, c, g, or t
  misc_feature (2797)..(2797): n is a, c, g, or t
  misc_feature (2801)..(2802): n is a, c, g, or t
  misc_feature (2804)..(2805): n is a, c, g, or t
  misc_feature (2807)..(2807): n is a, c, g, or t
  misc_feature (2809)..(2809): n is a, c, g, or t
  misc_feature (2811)..(2813): n is a, c, g, or t
  misc_feature (2815)..(2819): n is a, c, g, or t
  misc_feature (2821)..(2823): n is a, c, g, or t
  misc_feature (2828)..(2828): n is a, c, g, or t
  misc_feature (2830)..(2832): n is a, c, g, or t
  misc_feature (2837)..(2837): n is a, c, g, or t
  misc_feature (2842)..(2842): n is a, c, g, or t
  misc_feature (2844)..(2845): n is a, c, g, or t
  misc_feature (2851)..(2854): n is a, c, g, or t
  misc_feature (2856)..(2856): n is a, c, g, or t
  misc_feature (2858)..(2858): n is a, c, g, or t
  misc_feature (2860)..(2861): n is a, c, g, or t
  misc_feature (2867)..(2869): n is a, c, g, or t
  misc_feature (2874)..(2874): n is a, c, g, or t
  misc_feature (2876)..(2881): n is a, c, g, or t
  misc_feature (2884)..(2884): n is a, c, g, or t
  misc_feature (2886)..(2887): n is a, c, g, or t
  misc_feature (2889)..(2891): n is a, c, g, or t
  misc_feature (2893)..(2893): n is a, c, g, or t
  misc_feature (2895)..(2896): n is a, c, g, or t
  misc_feature (2898)..(2900): n is a, c, g, or t
  misc_feature (2902)..(2903): n is a, c, g, or t
  misc_feature (2908)..(2909): n is a, c, g, or t
  misc_feature (2911)..(2911): n is a, c, g, or t
  misc_feature (2917)..(2917): n is a, c, g, or t
  misc_feature (2921)..(2921): n is a, c, g, or t
  misc_feature (2923)..(2924): n is a, c, g, or t
  misc_feature (2928)..(2928): n is a, c, g, or t
  misc_feature (2930)..(2931): n is a, c, g, or t
  misc_feature (2933)..(2933): n is a, c, g, or t
  misc_feature (2935)..(2935): n is a, c, g, or t
  misc_feature (2937)..(2938): n is a, c, g, or t
  misc_feature (2942)..(2942): n is a, c, g, or t
  misc_feature (2944)..(2944): n is a, c, g, or t
  misc_feature (2952)..(2952): n is a, c, g, or t
  misc_feature (2965)..(2965): n is a, c, g, or t
  misc_feature (2972)..(2972): n is a, c, g, or t
  misc_feature (2976)..(2976): n is a, c, g, or t
  misc_feature (2998)..(2998): n is a, c, g, or t
  misc_feature (3002)..(3002): n is a, c, g, or t
  misc_feature (3013)..(3013): n is a, c, g, or t
  misc_feature (3015)..(3016): n is a, c, g, or t
  misc_feature (3018)..(3018): n is a, c, g, or t
  misc_feature (3027)..(3027): n is a, c, g, or t
  misc_feature (3031)..(3031): n is a, c, g, or t
  misc_feature (3035)..(3037): n is a, c, g, or t
  misc_feature (3042)..(3042): n is a, c, g, or t
  misc_feature (3044)..(3045): n is a, c, g, or t
  misc_feature (3047)..(3048): n is a, c, g, or t
  misc_feature (3057)..(3057): n is a, c, g, or t
  misc_feature (3064)..(3064): n is a, c, g, or t
  misc_feature (3084)..(3084): n is a, c, g, or t
  misc_feature (3086)..(3088): n is a, c, g, or t
  misc_feature (3090)..(3093): n is a, c, g, or t
  misc_feature (3095)..(3104): n is a, c, g, or t
  misc_feature (3106)..(3107): n is a, c, g, or t
  misc_feature (3110)..(3111): n is a, c, g, or t
  misc_feature (3113)..(3113): n is a, c, g, or t
  misc_feature (3115)..(3116): n is a, c, g, or t
  misc_feature (3125)..(3125): n is a, c, g, or t
  misc_feature (3130)..(3130): n is a, c, g, or t
  misc_feature (3134)..(3134): n is a, c, g, or t
  misc_feature (3136)..(3136): n is a, c, g, or t
  misc_feature (3140)..(3140): n is a, c, g, or t
  misc_feature (3144)..(3145): n is a, c, g, or t
  misc_feature (3147)..(3150): n is a, c, g, or t
  misc_feature (3152)..(3155): n is a, c, g, or t
  misc_feature (3163)..(3163): n is a, c, g, or t
  misc_feature (3165)..(3165): n is a, c, g, or t
  misc_feature (3167)..(3168): n is a, c, g, or t
  misc_feature (3171)..(3172): n is a, c, g, or t
  misc_feature (3174)..(3176): n is a, c, g, or t
  misc_feature (3181)..(3181): n is a, c, g, or t
  misc_feature (3183)..(3183): n is a, c, g, or t
  misc_feature (3185)..(3186): n is a, c, g, or t
  misc_feature (3188)..(3189): n is a, c, g, or t
  misc_feature (3191)..(3191): n is a, c, g, or t
  misc_feature (3199)..(3199): n is a, c, g, or t
  misc_feature (3204)..(3208): n is a, c, g, or t
  misc_feature (3210)..(3210): n is a, c, g, or t
  misc_feature (3218)..(3218): n is a, c, g, or t
  misc_feature (3223)..(3224): n is a, c, g, or t
  misc_feature (3226)..(3227): n is a, c, g, or t
  misc_feature (3229)..(3229): n is a, c, g, or t
  misc_feature (3234)..(3235): n is a, c, g, or t
  misc_feature (3237)..(3237): n is a, c, g, or t
  misc_feature (3242)..(3242): n is a, c, g, or t
  misc_feature (3244)..(3245): n is a, c, g, or t
  misc_feature (3258)..(3258): n is a, c, g, or t
  misc_feature (3261)..(3262): n is a, c, g, or t
  misc_feature (3264)..(3264): n is a, c, g, or t
  misc_feature (3272)..(3273): n is a, c, g, or t
  misc_feature (3275)..(3275): n is a, c, g, or t
  misc_feature (3277)..(3278): n is a, c, g, or t
  misc_feature (3280)..(3281): n is a, c, g, or t
  misc_feature (3283)..(3283): n is a, c, g, or t
  misc_feature (3291)..(3291): n is a, c, g, or t
  misc_feature (3296)..(3296): n is a, c, g, or t
  misc_feature (3299)..(3300): n is a, c, g, or t
  misc_feature (3304)..(3305): n is a, c, g, or t
  misc_feature (3322)..(3322): n is a, c, g, or t
  misc_feature (3324)..(3324): n is a, c, g, or t
  misc_feature (3327)..(3327): n is a, c, g, or t
  misc_feature (3330)..(3331): n is a, c, g, or t
  misc_feature (3333)..(3334): n is a, c, g, or t
  misc_feature (3339)..(3339): n is a, c, g, or t
  misc_feature (3342)..(3345): n is a, c, g, or t
  misc_feature (3348)..(3348): n is a, c, g, or t
  misc_feature (3350)..(3350): n is a, c, g, or t
  misc_feature (3363)..(3363): n is a, c, g, or t
  misc_feature (3365)..(3365): n is a, c, g, or t
  misc_feature (3373)..(3373): n is a, c, g, or t
  misc_feature (3376)..(3376): n is a, c, g, or t
  misc_feature (3378)..(3378): n is a, c, g, or t
  misc_feature (3396)..(3396): n is a, c, g, or t
  misc_feature (3403)..(3408): n is a, c, g, or t
  misc_feature (3414)..(3414): n is a, c, g, or t
  misc_feature (3416)..(3420): n is a, c, g, or t
  misc_feature (3423)..(3425): n is a, c, g, or t
  misc_feature (3428)..(3429): n is a, c, g, or t
  misc_feature (3431)..(3432): n is a, c, g, or t
  misc_feature (3435)..(3436): n is a, c, g, or t
  misc_feature (3439)..(3445): n is a, c, g, or t
  misc_feature (3452)..(3452): n is a, c, g, or t
  misc_feature (3454)..(3454): n is a, c, g, or t
  misc_feature (3456)..(3457): n is a, c, g, or t
  misc_feature (3465)..(3465): n is a, c, g, or t
  misc_feature (3467)..(3468): n is a, c, g, or t
  misc_feature (3473)..(3473): n is a, c, g, or t
  misc_feature (3475)..(3479): n is a, c, g, or t
  misc_feature (3481)..(3482): n is a, c, g, or t
  misc_feature (3484)..(3484): n is a, c, g, or t
  misc_feature (3486)..(3486): n is a, c, g, or t
  misc_feature (3488)..(3491): n is a, c, g, or t
  misc_feature (3493)..(3493): n is a, c, g, or t
  misc_feature (3495)..(3496): n is a, c, g, or t
  misc_feature (3501)..(3503): n is a, c, g, or t
  misc_feature (3506)..(3506): n is a, c, g, or t
  misc_feature (3508)..(3511): n is a, c, g, or t
  misc_feature (3514)..(3517): n is a, c, g, or t
  misc_feature (3521)..(3521): n is a, c, g, or t
  misc_feature (3525)..(3526): n is a, c, g, or t
  misc_feature (3528)..(3529): n is a, c, g, or t
  misc_feature (3532)..(3533): n is a, c, g, or t
  misc_feature (3535)..(3535): n is a, c, g, or t
  misc_feature (3541)..(3542): n is a, c, g, or t
  misc_feature (3544)..(3544): n is a, c, g, or t
  misc_feature (3546)..(3547): n is a, c, g, or t
  misc_feature (3552)..(3554): n is a, c, g, or t
  misc_feature (3561)..(3562): n is a, c, g, or t
  misc_feature (3566)..(3566): n is a, c, g, or t
  misc_feature (3572)..(3572): n is a, c, g, or t
  misc_feature (3574)..(3575): n is a, c, g, or t
  misc_feature (3577)..(3579): n is a, c, g, or t
  misc_feature (3584)..(3584): n is a, c, g, or t
  misc_feature (3586)..(3587): n is a, c, g, or t
  misc_feature (3590)..(3590): n is a, c, g, or t
  misc_feature (3592)..(3593): n is a, c, g, or t
  misc_feature (3599)..(3600): n is a, c, g, or t
  misc_feature (3602)..(3603): n is a, c, g, or t
  misc_feature (3614)..(3615): n is a, c, g, or t
  misc_feature (3620)..(3620): n is a, c, g, or t
  misc_feature (3622)..(3622): n is a, c, g, or t
  misc_feature (3626)..(3626): n is a, c, g, or t
  misc_feature (3630)..(3630): n is a, c, g, or t
  misc_feature (3638)..(3638): n is a, c, g, or t
  misc_feature (3648)..(3648): n is a, c, g, or t
  misc_feature (3651)..(3651): n is a, c, g, or t
  misc_feature (3655)..(3656): n is a, c, g, or t
  misc_feature (3658)..(3659): n is a, c, g, or t
  misc_feature (3662)..(3663): n is a, c, g, or t
  misc_feature (3665)..(3665): n is a, c, g, or t
  misc_feature (3667)..(3667): n is a, c, g, or t
  misc_feature (3669)..(3672): n is a, c, g, or t
  misc_feature (3679)..(3680): n is a, c, g, or t
  misc_feature (3684)..(3686): n is a, c, g, or t
  misc_feature (3688)..(3689): n is a, c, g, or t
  misc_feature (3691)..(3691): n is a, c, g, or t
  misc_feature (3693)..(3693): n is a, c, g, or t
  misc_feature (3699)..(3701): n is a, c, g, or t
  misc_feature (3703)..(3704): n is a, c, g, or t
  misc_feature (3708)..(3708): n is a, c, g, or t
  misc_feature (3710)..(3710): n is a, c, g, or t
  misc_feature (3713)..(3714): n is a, c, g, or t
  misc_feature (3719)..(3720): n is a, c, g, or t
  misc_feature (3722)..(3723): n is a, c, g, or t
  misc_feature (3725)..(3726): n is a, c, g, or t
  misc_feature (3733)..(3734): n is a, c, g, or t
  misc_feature (3736)..(3737): n is a, c, g, or t
  misc_feature (3741)..(3742): n is a, c, g, or t
  misc_feature (3744)..(3746): n is a, c, g, or t
  misc_feature (3751)..(3751): n is a, c, g, or t
  misc_feature (3753)..(3753): n is a, c, g, or t
  misc_feature (3756)..(3756): n is a, c, g, or t
  misc_feature (3758)..(3759): n is a, c, g, or t
  misc_feature (3761)..(3762): n is a, c, g, or t
  misc_feature (3766)..(3768): n is a, c, g, or t
  misc_feature (3770)..(3770): n is a, c, g, or t
  misc_feature (3772)..(3772): n is a, c, g, or t
  misc_feature (3777)..(3777): n is a, c, g, or t
  misc_feature (3782)..(3782): n is a, c, g, or t
  misc_feature (3784)..(3785): n is a, c, g, or t
  misc_feature (3787)..(3787): n is a, c, g, or t
  misc_feature (3789)..(3790): n is a, c, g, or t
  misc_feature (3794)..(3794): n is a, c, g, or t
  misc_feature (3796)..(3797): n is a, c, g, or t
  misc_feature (3799)..(3800): n is a, c, g, or t
  misc_feature (3802)..(3807): n is a, c, g, or t
  misc_feature (3809)..(3810): n is a, c, g, or t
  misc_feature (3812)..(3815): n is a, c, g, or t
  misc_feature (3817)..(3817): n is a, c, g, or t
  misc_feature (3819)..(3820): n is a, c, g, or t
  misc_feature (3824)..(3825): n is a, c, g, or t
  misc_feature (3830)..(3830): n is a, c, g, or t
  misc_feature (3832)..(3832): n is a, c, g, or t
  misc_feature (3834)..(3840): n is a, c, g, or t
  misc_feature (3842)..(3842): n is a, c, g, or t
  misc_feature (3847)..(3848): n is a, c, g, or t
  misc_feature (3850)..(3851): n is a, c, g, or t
  misc_feature (3853)..(3853): n is a, c, g, or t
  misc_feature (3858)..(3859): n is a, c, g, or t
  misc_feature (3862)..(3864): n is a, c, g, or t
  misc_feature (3866)..(3867): n is a, c, g, or t
  misc_feature (3870)..(3871): n is a, c, g, or t
  misc_feature (3874)..(3877): n is a, c, g, or t
  misc_feature (3879)..(3880): n is a, c, g, or t
  misc_feature (3883)..(3884): n is a, c, g, or t
  misc_feature (3886)..(3887): n is a, c, g, or t
  misc_feature (3889)..(3889): n is a, c, g, or t
  misc_feature (3891)..(3891): n is a, c, g, or t
  misc_feature (3895)..(3895): n is a, c, g, or t
  misc_feature (3899)..(3899): n is a, c, g, or t
  misc_feature (3906)..(3907): n is a, c, g, or t
  misc_feature (3909)..(3910): n is a, c, g, or t
  misc_feature (3915)..(3915): n is a, c, g, or t
  misc_feature (3917)..(3918): n is a, c, g, or t
  misc_feature (3923)..(3923): n is a, c, g, or t
  misc_feature (3925)..(3926): n is a, c, g, or t
  misc_feature (3928)..(3928): n is a, c, g, or t
  misc_feature (3930)..(3931): n is a, c, g, or t
  misc_feature (3933)..(3934): n is a, c, g, or t
  misc_feature (3940)..(3941): n is a, c, g, or t
  misc_feature (3943)..(3943): n is a, c, g, or t
  misc_feature (3945)..(3945): n is a, c, g, or t
  misc_feature (3947)..(3948): n is a, c, g, or t
  misc_feature (3956)..(3956): n is a, c, g, or t
  misc_feature (3958)..(3959): n is a, c, g, or t
  misc_feature (3961)..(3961): n is a, c, g, or t
  misc_feature (3963)..(3963): n is a, c, g, or t
  misc_feature (3965)..(3965): n is a, c, g, or t
  misc_feature (3967)..(3968): n is a, c, g, or t
  misc_feature (3974)..(3976): n is a, c, g, or t
  misc_feature (3978)..(3978): n is a, c, g, or t
  misc_feature (3980)..(3980): n is a, c, g, or t
  misc_feature (3982)..(3984): n is a, c, g, or t
  misc_feature (3986)..(3988): n is a, c, g, or t
  misc_feature (3990)..(3991): n is a, c, g, or t
  misc_feature (3993)..(3994): n is a, c, g, or t
  misc_feature (3997)..(4000): n is a, c, g, or t
cataaattatttttaatttattaccactttaaatgcaataagtctttattataaaaaataataataataataataataaattaaaatatatatatatcaaataatttttataaataatttttataattttctactacttaattttaattaaaacataaaatatattataataattattttggaaaaacgtactttatattttaaataatcaaagataatttttttttttaatttgtcaattttcattttatattctattaattaatgaattattaaattaaattattatatatatacattatacattataaaattaatattaggtccaacaaattaatgtaatgtattaagcatcatatatttttacctttaattatttaattaaatattaatttttattattattgaactttgattattcattattatttattttatatattaactgttcattcacctaataatagtaataatattttaatttcattaataatataataataagtatagtatatatttatttattttgttttgttttattttattttacttttttttttatattagtattttcacgactattataacgatatgaaataaatgaaattaatataaaggcttatttttcaaataattaaatatttatattaacaactaattttaattctaataatgagttttttaataatttaaaataatatatatatatataaattatatattacataatttatatgatatataataatattaattaagatgttgaatttgtgataaagaatttttcttataatttaaaattctctaataataacctttttttttcctaactgcgagttgtgaactcgtttttttttttttagacccgagttaacgagaaagaaggacgagaggatctccagtctctcccttaaacatatcaaactctcattggataccgtttgggcattgacccggacctctctctaagcaaagttaatataaaagacattctctatacgaaaggcttcttttcaattatctcttgaactatcatagtgggaggaataactacactaatcttctcacagaacaagctaacatttacatagtctaataacaggaatatctaccatggtgagagaacatccaacttcatttgtaggggaaaacaccctaggaggattaaaatttccttatataaacttaaaaggtaatcactgggtcgatctagaaaccttaagtgtgttagttctaagtactaaccacaaaagacatacgatcatagtatttgttatagtagtcttatttataaatacttaataagtattttaaatcataaaaaaaaaagtaaaatgttaaattacagataaagaagaactgaatacaatagaatattaatataaacctatgaaaaattttaacattttattatttatggagtcttgcattattagttttgaaaatttaaaaaaaaaaaaaaatttataaacctattaaactttttataatttattattgtttattaaaattttaaattattataattacacagtcattattttattaataaccatatgaatcttgcaaagttacacaagttatattttcatagtaacctattattttatttaaaacaataaaaatagaaatatataaataattttttgaaatatttattatactttatgttattaattattttttttaataataatttagtataatatatattattatatttaaaatatagcattgtaaccatagtaatttttatttaaaaaacaaaacaatcaattattaatttttttatgacaaaaaaaaagcatccaaacatcgaaccttttgttatatttaaaaataattctttatcatagtatatctatacttttcacaaattttttttcattaagcattagaacaaataaacattgatttatagttatttagtattaaagttatgtttacaatgctttaaattaaattcttttttttttttttttgtagattttnttttttatttttatattctttttaataatattattaaattttaaaaaatatataaatatataataataaactgttttgacaaatagatatttaggtatcataaacaagttaggaaagaaaattaattatttaaaataatatctattttaatattaagtttaattatgatttattagtagttttttcacatgtatcttttaaacatcataaggaccttcgaaaataaatataattaatattataccttttattatttttttaattattttgtattttatcaatttcaattttttttataatattgtttgataaaagtaattattactcttttaacattataacttttttgttaattcaaacaaataaaagaattctctaatacctcaataccttaaaatatgcatacataaaatattcattatttgaaaactctattataataaattttataaaattgtcattaattctcaacagatgataatctctaattttgtaatcattttaatataattttaaatatcatactatctttatataattttatgttttttaaaagtattttttttttaaaaaaaaaaaaaaaaaaaaaaaaaaaaaaaaaaanttttttttttntatanttttttntaaaaaaaaatataaaaaaantttttataanannantttnaanatatnttatattttttttnntttntnnnnntnnnannatntgaaanntntaaaaaaaanannntnnaaanntntnnaaananatnntannatannnannntttanncnncannatatnannataaaannntttantttnnannantnannngnnnnnannnctttntnnnaaaanatatnannaaaatnnnnanantnntaaacnnnaaatncnnnnnnctnannannntntnntnnntnntttannantttttntttntnntttntnntntntnntttntnaaaatttntatatatataaanataaaanaaanatatatatatataaatttaaantttntaaaattttantnntnaaatttttntatnaaannntaaanannannaaatttttntttaaanattttttaaaaaaaaaaaanannnannnntnnnnnnnnnnannatnntnannaaaaaaaanaaaanatantnaaanaaannannnntnnnnaaaaaaananannatnntnnnaaaanantnntnntnaaaaaaanaaatnnnnntnaaaaaaanaaatnntnntnaaatnntnaaaanannattttaaaaaaanatnntnaaaaaaannantnntnntnaaaaaaanaaaanatnntaannataaaaaaaaaaaaaanancanaannannaaaanaannnnttntntaaaaatatatananatatatanaananaaaaaaaaaaaaaaaaanaaaaaannnnnnaaaaanannnnnaannnaanntnnaannttnnnnnnnttttttntntnntttaaaanannatatncnnnnnannantncnnnnantnntcccnnngangnnnntannnntttntttnnanntcnntnaaaagnnantnntaaannntatttannatanaaaaananntnnnttttntnntantnnttttannannaaaaattttannttttntnaaanaaanataaaaanaaaaattttntanaaannannatnntnantnnnngaaaatnntttnnnannananaaaatnnnannaaananatnntaaanntnntnntttttanngnnaaanntnnngaaananatnannanngtgnnnangnttttnaaaangnngntnntttncnngnngnnnnnncnntnnnnantnntctnnttttntntnnnnnnnanaaatnntnngnaaaanntgnnnannatnntcnnnntnntanngnnantnaaanaaanaaaaatnntnnttttntnntttantnntnannannataaannantnannatataaantnntnantnannatatannntnangnnnannntnntnntannnn

SEQ ID NO: 1262 - DNA, 4000 bp, Escherichia coli
  misc_feature (342)..(342): n is a, c, g, or t
  misc_feature (390)..(390): n is a, c, g, or t
  misc_feature (662)..(662): n is a, c, g, or t
  misc_feature (1012)..(1012): n is a, c, g, or t
  misc_feature (1271)..(1271): n is a, c, g, or t
  misc_feature (1273)..(1273): n is a, c, g, or t
  misc_feature (1961)..(1961): n is a, c, g, or t
  misc_feature (1988)..(1988): n is a, c, g, or t
aaaagtggaggaagcgtaatgggtcttagattaaatgaattatcaccaggtgttggcgcaaagaaaactgcccaacgtcgtggtcgtggtatcggttcaggtcttggtaagactggtggtcgtggtgtaaaaggtcagaaatctcgttcaggttctagcattcgctcaggatttgaaggtggtcaaatgcctttatatcgtcgtctaccaaaatttggttttaccagtaaactggctatgaagactgctgaagtacgtctttctgaactgaataaaattgaaggcgatgtagttagccttgaaacacttaaagctgctaaccttatccgtcacgatatgaancgtgctcgtgtaatgctatcaggcgaagtcactaaagcttatactttnaaaggtattaaagtgactaaaggtgctaagcaagctatcgaagctgctggtggtagcatcgaggagtagtaacgtgtcaaaacaatcaatgtcatcggctggtataccgcttaatccattcgcatttatacgtaagtatgatgagctatggacgcgtttattatttttaatcggcgcattgattgtttatcgtttagggtcacatattccagttccgggtattaacccagttaacttggctgatctgttttcgcgcaacgaaaacaccattntgagcatgtttaatatgttctcaggtggtgcgctagagcgtatgtctatcatggcacttggcattatgccatatatctcagcatcgattatcgtacagatgatgtctgcagtattgccatcgcttgaagccctcaaaaaagaaggtgaagcgggacgacgcaagctaaacaagtatacccgtcagggaacgcttgctttagccctagtacagtcattaggaatgtgtgccggcttaatcagccaaaaccttactttatctactggtcttaccttttatattccagctgttacttctttagtagcaggcgcaatgttcttaatgtggcttggtgagcagattacagaacgnggcgtaggtaatggtatttcaatgctcatttttgcgagtattgtggctggtacgccaggtatgatttcgcagtctattgaacaggtcaatcaaggtcagatgaacttgattgtgctatttatttttgtactgctaggtatcgcggttactgcgggtatcgtttatattgaacgtgctcaacgccgtgttcctgtgaactatgcacaaaaacagcaacaaggtcgcaaaatttatgctcagcagcaatcacatttgccgntnaagctaaatatggcaggggttatcccagctatttttgccagttctttgttattgtttcctgcaagtttagggcagtgggttggtcaatcgactgatcctacctttgtacagaaaatacttcaaaatatggcattggtgttgtctccagggcagccgctatatttagtactgtttggcgcaatgattattttcttctgttatttttatacggcattggtatttagtccgcgtgaagtagcagagaaccttaaacgtagtggtgcgtatatcccaggtattcgcccaggacaacaaactcagcgttacctcgatcatgtattaaaccgactgacctttattggcgcgatgtatatgacggttatttgtttaatgccaatggtcgtccagtcatcgtttggtgtgccgtttcaactcggtggtacgtctttactgattatggtggttgtggtaatggacttcatctcgcagattcaagcgcatttgatgacccatcaatatcatgatcagacgttaattcaatcgcccactcaaccttaaatgagcggtacgatatttcaaggagcatgctatgaaagttcaagcatcagttaaaaagatttgtggtagctgtaaagttgtgcgccgtaaaggccgtgtacatattatttgtacagcagaacctcgccacaagcaacgtcaaggttaatanttagtattagaaaacatctagttttcnctgctaattaaattaatacttgaaaaataacggcggatgcgatatcatccgccacttgccgtgtttatacaaaatcttttataatagaatcgatgagcagacttatagtcaaaacatcgataatgactataaaagctctagtattaacagcaacaaatctgaagagtaaagccttatcgctagataacgcttatttttctttaatggagagaaatcaatggctcgtattgccggcgtaaacattccggataataagcatgctgttatttcactaacttacatctttggtgtaggtcgtaccactgctcagaaaatcttagaagcagttggcatcgcccctactactaaagtcagtcagttagatgatacacagttagatgctatccgtgcacaagttgcaaactacatgactgaaggtgaccttcgtcgtgaagtttcaatgaacatcaagcgtttagttgatcttggttgttaccgtggcatccgtcatcgtcgtaacctaccagttagaggtcagaacaccaagaacaacgctcgtactcgtaagggtccgacacgccctctcaaaagataattaacttaggaagctaaaagatggcaaaagacactcgcagtcgcaaaaaggtggctcgtcgttcagtatcggagggcattgcccatatccatgcgtcttttaataacaccattgttacgattaccgatcgtcaaggtaatgcattggcttgggccacttcaggtggacaaggcttccgtggttcacgtaaatctacaccatttgcagctcaggttgcagctgaagtcgctggtaaagcggcccaagaatatggtgttaagaatatcgatgttttggtcaaaggaccaggaccgggtcgtgagtctgcggtaagagcactaggtgcattgggttataaagttaacagcatctctgatgtaaccccaatcccacacaatggttgccgtgcgccgaaaaagcgccgcgtctaatattaaagacgaagctttttatactaaaagcttataggagacataacaatggcccgctatattggaccaaaactgaaattatcacgtcgtgaaggtacggatttaggccttaagtctggcgttaaaccgtatgacgtaaaaacgaagaaagctggtcgtccaccaggtcagcatggcgtaagccgtaacaagacctcagaatatgctctacagttgcgtgaaaagcaaaaagttaagcgtatttatggtgtactagagcgtcaattcgcgaactactataaagaagctgctcgtaagcgtggcgctactggtgaaaacttgctagcaatgcttgagagccgtctagataacgttgtatatcgcatgggctttggctcaactcgcgcagaagcacgtcagctagtcagtcatcgtactgttatggtaaaaaaagctggccgtgatgagtttgttcgtgtgaacattccttcaattcagcttcaagatggtgatgtcatcgctatccaagagaaatctcgcgaacagctacgtattaaaaacgctatcgaattagcgacacaacgtggtattccagaatggcttgatgttgaccacagcaaactacaaggcacgtttaaacatgcgcctgatcgtattgatctacctgctgaaatcaacgaaagcttgatcgttgagctatactctaagtaatgacgtaatgctcaatgttatgaaaatggcattgagcaattaacgttaattaaaccagtttaataaatcgaggtgacatcatgatgctaaatgcaactgagtttctaacgccgaatgccattaatgtggatacggttaacgaaacgattgcgaaagtcacgctcgaaccgttagaacgcggctttgggcataccctaggtaatgctctgcgtcgcatcttgttatcttcattacctggtgctgcagtcattgaagctgagattgatggtgttgaccatgaatactcaacgcttgaaggcctgcaagaagacgtacttgatttgcttttgaacctaaaa

SEQ ID NO: 1263 - DNA, 4000 bp, Escherichia coli
  misc_feature (1988)..(1989): n is a, c, g, or t
  misc_feature (1991)..(1991): n is a, c, g, or t
  misc_feature (2349)..(2349): n is a, c, g, or t
tgcggctgtagctgaagtctggccacccatagttgcggccgggaaggatgacattgacctcatcacccccgttcatcccatgttccgctgagagtatggtaccggactgttgatggacagccagtccaagctgatcgcgatgcccgtaggaaaacacggccgcattggcatcatccctgccaaggaaaggattactcgcaggaatgctgccgtcttcattcaagtgcaataccttgccattgacgctggccaaatcctgggcctggtctccgaagggtgccccggtagtgataaagattgtgccatcgggagcaaacgccaggcgggatccgctggtgccggcaaactctcccgcgaagagttctttcacctctaccaggcggccattatccaggcgtccccgcatcagggtgacggcactgcttggttcctcagaatccgggttcggtttgttgtaggtgaaatagagccattgattctcttcaaagtgcggatgcagggcgaggtcgttaagcccgccattgcggtagaaaggatccagttggggcatgcccatgactggctctggatcaagaacaggatcaggtcctgtggcctcatgaatgatacgaagctcgcgtccccgctcggataccagaaggtcgccattgggcaggaaggccatgctgaagggacgctcaaaatcccgcgcgatgacactgacttcgatgccatgttgctctgccgtatcaaaaatatagggcgtttctgcaaggtccatggcaggaataccgatttcaccctgctgtgcagagagtatgcatggagacagggccgtggtggcaatcaggaaaaatgtcgcagttttcatggcaaacctctgctggtaaggggatggctcaattcgtttgacgctgatattgaacgccggtgtcggaattgtataccgggaaaacagaaacagacagatgcccgaaaattatcctgtgccaataagggagggaatagtaagagtaaaaaaaagcacgcctgtacggggagtagaggcgtgctgcaaatgctcagggaattcgtgggaccctgagggttggggttaggggttaatgattcaggttcagcctcggttgaaatcacccagggcgcccaggcgattatcactacctggaagataattgcgattgctgatactgacaatacggtagacgttatcgttatattctgcccagcgagccagcttttccaggagaggtaattgctccctgagcagtggcaactgtacaggattatggataccaagctctgtactttgcaggttaagggcttggtcaaaggcttcaacagctttcgtatgttggccggattccgccatgtcacgggcaagtgccgtataggtctggatgagttgtgtattgtattgtgcctgctgatccgggttggtgttcaggccaactctttgcatgtgaaccctgtcttccagagttttggcggtggattcaagcaaagccgtgtcatgtcttgccttgtcagtgtttactgatatcagcggcataacatatgcggtgtccatggtgatggattgtggactgctatcggcagatacagggcctgaaaagagcgccgatgcgagcaatgccgttagcagcagacttgtatgatgctttttatgtttgggtaagcttgcaaccgcagactttcctgtatggaaagcagatgcggccaacccggcctttatagaagccatggtctttcccccagtgcaaatattatttccctaactgtcgaacctcgttttgacactccgggaacaccgatggtttcttttggtgaaactctggttggtgttcgccctgtgttcctttccaccggaattattgtttttatggtggatcggatagtccgacggctttgttacgtcttagcattttcagcaaggactaagaaccacataaaacgggtttttcatgctgctttgcacaacgaccggcatcacaaaatcagcaataaatctnntnaattcaataggttatgaattccgcttatgtctggtcgattttatttttttgtccggaattattgagtccctccttgataagaaaaacaatcctgtaccgtttaatgaaagttgacctggcaaagtcccgtttttgatcatccatctctgcacttatcaagtcgtgcgcaaaaaaaaggcgccaactggcgcccttttttgtcgtctatgttgacgaattttacgattcgtccaggaagctcttcaggtgatcggagcgggtcgggtgacgcaacttcctcagtgccttggcttcgatctgtcggatacgttcgcgtgtgacgtcgaactgtttgcccacttcttccaaagtatggtcngtgttcatgtcgataccgaagcgcatacgcagtaccttggcctcacgtgcagtcaggctgcccagtacttccttggtggcttcgcgaagtccttcgtccagtgaggagtccacgggggaatcgatattggcatcctcaatgaaatcacccaggtgcgaatcttcatcatcaccgataggggtttccatggagatgggttccttggcaattttcagcaccttacgaatcttgtcttccgaaagatccatacgctcacccagttcctcaggtgttggctcccggcctttctcgtgaagcatctgacgtgagatacggttaagtttgttgatggtctcgatcatgtgtaccggaatacggatggtacgggcctggtccgcaatggatcgggtgatggcctggcgaatccaccaggtagcgtaagtcgagaatttgtaaccacggcggtattcaaatttatccacggctttcatcaggccaatgttgccttcctgaatcaggtcaaggaactgcagaccacgattggtgtacttcttggcgatggagataaccaggcgcaggttggcttccaccatgtcttttttggcgcgacgtgactttgcttcgccgatggacatgcgacgattgatgtccttgatctcactgatagtaagacctgtttcttcctctaccagcaacatttttttctgtgcccgcaggatttccactttcacctttgccaggctttcggaatagtccttgcggcgcagatgggtgtccagccatttcaggttgacttcattacccggaaaactcttgatgaatacactgcgcggcatctggccagtgttgatacacaggttgcgaacagtcctttcatggcgacggatacgggtcaggcaagcgcgaacatgctcgagcagcgggtcgaactggcgtggagccagcttgaagaacttgaagacttcacccagtttttcaagggcttcgatacctttttcatggtcacgtccatactttttgagggcacgctgggttgaacgatactgcttgcgcaattcttcaaaacggatcttggcttcttccggatcaggaccaccagcattttcgtcctcatcgctggagtcgtcgtccttgtcatcgtcgtcatcactggcttccgagtcgtcagtttctacaggtgcactgcttgctcccggagtgatttctgattcgttagtaatgtccaggtaaccggtgagtaaatcggcgaggcgtttttcctctttttccaccagggtgtattcgtcgaggatgaattcgatagtaccggggaaaaaggccatggcagacatcagttcacgaatgccttcctcgattcgcttggcaatggcgatctcaccttcacgggtcagaagttctacagtgcccatttcacgcatgtacatgcgcacgggatcggtggtgcgaccggcttcattttccactgcagccagtgcggcggcggcttcggcggcagccagttcatcggtctcgttttcgatcatcaacaactgatcggcatcgggggcggtttcaaaaaccttgatgcccatgtcgtcgatcatctggatgatatcttctacctgatccggatctgagatggattcgggaagatggtcattcacttccgcataggtgaggtaattctgctcct

SEQ ID NO: 1264 - DNA, 4000 bp, Escherichia coli
  misc_feature (70)..(70): n is a, c, g, or t
  misc_feature (1407)..(1407): n is a, c, g, or t
  misc_feature (1605)..(1605): n is a, c, g, or t
  misc_feature (1827)..(1827): n is a, c, g, or t
  misc_feature (3129)..(3129): n is a, c, g, or t
  misc_feature (3178)..(3178): n is a, c, g, or t
  misc_feature (3841)..(3841): n is a, c, g, or t
tggaatactcatcaccgcacaaggatttgaaagagtatctgtcgaatgaaacagacaagtcacaatctcncccccggcattctctttaagatatgcgagcaactccccatcccgatctctgatatagtcggaataagtcgatgtcgtatactcctgcctggcagtgaaatcaagcatagcctgcatatcggttaccgaccgtttattgaagaaaaaagtagaagccggcaggatatctcccgggaaatcctccaccggttgttgttggcgcaacacattcataaatgtcagacaagtatccgtatcatggctgacaccggagaaataaatggcatctccattcattttcatatcaaattcggtccatccgcccaactgtgtacacgaacgaatcccgtcggtagcctttcccatactcaacggttgcatacgggcataaatagtagctgccacacgggcacgtttatcctcgtgtactttggcaaacgaggcatcggtcagcaaagatttcttggacaaacgggcatcgatcacttgctcaatcagttttttctgataactcacaaccagaaagtcggaagtgaaataacaagccaggaaactgtcatccggcatcggataaatacgaatctcttcccctttatagtcaaacagctttgacgggaaactactcgaacagtatttacgtataaacttttccaccaactcgtaatcgccgtttcccaagctgcaatacaacacctggttgcgatcattgtcgggttcatggaaactcaacaacactttattcatctgcttgctcaacccgtgcggcgtatcttccaacaacgtatacagatggagcttcagataagaaaataatttggaaacataaagaaaatgtcggtctttactgcaactcaactcattgatcccctgtatcattccggcaagatcatccgtctcgaggactacagtggccgaacccggaacaagcgtgtagagattaaaatccttgcgtccttccgccgccgacaacctgaagaaagaaaacatggcaaagcctgtacacagcagtacaacagacgagattacggctattttcactatcgtacggagtttcatggcattcgttgtttatcggctcagtgcaaaaataataatttctccaaataaaacaaaatatacttaaagaaagaattataaagcatcaatcactaacattctaattcaagcccgtcgaatgcaaaatgcacatgcggaggaagttgcttctctacatctgcctgaagtccgatatggtgactcatgtgaatcagccaggtttccttcgctccgatgcgtttcacagcctccaatgcttcagacaggctctgatgggtgttgtgtggcgctatgcgcaatgcattcatcaccagcacctctatnccttgcaactgctcaaacgattcatcgggcatggtcagcatatctgttatatatccaagctttccgatccgatatcccaaaatgggcagtttgccatgcattacccttaagggtaacacttcggtatgattaacaagaaaagggcgattgggttcaatctcacgcaaaggaatattcggaactcccggataggaatgntccacaaagcaatagggcatccggctgcgcaaacgttcggctgtataagtttcggcatagatgggcacttccccgaaacggcagaaagggcgaagatcatccaaccctcccacatgatcataatgttcatgcgaaatcaacacagcatcgatctttccaaacggaacgcgcaacatctgttccctaaaatccggaccgcaatccagcagtatagtagcgtcntcagtatacaccaatgctgaggtgcgaagacggcaatctctcggatcttttgaagtacaaaccgcacaagtacatcctatttcgggcactccggtagaagtcccgctaccaagtattcttattttcatttctttcaattatcaatctgtcattcctgagagccgacatgccctgcagccccatcgtaatcagataaaattcacttccggatgaatgtctatgccaaacttcgcacggaccgaagcacgcacggcatcggacaatgcgatgacatccgctccttttgcgcctccgcgattcaccagcaccaacgcttgcttatcgtgtaccgccgcagggcctaatgctttacccttccagccacactgatcaatcatccatccggccggaatcttcacccggtcagtatcgatctcgtaaaaaggcatttgaggatattctgcctgtaaggcttcgaactgctcacgacccacaatcggattcataaagaaacttcccgcattccccattacccggggatcaggcaacttctcttcacggatagcgataatcacccggcgcaccacatccaatgtcactccgggatacttctccagctcccggcggatagtaccgtaatctaatgtataatgttccctcttgctcagcctgaaactgacataggtaacaaaaacgctcttattctcagggcgcttgaagatgctgtcccggtaagaatatccacactccgttacatcataaacatgctctttcccttcaatgttcagggtttccacccggacaatcagatctttaacttcaaccccgtaggccccgatgttctgcaccgcactggctcccacctctccggggatcagtgaaagattctccacgccgtaccaatgccgttgcacgcaatagtccacgaagtcgtcccagaccacacctgcccccacacgcacaacaatatcgtcatccgtttcggccacaacctctacgcccccgatgcgtgaatgcaggatagtaccttcgtagtctttagtaaacaataagttgctcccccctccgatatgcagataaggagaggtaacccgtccggacccgatcaacccgcgtaattcatccaccgaagcatactccaggaaacaagccgcagacacatcgataccaaaagtgttatgtgataaaagagagtatttctgttccataatcctataaaagcaatctctaaatacttgtatcctcaaacttgtacaactcccagccactgtctttgcgctggaaatagaggatattggagaacccgttgccaatgcctttcantgccaatattttatgtgaggcattgtcatcattttgctgcccgtagttnatattcgaaagtttatcggcaggcaatgccggcttaaaggcaaaccattggttcaagtcaagtgtagtttcgagtatcgagaagtcatcatccggatcggttgtcacaaagacaagcggttggcggattcgccggctctggaaaatactatccgtcgcaaaatgaccgaagaattcaacaaagtcctcgttctcgttttcctcaatcggacgcagattgattgcttcgagcatccacgcccctttaattctttcaaaataatatttcttcaccattcgttttttcacgaaaatccattccacctgaacggatgtgagtgaagtgtctcctaccagatccatatcctcttcccggtcgaagagtaaggtataataactttgtttggcaaacaagtcatcatgcttccagtacttcctgtcgattttcgaagcccgttctccgttgtagtagggcaacggaaacaccacgcgctgcctttgcagagcgtcatcagaagcaaagttgtagataaagtcgtcaaacgattcgtcagcctcaatcggtttaggttcgtccgaagtcttttctctgtcaatagaatcggttttgttcaccattgccgaatctaccagatgtgtaatagatgcaaaggggtcagcgtcagtcttattactgttgccgcangaagcgaacaacaccaggacggtgactcccgccattattgttttcattttaataattagcaatgtgtcgatatccccacatgccaaccggttttcgaaactctttcatactccggtcggcacatgggatttatatcatcacattattttaatttagctc

SEQ ID NO: 1265 - DNA, 4000 bp, Escherichia coli
  misc_feature (10)..(10): n is a, c, g, or t
  misc_feature (62)..(62): n is a, c, g, or t
  misc_feature (391)..(391): n is a, c, g, or t
  misc_feature (461)..(461): n is a, c, g, or t
  misc_feature (1348)..(1348): n is a, c, g, or t
  misc_feature (1723)..(1723): n is a, c, g, or t
  misc_feature (2152)..(2152): n is a, c, g, or t
  misc_feature (2624)..(2624): n is a, c, g, or t
  misc_feature (2627)..(2627): n is a, c, g, or t
  misc_feature (2687)..(2687): n is a, c, g, or t
  misc_feature (2720)..(2720): n is a, c, g, or t
  misc_feature (2986)..(2986): n is a, c, g, or t
  misc_feature (3559)..(3559): n is a, c, g, or t
  misc_feature (3739)..(3739): n is a, c, g, or t
  misc_feature (3764)..(3764): n is a, c, g, or t
  misc_feature (3770)..(3770): n is a, c, g, or t
  misc_feature (3892)..(3892): n is a, c, g, or t
  misc_feature (3955)..(3955): n is a, c, g, or t
  misc_feature (3991)..(3991): n is a, c, g, or t
gttgtaaatntgggctaaaactcggtgcgctgtccagtaatgctttggtatagggatgcagnggacgtttacgtaacgctttcatttttcccgattctactgtttgcccgcaatatagcacagtcattgaatgcgccattgcagagattgccaataaatcatggcctacaaataatatacttaaatcacgggttttatttaaatgtgtgaataaggctaaaatctgtttctttatattcgtttccataccacgcgtaggatcatcagcaattaacaaggtaggctgagagattaatgcaagggcaatcataaatttttgacaaatatctaatgacaattcatggggatacttattgatacattgagccacgttctcaataccgactcgcgntaagatttgtttcgcaatcttcatttttgagcggtttcgctcccaccaataacgtccttcaacaaactcntcgggtacactttcgagcagttgttcttgaaggcgagatgagggatctaatgctgccattggatcttgaaaaatgacagcaatatcgcgacgcatgatagcctggcgttgtgcttgcttcatggttaataagttttcaccacgccatgtcaaccggtctgcagttacaatccactggggaggaagtgcacctgatatcgcacgtacaatcaaactttttccagagccagtttcgcctacgagtgctctaatctcattttctttaacggtcaggctgactttatcaagcgccttgattaatacaccgttactttcaatctctaaggtcaaatttttgatgtctaaaataatcattaatgtgacatcctgtttctgtgcgctgaacgtaaaccatcacctacaatattcaccgatagcaccatcaaaaatatagcaaggcctggcagtaaaatattccaaggggcaatataagcagtagatagcgcatctgcaatcatcacaccgagttctggcattaacgtttgagcacctaaatttaaaaatcctaaggctgaaatatctagtatcgcgatagaaatagccaatgtaccttggacaattaagcgttctaccatattaggtaagatgttataaataaataaagcggaagatgttgcgccatcaagtttggcggttaggatgtaatctttactcatttcttggcgaacaaaatcacgtgtgacatgaacaaatcgtggtattaaggccaagccaatcgccaacattgcattagttaacccagtacctagcattgccataatgataatggcaattaataaagtgggggttagcatcaaaatgtctaatacatgattgataaaactggaacgaagacctgcagacataccngctatgacacctaaaataacgccaaaacacaatgcaactaaaaccgtaatgatgctagaaaataacgttatttgagtaccgtaaaataagcgggttaacatatcacggcctaatgcatccgtacctaaaatatgtaatatactgccattatcattccatgctggtgggatcagcacagcatcggtatgctgtgtggttggctcaaatggagtcagcagtggtcctaaaatagccataataataaagaaaattaatatccccagtccggcaactgcaacatgacgttgtcgaaattcgctccaggtcgcctgtaacggcgttggatagtgttcttcttcgtataaactagtgtctggcataagcaaacctatctcnggtgggatcaatcatctggctcaagcattcaagacttaatgtcatcaccacgaccaccattgcgactaacaacatacctgcgcggatagcggggaaatctcgttcataaatagcttggataagccagtcaccaatccctggccatgaaaatatggtttcaacaatcatgacatttgtcattaacgtagatatttgcaacgctaacaaaggcaatactggtaacaaggcattacgcaatacatgtctaaagaaaatcgtagaggaaggcagtccacgtgtttgtgcacatttgatgtattcagtttgcaacacgtcagctacagaacggcgcgtcgtgcgcaggaaaacagcaaaggcgataaaagacactgataatgtcggtaggataaggtgctgcagcgcatcatataaagcagcttgtttataggngacatccgataaccaaatatccagtaagataaatccagtgcgatgagggatatcaaataataaactcaaacggcctgacatgggtaaccattgcgcttgtaaactgacgattaatattaataataacgccagccaaaatacggggaatgaatacatcaccatgcttgatgacataaagatattgtcgatttttttgtggtattgcatacctgcaataaaacctaatgggatcccaagtactaaagcgatggtgatagcatagagacttaattctaacgtagcaggtaacaagcgcataatttctggataaagcgcattacctgtggcgaaactgactccccattcgccttctaataatgcttggatataataccaaaatgccattaatacattggtttgttcagcgactagcattagggtaggttggtcttgaataaactcagcaccaaatagatttaaccaagtatctccnggnaagaagtaagctaatgcaaaggacaacaccactaagatacataatgtgataaaggtgagntttaaaaaacgaaacaaggtattgatcatggangcccatcctggttatctatttgttgtaccttgggtgctttcaccacattttcaaaccgaatactaccataagggtttattgataaccccttaatggagtgtgctttaacttgatagcgattagcatgtgcaatagggaccaaaggtatatcatgggcgataatattattagctttggcatataaagatgctcttaaatcgacatcagggatccggattgccgcattaattaatgcgttaaattccgtattacaccacatcgctcgnttagtacctgaaggaatggcttcacaactaagtaaggggcgataaaaattatccggatcaccattatctgccgaccagcctattaatacactatcatgttccccttgggaaagtttgtcacgaaatgcatgccaatcataggttacaacagtgacatcgacatcgaccgcagccaagtaatttttaatcagctgtgccatgcgtttggcattggggttatatgcgcgcacaaccggcattgcccaaagtgtcattttaaagcccgcagggatattggcttgattgagtaattctttggctttgatggggttgtaacttacttctttaatactgctgttataggcccaagaagaaggggggatcagcgaacgagctcgagaggctgaattgaagtaaatagcatctaaaatcgaatttttatcaattgccatcgccaaagctcgacgcactataggctgatcaaaaggcggtttacttgtgttaaaagcccaaaagccaacatttaacccaggctcttcttctaccacaatgtttggcgtagcacgcatgacatcaatctccgcttgagagggntaggcaatagtatcgcactcaccggtgactaacttggcaaagcgaatggcactggaaggcgtaatgtcataaatgagttgtgcagattgtggcacaccacgccaataacccagatgtggtaaaaagcggataaattgatttttttggtaagcatcgaatttaaatggcccagtgccgatnggataaaaatcgatttgtgattganggttancaacagctaacatatcggcatactcagcggataaaataacggcaaaatcggtagcaagattagctaagaaagaagaatctcgttcaaataaactgatctctatgcgataaccattgatacgnttaatggattgaattttctcagccaaattcaaactatcaaaataggggtaactgcccccattnacttcatgatagggatgactagggttgatccagcgntcaaaacta

SEQ ID NO: 1266 - DNA, 4000 bp, Escherichia coli
  misc_feature (628)..(628): n is a, c, g, or t
  misc_feature (1969)..(1969): n is a, c, g, or t
  misc_feature (1991)..(1991): n is a, c, g, or t
ggatcatcgccagtgcggtgcgaagcgcgttttggcccgagaaatcgatcatgcgtcggcgtgaatgaccaagggccacatgccctaactcatgggccaccacgcttgccatttcttcggcagtgacctcgccatcggtgaacttgcgataaaagccgcgggtgatatagattttgccatcgggtgcggccagaccgttgactggatcaatttcataaagatgcaagcgaattttagccacctcaagcgctttagccatgcggtcggtcaacacttttaactttggatcaagcaattcatgcgactggccggtgagctcgcgattggtacgccagaccgaaaaccggtacatgataacgccgtaaattagggccagaagaatgggtgaaaattgcaacatttaacttatatggggcatcatccaccctatgacaagcatgctcgggccacagggcgcaactcggcctgctagcggccgagttgtttcatgccttgttctattccagccagtgtcatcggaaccatccggccaggaaaaaggtcttggatcatgctgatggaatgtgtgtaaccccagtatttctgtggtaccggattaagccagaggtgattttgccagtggtcttgngcgcgctgcaaccagacttgacccgcctcggcattccaatgctcgttggcaccaccggggtaggcgatctcatagggtgacatgctcgcatcgccgacaaaaatgcatttatagtcagctccataggtgtgcaaaacgtccattgtcggaatttgcgcatcccagcgccggttgttgtcccgccaaaccccctcatagaggcagttgtgaaaataataatattcaaggtgtttaaactcggtccgcgccgcgctgaacaattcctccaccaccttgacatgggaatccattgagccgccaacatcaagaaaaagcaggacttttacggcattgcgccgctcggggcgggttttcacatcaagatagccgttttcggctgtggccttgatggtaccatccagatcaagctcgtcctcggccccgtcgcgggcccattggcgcagacgtttcagcgcaactttaatgtttcttgtgcccaactcaatcgtatcgtcgaggtttttaaactcgcgtttgtcccaaaccttgatcgcacgcttgtgccgactttcgttctggccgatccgcacgccttcggggttatagccaaaagcgccaaatggcgatgtgcccgcggtgccgatccatttgctgccgccctgatggcgtttctcttgttctttaaggcgttctttcagggtctccattagtttttcaaacccgccaagcgactgaatctcgtcgcgctcctcctgactgagatgcttttctgccatcttttccagccagtctgcagggatgtccacagcctccatcacttcgccaagcgtgatatcctcaagacccttgaatgtggcagagaacgcctgatcaaatttatcgatattgcgctcgtctttgaccattgcactgcgcgctagatagtaaaacgcctcaatatcataggtcacgatgccagctttcacggcctctaaaaatgttagatactcgcgtagagagactggaattttacgctcgcgcaggttttcaaagaacggcagaaacatcgctacgtcgcagctcggtggatgaccaaagttatgaccagacccgcgagcatgaacatgatgccatagctggtggcataatgcagaatgtcgggccagcggccttttcggcgatgggcggtgtagcccccaaaagacacgccgcaaatcaatcccaatattattagcatacgttttcctattttccccgcgtggcttggcctttgcaaggtggttttgtcaaatcccagcagctattagccggtttgctatctggcctgacaggcgctgtctagtcgaaccaccctgttttatgcatcattgagcagcactttancctctcgccttgcttggttganttacctagtgccgcgtgccataaaggccagtctctcaaataaatgcacatcttgttcgtttttcaacagcgccccgtgcaactgaggtaaagcattcgatccatcccgcgctaagtcctcagctgtgagatcttctgccaacagcagtttgagccaatccagcacctcggacgttgagggttttttcttcaaaccctgctgttcgcgcaactcgtagaactgggtgagggcagtggtcagcaacgcatcttttatcccggggtgatgtacttcgacaatttggcgcatcgtttcgaggtcaggaaaccgtatataatggaaaaagcagcgccgcaaaaacgcatcaggcagttctttttcattgtttgaagtgatgatgacgatgggcctttggcgggcttttatcagttcatcggtctcatagacatggaactccatcttatcgagttcctgcaaaagatcattgggaaactcgatgtcggctttgtcgatctcatcgatcaataatactagtttttcatcggcctcaaaagcctgccagagcttgcccttgcgaatatagttgcgcacatcctgcactttttcgtcgccaagttggctgtcacgcaagcggctaacggcgtcatactcataaagcccctgctgtgctttcgttgtggatttgatattccattcaaccatctcaaggcccagagccttagcgacttggcgggccagttctgtttttccggttcccggttcacctttgaccaaaagtggcctttcgagcgtcacggcggcattgaccgcaaccgtcagatcatctgttgcgacatattcttgggtgcctgtaaatttcatcggtcattccaattgtgtaagtgatttgcgctgacactaacgcgaacacaaaaacaccgcaatcggctcctaacagctagtgacaagcggcgggtcatgaggtaatgcacagcctacgcgtacgtgtgtttgtcaaacttaaaaacatcaaccttgtggagagctcgaaatgaaagcagacgtgattctgcccgataactataaaccgagcgaagatgaaccattcatgaacgccaaacagcgtgagtattttcaacgcaaattgttgagctggaaagctgatcttttagttgagaccagagatacgctggaaggtcttcaggggacgacgcgcaacattcctgattctgcggatcgcgccagtgaggaaactgaccgctcactggaactgcgtacccgggaccgccagcgtaagctggtgaccaagattgattcggccttgcagcgtattgccgagggtgaatttgggtactgcgaagtcaccggagagccgatctcgctcaagcggctggatgcacgacctattgcgacgatgagcctcgaggcgcaagaacgccacgaacgcaaggaaaaagtgcaccgcgacgactgagctcgacagctgtggcttaaacgacagccgtcgtgtcagatgctttgacggtttcggtttcaggatagcgcatgcggattaccggtaaaaaaatcatcgtgatcggtggcgggattggtggtcttgctgcggcgctggcgttggcgcggcttggcgctgtggtaaccgtgcttgaacaaactgccgaaatctctgacatgggggctgggttgcagatcagcccaaatggctttgtggtgcttgatgcgctggggttacgcgatgcggtggttgaccggtcggtggccgcaacttctgtggtcctgcgcaattatagcaattcggcgatggtggcgacacttgatgtttcgccccaaacaggtggacagaattaccacttcattcatcgggcggatctggttgcctgtctgctgagtgcggcaagacaggccggggttcaagtgcggttgcagcacaaggtaaaacaggtgcagacctcggtgataccgcaggtggtcttgacgaatggcgcgacgatgatggctgatctggtggttggtgcggatggtttgcattcttgcttgcggccggtcctaaa

SEQ ID NO: 1267 - DNA, 4000 bp, Escherichia coli
  misc_feature (1992)..(1992): n is a, c, g, or t
  misc_feature (2001)..(2001): n is a, c, g, or t
  misc_feature (2389)..(2389): n is a, c, g, or t
  misc_feature (2495)..(2495): n is a, c, g, or t
  misc_feature (3148)..(3148): n is a, c, g, or t
  misc_feature (3188)..(3188): n is a, c, g, or t
  misc_feature (3268)..(3268): n is a, c, g, or t
  misc_feature (3388)..(3388): n is a, c, g, or t
  misc_feature (3601)..(3601): n is a, c, g, or t
  misc_feature (3626)..(3626): n is a, c, g, or t
  misc_feature (3794)..(3794): n is a, c, g, or t
  misc_feature (3908)..(3908): n is a, c, g, or t
aacttgcgtcctgcgatttccttcaaaggaaaaaggttttgtcactaccgctactgtaagggcgccgatttccttactgatttcggcaatgacgggggcccctccggtgccggtgcctccgcccatgccggcagtgatgaagaccatatcgcttccttccagcattgcccggatatcgtctacgctctcttctgcggcctccctgccgatttcaggttttgcccctgctccgagtcccctggtgagccctttacccagttgaatcttattagaggccaaagacatttcaagggcctgggaatccgtatttgcagccacaaattcaacccccttgagttcggaggctatcatgttgttaatagcgtttccgcctccgcctccgactcctattgcctttatctttgcactgaggtttggttctataaactcaaacgacatatgtttggtcctccaactgatatttaaatcttgaaccatgacttcatgcgaagggttacccgattgaatatgtttccatcccttatccggaatttctttctgggttgactttccatgccgaagagcacaagacccacggcagtagcgaacatgggtccgttgaccacgtccaccaggccggagatccgttgcggaaaaccgattctcgtcggcaactggaatacctggtctgcgatctcggcaattccgggcagcagggcagagcctccggttataacaactcctccggccaatagttctttaagtcccgtccgttccatttcctggtcaatcagtgtaaaaatctcctccaccctgggctcaagtatctcagacaatatgtgtctggacagaagcctgggtttgcgccctcccacactggggacttctatcatctggtctttatccacaagggaactgaggcaactgccgtgacgtgtctttatttgttcggcctccttgacaggcgtccttaacccgactgctatgtcattagtaaggttgttaccgccaagtcccagcaccgccgtgtgttttattgcaccatcagtaaacagggcaagatccgtggtgccgcccccgaagtccacaagggccaccccgaggtccttttcttcctgggttaggacggcctcggccgaggcaaggggctgaaaaactatgtcaactacatcgagtcccgccctgtttgcgcacttgataaggttctgggcagccgtaaccgctcctgttactatatgtaccttggcttccagccttaccccggtcataccgacaggatccaggatccctctctgctcatccaccatatactcttgaggcagaatatgaataacctccctgtcgaggggtatggccaccgcccttgccgcatctatgaccctgtcaacatcctcctgggagacctcctggccctttacagctatcaccccatggctgttgaagccttttatatggccgccggcaatgccgattaacacagagcctatctcgcacccggccatgagttccgcctcttccatagccctccgtatggaatcaacggtgttgtctatattgacaaccactcccttccggagacctacggaagggtgagttcccacgcctataatatcagcacccttactgttgaattcactcactaccgcacatattttagtggtgccgatatccagaccgacgattatgtcacccggcctctcgaccatttcctctcctaatctttcagactgaccagggcctgaccgggaccgtagtccagttcaactttagccacttttttatattttcctgaactataaagttgatacaggactttttccgcctcactgaactgagagctgaggtcttcagtatcaaagtgaaaaggaataccgctgtcagccgtatagagtattaaggtgtcttttccggctatgtgtatctggcttatgttattgacacccagagttcttgtacctctgcctgccatggatattaattccagggccttttggatctggtgatccggtgatncggtgatcnggtgattctctgtgtacttcggatcaattcctgtgatgatgggaagagatacgggctcttccgcagaaagtagttcatcgataatcttaccctgctcatcaatcaaatagatcttgtcagaattcaatagggctaccggagtgcgttctttgatcgtgatcatcaagtggtccggcagctctctctcaacttcaacggcattgacccagggatgcgcctctatgttcgttgcgattgattccagatcgagagacatgagattgtcccgggcggttacaccgctgatctgcaaaacctcctcttctgtgagatgattgcagcctttcaccaggacctggccgaccctgaaaagttcagaccgacatacccaatgccagcacacaaaaangccggcaagaaccaggcatgccgaggccatggcgatcaacattttgggatggatagaccacgataccggaaatatcagactggtccacgggcctgatccatgcatngaagacctgaattctgtggacgtccttctgatcttcatgtctccataccccaaacagacacctccgggacaagtttaatgccagtctctttttgtacgcgctccctgatgatttttagcagatccactacctgtagggcactggcttttccgcagttcacaataaagtttgcatgccttttggatatctcggcatcaccgattctaagacccttgagtccgcaccggtctatgagccttcctgctgaatctcccgggggatttctgaaaatacaccctgcactcggttctcctgcaggctgggtggccctccgtttgagcatcacccttttgacacggcgcctgatccgatcgggatcggctttgcagagttgaatccttgcggcagagatgagggccctgtccggaagccttaaggacctgtaatcaaattgcagtctatctctccggagccagcaactcccatcagggcctgtaaattgtacagcttctattgcttctgacatggaaaacttgttagtgcctgcgttcatggctatggccccccctatacttgccggaatacccgaaagattctcgaggccggacaggccgttgcgtatggaccaggaaacaagggaatccagcctgcatcctgcccctacggacactgtnttaaggaaatggccacgggaggaatggatactgttcaaanctgcaaggctcatgactatcttcacgcctttatcgctgatcaacaggttgcttccccggcccagcaccttatagggtatngagcgattactgaggtaagaaatagtctgctcaagggccttcaaactgcccggaaccaggaacagatgcgcgggcccgcctatccggaagcttgtaagtggtaaaagaggaacatcctcncgtacctggagatctcttatttttttcagatcctcagaaagcaatcgctgactcctttgtcttaagcatgtccagaattttcgttcctatacggcctatagtgccggcaccgagtgttatgaccacgtcatcctcctggagacttgatataattgccccgggaaggtccccgcaggactccacataatgcacctgcctgccctgtttatcccngatatttctggccagacgtcttccnctgactccgactatgggggtttcgccggctggatagatctctgtcagccacagttcatcagcctccccaaaggccgtggtgaaatcgtccattaacatccgggtcctgctgtaccggtggggttcaaaaagaaccacgaaccggcgttcaggccaacatgtcctggcngccgcgagtgtggccagtatctcagtagggtggtgcgcataatcatccactattgttatcccttctgcctcacccagtatctcaaatcgtctgcctacaccttcatatgacatnagaccggtccggatcttgtgaaagggtatctcaagttcaaggcccagggccattgcagccagggaatttcttacatggtgcagccccgggac

SEQ ID NO: 1268 - DNA, 4000 bp, Escherichia coli
  misc_feature (576)..(576): n is a, c, g, or t
  misc_feature (3858)..(3859): n is a, c, g, or t
  misc_feature (3872)..(3872): n is a, c, g, or t
  misc_feature (3874)..(3874): n is a, c, g, or t
  misc_feature (3878)..(3878): n is a, c, g, or t
  misc_feature (3880)..(3881): n is a, c, g, or t
  misc_feature (3883)..(3884): n is a, c, g, or t
  misc_feature (3887)..(3887): n is a, c, g, or t
  misc_feature (3889)..(3890): n is a, c, g, or t
  misc_feature (3893)..(3893): n is a, c, g, or t
  misc_feature (3895)..(3897): n is a, c, g, or t
  misc_feature (3899)..(3899): n is a, c, g, or t
  misc_feature (3901)..(3901): n is a, c, g, or t
  misc_feature (3903)..(3903): n is a, c, g, or t
  misc_feature (3905)..(3905): n is a, c, g, or t
  misc_feature (3907)..(3913): n is a, c, g, or t
  misc_feature (3915)..(3923): n is a, c, g, or t
  misc_feature (3925)..(3926): n is a, c, g, or t
  misc_feature (3928)..(3928): n is a, c, g, or t
  misc_feature (3930)..(3933): n is a, c, g, or t
  misc_feature (3935)..(3935): n is a, c, g, or t
  misc_feature (3938)..(3940): n is a, c, g, or t
  misc_feature (3943)..(3946): n is a, c, g, or t
  misc_feature (3948)..(3949): n is a, c, g, or t
  misc_feature (3951)..(3961): n is a, c, g, or t
  misc_feature (3963)..(3966): n is a, c, g, or t
  misc_feature (3968)..(3973): n is a, c, g, or t
  misc_feature (3975)..(3979): n is a, c, g, or t
  misc_feature (3981)..(3984): n is a, c, g, or t
  misc_feature (3986)..(3992): n is a, c, g, or t
  misc_feature (3994)..(3995): n is a, c, g, or t
  misc_feature (3998)..(4000): n is a, c, g, or t
atagactttcctgtcttagctgactcattactctgaccttgaatatctacccgcaccccaggatatctctcttgtaatttaggaaagagttcattagacgctagtgttaacagctcctgagcattggcaatatcactctctacatctccttgaatggttactgcccgctcaccatcaacacggttgatacgtgcccatccgcgcccctcctctatatccactacgacctctaacggaatcaatgctccattttttcctacaatagttaactgctctagctcaccactacttcggagctctatctcataagtctctctacctagtggaaactcatcaattttaaccccctgaaaagcagctctgacttgatttgatatgtagttagcatctaaccccatagcacctgcactatcttttatatgtaagcgatactcccgtttaccaggacgcagatcatcattaagatcaaccactcctgcataagatcttaaccaactcttaacctctgcagaggctgctttaagctcctgtagatcctctcctaagagacggatatccaatgatctgccacctggncctacagctggttctgtataagtgatcgctattacatctgttaacatcccactctgtttacgccactgctcacgaaactcatctattgaggcatctcttgtctcaccacctaataggtcaacaacaactctagcgacatgtggaccattttcatgagcatctggattctcgccataaatgatagtaatatgttgcactaaatcctgctcatctggttggcgaggtttaaataccctatttgtctcatatagtgctttagttaactctgccaccacctcttcggtgcgagagagaggggttccttgcggaagtagaatacgcgcctccagaatatctccatctatagcaggaaaacctacaaactttatcttacccgccaccggcatagccacagctaaaatcaacaacattaaaactagaccaatagtgagataacgctgttctactgcaaagtctataactggaccaaaaacattatctcttatcttatcaaagcctctctcaaaagattctctgaacttagactgtttattagcatctatatattttaatgagtgccccagatggttaggcagaactaaaaatgcctccgctaaacttactgttaacaccaccaacaatacaatgggcataacccttagtacctgccctatctcgccactaataaaagctaatgagccaaaaattagcaccgtagtggtaaacgaggagagaattccaggtagaacttgtttaatacctgtagttgctgcctccattggttgatcacctttcgccagcctagaggctatgttttcagcgataacgatagcatcgtccatcaacagtcctatcccaatgagtaaacccaccattgagatcatatttatagttacccctaacatcggcaagataaatagagcccctaaaaatgatattggcagccccatagttacccagaaactatatctcagactaaaaaatagccataacactaaaaatactagagctagaccagccattccattacctaataacatatcaagacgatcttgcactggtgaggagcgatcttgggtaatagttagctgaatacctgttggtgcacgctcctgctcactaactacaaattccgcaacctgattatatattgtgagaatatcctgttgacggctcttagttatattaagaatggcagcccgtttcccatcaaactctaccttgctctcatctttttcaaactgatcgtggatagttgcaatatccccaagtctaattgcggcgcctgttttaccagaaataaccactaaatcttctaactcagcagtcgtcttacgctgatctgcaaagcgcagaattatctcctcctgctcaccattaagctctccactaggggttgcgatacttctctgttgaataatattagcgatatcagcagctgaaataccaaattgacgcaccctctggataggaatctcaacccttaactggtggtcagaaaagccctgaatagttatattagcaacatcagcagctctctttaaacggtctttaactacctccgcataccccttcaacactacaggattttcagggccagtaattgcaatagatactacagcatccgtgcgccccaactcctcagtgatagggagctcacactccttaggaaagtcagaaatagcatctacattggattttatatcattaagaaaacgctccattgccgagccctctatcttaataagagtagcaactccccttccctcactagactcacaacgcatctcatctaaacccaccacaccttcaacagcctcctctaagcgttggcagactgcatcctccacctctctcgcagttgcccccttataaatgacagtaaccttaactttattactctcaattttaggaaaagtttcacgctgaagatctgggatagttacgagccctaacagaataatggctgccatcaaaatatttgaggcatttggatggtgggtaaaccagttaatcattttggtaatctaagagctgctgttgcagcttgttatctagttgcggtttaagtaacattccattcactgcagggataagatcagatacgaccaaaatatctccctcattcacacctgagctaactatatttatatcaccctgacggtagagaatctcaactttagatgtctgtagacgctgttcgccatccatcaacatcacctcaccacctctcacagcagttctagggattattatctgctcaggttgaatgcgcccaaagagctgtagccgtacaaacattcccttagagagtggcggacgcactccagggataatcttactgtatggtttatcaattgcaactaccaccccaatcgtacgagtctcactatcgacactatccgtaaaacggacaaactctgcactccactcggcactctcatttcccatatccacctgaacagtagatgtaagctccgcatactctgcaagaccttcactcatctgcagtgagctaggtgcactacgatggctagtaaatagcttagagactgatgagagagccacttgagcaactacctctgaacgatctataccatcccccacaaaaagtttctgcccagtagttacatactgctctctctccatacttaaattagcaattcgtagattaaatggagcataaaccacactattatccaagtctctctctgcctgtgccaacttagcctttaagacccgttgttgagtaggaattagagatagagaattgcgaagattttggactgaactccttgaattaagcataatcctctcagcactatcgatactactttgagatacaccacctgtagcagataactgagagagacgctgaaactcctgattagcaagctcgaaattgcgctgctcaatagtcaataaatcatcagtattggtatgttgaatctctaactctaaaagttgcgctttaagctgctctagtacgagctcataattgatagggtcaaccttaaacaggagctctccagcagagataatctccccattgcgcaaccgaggatgcatcttaataatacgcccactaacttgagcaattgcactccaaactttcgctggctgcaccaccccataaccctctgccataggacgaatcgcaagcttagggacagttatagtacggaccgcacgcaccacctcctgcttttcactcttaataggagcagctttaccacccaccaataacacaaaagcagccaccccaactatgatcggggggactacccataagatagataatcnntttatggttgacntnctgntnntnntantnnctncnnntntnananannnnnnntnnnnnnnnncnnancnnnncnccnnnctnnnntnncnnnnnnnnnnntnnnncnnnnnntnnnnntnnnnannnnnnntnnatnnn

SEQ ID NO: 1269 - DNA, 4000 bp, Escherichia coli
  misc_feature (535)..(535): n is a, c, g, or t
  misc_feature (591)..(591): n is a, c, g, or t
  misc_feature (602)..(602): n is a, c, g, or t
  misc_feature (653)..(653): n is a, c, g, or t
  misc_feature (1968)..(1968): n is a, c, g, or t
  misc_feature (2035)..(2035): n is a, c, g, or t
  misc_feature (2066)..(2066): n is a, c, g, or t
  misc_feature (2381)..(2381): n is a, c, g, or t
  misc_feature (2975)..(2975): n is a, c, g, or t
  misc_feature (3158)..(3158): n is a, c, g, or t
  misc_feature (3312)..(3312): n is a, c, g, or t
  misc_feature (3762)..(3762): n is a, c, g, or t
  misc_feature (3886)..(3886): n is a, c, g, or t
  misc_feature (3943)..(3943): n is a, c, g, or t
  misc_feature (3963)..(3963): n is a, c, g, or t
  misc_feature (3966)..(3966): n is a, c, g, or t
  misc_feature (3972)..(3972): n is a, c, g, or t
  misc_feature (3981)..(3981): n is a, c, g, or t
ctgtaatatcacctactaaggctttcgggtctacttctaatccatattttttagatagttctgtaatttttttagcagcagaatctaaatcgatttttccgccttttacttcttccattcctaagatgatattctcagcaacagtgaagtttttaattaatttaaagtgttggtgaaccataccgatcccaagctgattagcatgtttaggatctttaatgtcaacttctttcccatctaatttaatgacaccctcttcttgatggtacataccaaaaagaacggacatcaacgtagatttaccagcaccattttcaccaagcaatgcatgaacttcgttctttttcacctgaatagtaatgtctttatttgcgtagaagtcaccaaactttttagttatgtttagcatttctatagcgtacatatatttacctctcttttgtatattgttacttatctattataatatatttttgcaatctagtatagcattttagtacgattctgttaattaattttatattatttatcaatnttataattataaaaattaaaactataaaaactgcataatatcattgtgttttcatngttatttccanaatttttcaaagcttaatattgtagaaaatttttttaattattcacatttnaaaaaataataattacgtttgcaaatttatagcttttttaaaaaatttttcaataaaaaaggcctagtataatactagacctttttttgaattataattttaaaaattatagttcaccttcgatatttgctttatctgttactttatctgcttcaggagctacagttgctttaccagatttaagtgattctacaacttctttaattttgttgttgatatcactgcttaagtttggattttcagcaggtagacctacaccatcttctttgatagtgaatactttagcttttccaccttcgaatttaccagctttgatagcatctaatacttgagttactgcaacatcgatacgtttaacagcagatgttaagattacagatttttctacatcttttccatctttatctttagctttgaatacaccttcagaatattggtctttatctacaccaacgatccagtgtttgatttctccgctttctttaagatctttagtagctctttcttgtgcttctttaattgaaccacttccagttccaccagctgctacgaagataacgtcagctccagcatcatacatagttgctgctaaagttttacctttgttagtatcgttgaatgatccactgtagttgtatacgattttgatgtctttgttagcagctttagctccttgaacaaatcctacaccaaatttaactactgcagggattttagctccaccgataaatccaactttaccagtttttgattgtaaagctgctgcatatccagctaagtatcctgcttcgtgttcagcaaatgtaatagattcaacgtttttgttatctacagttccatcgatgaagatgaattttttatctgcaaatgattctgcaacttttggtaattctttttcgaaatagaatcctgctaatgaaataacatcagctgctttagctgcattttgtaagttagctgcgatatcactttggtttttagtttcgattgggtttaatgctttaccaccgtttttatctacccaagctttaacagcttctacgttactttggttgaaacttttatcttttgctccaccttcgtcagtaactactccgatttttaaatcagattttgaagatgaatcttcttttttctcagttttagaagaacatcctacaaagataagtgctgctgataaaataacagcgattaatgaaaatatctttttcataaacaaataatctcctttatttatttttgtatattgtttatacctaaataataccacataattgtataaatatcaacattttattactttttaaaaaaatanttttattattgttcgtattaagcgaaatttaagcgtatttttatctagttataaagagaatgttcantttttgtaatcttatatatacatatacaganagaattaaagcattttcataactataatttatactatttattttattaatacacatttttgatattcttttcaaaaatactttgacataataaaaaagtctcactaaatttctttagcaagacttttattataattatagttcaccttctaaattagtaactgatccttttgcttttagctcatcaccagttcctactacttctaccttacctgatttaagttcttcaatagctttatcaattttagttttattgtcatcacttaggtttggattttcttttggtagccctacaccattttctttaataccgaanatatgttcacctttttcaaatttattttctttgatttcatttaagatttttgttactgctacttcgatatttttaacagctgatgttaagattacagatttttggtattcttttccatttttatcttttcctttgaaaataccttcttcgtattggtctttatctacaccaacaacccagtgtttaatttctccgtctttagacatatcaaggttaccacgttcttttgcttctgagataacaccattacctgtattacctgccgctacaaagattacatctgcacctgaatcatacatagtagctgctaatgttttacctttatttgtatctgagaatgttccactgtagttgtacatgattttaatatcactcttagctgctttagcaccttgaacaaatccaattccaaatctttctacaggtggaattttagttcctccgataaatccaactttaccagttttagattgtaatgcagctgcataaccagctaggtaccctgcttcttgctctttaaagataagtgacgctatatttggtgcatcaacaaaagtatcaacatacatgaattttttatctttatattgttcngcaacttttggtaattctttttcgaattcatatcctgctaaagaaatgatatctgaaacttttgaagcattttgaaggtttgcagccaaatcagattggttttttgattcaacaacaactggatcttttgctccattggcctttgcccatgcttgtatagcttctacgtttgcttggttaaancttttatctttagctccaccttcaccggtaacaacccctattttgtaggaacttttttcttcagtatttgattctgatttattttttttagaagaacatcctactacaattaatgataatgcaagtaacattgcaataatagtacgtaactttntcataatgacctcctatttttatgtactaagaacacaataacacatttttaaaccgatttcaatatttttttactatattattacaaaaacttaaatttattaaacattttaacaattaaatatataaaaagtgttaaatttatatatttccttaattttttatgatataattgaattgattaaagcattttcaggaggatttatttatgacttattatgaaaatattgtggaaactgcgaattatattaagaagtatttcaatgagccaattgattacgcagttgtcctaggaagtggaattacattagaacttgaagaacaacaagagcttggttacgaggctattcctcttttcccaggaaataaacgttcaaaccatgttaaagggcatgcaaataaacttacttttgggaaaatctcaggtaaaaatgtccttgtattaaacggnagacttcactattatgaaggatacaaaatgaaagaagttgcatttatgacttatgttgtaaaattcttaggtgccaaaggattatttattactaacgcttgtggcgctattaacactaactttnctgaaggagatatcgtttgtctagatgatttcatctctctagtaagtaataatcctntaatgggagaaaacgatccncgncttggngagagattngttgatatgactactccat

SEQ ID NO: 1270 - DNA, 4000 bp, Escherichia coli
  misc_feature (1)..(2): n is a, c, g, or t
  misc_feature (4)..(13): n is a, c, g, or t
  misc_feature (15)..(15): n is a, c, g, or t
  misc_feature (18)..(21): n is a, c, g, or t
  misc_feature (24)..(25): n is a, c, g, or t
  misc_feature (28)..(29): n is a, c, g, or t
  misc_feature (32)..(32): n is a, c, g, or t
  misc_feature (35)..(37): n is a, c, g, or t
  misc_feature (39)..(42): n is a, c, g, or t
  misc_feature (45)..(45): n is a, c, g, or t
  misc_feature (49)..(49): n is a, c, g, or t
  misc_feature (51)..(52): n is a, c, g, or t
  misc_feature (54)..(60): n is a, c, g, or t
  misc_feature (62)..(62): n is a, c, g, or t
  misc_feature (65)..(67): n is a, c, g, or t
  misc_feature (75)..(75): n is a, c, g, or t
  misc_feature (77)..(77): n is a, c, g, or t
  misc_feature (80)..(82): n is a, c, g, or t
  misc_feature (84)..(84): n is a, c, g, or t
  misc_feature (86)..(89): n is a, c, g, or t
  misc_feature (92)..(94): n is a, c, g, or t
  misc_feature (96)..(98): n is a, c, g, or t
  misc_feature (100)..(101): n is a, c, g, or t
  misc_feature (103)..(104): n is a, c, g, or t
  misc_feature (106)..(106): n is a, c, g, or t
  misc_feature (114)..(114): n is a, c, g, or t
  misc_feature (116)..(116): n is a, c, g, or t
  misc_feature (119)..(119): n is a, c, g, or t
  misc_feature (124)..(124): n is a, c, g, or t
  misc_feature (126)..(128): n is a, c, g, or t
  misc_feature (131)..(134): n is a, c, g, or t
  misc_feature (137)..(139): n is a, c, g, or t
  misc_feature (141)..(141): n is a, c, g, or t
  misc_feature (143)..(143): n is a, c, g, or t
  misc_feature (145)..(145): n is a, c, g, or t
  misc_feature (148)..(149): n is a, c, g, or t
  misc_feature (151)..(151): n is a, c, g, or t
  misc_feature (153)..(155): n is a, c, g, or t
  misc_feature (159)..(165): n is a, c, g, or t
  misc_feature (168)..(168): n is a, c, g, or t
  misc_feature (171)..(172): n is a, c, g, or t
  misc_feature (175)..(175): n is a, c, g, or t
  misc_feature (179)..(181): n is a, c, g, or t
  misc_feature (184)..(184): n is a, c, g, or t
  misc_feature (187)..(187): n is a, c, g, or t
  misc_feature (191)..(191): n is a, c, g, or t
  misc_feature (194)..(194): n is a, c, g, or t
  misc_feature (198)..(198): n is a, c, g, or t
  misc_feature (200)..(201): n is a, c, g, or t
  misc_feature (203)..(205): n is a, c, g, or t
  misc_feature (207)..(208): n is a, c, g, or t
  misc_feature (210)..(211): n is a, c, g, or t
  misc_feature (213)..(213): n is a, c, g, or t
  misc_feature (234)..(234): n is a, c, g, or t
  misc_feature (247)..(247): n is a, c, g, or t
  misc_feature (266)..(266): n is a, c, g, or t
  misc_feature (279)..(279): n is a, c, g, or t
  misc_feature (304)..(304): n is a, c, g, or t
  misc_feature (310)..(310): n is a, c, g, or t
  misc_feature (318)..(318): n is a, c, g, or t
  misc_feature (329)..(332): n is a, c, g, or t
  misc_feature (334)..(335): n is a, c, g, or t
  misc_feature (338)..(338): n is a, c, g, or t
  misc_feature (345)..(350): n is a, c, g, or t
  misc_feature (353)..(353): n is a, c, g, or t
  misc_feature (358)..(359): n is a, c, g, or t
  misc_feature (363)..(363): n is a, c, g, or t
  misc_feature (365)..(365): n is a, c, g, or t
  misc_feature (370)..(370): n is a, c, g, or t
  misc_feature (373)..(373): n is a, c, g, or t
  misc_feature (376)..(376): n is a, c, g, or t
  misc_feature (379)..(379): n is a, c, g, or t
  misc_feature (381)..(383): n is a, c, g, or t
  misc_feature (385)..(387): n is a, c, g, or t
  misc_feature (389)..(391): n is a, c, g, or t
  misc_feature (393)..(393): n is a, c, g, or t
  misc_feature (395)..(400): n is a, c, g, or t
  misc_feature (403)..(405): n is a, c, g, or t
  misc_feature (407)..(413): n is a, c, g, or t
  misc_feature (415)..(416): n is a, c, g, or t
  misc_feature (418)..(420): n is a, c, g, or t
  misc_feature (423)..(424): n is a, c, g, or t
  misc_feature (427)..(428): n is a, c, g, or t
  misc_feature (430)..(431): n is a, c, g, or t
  misc_feature (433)..(435): n is a, c, g, or t
  misc_feature (439)..(440): n is a, c, g, or t
  misc_feature (442)..(442): n is a, c, g, or t
  misc_feature (445)..(445): n is a, c, g, or t
  misc_feature (447)..(447): n is a, c, g, or t
  misc_feature (449)..(450): n is a, c, g, or t
  misc_feature (452)..(453): n is a, c, g, or t
  misc_feature (456)..(456): n is a, c, g, or t
  misc_feature (461)..(461): n is a, c, g, or t
  misc_feature (463)..(464): n is a, c, g, or t
  misc_feature (467)..(467): n is a, c, g, or t
  misc_feature (470)..(470): n is a, c, g, or t
  misc_feature (474)..(475): n is a, c, g, or t
  misc_feature (477)..(482): n is a, c, g, or t
  misc_feature (484)..(484): n is a, c, g, or t
  misc_feature (487)..(490): n is a, c, g, or t
  misc_feature (493)..(493): n is a, c, g, or t
  misc_feature (496)..(497): n is a, c, g, or t
  misc_feature (500)..(503): n is a, c, g, or t
  misc_feature (506)..(508): n is a, c, g, or t
  misc_feature (510)..(510): n is a, c, g, or t
  misc_feature (513)..(514): n is a, c, g, or t
  misc_feature (518)..(522): n is a, c, g, or t
  misc_feature (525)..(527): n is a, c, g, or t
  misc_feature (529)..(530): n is a, c, g, or t
  misc_feature (532)..(540): n is a, c, g, or t
  misc_feature (542)..(542): n is a, c, g, or t
  misc_feature (544)..(544): n is a, c, g, or t
  misc_feature (546)..(546): n is a, c, g, or t
  misc_feature (548)..(550): n is a, c, g, or t
  misc_feature (552)..(552): n is a, c, g, or t
  misc_feature (555)..(555): n is a, c, g, or t
  misc_feature (558)..(561): n is a, c, g, or t
  misc_feature (564)..(564): n is a, c, g, or t
  misc_feature (569)..(573): n is a, c, g, or t
  misc_feature (575)..(584): n is a, c, g, or t
  misc_feature (587)..(588): n is a, c, g, or t
  misc_feature (590)..(590): n is a, c, g, or t
  misc_feature (592)..(592): n is a, c, g, or t
  misc_feature (594)..(600): n is a, c, g, or t
  misc_feature (603)..(603): n is a, c, g, or t
  misc_feature (605)..(606): n is a, c, g, or t
  misc_feature (609)..(610): n is a, c, g, or t
  misc_feature (614)..(616): n is a, c, g, or t
  misc_feature (619)..(623): n is a, c, g, or t
  misc_feature (630)..(631): n is a, c, g, or t
  misc_feature (634)..(636): n is a, c, g, or t
  misc_feature (638)..(645): n is a, c, g, or t
  misc_feature (647)..(647): n is a, c, g, or t
  misc_feature (649)..(649): n is a, c, g, or t
  misc_feature (651)..(654): n is a, c, g, or t
  misc_feature (657)..(661): n is a, c, g, or t
  misc_feature (664)..(664): n is a, c, g, or t
  misc_feature (668)..(669): n is a, c, g, or t
  misc_feature (671)..(674): n is a, c, g, or t
  misc_feature (676)..(676): n is a, c, g, or t
  misc_feature (678)..(678): n is a, c, g, or t
  misc_feature (680)..(681): n is a, c, g, or t
  misc_feature (683)..(684): n is a, c, g, or t
  misc_feature (686)..(686): n is a, c, g, or t
  misc_feature (688)..(688): n is a, c, g, or t
  misc_feature (690)..(692): n is a, c, g, or t
  misc_feature (694)..(695): n is a, c, g, or t
  misc_feature (697)..(697): n is a, c, g, or t
  misc_feature (700)..(702): n is a, c, g, or t
  misc_feature (704)..(705): n is a, c, g, or t
  misc_feature (707)..(708): n is a, c, g, or t
  misc_feature (711)..(711): n is a, c, g, or t
  misc_feature (713)..(719): n is a, c, g, or t
  misc_feature (721)..(723): n is a, c, g, or t
  misc_feature (726)..(730): n is a, c, g, or t
  misc_feature (732)..(732): n is a, c, g, or t
  misc_feature (734)..(734): n is a, c, g, or t
  misc_feature (736)..(736): n is a, c, g, or t
  misc_feature (740)..(740): n is a, c, g, or t
  misc_feature (742)..(745): n is a, c, g, or t
  misc_feature (747)..(748): n is a, c, g, or t
  misc_feature (752)..(754): n is a, c, g, or t
  misc_feature (757)..(757): n is a, c, g, or t
  misc_feature (759)..(761): n is a, c, g, or t
  misc_feature (763)..(766): n is a, c, g, or t
  misc_feature (769)..(773): n is a, c, g, or t
  misc_feature (775)..(780): n is a, c, g, or t
  misc_feature (782)..(783): n is a, c, g, or t
  misc_feature (786)..(787): n is a, c, g, or t
  misc_feature (789)..(793): n is a, c, g, or t
  misc_feature (795)..(795): n is a, c, g, or t
  misc_feature (797)..(800): n is a, c, g, or t
  misc_feature (802)..(804): n is a, c, g, or t
  misc_feature (806)..(820): n is a, c, g, or t
  misc_feature (822)..(822): n is a, c, g, or t
  misc_feature (825)..(829): n is a, c, g, or t
  misc_feature (831)..(831): n is a, c, g, or t
  misc_feature (834)..(836): n is a, c, g, or t
  misc_feature (838)..(840): n is a, c, g, or t
  misc_feature (843)..(845): n is a, c, g, or t
  misc_feature (848)..(849): n is a, c, g, or t
  misc_feature (853)..(853): n is a, c, g, or t
  misc_feature (858)..(859): n is a, c, g, or t
  misc_feature (864)..(870): n is a, c, g, or t
  misc_feature (872)..(872): n is a, c, g, or t
  misc_feature (877)..(878): n is a, c, g, or t
  misc_feature (880)..(880): n is a, c, g, or t
  misc_feature (883)..(883): n is a, c, g, or t
  misc_feature (885)..(885): n is a, c, g, or t
  misc_feature (888)..(889): n is a, c, g, or t
  misc_feature (893)..(894): n is a, c, g, or t
  misc_feature (898)..(898): n is a, c, g, or t
  misc_feature (1092)..(1092): n is a, c, g, or t
  misc_feature (1095)..(1096): n is a, c, g, or t
  misc_feature (1098)..(1102): n is a, c, g, or t
  misc_feature (1108)..(1110): n is a, c, g, or t
  misc_feature (1113)..(1115): n is a, c, g, or t
  misc_feature (1117)..(1120): n is a, c, g, or t
  misc_feature (1122)..(1122): n is a, c, g, or t
  misc_feature (1126)..(1126): n is a, c, g, or t
  misc_feature (1128)..(1129): n is a, c, g, or t
  misc_feature (1131)..(1131): n is a, c, g, or t
  misc_feature (1133)..(1133): n is a, c, g, or t
  misc_feature (1137)..(1137): n is a, c, g, or t
  misc_feature (1142)..(1142): n is a, c, g, or t
  misc_feature (1145)..(1152): n is a, c, g, or t
  misc_feature (1157)..(1157): n is a, c, g, or t
  misc_feature (1163)..(1164): n is a, c, g, or t
  misc_feature (1167)..(1167): n is a, c, g, or t
  misc_feature (1169)..(1169): n is a, c, g, or t
  misc_feature (1171)..(1171): n is a, c, g, or t
  misc_feature (1173)..(1173): n is a, c, g, or t
  misc_feature (1175)..(1175): n is a, c, g, or t
  misc_feature (1178)..(1178): n is a, c, g, or t
  misc_feature (1180)..(1182): n is a, c, g, or t
  misc_feature (1184)..(1191): n is a, c, g, or t
  misc_feature (1196)..(1196): n is a, c, g, or t
  misc_feature (1205)..(1206): n is a, c, g, or t
  misc_feature (1209)..(1210): n is a, c, g, or t
  misc_feature (1212)..(1212): n is a, c, g, or t
  misc_feature (1214)..(1217): n is a, c, g, or t
  misc_feature (1225)..(1225): n is a, c, g, or t
  misc_feature (1228)..(1228): n is a, c, g, or t
  misc_feature (1231)..(1232): n is a, c, g, or t
  misc_feature (1237)..(1237): n is a, c, g, or t
  misc_feature (1543)..(1543): n is a, c, g, or t
  misc_feature (1609)..(1609): n is a, c, g, or t
  misc_feature (1664)..(1664): n is a, c, g, or t
  misc_feature (1743)..(1743): n is a, c, g, or t
  misc_feature (1775)..(1775): n is a, c, g, or t
  misc_feature (1789)..(1789): n is a, c, g, or t
  misc_feature (1806)..(1806): n is a, c, g, or t
  misc_feature (2364)..(2364): n is a, c, g, or t
nntnnnnnnnnnnangtnnnnggnnttnntgngannntnnnngtnaatntnntnnnnnnntnaannnaaaaaaantnatnnntnannnnttnnntnnnanngnntntaaatcantnttnatatntnnngcnnnnttnnntngnancanntntnnntaannnnnnntanttnntcnatcnnnatnaanaatnaancttngnngnnntnnanntntaaaaattatttagacttganataatttttaaantaaaaatattttctatatnaaccatcaaaaancttaaaacaaaatctagagaagggnagaatnatttttcnccaccctaatnnnntnnttnttttaannnnnncancaccnntagnanattcnaangantgntnnnannntnnnanannnnnnatnnnannnnnnntnncnnnacnngtnntnnannnttgnncnatnancnnanntanagganannaantgntatnnannnnnntnagnnnnttnttnnctnnnntgnnngntannatannnnnatnnncnncnnnnnnnnntntngnannncntantannnnatnattannnnnannnnnnnnnncanntntntnnnnnnnttnannaanntttnnnttnnnnngcagccnnacnnntnnnnnnnngnangnnnnttnnnnnaanttannannnntnantnnanngncntnnnanngnatnnnannannttnannnnnnnannnccnnnnnantntnttancnnnnanntttnnnaanannnannnntgnnnnntnnnnnnannaanntnnnnnantnnnntnnntnnnnnnnnnnnnnnncntcnnnnncnatnnnannntgnnnccnncccnttagnnggggnnnnnnnanccccnnanaantnccnnaacnnattnttttagttacactttaatcaatggttaattttagttcagtttagtgaaactgataattgaagtcaagtttaaaagataatatctcatcatgcataaaacatttataataaaaatttaattattattggtcgaccaaaccaaaacttttacaatatttggtcctggtgagccacatagatacaggccttgggganagnngnnnnnttgggnnnagnnnannnngnaaancnnanangagnttaanccnnnnnnnnttttnaaaaanntantnantncnttngnnngnnnnnnnnaaaantaaaaaaannaannanannnntattgacnaanaannatttnaaaaaaacctgcactagattaaattgatttatttgtttctatgttttgatttatcatggttgaatgaaattaaatattaaaaaaacactgcagcaggctatagcagcacataaagaaggtaaattacaagatgctgaacgcctttatctatccatcttgcagtcatatcctaaccatccagaagccaatcaaaatctaggtgtattagaaacaaataagctaatacaactttttcaaaatagccaatacgacgaagctataaaattaggacaatcccttactgaaagattccctaaacatcaattngcctggaaaatattaggtgttgtattgggacaaacaggcaggcattctgaagctttaaatgcaagncaaactgccgccgcattgcctcctcaagatgcccaagtccactacaacttgggtntcacgctcaaagaattaggtaggttagatgaggctgaagcaagctatagacaagcgatagtgttgcaacctgataatgntcaagcccataataacttgggtgttacgctcnaagaattaggtagnttagatgaagctgaagnaagctataggcaagcgatagtgttgcaacctggttttgctcaagcccatagcaacttgggcctcatactccaaacattgggtaggttagatgaggctgaagtaagctgtaggcaagcgatagctttgcaacctggttatgccaaagctcacaacaacttaggtgttacgctcaaagaattaggtaggttagatgaggctgaagcaagctataggcaagcgatagctttgaaagcagactatgcacaagctcacaacaacctaggtgttacgctccaagaattaggtatattagatgaggctgaagcaagcttgagacaagcaatagcattgaaggcagattatgctgaagctcacaaaaacctaagtcttacgctccaagaattgggcaaatttgatgaggctataaaaatacttaaaaatgttatcaacaaagataaaaaaaaatactcctacctgtattgcgacattcttcatcttaaaacccatgaatatagttgggatgattatgatttttatttaaatgaaataaataaatttgttaacaaaacaaatgggtncgttaataatttcagtcttctaagcatttcagacaacttatcttttttgcaaaaaaatgccagaaataatgccagaaaaacatccaaagcaatttatccaaaactccccctcaatgtaaaactgaaaaatgaaaaccataaaataaaaatagcctatttttctttagatttcaaagatcatgccgttggtaggttagtcaaaaatttatttaaaaatcataatcgtaaaaaatttatagtttatgggttttcttttgcacgccatgaagatgataatatttacaaagaaattaaaaaaacatttgatcatttttatgatttttcagaaaaatcagactctacagccttacaaactatttctgaccttggtcttgatgttgctattgacatgatggggcacacaaaaggtagtcggtcttatttatttaataataggatagcgccaactcaaatctcattcttgggatacctagggaccatgggggataatgcatacgactatatcgttgctgataatttcgttatacccactgaaaatgaaaaatactatgatgaaaaagttttaaaacttccgatatatcaaccaaacaactataaagaaatttctttcaaaactatctctaaaaaatctcttggtttgcctgataattcttttatctattgctgtcttaataatccctataaagttacgccttttatttttgattcctggattaaaattttacaagctacagaaaatacttatttatatttattaaaaagaaacaataatggtgagaaaaatataaaaaaatatatttctaataagggacttgatccaagaagaataatatttaccgataaagtttcgtatgaaaaatacttaagtatattaaatgtctgtgatgtttttcttgatacatctccatacaatgcaggggcaacagcaattgattgcttagcagcaaatactccaataatttcacttgttggtaactcttatgtaagtaggatgtgcggtagtattttaaaaaaattagaattaagtgattttatagcggtggatattgatgattatataagtaaagctgttgctttaacaaaaaaaccaaaagtaaaaataaatttagaaaaatttaacattttcgaaatttctaattttgtacttaattttgaaaaagagttaattaaaattcacaaataaaaagtggtgccctcggcacgattcgaacgtgcgaccctccccttaggagggggatgctctatcccctgagctacgaaggcgtaattaaaaaagtaattaaatctatttaaacgtatttttttaaattactagtatatattttctttttagtataatttaaaaagaatctaaaaatagatagaagttaataaaaatgagtctaaatatttctataatagttgttacctataacagtgaaaatattattaaatcattcctaacgcaaccaattttaagaaaagaacctgacattgttatcgtggataatgcaagtagtgataaaacaaaaactattataaaaaaaattatgccttctgtaactttgatatccttaaaaaaaaatgtaggttatggttcagctgtaaacaaggggataaaagttataaaaaataaatatttattagtaacaaatcc

SEQ ID NO: 1271 - DNA, 4000 bp, Escherichia coli
  misc_feature (3)..(3): n is a, c, g, or t
  misc_feature (5)..(7): n is a, c, g, or t
  misc_feature (11)..(13): n is a, c, g, or t
  misc_feature (16)..(16): n is a, c, g, or t
  misc_feature (18)..(18): n is a, c, g, or t
  misc_feature (20)..(20): n is a, c, g, or t
  misc_feature (22)..(22): n is a, c, g, or t
  misc_feature (24)..(24): n is a, c, g, or t
  misc_feature (26)..(28): n is a, c, g, or t
  misc_feature (30)..(30): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (46)..(46): n is a, c, g, or t
  misc_feature (50)..(52): n is a, c, g, or t
  misc_feature (55)..(57): n is a, c, g, or t
  misc_feature (59)..(62): n is a, c, g, or t
  misc_feature (64)..(71): n is a, c, g, or t
  misc_feature (73)..(74): n is a, c, g, or t
  misc_feature (78)..(78): n is a, c, g, or t
  misc_feature (80)..(80): n is a, c, g, or t
  misc_feature (84)..(85): n is a, c, g, or t
  misc_feature (87)..(87): n is a, c, g, or t
  misc_feature (91)..(91): n is a, c, g, or t
  misc_feature (93)..(93): n is a, c, g, or t
  misc_feature (95)..(95): n is a, c, g, or t
  misc_feature (97)..(98): n is a, c, g, or t
  misc_feature (100)..(101): n is a, c, g, or t
  misc_feature (104)..(106): n is a, c, g, or t
  misc_feature (108)..(110): n is a, c, g, or t
  misc_feature (113)..(113): n is a, c, g, or t
  misc_feature (118)..(118): n is a, c, g, or t
  misc_feature (125)..(125): n is a, c, g, or t
  misc_feature (127)..(127): n is a, c, g, or t
  misc_feature (130)..(131): n is a, c, g, or t
  misc_feature (134)..(135): n is a, c, g, or t
  misc_feature (137)..(137): n is a, c, g, or t
  misc_feature (140)..(142): n is a, c, g, or t
  misc_feature (144)..(144): n is a, c, g, or t
  misc_feature (147)..(147): n is a, c, g, or t
  misc_feature (149)..(149): n is a, c, g, or t
  misc_feature (151)..(151): n is a, c, g, or t
  misc_feature (155)..(155): n is a, c, g, or t
  misc_feature (158)..(158): n is a, c, g, or t
  misc_feature (161)..(162): n is a, c, g, or t
  misc_feature (169)..(169): n is a, c, g, or t
  misc_feature (171)..(171): n is a, c, g, or t
  misc_feature (178)..(179): n is a, c, g, or t
  misc_feature (181)..(183): n is a, c, g, or t
  misc_feature (187)..(187): n is a, c, g, or t
  misc_feature (189)..(189): n is a, c, g, or t
  misc_feature (191)..(194): n is a, c, g, or t
  misc_feature (199)..(200): n is a, c, g, or t
  misc_feature (202)..(202): n is a, c, g, or t
  misc_feature (205)..(205): n is a, c, g, or t
  misc_feature (207)..(207): n is a, c, g, or t
  misc_feature (210)..(210): n is a, c, g, or t
  misc_feature (212)..(215): n is a, c, g, or t
  misc_feature (218)..(218): n is a, c, g, or t
  misc_feature (220)..(220): n is a, c, g, or t
  misc_feature (228)..(229): n is a, c, g, or t
  misc_feature (236)..(239): n is a, c, g, or t
  misc_feature (246)..(247): n is a, c, g, or t
  misc_feature (249)..(251): n is a, c, g, or t
  misc_feature (253)..(253): n is a, c, g, or t
  misc_feature (256)..(259): n is a, c, g, or t
  misc_feature (264)..(265): n is a, c, g, or t
  misc_feature (267)..(268): n is a, c, g, or t
  misc_feature (271)..(271): n is a, c, g, or t
  misc_feature (273)..(278): n is a, c, g, or t
  misc_feature (283)..(284): n is a, c, g, or t
  misc_feature (286)..(286): n is a, c, g, or t
  misc_feature (288)..(290): n is a, c, g, or t
  misc_feature (293)..(293): n is a, c, g, or t
  misc_feature (296)..(297): n is a, c, g, or t
  misc_feature (299)..(299): n is a, c, g, or t
  misc_feature (301)..(302): n is a, c, g, or t
  misc_feature (304)..(304): n is a, c, g, or t
  misc_feature (306)..(310): n is a, c, g, or t
  misc_feature (312)..(322): n is a, c, g, or t
  misc_feature (326)..(326): n is a, c, g, or t
  misc_feature (330)..(332): n is a, c, g, or t
  misc_feature (334)..(338): n is a, c, g, or t
  misc_feature (340)..(340): n is a, c, g, or t
  misc_feature (342)..(342): n is a, c, g, or t
  misc_feature (344)..(344): n is a, c, g, or t
  misc_feature (346)..(348): n is a, c, g, or t
  misc_feature (351)..(351): n is a, c, g, or t
  misc_feature (353)..(354): n is a, c, g, or t
  misc_feature (356)..(359): n is a, c, g, or t
  misc_feature (362)..(362): n is a, c, g, or t
  misc_feature (364)..(366): n is a, c, g, or t
  misc_feature (368)..(368): n is a, c, g, or t
  misc_feature (370)..(371): n is a, c, g, or t
  misc_feature (373)..(374): n is a, c, g, or t
  misc_feature (377)..(379): n is a, c, g, or t
  misc_feature (382)..(387): n is a, c, g, or t
  misc_feature (390)..(400): n is a, c, g, or t
  misc_feature (402)..(402): n is a, c, g, or t
  misc_feature (405)..(416): n is a, c, g, or t
  misc_feature (418)..(419): n is a, c, g, or t
  misc_feature (421)..(424): n is a, c, g, or t
  misc_feature (427)..(427): n is a, c, g, or t
  misc_feature (429)..(431): n is a, c, g, or t
  misc_feature (433)..(437): n is a, c, g, or t
  misc_feature (439)..(441): n is a, c, g, or t
  misc_feature (443)..(444): n is a, c, g, or t
  misc_feature (446)..(447): n is a, c, g, or t
  misc_feature (449)..(449): n is a, c, g, or t
  misc_feature (451)..(451): n is a, c, g, or t
  misc_feature (453)..(457): n is a, c, g, or t
  misc_feature (460)..(461): n is a, c, g, or t
  misc_feature (464)..(465): n is a, c, g, or t
  misc_feature (468)..(473): n is a, c, g, or t
  misc_feature (475)..(476): n is a, c, g, or t
  misc_feature (480)..(482): n is a, c, g, or t
  misc_feature (484)..(487): n is a, c, g, or t
  misc_feature (489)..(489): n is a, c, g, or t
  misc_feature (491)..(494): n is a, c, g, or t
  misc_feature (496)..(496): n is a, c, g, or t
  misc_feature (498)..(500): n is a, c, g, or t
  misc_feature (504)..(511): n is a, c, g, or t
  misc_feature (513)..(513): n is a, c, g, or t
  misc_feature (518)..(524): n is a, c, g, or t
  misc_feature (526)..(529): n is a, c, g, or t
  misc_feature (531)..(541): n is a, c, g, or t
  misc_feature (545)..(549): n is a, c, g, or t
  misc_feature (551)..(551): n is a, c, g, or t
  misc_feature (553)..(559): n is a, c, g, or t
  misc_feature (561)..(564): n is a, c, g, or t
  misc_feature (567)..(567): n is a, c, g, or t
  misc_feature (569)..(572): n is a, c, g, or t
  misc_feature (574)..(578): n is a, c, g, or t
  misc_feature (580)..(582): n is a, c, g, or t
  misc_feature (584)..(585): n is a, c, g, or t
  misc_feature (588)..(595): n is a, c, g, or t
  misc_feature (597)..(601): n is a, c, g, or t
  misc_feature (603)..(611): n is a, c, g, or t
  misc_feature (614)..(614): n is a, c, g, or t
  misc_feature (617)..(618): n is a, c, g, or t
  misc_feature (620)..(626): n is a, c, g, or t
  misc_feature (628)..(632): n is a, c, g, or t
  misc_feature (634)..(634): n is a, c, g, or t
  misc_feature (636)..(639): n is a, c, g, or t
  misc_feature (642)..(647): n is a, c, g, or t
  misc_feature (650)..(651): n is a, c, g, or t
  misc_feature (653)..(653): n is a, c, g, or t
  misc_feature (658)..(660): n is a, c, g, or t
  misc_feature (662)..(671): n is a, c, g, or t
  misc_feature (674)..(676): n is a, c, g, or t
  misc_feature (678)..(679): n is a, c, g, or t
  misc_feature (681)..(688): n is a, c, g, or t
  misc_feature (691)..(692): n is a, c, g, or t
  misc_feature (694)..(698): n is a, c, g, or t
  misc_feature (701)..(702): n is a, c, g, or t
  misc_feature (704)..(708): n is a, c, g, or t
  misc_feature (710)..(712): n is a, c, g, or t
  misc_feature (714)..(715): n is a, c, g, or t
  misc_feature (717)..(720): n is a, c, g, or t
  misc_feature (722)..(723): n is a, c, g, or t
  misc_feature (725)..(727): n is a, c, g, or t
  misc_feature (729)..(733): n is a, c, g, or t
  misc_feature (735)..(737): n is a, c, g, or t
  misc_feature (739)..(742): n is a, c, g, or t
  misc_feature (744)..(745): n is a, c, g, or t
  misc_feature (747)..(748): n is a, c, g, or t
  misc_feature (751)..(754): n is a, c, g, or t
  misc_feature (756)..(759): n is a, c, g, or t
  misc_feature (762)..(762): n is a, c, g, or t
  misc_feature (764)..(765): n is a, c, g, or t
  misc_feature (767)..(771): n is a, c, g, or t
  misc_feature (773)..(782): n is a, c, g, or t
  misc_feature (784)..(789): n is a, c, g, or t
  misc_feature (793)..(793): n is a, c, g, or t
  misc_feature (795)..(797): n is a, c, g, or t
  misc_feature (799)..(804): n is a, c, g, or t
  misc_feature (807)..(809): n is a, c, g, or t
  misc_feature (811)..(811): n is a, c, g, or t
  misc_feature (813)..(820): n is a, c, g, or t
  misc_feature (823)..(823): n is a, c, g, or t
  misc_feature (826)..(827): n is a, c, g, or t
  misc_feature (829)..(829): n is a, c, g, or t
  misc_feature (832)..(833): n is a, c, g, or t
  misc_feature (835)..(836): n is a, c, g, or t
  misc_feature (838)..(839): n is a, c, g, or t
  misc_feature (841)..(842): n is a, c, g, or t
  misc_feature (844)..(855): n is a, c, g, or t
  misc_feature (860)..(861): n is a, c, g, or t
  misc_feature (863)..(863): n is a, c, g, or t
  misc_feature (867)..(869): n is a, c, g, or t
  misc_feature (873)..(877): n is a, c, g, or t
  misc_feature (879)..(882): n is a, c, g, or t
  misc_feature (884)..(894): n is a, c, g, or t
  misc_feature (897)..(904): n is a, c, g, or t
  misc_feature (906)..(909): n is a, c, g, or t
  misc_feature (912)..(915): n is a, c, g, or t
  misc_feature (917)..(918): n is a, c, g, or t
  misc_feature (920)..(922): n is a, c, g, or t
  misc_feature (925)..(927): n is a, c, g, or t
  misc_feature (929)..(932): n is a, c, g, or t
  misc_feature (934)..(934): n is a, c, g, or t
  misc_feature (936)..(937): n is a, c, g, or t
  misc_feature (939)..(951): n is a, c, g, or t
  misc_feature (953)..(954): n is a, c, g, or t
  misc_feature (956)..(961): n is a, c, g, or t
  misc_feature (963)..(971): n is a, c, g, or t
  misc_feature (973)..(973): n is a, c, g, or t
  misc_feature (975)..(977): n is a, c, g, or t
  misc_feature (979)..(989): n is a, c, g, or t
  misc_feature (991)..(994): n is a, c, g, or t
  misc_feature (996)..(997): n is a, c, g, or t
  misc_feature (999)..(999): n is a, c, g, or t
  misc_feature (1001)..(1001): n is a, c, g, or t
  misc_feature (1003)..(1018): n is a, c, g, or t
  misc_feature (1020)..(1022): n is a, c, g, or t
  misc_feature (1024)..(1024): n is a, c, g, or t
  misc_feature (1026)..(1030): n is a, c, g, or t
  misc_feature (1032)..(1032): n is a, c, g, or t
  misc_feature (1034)..(1039): n is a, c, g, or t
  misc_feature (1041)..(1048): n is a, c, g, or t
  misc_feature (1051)..(1055): n is a, c, g, or t
  misc_feature (1058)..(1058): n is a, c, g, or t
  misc_feature (1060)..(1069): n is a, c, g, or t
  misc_feature (1071)..(1072): n is a, c, g, or t
  misc_feature (1074)..(1080): n is a, c, g, or t
  misc_feature (1082)..(1087): n is a, c, g, or t
  misc_feature (1092)..(1098): n is a, c, g, or t
  misc_feature (1101)..(1101): n is a, c, g, or t
  misc_feature (1103)..(1103): n is a, c, g, or t
  misc_feature (1105)..(1106): n is a, c, g, or t
  misc_feature (1110)..(1110): n is a, c, g, or t
  misc_feature (1113)..(1121): n is a, c, g, or t
  misc_feature (1124)..(1124): n is a, c, g, or t
  misc_feature (1126)..(1127): n is a, c, g, or t
  misc_feature (1130)..(1131): n is a, c, g, or t
  misc_feature (1136)..(1137): n is a, c, g, or t
  misc_feature (1139)..(1141): n is a, c, g, or t
  misc_feature (1143)..(1143): n is a, c, g, or t
  misc_feature (1146)..(1147): n is a, c, g, or t
  misc_feature (1150)..(1150): n is a, c, g, or t
  misc_feature (1152)..(1159): n is a, c, g, or t
  misc_feature (1164)..(1165): n is a, c, g, or t
  misc_feature (1170)..(1170): n is a, c, g, or t
  misc_feature (1175)..(1175): n is a, c, g, or t
  misc_feature (1180)..(1180): n is a, c, g, or t
  misc_feature (1182)..(1184): n is a, c, g, or t
  misc_feature (1186)..(1186): n is a, c, g, or t
  misc_feature (1188)..(1189): n is a, c, g, or t
  misc_feature (1372)..(1372): n is a, c, g, or t
  misc_feature (1383)..(1383): n is a, c, g, or t
  misc_feature (1385)..(1385): n is a, c, g, or t
  misc_feature (1387)..(1391): n is a, c, g, or t
  misc_feature (1396)..(1397): n is a, c, g, or t
  misc_feature (1400)..(1402): n is a, c, g, or t
  misc_feature (1404)..(1405): n is a, c, g, or t
  misc_feature (1407)..(1408): n is a, c, g, or t
  misc_feature (1411)..(1414): n is a, c, g, or t
  misc_feature (1416)..(1417): n is a, c, g, or t
  misc_feature (1420)..(1425): n is a, c, g, or t
  misc_feature (1427)..(1427): n is a, c, g, or t
  misc_feature (1429)..(1429): n is a, c, g, or t
  misc_feature (1431)..(1431): n is a, c, g, or t
  misc_feature (1433)..(1433): n is a, c, g, or t
  misc_feature (1438)..(1439): n is a, c, g, or t
  misc_feature (1441)..(1443): n is a, c, g, or t
  misc_feature (1445)..(1445): n is a, c, g, or t
  misc_feature (1447)..(1448): n is a, c, g, or t
  misc_feature (1451)..(1452): n is a, c, g, or t
  misc_feature (1454)..(1454): n is a, c, g, or t
  misc_feature (1456)..(1456): n is a, c, g, or t
  misc_feature (1458)..(1458): n is a, c, g, or t
  misc_feature (1461)..(1462): n is a, c, g, or t
  misc_feature (1466)..(1467): n is a, c, g, or t
  misc_feature (1469)..(1469): n is a, c, g, or t
  misc_feature (1471)..(1479): n is a, c, g, or t
  misc_feature (1481)..(1481): n is a, c, g, or t
  misc_feature (1485)..(1485): n is a, c, g, or t
  misc_feature (1487)..(1488): n is a, c, g, or t
  misc_feature (1491)..(1491): n is a, c, g, or t
  misc_feature (1493)..(1496): n is a, c, g, or t
  misc_feature (1498)..(1502): n is a, c, g, or t
  misc_feature (1504)..(1505): n is a, c, g, or t
  misc_feature (1508)..(1509): n is a, c, g, or t
  misc_feature (1514)..(1520): n is a, c, g, or t
  misc_feature (1522)..(1522): n is a, c, g, or t
  misc_feature (1524)..(1527): n is a, c, g, or t
  misc_feature (1529)..(1529): n is a, c, g, or t
  misc_feature (1532)..(1532): n is a, c, g, or t
  misc_feature (1534)..(1535): n is a, c, g, or t
gtntnnncttnnnatnantntnanannnanaattataantntcngnatgnnnatnnnannnntnnnnnnnntnngtantntttnntntgtntntntnnanntcnnntnnnttnaaatncacatananagnntanncntannntntantngnatantcntcnngttctantncttgcanntnnnttanantnnnnatttnnanaangncangnnnnacncnaccagaannagtaatnnnnatttttnntnnngntannnntaaannannatnannnnnnaccanntncnnntantcnntnanntncnnnnncnnnnnnnnnnnaaantccnnngnnnnntnancntnnnccntnntnnnnttntnnncncnnannatnnntgnnnnnnatnnnnnnnnnnntnatnnnnnnnnnnnntnntnnnntanannntnnnnntnnntnngnntnanannnnnatnnatnnttnnnnnnannaatnnntnnnnanannnntncnnntttnnnnnnnnanaaaannnnnnntnnnntnnnnnnnnnnncaannnnnanannnnnnntnnnntantnnnnannnnnannncnnctnnnnnnnnannnnncnnnnnnnnnatnccnncnnnnnnntnnnnntnannnntannnnnnctnntnggggnnnannnnnnnnnnatnnncnnannnnnnnnttnntnnnnnaannannnnnannncnngnnnntnngnnntnnnnnannntnnnnannannttnnnntnnnntantnngnnnnntnnnnnnnnnntnnnnnntttnannnannnnnnaannnantnnnnnnnnctnttnngnatnntnngnntnncnnnnnnnnnnnnaagtnnanacannncaannnnntnnnncnnnnnnnnnnnttnnnnnnnncnnnnatnnnnannannncannnannnnantnnannnnnnnnnnnnnanncnnnnnnannnnnnnnnantnnnannnnnnnnnnnannnnannananannnnnnnnnnnnnnnnannntntnnnnnanannnnnnannnnnnnnagnnnnngangnnnnnnnnnnannannnnnnnannnnnnaatgnnnnnnntgnantnnaacnagnnnnnnnnngangnngannacgannannnanaannagnannnnnnnntaaanntaaanatatngaaantnnnantnncagccctattaaaacgtatttggaaactagttcggtcgatactatttcccaagaaggaatgctgcaaataaaggagtattactacaagaaaaaatacctagatcgtattttggaagattttcgttaatagcgtaatattgcaaccctgcccagatggcggaattggtagacgcactagactcnaaatctagcgntngnnnnnatgtnnagnnncnntnnctnnnntnngcnnnnnncntntnangattnncnnnananngtnntntntntcnnagcnntntnnnnnnnnngntttngnnaanannnnannnnnannaannccaannnnnnngnannnngntantnntgaaagggtttgggtaagaccaccttttaggaagacggcgaaatgaaatgaagccgtcagtcctaaaagaaaaattattacttagtagctttcctaggaaccttctccgttgccattgcagcatgataaatataagaagccataattgttgcattcttcattaagtcttctggttgaataccttcaagataatctagattggtatgtcctgcagtaccgggtgttctatcttgtaaatattgaaaacctggaagacccacttcatcaaaagaaacatggtcggtacttcctaggctttgattagacaccatattcatacctaagtcacgaaaaggttccatccatgcagtaagcatggtgcgtgctgcttcattaccttgtaaatatatgcctcggtattgtcctgcaccatagtcttgattaaaataagcagataacatttcatattctggcttgatgccaatagctgcattacgcgggtcaccaaaatgtttttgtacataagcgcgcgagccatataaaccttgctcttctcccgaccataaagcaatgcgaatagtacgcataggttttacccctaaagttttaagtatgcgcatggcttccaatgcgactgctgtgccagatgagttatcacttgcattagaactaccatgccaagtatcaaaatgtgcacccaccattactattccttctttaggatttgttccagggatttcacctactaaattcattgcttgttctaccttatctcctattttattttttatctctagttcaatttttactgctatacctctttttaatacacggtacattctattataatgttctggtgtgactgctaaaatgggtgatgcatttttcatgcctgctgcagaccatccatcttctcttacacccggacgtgaataagcaggaactatacctaatctattgccatcggtttgtaaaaccactgctacattttctgattttaaaaaagccatgcgctctactgcattaataattgttgggtttttaataaccctagctgcatttgcttttataggcgtaatagtggcttgttcaagtgcaataagctcttcgttattataacggtgtaccccatttataagtgttagtaaatcaattacagcagggcttgaaataagtactgccttgccttttaatttacctctatataattcaatgtcttctttggtttgaatatccaccaccattgcctctgcatttatttttcctactgtaccagcagtataagcaactggataagcgttgagtggcatgtaatcgggttcaatcatatgtgccgatacatattcattatcccaggtaacaccatagtccatataggcttcgctattcacattcgttaagcccatctttttcatttcatctaaagcccaaacttgagctctttgcatgtctctagacaaagtaagtcttgcgcctaatacatctacgatataagactcatactccattactttagaacgctgtaagccttcttcgcgtatacgcgctaccatggcccagtctactaaaccaggaaaggtaaacgcaaaggaagaggtaagcacaagtacaaaggaaattactcgaacaagtttgattttgaaaaatgtcttcatgagaacttaaatttagggataggaatgtattttttctacattcaatatactaaaatattctcagaactattatttctccatggtcattatagcagagaaaacctgaataccctcaaaaaagtttttcagtttaatattctcattctcggcatgctggttattatcgtgattggcaataggcaccgtcactggagaagttttcaatactttttcaaatacaaataaaggaaggcttcctccaagtgttggaagtaatagtggctgctcattatctactagtgaaatggcttttgaaattcttcttacatacagattgtctaaagaagttttttgagcattataactttttttatcctgcacgaccatacaaattttagcattcaattttctttcttcatcggtaggttctttatctgttacaaaaaagccttgcgccttaatatggtcaattactttttgttgttgtctttgccaatcattaccaactaccaatctcatatcaacagaagcgatagccttcgtaggtattacattggcagaatacttacctacccctgcgctttgtataccattgatatttaaagaaggtaattgtaaggcgtcgtttaaggcgcctgttctttctgtggcattaatacctaattcttttttaagttggtcttccacactgggaatatttgcaagggcttgcttttcggcagtagataaagctattacatcgtcgtaaaaacctttaatagttacttcccccttttcatttttcatactggcaagtagtcttacaagttccatcgccgggtttaatacccaattaccataatgtccagagtg

SEQ ID NO: 1272 - DNA, 4000 bp, Escherichia coli
  misc_feature (112)..(112): n is a, c, g, or t
  misc_feature (337)..(337): n is a, c, g, or t
  misc_feature (1063)..(1063): n is a, c, g, or t
  misc_feature (2046)..(2046): n is a, c, g, or t
  misc_feature (2454)..(2454): n is a, c, g, or t
  misc_feature (2877)..(2877): n is a, c, g, or t
  misc_feature (2916)..(2916): n is a, c, g, or t
  misc_feature (2935)..(2935): n is a, c, g, or t
  misc_feature (2938)..(2938): n is a, c, g, or t
  misc_feature (2942)..(2942): n is a, c, g, or t
  misc_feature (2951)..(2951): n is a, c, g, or t
  misc_feature (2962)..(2963): n is a, c, g, or t
  misc_feature (2965)..(2966): n is a, c, g, or t
  misc_feature (2968)..(2968): n is a, c, g, or t
  misc_feature (2970)..(2975): n is a, c, g, or t
  misc_feature (2979)..(2979): n is a, c, g, or t
  misc_feature (2981)..(2985): n is a, c, g, or t
  misc_feature (2987)..(2991): n is a, c, g, or t
  misc_feature (2994)..(2994): n is a, c, g, or t
  misc_feature (2996)..(2999): n is a, c, g, or t
  misc_feature (3001)..(3002): n is a, c, g, or t
  misc_feature (3005)..(3007): n is a, c, g, or t
  misc_feature (3009)..(3011): n is a, c, g, or t
  misc_feature (3013)..(3013): n is a, c, g, or t
  misc_feature (3015)..(3016): n is a, c, g, or t
  misc_feature (3018)..(3021): n is a, c, g, or t
  misc_feature (3023)..(3023): n is a, c, g, or t
  misc_feature (3025)..(3030): n is a, c, g, or t
  misc_feature (3033)..(3040): n is a, c, g, or t
  misc_feature (3043)..(3052): n is a, c, g, or t
  misc_feature (3054)..(3054): n is a, c, g, or t
  misc_feature (3056)..(3065): n is a, c, g, or t
  misc_feature (3067)..(3068): n is a, c, g, or t
  misc_feature (3070)..(3070): n is a, c, g, or t
  misc_feature (3072)..(3072): n is a, c, g, or t
  misc_feature (3074)..(3076): n is a, c, g, or t
  misc_feature (3078)..(3080): n is a, c, g, or t
  misc_feature (3083)..(3084): n is a, c, g, or t
  misc_feature (3086)..(3087): n is a, c, g, or t
  misc_feature (3089)..(3097): n is a, c, g, or t
  misc_feature (3099)..(3105): n is a, c, g, or t
  misc_feature (3107)..(3107): n is a, c, g, or t
  misc_feature (3110)..(3110): n is a, c, g, or t
  misc_feature (3113)..(3117): n is a, c, g, or t
  misc_feature (3119)..(3119): n is a, c, g, or t
  misc_feature (3122)..(3131): n is a, c, g, or t
  misc_feature (3133)..(3133): n is a, c, g, or t
  misc_feature (3136)..(3141): n is a, c, g, or t
  misc_feature (3144)..(3144): n is a, c, g, or t
  misc_feature (3146)..(3146): n is a, c, g, or t
  misc_feature (3149)..(3151): n is a, c, g, or t
  misc_feature (3155)..(3155): n is a, c, g, or t
  misc_feature (3161)..(3162): n is a, c, g, or t
  misc_feature (3164)..(3168): n is a, c, g, or t
  misc_feature (3170)..(3170): n is a, c, g, or t
  misc_feature (3172)..(3174): n is a, c, g, or t
  misc_feature (3176)..(3181): n is a, c, g, or t
  misc_feature (3183)..(3183): n is a, c, g, or t
  misc_feature (3185)..(3185): n is a, c, g, or t
  misc_feature (3188)..(3191): n is a, c, g, or t
  misc_feature (3193)..(3193): n is a, c, g, or t
  misc_feature (3199)..(3201): n is a, c, g, or t
  misc_feature (3203)..(3203): n is a, c, g, or t
  misc_feature (3205)..(3205): n is a, c, g, or t
  misc_feature (3207)..(3210): n is a, c, g, or t
  misc_feature (3213)..(3213): n is a, c, g, or t
  misc_feature (3216)..(3216): n is a, c, g, or t
  misc_feature (3219)..(3225): n is a, c, g, or t
  misc_feature (3227)..(3230): n is a, c, g, or t
  misc_feature (3232)..(3234): n is a, c, g, or t
  misc_feature (3236)..(3240): n is a, c, g, or t
  misc_feature (3244)..(3249): n is a, c, g, or t
  misc_feature (3251)..(3252): n is a, c, g, or t
  misc_feature (3256)..(3258): n is a, c, g, or t
  misc_feature (3260)..(3262): n is a, c, g, or t
  misc_feature (3264)..(3264): n is a, c, g, or t
  misc_feature (3267)..(3268): n is a, c, g, or t
  misc_feature (3272)..(3272): n is a, c, g, or t
  misc_feature (3276)..(3276): n is a, c, g, or t
  misc_feature (3279)..(3279): n is a, c, g, or t
  misc_feature (3282)..(3282): n is a, c, g, or t
  misc_feature (3285)..(3287): n is a, c, g, or t
  misc_feature (3289)..(3291): n is a, c, g, or t
  misc_feature (3296)..(3298): n is a, c, g, or t
  misc_feature (3300)..(3302): n is a, c, g, or t
  misc_feature (3304)..(3304): n is a, c, g, or t
  misc_feature (3306)..(3308): n is a, c, g, or t
  misc_feature (3315)..(3316): n is a, c, g, or t
  misc_feature (3319)..(3322): n is a, c, g, or t
  misc_feature (3324)..(3327): n is a, c, g, or t
  misc_feature (3331)..(3333): n is a, c, g, or t
  misc_feature (3336)..(3338): n is a, c, g, or t
  misc_feature (3341)..(3341): n is a, c, g, or t
  misc_feature (3345)..(3346): n is a, c, g, or t
  misc_feature (3349)..(3349): n is a, c, g, or t
  misc_feature (3353)..(3353): n is a, c, g, or t
  misc_feature (3355)..(3355): n is a, c, g, or t
  misc_feature (3357)..(3361): n is a, c, g, or t
  misc_feature (3363)..(3366): n is a, c, g, or t
  misc_feature (3368)..(3368): n is a, c, g, or t
  misc_feature (3370)..(3370): n is a, c, g, or t
  misc_feature (3372)..(3372): n is a, c, g, or t
  misc_feature (3375)..(3375): n is a, c, g, or t
  misc_feature (3377)..(3377): n is a, c, g, or t
  misc_feature (3379)..(3379): n is a, c, g, or t
  misc_feature (3381)..(3382): n is a, c, g, or t
  misc_feature (3384)..(3384): n is a, c, g, or t
  misc_feature (3386)..(3388): n is a, c, g, or t
  misc_feature (3393)..(3394): n is a, c, g, or t
  misc_feature (3396)..(3396): n is a, c, g, or t
  misc_feature (3398)..(3399): n is a, c, g, or t
  misc_feature (3404)..(3404): n is a, c, g, or t
  misc_feature (3406)..(3407): n is a, c, g, or t
  misc_feature (3410)..(3411): n is a, c, g, or t
  misc_feature (3413)..(3413): n is a, c, g, or t
  misc_feature (3421)..(3421): n is a, c, g, or t
  misc_feature (3423)..(3423): n is a, c, g, or t
  misc_feature (3425)..(3425): n is a, c, g, or t
  misc_feature (3427)..(3427): n is a, c, g, or t
  misc_feature (3432)..(3435): n is a, c, g, or t
  misc_feature (3437)..(3437): n is a, c, g, or t
  misc_feature (3441)..(3442): n is a, c, g, or t
  misc_feature (3444)..(3445): n is a, c, g, or t
  misc_feature (3449)..(3451): n is a, c, g, or t
  misc_feature (3453)..(3455): n is a, c, g, or t
  misc_feature (3462)..(3462): n is a, c, g, or t
  misc_feature (3464)..(3465): n is a, c, g, or t
  misc_feature (3467)..(3469): n is a, c, g, or t
  misc_feature (3472)..(3472): n is a, c, g, or t
  misc_feature (3476)..(3479): n is a, c, g, or t
  misc_feature (3481)..(3481): n is a, c, g, or t
  misc_feature (3483)..(3485): n is a, c, g, or t
  misc_feature (3492)..(3493): n is a, c, g, or t
  misc_feature (3495)..(3495): n is a, c, g, or t
  misc_feature (3497)..(3497): n is a, c, g, or t
  misc_feature (3500)..(3500): n is a, c, g, or t
  misc_feature (3503)..(3503): n is a, c, g, or t
  misc_feature (3505)..(3505): n is a, c, g, or t
  misc_feature (3509)..(3509): n is a, c, g, or t
  misc_feature (3511)..(3512): n is a, c, g, or t
  misc_feature (3514)..(3516): n is a, c, g, or t
  misc_feature (3520)..(3520): n is a, c, g, or t
  misc_feature (3524)..(3524): n is a, c, g, or t
  misc_feature (3526)..(3527): n is a, c, g, or t
  misc_feature (3530)..(3536): n is a, c, g, or t
  misc_feature (3539)..(3539): n is a, c, g, or t
  misc_feature (3543)..(3543): n is a, c, g, or t
  misc_feature (3546)..(3546): n is a, c, g, or t
  misc_feature (3550)..(3550): n is a, c, g, or t
  misc_feature (3552)..(3553): n is a, c, g, or t
  misc_feature (3557)..(3557): n is a, c, g, or t
  misc_feature (3559)..(3559): n is a, c, g, or t
  misc_feature (3561)..(3565): n is a, c, g, or t
  misc_feature (3567)..(3572): n is a, c, g, or t
  misc_feature (3574)..(3575): n is a, c, g, or t
  misc_feature (3578)..(3578): n is a, c, g, or t
  misc_feature (3581)..(3582): n is a, c, g, or t
  misc_feature (3584)..(3584): n is a, c, g, or t
  misc_feature (3586)..(3587): n is a, c, g, or t
  misc_feature (3589)..(3590): n is a, c, g, or t
  misc_feature (3592)..(3592): n is a, c, g, or t
  misc_feature (3595)..(3595): n is a, c, g, or t
  misc_feature (3598)..(3598): n is a, c, g, or t
  misc_feature (3601)..(3601): n is a, c, g, or t
  misc_feature (3605)..(3606): n is a, c, g, or t
  misc_feature (3614)..(3614): n is a, c, g, or t
  misc_feature (3616)..(3616): n is a, c, g, or t
  misc_feature (3618)..(3619): n is a, c, g, or t
  misc_feature (3622)..(3623): n is a, c, g, or t
  misc_feature (3626)..(3626): n is a, c, g, or t
  misc_feature (3631)..(3632): n is a, c, g, or t
  misc_feature (3635)..(3635): n is a, c, g, or t
  misc_feature (3637)..(3637): n is a, c, g, or t
  misc_feature (3639)..(3640): n is a, c, g, or t
  misc_feature (3642)..(3647): n is a, c, g, or t
  misc_feature (3649)..(3649): n is a, c, g, or t
  misc_feature (3651)..(3651): n is a, c, g, or t
  misc_feature (3653)..(3653): n is a, c, g, or t
  misc_feature (3658)..(3658): n is a, c, g, or t
  misc_feature (3665)..(3665): n is a, c, g, or t
  misc_feature (3667)..(3671): n is a, c, g, or t
  misc_feature (3673)..(3673): n is a, c, g, or t
  misc_feature (3676)..(3676): n is a, c, g, or t
  misc_feature (3679)..(3679): n is a, c, g, or t
  misc_feature (3681)..(3683): n is a, c, g, or t
  misc_feature (3686)..(3686): n is a, c, g, or t
  misc_feature (3688)..(3688): n is a, c, g, or t
  misc_feature (3694)..(3695): n is a, c, g, or t
  misc_feature (3698)..(3703): n is a, c, g, or t
  misc_feature (3706)..(3709): n is a, c, g, or t
  misc_feature (3712)..(3715): n is a, c, g, or t
  misc_feature (3717)..(3717): n is a, c, g, or t
  misc_feature (3719)..(3720): n is a, c, g, or t
  misc_feature (3722)..(3722): n is a, c, g, or t
  misc_feature (3726)..(3726): n is a, c, g, or t
  misc_feature (3729)..(3729): n is a, c, g, or t
  misc_feature (3732)..(3733): n is a, c, g, or t
  misc_feature (3740)..(3740): n is a, c, g, or t
  misc_feature (3742)..(3742): n is a, c, g, or t
  misc_feature (3746)..(3750): n is a, c, g, or t
  misc_feature (3755)..(3758): n is a, c, g, or t
  misc_feature (3762)..(3764): n is a, c, g, or t
  misc_feature (3767)..(3768): n is a, c, g, or t
  misc_feature (3770)..(3770): n is a, c, g, or t
  misc_feature (3772)..(3772): n is a, c, g, or t
  misc_feature (3774)..(3774): n is a, c, g, or t
  misc_feature (3776)..(3776): n is a, c, g, or t
  misc_feature (3778)..(3779): n is a, c, g, or t
  misc_feature (3782)..(3782): n is a, c, g, or t
  misc_feature (3784)..(3784): n is a, c, g, or t
  misc_feature (3786)..(3786): n is a, c, g, or t
  misc_feature (3790)..(3790): n is a, c, g, or t
  misc_feature (3792)..(3793): n is a, c, g, or t
  misc_feature (3795)..(3795): n is a, c, g, or t
  misc_feature (3797)..(3803): n is a, c, g, or t
  misc_feature (3807)..(3808): n is a, c, g, or t
  misc_feature (3810)..(3811): n is a, c, g, or t
  misc_feature (3818)..(3818): n is a, c, g, or t
  misc_feature (3822)..(3823): n is a, c, g, or t
  misc_feature (3825)..(3826): n is a, c, g, or t
  misc_feature (3828)..(3832): n is a, c, g, or t
  misc_feature (3834)..(3840): n is a, c, g, or t
  misc_feature (3843)..(3847): n is a, c, g, or t
  misc_feature (3851)..(3854): n is a, c, g, or t
  misc_feature (3856)..(3857): n is a, c, g, or t
  misc_feature (3859)..(3859): n is a, c, g, or t
  misc_feature (3862)..(3862): n is a, c, g, or t
  misc_feature (3864)..(3864): n is a, c, g, or t
  misc_feature (3866)..(3868): n is a, c, g, or t
  misc_feature (3870)..(3874): n is a, c, g, or t
  misc_feature (3876)..(3879): n is a, c, g, or t
  misc_feature (3881)..(3881): n is a, c, g, or t
  misc_feature (3883)..(3884): n is a, c, g, or t
  misc_feature (3886)..(3890): n is a, c, g, or t
  misc_feature (3897)..(3898): n is a, c, g, or t
  misc_feature (3901)..(3901): n is a, c, g, or t
  misc_feature (3904)..(3905): n is a, c, g, or t
  misc_feature (3910)..(3911): n is a, c, g, or t
  misc_feature (3913)..(3913): n is a, c, g, or t
  misc_feature (3915)..(3915): n is a, c, g, or t
  misc_feature (3918)..(3918): n is a, c, g, or t
  misc_feature (3920)..(3926): n is a, c, g, or t
  misc_feature (3928)..(3928): n is a, c, g, or t
  misc_feature (3931)..(3931): n is a, c, g, or t
  misc_feature (3933)..(3936): n is a, c, g, or t
  misc_feature (3939)..(3939): n is a, c, g, or t
  misc_feature (3943)..(3944): n is a, c, g, or t
  misc_feature (3946)..(3947): n is a, c, g, or t
  misc_feature (3949)..(3950): n is a, c, g, or t
  misc_feature (3952)..(3952): n is a, c, g, or t
  misc_feature (3954)..(3959): n is a, c, g, or t
  misc_feature (3962)..(3962): n is a, c, g, or t
  misc_feature (3964)..(3965): n is a, c, g, or t
  misc_feature (3967)..(3967): n is a, c, g, or t
  misc_feature (3969)..(3975): n is a, c, g, or t
  misc_feature (3982)..(3984): n is a, c, g, or t
  misc_feature (3986)..(3988): n is a, c, g, or t
  misc_feature (3990)..(3991): n is a, c, g, or t
  misc_feature (3993)..(3993): n is a, c, g, or t
  misc_feature (3995)..(3995): n is a, c, g, or t
  misc_feature (3997)..(3997): n is a, c, g, or t
  misc_feature (3999)..(3999): n is a, c, g, or t
gttaagatctaacgctttccaaaggttcaattgcaggctacttgtcaccttattctttagatattccaacgcgtaaaggctgtgaataccggctgcttctatttgatgttgntgaatgaaacaatagccaacactaaatgatttcaataacttctgacttggaagtaactggcggaagtctgcatttagtgtcgtttcaaagcctaaagcgttaatcgttccgaagttaactgacttccaaagtattgctcctgcagcgtctttttcgccatcatcaatccaatcgatgaggttagtatggtgattatagaagctacttacagtgcctgaaagtccntttttgttatatttcactccgacttctacggcagaaagttcctcaggtttaaggtttggatcggctttatggcctccaaccgagtagaaaagttcggttactgatggcatgcgtagcgacgtattataactcgcatagactttccatgcatcgccaaatctataacttgcgttgatgcttggatagacttttacattcatttcggcccaactgttcttcacacccactactcctgccgacatcgttagacgcccaatgagaaggttatgctctgcaacgaactggatgtttgtgcgattaagtcccatcttatacatcacattgtcggttcctttcacgtgtttgggcttggaaagtgggttgccaaggttcgtacttactaagtcttcgtttcgcaattcagcaccaaacgccgtgcgacctaacgtccaatcaaagtatgcattgacgttaacgccgtagacatctgtacgatgatagttgaaaggataacgttccgcatggtcgcgaaagagttcaaagcggtcgtagttatgattccaatagatagccggacgccatttaacagcaccctttcttgtttcagcttgcaccgccgtataggtcttaaaggtatgttcaaactggtcatcatacttggaactatagttagtactcgagccaaagtctttgttactaaggcctgcatgccaactaatggagaggtcatcatcgtcataaaagccntgataaaaagccttctgacttcggaaatcagtatttaacgcgccggctttattgcgattatagccatcggttcgcatgaaactgcccgataattgattgttccatttgcccctcgctacattgattcttcctcccgaagtgactgagccgaagctgccacttgccgcatgtagggtgacacttgaagttcgattggcctttgtaacgatgtttatggcaccaagaagtgacgatgttccataaacacttgcagccggtccttcgagtatttcaatgcgttctatctcactgatatccacgggaaaatcaaatgcattgtgtcccgtttgcggatcaccaatgttgattccattgagaagcaccgtcatctgctcatagtttccgcctcgaatgctcacgtcagtctgcgctcccaatgggccacgctgacgcacatcgacgcctgaaaccaatttcaataggtcgttaacactatgtactggcgccgcgtttacatcctttcgactcagtacagttaccattctcgactgctgactttgcgtcagaggcgcccttgatccggtgactttcacctcgtcaagcaacgtgggttgtccgctcttataaagcgaagtgtcggccttttgcacgtcagtgctaatgccttttgcttgcgcattagagagtgttgccacgctaagtataccgataattacctctttaccaaggcatgaaaagagtgcaaagcccttgttggtaaagtgattaaaacggatacaacggcgctcgttgaaaactgttttgttcacgtttaaattatttattaacgtttatgcaactgcaaaaacgatggcaaaattagtaaaaataaatgaaataaggagtagaaatgatagaaatttgtaaataataaataaggaaaaagattgtcaagtgcagctaacggagcagcggaatggggctgttcgcgttgatacacattagattatgtttcgtgctttacngccttttggcgtgtgttatcgctgttttatggttccaaacactgcttaatctcagcaaaattatcaatgatatagtcggcaaatgcagcctcaaggtcttctcttttgccatttccataggtcacaccgcaggtctttgcccccgcatttcgccccatctgaatgtcaaaaatggtgtcgccgaccaccagagcctcggcaggttgcaacccgaaatgatgcaaagtgttgagcactggctcggcatttggctttgcattttcaacgtcgtcagcccccaaaatcaaacgaatatagggctctaaatgcagttcttgaacgaaagctactaacgattgatggcctcgactgcttgcaatcgtcacgataagtccctcattgtgcaattgttttatcgtctcaacaacncccggaaaggctggaacggcgccgggaacattgttttccatgaacaatttatgatagagatgagcacatgcttcggcctgttcttcagtcatgttttgcaaggctttgaaacattctttcaatggaagtccgatggttttcgcacattcttcggtcgtgcgttcaggcaaaccgagttgtttgagcgttgctttcatcgtgcgggtgatgagtgcttgcgagtcgccgagcgttccatcgaagtccaaaatcacaatctttgtcttcatcttcgttgcagttttgctcgcgaagttacacataaaatcgcaaaaaacagctgcttttcggatataaaatgccgcagcccatcttttcgtgggttataaaccataagccaatgataatcaaaatgttatctcatttcataaaaatggttttgcngtttgcaccaaatcagcctataatttgcatcaaaacacncgatgatttgaggcatttnatngcangaaatgccncaaatcgtttnncnntntnnnnnnaacnannnnncnnnnncgnannnntnnttnnntnnntngnncnnnntngnnnnnnaannnnnnnnccnnnnnnnnnnantnnnnnnnnnntnngncncnnnannngtnnanntnnnnnnnnnannnnnnngntantgnnnnnanttnnnnnnnnnntnatnnnnnnaancngtnnnaccnatgccnntnnnnnanannntnnnnnncntnatnnnnancgtatnnngntncnnnntgngtngannnnnnntnnnntnnntnnnnncttnnnnnncnntatnnntnnnancanngaanaatncgntgnaannnannntgtcnnnannntngnnngagaganngannnnannnnaacnnnccnnnganaggnntgnaatngngnnnnnannnntntngnttngngngnnanannnatgcnnancnnagcgnannaanncnggaaatgncngntnaaaannnncntccnntnncttnnntnnntgcattntnngnnnttnaaannnntngnnngtttcgnnangncangcnanttgngnnannnttcnattngnnatnnnnnnnatnatgngcntagntnngccntnannnnnannnnnntnnagnatnngnanngnncntcnganttntgannaggcttgntngnnacnnccnatacnntgnancnngnnnnnnangngntattnttcgcgncnnnnntnatngcnannnggngngtaaanngtnnnnnntcnnnncannnntncnntnggantgntannccatatntntgannnnntgccnnnnggannnttnntnancntntnnagntngnctcntnngncnnnnnnnaagnntnnacttgcnacgnngnnannnnntnnnnnnncannnnnattnnnngnntnagncncnnntnnnnnannnntnannannnnntattggnnganttnnggcgnnanangantnnnnnnngngtntnnnnatncgcnntnngnntntnnnnnnagntnngntnnnnnnncaatttnnnannntnntngngncnt

SEQ ID NO: 1273 - DNA, 4000 bp, Escherichia coli
  misc_feature (21)..(21): n is a, c, g, or t
  misc_feature (72)..(72): n is a, c, g, or t
  misc_feature (91)..(91): n is a, c, g, or t
  misc_feature (242)..(242): n is a, c, g, or t
  misc_feature (260)..(260): n is a, c, g, or t
  misc_feature (290)..(290): n is a, c, g, or t
  misc_feature (335)..(335): n is a, c, g, or t
  misc_feature (1003)..(1003): n is a, c, g, or t
  misc_feature (1067)..(1067): n is a, c, g, or t
  misc_feature (1102)..(1102): n is a, c, g, or t
  misc_feature (1199)..(1199): n is a, c, g, or t
  misc_feature (1991)..(1991): n is a, c, g, or t
  misc_feature (2445)..(2445): n is a, c, g, or t
  misc_feature (3051)..(3051): n is a, c, g, or t
gccgtgggtgacgcgttcaangccgccgggttcaaggccccgacgttcctggacgcgacgccctgacccgcncgagccagcccgccccggnccggccacaaagtggagcgttgtgacacagacacgccgtgcaggcgtgccacttcactccacagggttgcgagcggggctagaggtcgtagctgaggacgaggggggcgtggtcgctccagcgggtgtcccaggaccgggcgcggtcgatntcggcggtcacggcggcntcggcaagctccggtgtggcgagctgatantcgatccgccacccggcgtcgttgtcgaaggcctggccacgcatngaccaccaggtgtacggcccgggtccctcgccacccagcacccggccgaggtcgacccagcgcagctcgccgaaccagcggtcgaggtacccgcgctcctcgggcaggaagccggcggacttcaggttgccccgccagttcttgatgtccacctcgcggtgcgcgatgttcaggtccccgccgacgacgacgtacccgcccgcgtcctgcagctcgccgaaccgcgcggtcacccgctcgaggaacgcgtacttgtcgtcctgcttgggcgtcccggcctcgcccgagtggatgtaggccgagaccgcggtcagggtcccgccgcccgccagcgtcaggtccgcctcgacccatcggccgctgtccgtggccaggtccgagccgatcccgatccgcgcgccgaccatcggcagccgcgaggcgatggcgacgcccgcgcggcccttcgcctgagcctcctggtgcactatcgcccactcgtcaccgagcagctcgtgcaccacgtcgtcgggcgcgcggacctcctgaagcaggagcacgtcgggccgacgctcggccagccagtccggcatgcccttgcggaaggcagcccggagcccgttgacgttgacggtcgcgatggtcagcatccgcccatcaaacctcatgtcaccgacccggtcgccacncccgccccggccggacggtgagtgtcgcgctgtcgagccgagcagcgatcctcaccggcggtgncggatcagaggctgcgctcggcggcctccaccacnttcgtgagcagcatcgcgcgagtcatcgggccgacgccgcccggcatcggcgcgatccacgccgcgatcccgcggacgccaggatcaatatcgccgnccaaccgcgtcttccccgtctccgggtccgggacgcgggtgatgcccacgtcgagcacggctgcgcccggcttgaccaggtccgccgtgatgatcccgggcacgccggcggctgcgacgatgacgtccgcgttccgggtgtgctcggcgatgtcctccgtcccggtgtggcacagcgtgaccgtcgcgttcacctcgcgccgggtcagcatcaggccgagcggtcgcccgaccgtcaccccgcgcccgatgacgacgacgtccgctccggccagcgccaccccgtggcgctggagcagctcgatgatgccgcgcggggtacacggcagcggcgtatcgatcggcccgctgacccggagcaccaggcgacccaagttcgtcgggtgcaggccgtcggcgtccttcgccgggtccatcagctcgagcacccgctgggcgtcgaggtgacgcggcagcgggagctgcacgatgaagccggtgcacgccgggtccgcgttcagcgcggcgatcgcggcgtcgacatcggcctggctcgcgtcggcggggagatctacccggatcgagcggatgccgacctcttcgcagtctcggtgcttgccggcgacgtaggcgtgggagcccgggtcgtcaccgaccagcaacgtgccgagaccaggtgtgatgccccgctcgcgcagcgcgcgaacccgctccgcgagctccgccttgattacggctgcagtcgcgaccccgtcgaggatctgagcggtcactgctgcagccccgggtagagcgggaattcctcggtcagctntttcacccgcgcgcgcaaggcctcgacatcggcgccgcccttgagcacggtcgcgatgatctccgccacctcggtgaactcggtagcgccgaagccgcgggtcgcgagcgccggggtgccgatccgcagaccggaggtcacccgcggcgggcgcgggtcgaacggcaccgcgttgcggttcaccgtgatgcccgcctcgtgcagctggtcctcggcctgctggccgtccatcgcggagttgcgcaggtcgacgagcaccaggtgcacgtccgtgccgccggtcagcacggagacaccggccgccgtgacgtcggccgcggtcaggcgctccgcgatgatccgggcaccgtcgagggtgcgctgctggcgggcgcggaactcctcgcccgccgcgatcttgaacgcgacggccttggcggcgatgacgtgcatgagcgggccaccctgctgaccngggaacacggccgagtcgatcctcttcgcgtactcctcgcgcgacaggatgaagccggagcgggggccaccgatggtcttgtgcacggtcgaggagacgacgtcggagaacggcaccggactcgggtgcaggcccgcggcgacgagacccgcgaagtgagccatgtcgacccagagcttcgcaccgacctcgtccgcgatcgagcggaaggccgcgaagtcgaggtggcgcgggtacgcggaccagccgccgatgatgacgtcggggcgctgctcgagcgccttctcgcggaccttgtccatgtcgacgaggaaggtgtcggggtccaccccgtaggagccgacctggtagagcttgccggagaagttgatcttcatcccgtgggtgaggtggccaccgtgcgcgagctcgaggccgaggatcttgtcgccgacgttgatgagcgcgtgcaggacggcggcgttggccgtcgcaccggagtgcggctggacgttcgcgtgctcggcgccgaacagctccttggcgcgcgcgatcgcgagcgtctcggcgatgtccacctgctcgcagccgccgtagtagcgcttgcccgggtagccctcggcgtanttgttggtgagcacggagccctgcgcctgcaggaccgcgcgagggacgaagttctcgctcgcgatcatctcgagcgtctcgcgctgacgggtgagctcgccctcgaggacggcggcgatctcggggtcgacctgggccaggggctggtcgatgacagagtggtaggtcgactgggcgctcatgatctcctcgcaagcatgttgacggtcagggtgcgtccgcggggatctgcgtgcaggaactccgcggtgcggtgaccttcggcccaggcgtccgacctgaagtcaactgctgcgtcactccccggtggtcgtccacccattgcgccagtcgcgaccggcacagcctaccaagtcacccggcgtcctcgacatcgacaacttcgccctcgccgaggatgcggcgcaggtacgcgtaggtgaggtcccccgccgtcttgtcgtactggtgctcgaacccgtgcttggcgtacagcgcgaggttctgcttggagtcctgaccggtgaagacccacacctcgcgggtgttctccggcaggtaatggagcacctcgaagagcagctgggtgccgatgccctggccctggatgtcgggagcgacggcgagccggccgagggtcgccctgtcgtcctcgatgccgacccggatcgagccgaccagccgggggccgatccaggctccgatcgtgacgacgtcgtcccgcgccatgtcctcacggagctcgccgagggtctgggtgagcggcgggatgttcgggtccccgcagagttgcgcctcggtcacgaaggccgcgcggcggagtgtcaggagttcaccagcagcgtcgcccgggacacggtcgagtcgcacctcaacgtcagtcatgccgtaatcgtctcaggtcgccggagcggcgactaccctcacacacgtgtccgaccacgattccgccgcgcctgcctctcccgcc

SEQ ID NO: 1274 - DNA, 4000 bp, Escherichia coli
  misc_feature (999)..(999): n is a, c, g, or t
  misc_feature (1466)..(1466): n is a, c, g, or t
  misc_feature (1742)..(1742): n is a, c, g, or t
  misc_feature (1943)..(1943): n is a, c, g, or t
  misc_feature (1955)..(1955): n is a, c, g, or t
  misc_feature (1957)..(1957): n is a, c, g, or t
  misc_feature (1960)..(1960): n is a, c, g, or t
  misc_feature (1988)..(1988): n is a, c, g, or t
  misc_feature (2020)..(2020): n is a, c, g, or t
  misc_feature (2068)..(2068): n is a, c, g, or t
  misc_feature (2272)..(2272): n is a, c, g, or t
  misc_feature (2479)..(2479): n is a, c, g, or t
  misc_feature (2648)..(2648): n is a, c, g, or t
  misc_feature (2653)..(2653): n is a, c, g, or t
  misc_feature (2659)..(2659): n is a, c, g, or t
  misc_feature (2662)..(2662): n is a, c, g, or t
  misc_feature (2664)..(2665): n is a, c, g, or t
  misc_feature (2667)..(2679): n is a, c, g, or t
  misc_feature (2682)..(2711): n is a, c, g, or t
  misc_feature (2713)..(2720): n is a, c, g, or t
  misc_feature (2722)..(2726): n is a, c, g, or t
  misc_feature (2728)..(2737): n is a, c, g, or t
  misc_feature (2739)..(2750): n is a, c, g, or t
  misc_feature (2752)..(2765): n is a, c, g, or t
  misc_feature (2767)..(2768): n is a, c, g, or t
  misc_feature (2770)..(2789): n is a, c, g, or t
  misc_feature (2791)..(2798): n is a, c, g, or t
  misc_feature (2800)..(2802): n is a, c, g, or t
  misc_feature (2804)..(2824): n is a, c, g, or t
  misc_feature (2826)..(2851): n is a, c, g, or t
  misc_feature (2853)..(2859): n is a, c, g, or t
  misc_feature (2861)..(2863): n is a, c, g, or t
  misc_feature (2865)..(2872): n is a, c, g, or t
  misc_feature (2874)..(2889): n is a, c, g, or t
  misc_feature (2891)..(2892): n is a, c, g, or t
  misc_feature (2895)..(2898): n is a, c, g, or t
  misc_feature (2900)..(2902): n is a, c, g, or t
  misc_feature (2905)..(2912): n is a, c, g, or t
  misc_feature (2914)..(2926): n is a, c, g, or t
  misc_feature (2928)..(2932): n is a, c, g, or t
  misc_feature (2934)..(2944): n is a, c, g, or t
  misc_feature (2946)..(2950): n is a, c, g, or t
  misc_feature (2952)..(2962): n is a, c, g, or t
  misc_feature (2965)..(2984): n is a, c, g, or t
  misc_feature (2986)..(2995): n is a, c, g, or t
  misc_feature (2997)..(2997): n is a, c, g, or t
  misc_feature (2999)..(3012): n is a, c, g, or t
  misc_feature (3014)..(3019): n is a, c, g, or t
  misc_feature (3021)..(3027): n is a, c, g, or t
  misc_feature (3029)..(3029): n is a, c, g, or t
  misc_feature (3031)..(3063): n is a, c, g, or t
  misc_feature (3065)..(3073): n is a, c, g, or t
  misc_feature (3075)..(3082): n is a, c, g, or t
  misc_feature (3084)..(3088): n is a, c, g, or t
  misc_feature (3090)..(3097): n is a, c, g, or t
  misc_feature (3099)..(3118): n is a, c, g, or t
  misc_feature (3120)..(3120): n is a, c, g, or t
  misc_feature (3122)..(3127): n is a, c, g, or t
  misc_feature (3129)..(3130): n is a, c, g, or t
  misc_feature (3132)..(3150): n is a, c, g, or t
  misc_feature (3153)..(3189): n is a, c, g, or t
  misc_feature (3192)..(3192): n is a, c, g, or t
  misc_feature (3195)..(3196): n is a, c, g, or t
  misc_feature (3198)..(3207): n is a, c, g, or t
  misc_feature (3209)..(3209): n is a, c, g, or t
  misc_feature (3211)..(3217): n is a, c, g, or t
  misc_feature (3219)..(3234): n is a, c, g, or t
  misc_feature (3236)..(3253): n is a, c, g, or t
  misc_feature (3255)..(3310): n is a, c, g, or t
  misc_feature (3312)..(3321): n is a, c, g, or t
  misc_feature (3323)..(3325): n is a, c, g, or t
  misc_feature (3327)..(3356): n is a, c, g, or t
  misc_feature (3358)..(3374): n is a, c, g, or t
  misc_feature (3376)..(3384): n is a, c, g, or t
  misc_feature (3386)..(3396): n is a, c, g, or t
  misc_feature (3398)..(3404): n is a, c, g, or t
  misc_feature (3406)..(3415): n is a, c, g, or t
  misc_feature (3417)..(3423): n is a, c, g, or t
  misc_feature (3425)..(3428): n is a, c, g, or t
  misc_feature (3430)..(3432): n is a, c, g, or t
  misc_feature (3434)..(3453): n is a, c, g, or t
  misc_feature (3455)..(3513): n is a, c, g, or t
  misc_feature (3515)..(3543): n is a, c, g, or t
  misc_feature (3545)..(3545): n is a, c, g, or t
  misc_feature (3547)..(3557): n is a, c, g, or t
  misc_feature (3559)..(3559): n is a, c, g, or t
  misc_feature (3561)..(3569): n is a, c, g, or t
  misc_feature (3571)..(3574): n is a, c, g, or t
  misc_feature (3576)..(3620): n is a, c, g, or t
  misc_feature (3622)..(3629): n is a, c, g, or t
  misc_feature (3631)..(3651): n is a, c, g, or t
  misc_feature (3653)..(3680): n is a, c, g, or t
  misc_feature (3682)..(3695): n is a, c, g, or t
  misc_feature (3697)..(3703): n is a, c, g, or t
  misc_feature (3705)..(3714): n is a, c, g, or t
  misc_feature (3718)..(3718): n is a, c, g, or t
  misc_feature (3720)..(3721): n is a, c, g, or t
  misc_feature (3723)..(3724): n is a, c, g, or t
  misc_feature (3726)..(3726): n is a, c, g, or t
  misc_feature (3728)..(3744): n is a, c, g, or t
  misc_feature (3746)..(3747): n is a, c, g, or t
  misc_feature (3749)..(3750): n is a, c, g, or t
  misc_feature (3752)..(3756): n is a, c, g, or t
  misc_feature (3758)..(3762): n is a, c, g, or t
  misc_feature (3764)..(3766): n is a, c, g, or t
  misc_feature (3768)..(3768): n is a, c, g, or t
  misc_feature (3770)..(3774): n is a, c, g, or t
  misc_feature (3776)..(3781): n is a, c, g, or t
  misc_feature (3783)..(3783): n is a, c, g, or t
  misc_feature (3786)..(3786): n is a, c, g, or t
  misc_feature (3800)..(3800): n is a, c, g, or t
  misc_feature (3802)..(3802): n is a, c, g, or t
  misc_feature (3805)..(3805): n is a, c, g, or t
  misc_feature (3810)..(3810): n is a, c, g, or t
  misc_feature (3831)..(3831): n is a, c, g, or t
  misc_feature (3841)..(3841): n is a, c, g, or t
  misc_feature (3845)..(3848): n is a, c, g, or t
  misc_feature (3850)..(3852): n is a, c, g, or t
  misc_feature (3858)..(3861): n is a, c, g, or t
  misc_feature (3864)..(3865): n is a, c, g, or t
  misc_feature (3874)..(3874): n is a, c, g, or t
  misc_feature (3880)..(3880): n is a, c, g, or t
  misc_feature (3883)..(3883): n is a, c, g, or t
  misc_feature (3886)..(3889): n is a, c, g, or t
  misc_feature (3891)..(3892): n is a, c, g, or t
  misc_feature (3899)..(3900): n is a, c, g, or t
  misc_feature (3907)..(3907): n is a, c, g, or t
  misc_feature (3910)..(3911): n is a, c, g, or t
  misc_feature (3914)..(3914): n is a, c, g, or t
  misc_feature (3924)..(3924): n is a, c, g, or t
  misc_feature (3927)..(3927): n is a, c, g, or t
  misc_feature (3931)..(3931): n is a, c, g, or t
  misc_feature (3937)..(3937): n is a, c, g, or t
  misc_feature (3942)..(3943): n is a, c, g, or t
  misc_feature (3945)..(3945): n is a, c, g, or t
  misc_feature (3954)..(3954): n is a, c, g, or t
  misc_feature (3960)..(3961): n is a, c, g, or t
  misc_feature (3963)..(3964): n is a, c, g, or t
  misc_feature (3971)..(3971): n is a, c, g, or t
  misc_feature (3973)..(3973): n is a, c, g, or t
  misc_feature (3978)..(3978): n is a, c, g, or t
  misc_feature (3985)..(3985): n is a, c, g, or t
  misc_feature (3988)..(3988): n is a, c, g, or t
  misc_feature (3990)..(3990): n is a, c, g, or t
gataggctcaacgcggacgtcattgcccatgtcatcatagtagatgtcagcctgcatatcgatcaggtcgataatacccttgaaggtatcctcctgaccgacgggcagctggatgggcacaccgttggcgtgcagacgatcatggagcatctgaacgcagcggtagaaatcggcacccatggtgtccatcttgttgacgtacaccatgcggggaaccttgtactcgtcagcctgacgccaaacggtctcagactgcggctcaacaccgcccttagcggccagaacggtaacggaaccgtccagaacacgcagagaacgctgaacctcaacagtgaagtcaacgtgacccggggtgtcgatgatgttgatacgatggcggttcttcttgaagagagccggatcgtgctgggtctcggtatggctccaatagcaggtggtagcagcggaagtgatggtgataccacgctcctgctcctgttccatccagtccatcgtagcagcgccgtcatgaacctcaccgatcttatggttgataccggtgtagtacaggatgcgctcggtggtggtggtcttacctgcgtcgatgtgggccatgataccgatgttacgggtcatttgcagagatacatctctcggcgtagccatggcttatacctcctcgacagcgaatcaataacgatagtgggcaaaagccttgttggcctcggccatcttgtgcgtatcctcgcgcttcttgacagagccgccgacaccgttggtggcgtcgatgatctcagcagccagacgagcagacatggtcttctcgccacgggcgcggctgtaagcggtcagccagcgcaggccgagggtctcgcggcgggcagggctaacttccagaggaacctgatagttagcgccgccgacacggcgggtcttgcactcgaggttaggcatgatgttctccattgccttctcgaacatctcgagcgggtcgttgccggtcttttccttcacgatgtngaatgcatcgtaaacgatctcctgcgcaacacctttcttgccatccagcatgatgtagttgaccaggcgggtgacaaccttggaattgtaaataggatcggccagaacttcgcgtttcgcgacattacctcttctgggcatctttcttccctccttcacataaatgatatcatcggtactcgaaagttaagaaactcccgttgtgccacaaaaaaggcgttggcctattttatggcgaaaagatgtttccttacttcttggcaccggccttggggcgcttagcaccgtatttgctgcgggcctgattacggttcgcaacaccctgggtatccagagtaccacggatgatgtggtaacggacaccgggcagatccttgacacgaccgccgcggatcagaacaacgctgtgctcctgcaggttatggccgataccgggaatgtaagaggtgacctcgataccattcgtnaggcggacacgggcaactttacgcagagcagagttaggcttcttgggggtcatggtacgcacggcagtgcagacaccacgcttctgcgggctgttgaggttggtgtactcctttttctgggagttgtagctcttcagaagggcaggcgcggtgctctttttgaccagaacctcacggcctttgcgcacgagctggttaaaagtaggcatttcttttctcctttcttcacttattcacgcgctttttgcgggtcgtccggccagatggccgcactanaccccgcatctcacgcaatgattatattacagcatcccggccggaatgtcaagagtattgccaaaaaaatcttgaaaaaatcgtgcaatacggagaatttttcatttctgaagcaaaatgtgcaaatcttgcgccggtttgggcggcagcgttgcattttggtaagtccgcgcatagaatgaagcggaccgtctccccccnccgccgcgcggncngcngccgtccgtgcgcgttttgtctatttancagagacaaatatacattttgcacaaaaacangccgccagattcatggacttgacgagtcgatttctgttgcattgtgtnccccgctttgctataatgaagatacagacaaaaccggaacagttccggccatgcaagttctgacgctacatttttgaggaggtcctgacaatgaagaaactgcttgctatcctgatttccctgtgcatggtatccgccttcgctgtacctgtttttgcagatgccaacagcgattatatcgccgccgtcaaggcctaccaggcncagatcgccgcgaaggaagccgcctacactgcagcggtggatgcttattccaagaatgcaaaggccaaggcagacgccgacagcgccgcaattctgaaggccgccaaggctgcccaggcgaaggccgatgcagactgtctggccgtcatcgccgcgggcaaggctgcccagtcccaggctgacgcgcgcgtcgccgcggtaattgcngcaggcaaggccacgcaggccaaggctgatgcacgcgaggccgcctatgcgaaggccgtgaaggcgtatcaggatcagatcgccgcacgtgaggccgcctacatcaaggccgtgctgggcaagtaattctaccttattataataggagcggagcgccgggaaaggcgcnccgcntttttnttntnntnnnnnnnnnnnnnggnnnnnnnnnnnnnnnnnnnnnnnnnnnnnngnnnnnnnncnnnnngnnnnnnnnnncnnnnnnnnnnnncnnnnnnnnnnnnnncnnannnnnnnnnnnnnnnnnnnncnnnnnnnngnnngnnnnnnnnnnnnnnnnnnnnngnnnnnnnnnnnnnnnnnnnnnnnnnngnnnnnnncnnngnnnnnnnncnnnnnnnnnnnnnnnncnncgnnnncnnnggnnnnnnnngnnnnnnnnnnnnngnnnnngnnnnnnnnnnngnnnnngnnnnnnnnnnngcnnnnnnnnnnnnnnnnnnnntnnnnnnnnnngncnnnnnnnnnnnnnncnnnnnngnnnnnnncngnnnnnnnnnnnnnnnnnnnnnnnnnnnnnnnnnannnnnnnnngnnnnnnnngnnnnngnnnnnnnngnnnnnnnnnnnnnnnnnnnngncnnnnnngnngnnnnnnnnnnnnnnnnnnnaannnnnnnnnnnnnnnnnnnnnnnnnnnnnnnnnnnnncgncgnngnnnnnnnnnncncnnnnnnncnnnnnnnnnnnnnnnngnnnnnnnnnnnnnnnnnncnnnnnnnnnnnnnnnnnnnnnnnnnnnnnnnnnnnnnnnnnnnnnnnnnnnnnnnngnnnnnnnnnngnnngnnnnnnnnnnnnnnnnnnnnnnnnnnnnnnannnnnnnnnnnnnnnnngnnnnnnnnncnnnnnnnnnnngnnnnnnntnnnnnnnnnncnnnnnnngnnnntnnngnnnnnnnnnnnnnnnnnnnntnnnnnnnnnnnnnnnnnnnnnnnnnnnnnnnnnnnnnnnnnnnnnnnnnnnnnnnnnnngnnnnnnnnnnnnnnnnnnnnnnnnnnnnncncnnnnnnnnnnncngnnnnnnnnncnnnngnnnnnnnnnnnnnnnnnnnnnnnnnnnnnnnnnnnnnnnnnnnnngnnnnnnnntnnnnnnnnnnnnnnnnnnnnncnnnnnnnnnnnnnnnnnnnnnnnnnnnntnnnnnnnnnnnnnntnnnnnnnannnnnnnnnngcgngnngnngncnnnnnnnnnnnnnnnnncnncnncnnnnngnnnnntnnngngnnnnngnnnnnngngcntggcggcgagattntngtngaccncggcggcgacgttgtcgtcgnccacggcggncgcnnnntnnnccgccnnnntgnncgcggcggnggaggnggngtnnnngnnggcggcnncggcggnggnngcngcgatggtgncgncgtngtaggnggcgnngntgttgttgntgtggnngnngttcttntngtagntgcggtnggngntcttctccag

SEQ ID NO: 1275 - DNA, 4000 bp, Escherichia coli
  misc_feature (626)..(626): n is a, c, g, or t
  misc_feature (1151)..(1151): n is a, c, g, or t
  misc_feature (3556)..(3556): n is a, c, g, or t
  misc_feature (3568)..(3568): n is a, c, g, or t
  misc_feature (3768)..(3768): n is a, c, g, or t
  misc_feature (3970)..(3970): n is a, c, g, or t
gactcgaccctttggcgcaggcgttggcctaacgcatcgagtgcctgccgggcggcggcggcatcgatatcaaacagccacaccggatgcccggccccggccgccacctgggcgataccgatgcccatggtgccggcaccaatcacggcgacccttgcgttgacgttcggcaggttcatgattatttcccgctgaaattaggggggcgtttggcgaagaaggcgctgacgccttcgcggtagtcgtcgctgcggccgccgaggcgctgcaggtcgcgttccagatcgagctgctgatcgagggtattgttcgccgagctgtagagggcttttttaatcagccccagcccgtaagtgggttgggtggccaggtgttgtgccagcgtttggctggtggcggccagttggtccgccgctaccacctgccagatcatgccccatgccagcgcctgttgtgcgctgactttatctcccagcagcgccatgcccatggcgcgggcgtggcctgccaaacggggcaggaaccagctgccgccggagtccggcaccagccccaggcggcagaaagactgaataaaattggcgttatcggcggcgatcacgatatcgcaggccagcgccagcgcngcgccggcccccgccgcgacaccgttgacggcgcacaccaccggctttggcagggcggtcagacgacggatcagcggattgtaaaaacgctctaccgacaggccgagatccggcgcctgctgttcgacgctgacgttgcgatcgttcagatcctgcccggcgcaaaagccacgtcccgcaccggtgatcagcaggcagcgtacggtttcgtcccgctcggcgagggtcaaggcttcgctcagttggcggtgcatctcgtcgttgaagctattgagccggtctggccgattgagggtcagcgtcagcaccccggcttcaaggtgggtgagaatcaatgcgttttccataaatcagcgcccctgatagtttggcgtacgtttttcgaagaaggcggcgatgccctcgcggcgatcgtcggtggcggccagggtggcaaactgctggcgttcgatgagcagcccttggctaaggccggtttcctccgcctgtttcagcgcctgtttggcggcgcgcagtgccagcggngcctgcctgctgatgtgctcggcgatctgctgtgcgcgttccagcgtcagggcgtcgacgcacacttcactgaccaacccgcactgcaatgcgcgcgaggcgttaatggcttcgccactcagcaccatctgactggcgaaggacttgccgacgcagcgaatcaagcgctgagtgccgccggcccctggcatcaggccgagggtgatttccggcaggccaaagcgggcgctttcgccgcaaatgacaatgtcgcaggccagcgccagctcgcagccggcgccgagcgcatagccgttcactgccgccagcagcggtttactgaactgcgccagccgttgccacaacagcgggcggcgatccgtcagcgtagcgggcaggtcctgccgttgcagttcgtgcagatcggcaccggcggcaaagaaacgcgttgtgccggtgatcactactgcgccaatggcggtatcggcatcggcctgttccagtaaatacaccagctgctccaggcagggtgtgttcagggcattgcgcgcttgtggacggtgcagttccagcgtcagcacgcgcgcctggcgatgttgcaggatcaaaggggtttccattggcggctcctatacgtcaaagtccagcaccacaccgtcaccgcgtggccacgactggcagctcaatacgtagcctgccgcgagttgatccggctccaggctgtagttgacggccatgtccacctgaccggcttttaaccggcacttgcaggtggcgcacacgccgcctttgcaggcatagggaagatcggcaccctgacgcagcgccgcgtccagaatgctgtcgtcctgcgaaccgacctcgatatccaaccggcggccgtcgagcaaaatcgccactcgcgtggcgttgcgcggggtgtcgttgaccgggcgggcgaccacgccgctggtgttaaagcgctcgctgtggatacgctcggcggctacgccagcctgttccagcacgctttgggcgtcgtccatcatggtttgcgggccgcagataaaggcatggtcatagtcgcggtaatccagcagcgcgccgccgatcgccaacaggcgctcgcggtcgatgcgcccactgagcagcgggctgtcgaggctctcctggctgaacagatacagcggctgaaaacgttgtggatagcggtttttcagatcggacagcgtctccttgaacatcaccgaacggctgctgcggttgccgtaaatcagcgtgaagctgctgtttggttcaagttgcagggtggctttgatgatcgacagcatcggcgtgatgccggaaccggcggcaatcgccagatagttgccgctgttttccgcctgtggctggtagccgaaacggccctgcggcaccatcacctccagcgcgtcgccgactttcagtagccgattaacgaacgaggaaaagcggccctgatggatggctttaacgccgatctgcagcagcccttcctgaggagcgctgcagatggagtagcagcggcgcagctcttcgccatccacctgcgcctttagcgtcagatgttggccgggggtgtagcagtaatgacttttcagctcttcgggcacgcgcagagtgatagctacggcgtccggcgtttcgcgctcgatggcggcgacgttcaggcgatggaagaccgtcatggttttctgcgctcctaaatgcatttgaaatagtcgaagggttcgcggcaatcgcagcagcgatacagcgctttgcaggcggtggagccgaattcgctgattttttcgctgtgggtgctgccgcagcgcgggcagggcaccgggcctgcagcctgcggtttgtcgcaggtatggccctgtggcggtgcgacgccgtattcacgcagccgttcacgcgccgaggcgttcatccagtcggtggtccacgccgggctgaggcgaatgtccactttgaccggggcaaagccggcctcggccagccgctgctcgatggcttcgagcaggaactcggtggcggggcagccggagtaggttggcgtaaaggtaatgcgccagccgtcgccgtcggcttcaacgtcgcgaaccatgcccagatcggtaatcgacagcaccggcagttccggatcgctgatctgttgcaggcagtgccagatttgcggaatttccgcggcctgcagccgggtaatgttcatagcggccccttaccagtttgcgttgggataggcgcgttgcaggaactgcatctcggccagcagcggaccgagatgttcgctgtgccgaccctgtttaccgccgtggcggaacgcctgctctgccggcagcgtcagggtggcctgttgcagcgtttcttcaaccagcgccagccacggagcctcaagctggcgcggatcggcggcgataccctgttctgccaactgnagttcaagctcntcggcatggaacagctcggcggtaaaacgccacaggccatccagcgactgctgcattttttggtggctgacggggctgccgtcacccagacggatcatccagccacggctgaaacgcaggtggtaatgcgcctctttcagtgacttggcggcgatggcggcgagttgcgcatcgcgactttggctcaaggcctgatgcanctgcacgtggtaggcgtccatcaggaactgccgcaccagagtgtcgttgaagccgccgttgggctgttccgccagcagcaggttatggaactcacgttcgtcacggccgaaggccagtcggtcttcgctgaattgcggcccggccagttcggcggcataaccgagaaagttgcgtgcctggccgagtaggtccaggccgatnttggccagcgccaggtcgatctccagttcc

SEQ ID NO: 1276 - DNA, 4000 bp, Escherichia coli
  misc_feature (1)..(298): n is a, c, g, or t
  misc_feature (356)..(356): n is a, c, g, or t
  misc_feature (417)..(417): n is a, c, g, or t
  misc_feature (599)..(599): n is a, c, g, or t
  misc_feature (1017)..(1017): n is a, c, g, or t
  misc_feature (1025)..(1025): n is a, c, g, or t
  misc_feature (2016)..(2016): n is a, c, g, or t
  misc_feature (2150)..(2152): n is a, c, g, or t
  misc_feature (2173)..(2173): n is a, c, g, or t
  misc_feature (3729)..(3731): n is a, c, g, or t
  misc_feature (3736)..(3744): n is a, c, g, or t
  misc_feature (3748)..(3751): n is a, c, g, or t
  misc_feature (3754)..(3754): n is a, c, g, or t
  misc_feature (3760)..(3761): n is a, c, g, or t
  misc_feature (3763)..(3763): n is a, c, g, or t
  misc_feature (3766)..(3767): n is a, c, g, or t
  misc_feature (3769)..(3769): n is a, c, g, or t
  misc_feature (3771)..(3772): n is a, c, g, or t
  misc_feature (3775)..(3778): n is a, c, g, or t
  misc_feature (3780)..(3781): n is a, c, g, or t
  misc_feature (3785)..(3788): n is a, c, g, or t
  misc_feature (3790)..(3791): n is a, c, g, or t
  misc_feature (3794)..(3794): n is a, c, g, or t
  misc_feature (3805)..(3806): n is a, c, g, or t
  misc_feature (3809)..(3810): n is a, c, g, or t
  misc_feature (3812)..(3813): n is a, c, g, or t
  misc_feature (3822)..(3822): n is a, c, g, or t
  misc_feature (3824)..(3825): n is a, c, g, or t
  misc_feature (3830)..(3830): n is a, c, g, or t
  misc_feature (3835)..(3836): n is a, c, g, or t
  misc_feature (3840)..(3840): n is a, c, g, or t
  misc_feature (3842)..(3843): n is a, c, g, or t
  misc_feature (3845)..(3845): n is a, c, g, or t
  misc_feature (3848)..(3848): n is a, c, g, or t
  misc_feature (3850)..(3850): n is a, c, g, or t
  misc_feature (3852)..(3852): n is a, c, g, or t
  misc_feature (3858)..(3858): n is a, c, g, or t
  misc_feature (3860)..(3860): n is a, c, g, or t
  misc_feature (3862)..(3864): n is a, c, g, or t
  misc_feature (3866)..(3867): n is a, c, g, or t
  misc_feature (3869)..(3870): n is a, c, g, or t
  misc_feature (3872)..(3878): n is a, c, g, or t
  misc_feature (3880)..(3880): n is a, c, g, or t
  misc_feature (3882)..(3886): n is a, c, g, or t
  misc_feature (3888)..(3892): n is a, c, g, or t
  misc_feature (3894)..(3900): n is a, c, g, or t
  misc_feature (3903)..(3906): n is a, c, g, or t
  misc_feature (3908)..(3908): n is a, c, g, or t
  misc_feature (3912)..(3917): n is a, c, g, or t
  misc_feature (3920)..(3920): n is a, c, g, or t
  misc_feature (3922)..(3922): n is a, c, g, or t
  misc_feature (3924)..(3924): n is a, c, g, or t
  misc_feature (3926)..(3929): n is a, c, g, or t
  misc_feature (3931)..(3933): n is a, c, g, or t
  misc_feature (3935)..(3938): n is a, c, g, or t
  misc_feature (3940)..(3947): n is a, c, g, or t
  misc_feature (3950)..(3951): n is a, c, g, or t
  misc_feature (3953)..(3955): n is a, c, g, or t
  misc_feature (3957)..(3959): n is a, c, g, or t
  misc_feature (3961)..(3961): n is a, c, g, or t
  misc_feature (3963)..(3964): n is a, c, g, or t
  misc_feature (3968)..(3971): n is a, c, g, or t
  misc_feature (3973)..(3979): n is a, c, g, or t
  misc_feature (3981)..(3984): n is a, c, g, or t
  misc_feature (3986)..(3987): n is a, c, g, or t
  misc_feature (3990)..(3993): n is a, c, g, or t
  misc_feature (3995)..(4000): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagatctcggctgagacatagacagagtacttggaaaacgcccccattgtggagacnccgagaccatctgctgcgtcggtcgacccttcccgcgtgatcgtgtgatcgtgacgagggngcgtacatcgcgttcggaggggtttgaatacgacaacgacgacggtgtgtgcgtgcgcgtgggcgcgcgcgcgtctcacgcagtttgacggatatacaccggtattcaccggaatacactacgggtacgatacccgtatgataccgacggaagacacgacggaccctcttcgccccctaacnaccctcggaacgcggcggtttgagttttttctcatctctctcatataacatggaagaaatcgcggggtcaaacgcacaccgcgagcggaaaacaccccgcggatcccccgtaccgatgccggaccgggttcgcgcgtgcttcgatacgcacgcgaggtgcgtataatacttagggtttagggatccagcgcgcgacgcgcgcgcactgggacgtccgagagcgcgagagcgcgatgggagtccgtccgtcctctgttcagtcgttcatcgcgtgaaatccatcgttatacgtgaaacgcgcgaacgtccagcgcgaacgttcgaacgtcgtcgtccagcgtgacgttctaacgccgaacgcgcgggttcgcgtcggcgttcgcgtcggcgcgtcgggcgttacgggcggcgacggttngacgacgnttcgacgacgacgttcgagcgttcgcgacgttcgcgaccgtcgtcgtcgcgatcgaacgaacgaacgatggatcgatcgatggacagaatgttggcactcgcgctcgcgtttaaactcaacggatggagcgatgcgtcgaacggtgcgagggaccggacgcggtgagtgtctgggtgtgattttgttacaagtgagagctatcgcgcggcttccgcggcttccgcgtcgaacggcggacgcgaacgacggataatcagagcccgacgcgatcggtgtcgcccatcagcggcgtcgggtcccgcccgagaatctccccggtcgcgcccttccagtcggcgacgcccaaagagtacccccaatcgctctgcgtctcgatctccacgtccccgatcgggcgcgccatgcacaacaaaaccatcccttgctcgatctcgtcttcgctgagcgtgaactcgagatcggtgatgtcgctctggtcgatcgcgcccttggcgcagcgggcgacgcacgccccgcagatgcccccgcggcaggtgaacgggatctcgatcccggcggcgagtccggcgtcgaggatgtactggttcgacccgcactcgacgtcgacgcgggaatcgccggcgccgagaaaggtgacggtgaccttatcgccgacgtcgtcgtcggacgtggcgatctttcgcttggacaagtcgatggcgtctcgggcaaacttatctccattgtctcgaccgaagagcgccgtcgtcttcgcggcgctcttcgcgcgagacgcgcgcgaggaggaggacggacgaagacgacggagcgcgtcggtggccgggcgggcgagcgcgctcgggtcgagacgcgcgcgcatcgtcgcgaggaggcgcgtcgcgaggtgccgccgggagtcggtgtcgccgacacgcgacgagtccctcgttggtttcccgcctgagtcatcaaaaaagatgtacatggatgtacgagagacgtcaatatgtnccgtatgtccgataccattatttatacgacgcgctatccagattcaatgtcgcgacgcgcggcgcgtcatacgacgccgcgacgaacgaagatgacgacgacgacgtcgtcatccgtggtcaccgcgctcgccnnncgatgggaatccgtcgtggantcggcgagcgccgcgatcggtgccccgagaggttcaaccatgttcctcctcggactcgccttagggcctctgatcggcgttggatttcccgcgatcgatttcgcgctggaacgcgtcgtcggcgcgtccaaacgaaccaaggctttcgtgaagagcgcgtacggtttggtgttcggggtgttgctgtcgttggcgagttttggacgggcgacgatcgtgtgcgcgcactttggggcgtgctcgtacgcgacgatggttttcgcgcgcagacggtgcggcgggttggtgttcgtcggatcgttcgcgtatctcatttggtatcacatgaaggcggacacggcgaacacgtggaaacgcggagaggtggatattagcggattactcatggtgttggtgctcaaggtgacggcgtgcgcggtcaactatcaagacgcggcgacgacgccggcgaacgagatgagcgaatttcaaaatcggagacatctcaagacgctgccaaacgtgctagattacgcgagttggttgatgtttccgtgtaccttagtcagcggtccggcggtggagttccgagactactctgattggttgcacgacagaggagtgtggggaggcgacaagagaccgagcgcgtttgttccggcgatgaaaaaattcctcggcagcgtcgtttgcctcgcgttgcacaagggagtgacggcgtattacaccatagaaaacacatatctctcatggaagtggtctcagtactcattcttcgagaaggtttggcaccagtacatgtacggacaaggaaaccgattcaagtactactttgtttggatgtttgccgatttcgcagctacggtgtcgggtcttggctttagcggttacgacgccaagggcaacggccggtgggagacgacttgcaacatccatccaatcggatgcgaaaccgccatcacgatgaacacgattccgattcattggaacgtgcaaaccggcatgtggttgcgccactacgtctacgatcgcgtgacgccaaaggggaagaagcccggattgctccagcttctcatcacgcaaaccgtctccggcgtctggcacggcctctacgctggctactggctattcttcgtttccaccgcgttcgccgtgaacgccgcccgtttgatttaccgctggcaacagggccgcgtgccgaaaaagtaccatcgtctcgtcgaaatcccgcattggttcttcacccagtttggcctcaactacctctgctccgccttcatcctcgtcgatctccgtcagtgtatcaacgattgggcatccgtccactactggggtcacgtcgtcatcgccatcatgctcgtattcggtaccgttttcgcccctccgagcaaatccaaatccaaagccgcgtaggaaggaaaagacgcgagcgaacgcgccgacgcgagcgaacgcgcgtcgacattagaccatgaaatcaacaattttacattcacttcacgcgcgcacaatccaatccacccgtcgtctttccacgcatccattcgttcgtttacatttgacttttgactttgacnnngacgnnnnnnnnnaaannnnccncccccnncnggnngngnncgnnnngnncgcnnnncnnccncgcccgcgcgnncgnncnnaccgacgancnntccgncgcgnncgangnnangcncncncctcgntngnnngnnanncnnnnnnngncnnnnncnnnnncnnnnnnntcnnnncncgcnnnnnncgnangnannnnannnannnncnnnnnnnngtnngnnngnnngngnncgannnngnnnnnnnannnngnncgnnnnannnnnn

SEQ ID NO: 1277 - DNA, 4000 bp, Escherichia coli
  misc_feature (479)..(479): n is a, c, g, or t
  misc_feature (561)..(561): n is a, c, g, or t
  misc_feature (578)..(578): n is a, c, g, or t
  misc_feature (3632)..(3632): n is a, c, g, or t
ccaccatttggaccgccaaattcaatatacttttcacgtcggaagcttacgcaaccgttccctccctttccggagctgataaaaagttttgcttggtcaagaaatttcataacctatctcataattaataaatttataaaaaataaatagaactatgaactggttaaattaaagtttaattagttttttcagcaatagggtcaacagaaataactggaccacctgttcttagttttttaaaactaactgtaccctcgattagagaaaaaattgtatgatctcttccaagtcctacatttttcccgggttgccacttagttcctcgttgacgaacaattatatttccaggaataacactttcaccaccaaattttttaacgcccaaccttcttccggctgaatctcttccattcctagatgaaccacctgcttttttatgcgccattttttactcctcagtcttctttttcttaactganctagttttagtatcagtctttactgttttctttgctgtagttttctttgctgtagctgttttctttacaggagctttttccntttcaggagctgcatcngtttttactgccgctgcttttttagtttctttttctttaatatctacaatttttaacattgttaagtgttgttgatgaccattttttcttctgtagttatgtcttctttttttcttaaagacgataattttctcagctcgagtttgttcaactacttcagcattaacaacagcacctttgataactggatcaccaacaattgggtcacctttaccaccaatcataagtacttcatttaggttaactttatcacccgcttcaccgattagtttttcaactgaaataacgtcatcttttgaaactttatattgctttccgccactacgaattactgcgtacattataaatatccattaatatgatggggaattaaaatttcccctaggggcgcaaatataacgttgagtgagtaggtgtcaagcatattataggtaaaatatagtttatcttgctttatttaaaaccatcattctttgtattactagaatgggtaaaaatgacaataaaaacataactaaatatatctcattaactgatatgtttaaatagtctaaaagacccgctagccactctccaataatacgagagaagtgcctaatactcattaaaaatgcaaattgtgttgcggctataactttaaatgaaagactcatacagagtgataaactggcagacatcacaaatgaacccattatggataataaaattaaaattgatgagcctatgtatagattagaaatatggttgtttaaaataaatactgagatcatcgttagagcaatgaaaagctgagacatcgtaataattttatagggattaaatttatctgataaataacctcccgctatagctgagaaaactcctatatagagcccaatagagcgaatttttgttaagagttcatgatcccaaccagcgagatttgtgtatagattagatatgcttacatagtgcattccaaaagaaatattagacactaagcagaataatattaacattaaaattactggtgtaattgaggtttgatataaatcttttagtattttttttaaatttattatctgtttctttttatttggtcttgaaaaagaaagaattttatctttaatactttctttctggaaaattataaaaaatgaacttcctaatagtgcaataccaaaaaatatgaaagtttggtttaatccataatttcttattaaaatagaacttactagagcagaaatgctcacaccaaacgttcttgcgccccacataaggccattacttatacctctctcatttttatcaagtatatcaatagcaaggccatcagttgccacatcaagaattgatgtgctgagtattataaaagataataatattccgattagtaatggagacatttgtattgaaatgaattgagacaatacaaggaaaataaggcctaatagggttaacgaactcaatatccagggttttctttttcccattttggatgattgatatgtgtcaacgaacggcccaatgataaacttaagtgtccatggcaaggaggctactgaggttattatagcaatatcgctaatagaaaagtcttttgacgctaaccaatctagtaaagaaaaataaatcaggccctgaggtataccctgaataaagtataaaaaagaaagtccaacacgtctatttagacggctgttagaaagaaccaaagatctactccattgatgtttcttgttttttaactgcatcagaaacttctcggtcaattcctaatgcaaaatctgagacatacgggtttgttaatctttcgttaccaaaagtagacattgggccgtggccaggtataaatcttatctcatcacctagaggccataattcattaactattgaattaactaattgctcatggtttcctctcggtagatctgatcttcctatcgacccttggaataatacatcaccaacagcagctatctttgcttctttatgaaaaaatattacatgcccaggagtatgaccaggacagtgacgaacaccaaatatttgatttcctattgtcacttcatcgccaccctcaaggaatctagatgtctcaaaagactcagcaggagaaaaattatatttctttccttgctcctcaaggctttcaattaaaaacatatcatccttatgcggaccttctattggaatattaagttggcgggcaagttcagcagttgcaccagcgtgatctaagtgtgcatgcgtaataagaattttctcaatttttacatcatacttctttattgcggtaattatttgatcgatatcaccgcccgggtcaattacagcaccttttttagtttctgtgcaccataagatagaacagttctgttggaacggagtaaccggtataacaaaggcatgtacagcaagttctttttcttcagtcatgattctattgtatatccttagaggcttatttagccaatcacttcttttaaaaagtcttgcattgctttccatgagcgtctatctgcatctggattatatgccattcccatttccggggaatttgcttctttgttagtaaatgcatgagaagttgatccataggcatgaatttgccaatcagccttagattctgtcaactcatttgcgagaccattaacatcttcgtgtggtaccattggatcatcattaccatgcaaaacaagaacttttgtattgatggtgttaccttcggtatttcctggcttattaaaaataccatgaaaagagactacaccagctatatctgaacctatcctcgcaacatcaagaacacaaagaccgccaaagcaaaagcctatacttgcaatttttgaattgttcacaccagtttctgatcttactgcatcaattgcagataacattcttttttgaagttttggtcgatcagaaagaacatcattcattaattcaatattttcttctggcgagcttccagtttttccttctccatacatatctacagcaaatccggaataccctaagtcattcatcgattttgctttatcgagtgtaaattgatctctacccgcgtaagtnggaacaactaaaacaacaggggcattcttattaccctcataaggaaagaaaataccttctaggcgagtatcatcatcaaaataatcaacaacttttcccatttgtaactcctaattattctggcatatttcctgatacgactgacatagcattatcaactcgtatttgagctccgttaacaaatttagattcatctgaagcaagatatagtgcagcatttgcaatatctaaaggttcgccaactttattgctctctactggagcttcttgaacaacaggtgaggctccaaatttttcttccattaatgctggaacgcttgcaaccattggggttgctattcctgatggatgaatcgtattacatctca

SEQ ID NO: 1278 - DNA, 4000 bp, Escherichia coli
tcagtgagcaaacgccgcgcgacgtatgggaaagcggagtccaagaggttgaagtctggatcgagcgtgagacaaatgttctcttgcgtcagaagagatctgatcacgagcgaaaatctctccggaactcgaatcggatagtcgtacaggagtttgttgaactcacgggtgagtccccggaacgaaaacttttccgtgctcgccagagattgaagggcttcgtctccccacacatcggccaaaccttcggccaccggtccgatgtcagcaccgggttgcaaaaagccgaggtcttcgagagtctccgccaacgcttcgtagtctctgttcatggtatgcaccaccgcatcgataagactctcttggttggatcgagaaatctcggcgacgttcccaaagtcgacgtacgcaatgtcgccgtttggcagagccaacacgttgcccgggtgcggatcgccgtggaagagcccgaattcgagcagttgcttcaaaccagcttcgacaccgttcaccataaagcgtgcgcgagctgcatcgtcatcgaacgcatcctcgcgagtgcaccgcacgccctgctgccaatgcatcacgagaacgcgcggcccactcaattcgctcaccacgggcggaatctgcacgttgacgtcgttgcgaaaattgaagccaaaatcgcgaaggttacgcgcttcttgcacgaaatccaactcctcgagcaatttctccgcgaactcatccaccaagagagacgccgagcacccgagattggctcgagcgtaaccgtcaaaaaattgcagagcggccgcgcgcagcaaaaacaaatccatgacgcatcgcgcgcgcgtattcggtcgcaaaaccttgatcgcgacgtcggtaccatccttcttgagcttgcctcggtacacttgaccgatcgatgccgcagcgatcggctcttcagagatttcactaaacgtatcctcgatgacgcgtcccgtttcctcctctataattttgtacgccaactttgagttgaacggcggtacgcgatcctgaagcttggtcaactcctccatcaagtcctcattcaccaaatccggcctgttggccaagttttgcccgagcttcacgaagagcggaccgagctcgatgagcgtctctttgactgcttctccccaacgcgttccgccgtcctccgcatccaacttttgcaatcgatcctgcttattcctcagctttccgagtaccaaagcaagctctgccgatcgtttcgccaactccaacggcctgctcagcgcctcattgcgaatctcctcgggattatacctcgtcaccattcgacaaaagtctctgtccgcctccaacttcgccttatccttctccttgagcgtcgccttcttcaccgccttgggcttggacgtcactttttgcgtccccgcttccaacgcaacaccccccgcgccttctcgcgtctcatccgggttcgccaccgcctctccccgcgtcgtcgacgctcgacttcctcgctcggccgacgcaaccctcgacttcgcgaatcccaaaggcgtcgcattccttccttcaccgaaacccgtccccatccgccggttccctcccaaacgagccctcaacgcatcgcgcgcgatgcgttccccgcgtaccccctttgaacccgtcgccacccgtcgcgtgggaccgggtgtcgagttcggcgcgctcgcgataccgatccgcattgtatgcgtcagcggcaactaccccgaacgagtcgaactgagtggagctcgcgcgcgccttcgcttctcttcacttcgcgcgcgtccgaacacgacgggcgattcgttcgatcgcgacgaccgcctacttcgtatcgacgaccacgaccgacgcgcgcgcgcgtgtgacgacgacgaagtggacgccgacgtgcgcgacgtcacgcacaaaaactacaactacgtggagcgacgatttcacccaattcctggattagcgccgcacgcgtttgtgacgagtgcatttcggttaaaagctcgcgcgtgtccgccggcgacgcgacgacgcgacgcggaaggcgtccgacccgactgacgcgtcggcgcgcgagcacgtattttaaatcgttttatttcttcaccaatgtccgcggtgtccgtgggggcacacgccggcgtcatcggacgccccgagcatcggtcgcgcacgcaccggcgcgcggcgggcgtcgtcccgcgagccgagggtggtggccccggtcccggcggcgcgcgacgcgcgaattcacccggtggtggtcgaagcggggcgagaggaatggggcgaggcggtggacgcgggcgtggacgcgggcgtggacgcgggcgcgggcgtggacgcggcggggttcgtaaacagagcgacgggaagcagcaccttgggcaaacgctcgagtacgtcgcggaaaaggcgttcccggcggtggatgatctcgtcgacgacccgccgttgaaaattcttccgttgggtgggttgggagagattgggatgaactgcatgctgattggacacggggatcgatacattttgttggacgcggggttgatgtttccagagtgcgttttgagttttgtcgtgttttcgtacggcgttttacgtttcgctttttttcgtttaccgagactgacgatcgttgttgaaaaaattgtagtcacgaggaattgggtattcaaaaggttttaccggacgtgtcgttcttggcgcgttggcgcgataagattgaagccgtgctcataacgcacggacacgaggaccacattggagcgttgccgtgggtggtgccggcgctcgatccgtcgacacccatttacgcgggtttgtttacgatgcaactcattagacggagaatgatggagttttctctctggaacgacgagcggttcaaggtttttgagatgaatgagcgctttcaagcgggtccatttgacatggaggcggtgcgcgtgacgcactccattccggattgttgcggtttaattttccgttgcgacgcgggtaccatcgtgcacactggcgattggaagattgacgaaaacccggtagatgggcgcgttttcgatcgcgaatcgtgggaacgcgtcggaaacgagggtgtgacgctcatgatgagcgacagcacaaacgtgctctctccggggagaacagtgagcgaatccgccgtgagcgaaggcatcatgcgtcgagtgttgggacaccgcgggcgtatcatcaccacgcagtttgcgtccaacattcaccgtctgtacggtgtccgagatgctgcagaagcgacgggtcgccagattgcgtttttgggtttgtcgttgacgacgtaccttgaagcggcgaaaaaggcgggcatcgctcccatcgaccctgagaagctcattccggctgatgaaatcgacaactgcgatccaagcaagcttctcatcgtcaccactggatcacaaggggaggatcgcgcgcagctcgcgcaggcggctttcggtagctcgcgtttgttgacgcttcaacccgaggatctcttgttgtactcggccaagatgattccgggtaacgaaaagagagtcatgcgcatgatgaacgagattgccaagagaggaccagaaatcgcaatgagccgcgaggattgtttgcactcatcaggtcatggatacaaggatgagctggacgaagtgatcaaactcgtcaagccggagcattttttgcctgtgcacggggagtacgcgtttttgcgagcgcacgaacagctcgcgagacaatctggggtcatgcacacgactgtgatagggaacggggaaatgcttggagtcacgcctctggcgtctaagcgtcaacacggaacgatgggcaacttccaccgcatcggcaaggcgcgtttacagacgatgttcaacgacggggggttcggaagcggcacggcggaggatctcgccatcgaagagcgcatgagaatcgctgtcgaaggcatcatcgtgtgcgattacgaaatcgcaaacaacgg

SEQ ID NO: 1279 - DNA, 4000 bp, Escherichia coli
  misc_feature (1)..(4): n is a, c, g, or t
  misc_feature (7)..(16): n is a, c, g, or t
  misc_feature (18)..(27): n is a, c, g, or t
  misc_feature (29)..(78): n is a, c, g, or t
  misc_feature (80)..(97): n is a, c, g, or t
  misc_feature (99)..(124): n is a, c, g, or t
  misc_feature (126)..(158): n is a, c, g, or t
  misc_feature (160)..(178): n is a, c, g, or t
  misc_feature (180)..(197): n is a, c, g, or t
  misc_feature (199)..(227): n is a, c, g, or t
  misc_feature (229)..(229): n is a, c, g, or t
  misc_feature (231)..(255): n is a, c, g, or t
  misc_feature (257)..(280): n is a, c, g, or t
  misc_feature (282)..(301): n is a, c, g, or t
  misc_feature (303)..(310): n is a, c, g, or t
  misc_feature (312)..(381): n is a, c, g, or t
  misc_feature (383)..(436): n is a, c, g, or t
  misc_feature (438)..(439): n is a, c, g, or t
  misc_feature (441)..(443): n is a, c, g, or t
  misc_feature (446)..(454): n is a, c, g, or t
  misc_feature (456)..(470): n is a, c, g, or t
  misc_feature (472)..(479): n is a, c, g, or t
  misc_feature (481)..(481): n is a, c, g, or t
  misc_feature (483)..(483): n is a, c, g, or t
  misc_feature (486)..(496): n is a, c, g, or t
  misc_feature (498)..(544): n is a, c, g, or t
  misc_feature (546)..(575): n is a, c, g, or t
  misc_feature (577)..(591): n is a, c, g, or t
  misc_feature (594)..(594): n is a, c, g, or t
  misc_feature (596)..(609): n is a, c, g, or t
  misc_feature (611)..(613): n is a, c, g, or t
  misc_feature (615)..(625): n is a, c, g, or t
  misc_feature (627)..(627): n is a, c, g, or t
  misc_feature (629)..(637): n is a, c, g, or t
  misc_feature (639)..(646): n is a, c, g, or t
  misc_feature (648)..(688): n is a, c, g, or t
  misc_feature (690)..(699): n is a, c, g, or t
  misc_feature (701)..(753): n is a, c, g, or t
  misc_feature (755)..(779): n is a, c, g, or t
  misc_feature (781)..(795): n is a, c, g, or t
  misc_feature (797)..(807): n is a, c, g, or t
  misc_feature (809)..(818): n is a, c, g, or t
  misc_feature (820)..(824): n is a, c, g, or t
  misc_feature (826)..(858): n is a, c, g, or t
  misc_feature (860)..(869): n is a, c, g, or t
  misc_feature (871)..(880): n is a, c, g, or t
  misc_feature (882)..(892): n is a, c, g, or t
  misc_feature (894)..(911): n is a, c, g, or t
  misc_feature (913)..(921): n is a, c, g, or t
  misc_feature (923)..(929): n is a, c, g, or t
  misc_feature (931)..(946): n is a, c, g, or t
  misc_feature (948)..(949): n is a, c, g, or t
  misc_feature (951)..(955): n is a, c, g, or t
  misc_feature (957)..(975): n is a, c, g, or t
  misc_feature (977)..(979): n is a, c, g, or t
  misc_feature (981)..(981): n is a, c, g, or t
  misc_feature (983)..(986): n is a, c, g, or t
  misc_feature (988)..(999): n is a, c, g, or t
  misc_feature (1001)..(1014): n is a, c, g, or t
  misc_feature (1016)..(1035): n is a, c, g, or t
  misc_feature (1037)..(1037): n is a, c, g, or t
  misc_feature (1039)..(1040): n is a, c, g, or t
  misc_feature (1042)..(1051): n is a, c, g, or t
  misc_feature (1054)..(1092): n is a, c, g, or t
  misc_feature (1094)..(1103): n is a, c, g, or t
  misc_feature (1105)..(1111): n is a, c, g, or t
  misc_feature (1113)..(1116): n is a, c, g, or t
  misc_feature (1118)..(1120): n is a, c, g, or t
  misc_feature (1122)..(1128): n is a, c, g, or t
  misc_feature (1130)..(1139): n is a, c, g, or t
  misc_feature (1141)..(1141): n is a, c, g, or t
  misc_feature (1144)..(1166): n is a, c, g, or t
  misc_feature (1168)..(1184): n is a, c, g, or t
  misc_feature (1186)..(1193): n is a, c, g, or t
  misc_feature (1195)..(1195): n is a, c, g, or t
  misc_feature (1197)..(1205): n is a, c, g, or t
  misc_feature (1207)..(1207): n is a, c, g, or t
  misc_feature (1209)..(1209): n is a, c, g, or t
  misc_feature (1211)..(1219): n is a, c, g, or t
  misc_feature (1221)..(1238): n is a, c, g, or t
  misc_feature (1240)..(1252): n is a, c, g, or t
  misc_feature (1254)..(1257): n is a, c, g, or t
  misc_feature (1259)..(1291): n is a, c, g, or t
  misc_feature (1293)..(1298): n is a, c, g, or t
  misc_feature (1302)..(1303): n is a, c, g, or t
  misc_feature (1306)..(1315): n is a, c, g, or t
  misc_feature (1317)..(1317): n is a, c, g, or t
  misc_feature (1320)..(1325): n is a, c, g, or t
  misc_feature (1327)..(1327): n is a, c, g, or t
  misc_feature (1329)..(1329): n is a, c, g, or t
  misc_feature (1332)..(1332): n is a, c, g, or t
  misc_feature (1334)..(1334): n is a, c, g, or t
  misc_feature (1336)..(1336): n is a, c, g, or t
  misc_feature (1338)..(1354): n is a, c, g, or t
  misc_feature (1356)..(1366): n is a, c, g, or t
  misc_feature (1368)..(1368): n is a, c, g, or t
  misc_feature (1370)..(1372): n is a, c, g, or t
  misc_feature (1374)..(1375): n is a, c, g, or t
  misc_feature (1377)..(1381): n is a, c, g, or t
  misc_feature (1383)..(1387): n is a, c, g, or t
  misc_feature (1389)..(1395): n is a, c, g, or t
  misc_feature (1397)..(1400): n is a, c, g, or t
  misc_feature (1402)..(1404): n is a, c, g, or t
  misc_feature (1406)..(1407): n is a, c, g, or t
  misc_feature (1410)..(1410): n is a, c, g, or t
  misc_feature (1413)..(1422): n is a, c, g, or t
  misc_feature (1424)..(1429): n is a, c, g, or t
  misc_feature (1431)..(1435): n is a, c, g, or t
  misc_feature (1437)..(1443): n is a, c, g, or t
  misc_feature (1446)..(1448): n is a, c, g, or t
  misc_feature (1452)..(1456): n is a, c, g, or t
  misc_feature (1458)..(1461): n is a, c, g, or t
  misc_feature (1463)..(1470): n is a, c, g, or t
  misc_feature (1473)..(1476): n is a, c, g, or t
  misc_feature (1478)..(1482): n is a, c, g, or t
  misc_feature (1484)..(1486): n is a, c, g, or t
  misc_feature (1490)..(1491): n is a, c, g, or t
  misc_feature (1493)..(1493): n is a, c, g, or t
  misc_feature (1496)..(1498): n is a, c, g, or t
  misc_feature (1503)..(1506): n is a, c, g, or t
  misc_feature (1508)..(1512): n is a, c, g, or t
  misc_feature (1514)..(1515): n is a, c, g, or t
  misc_feature (1520)..(1521): n is a, c, g, or t
  misc_feature (1523)..(1526): n is a, c, g, or t
  misc_feature (1528)..(1528): n is a, c, g, or t
  misc_feature (1532)..(1532): n is a, c, g, or t
  misc_feature (1535)..(1536): n is a, c, g, or t
  misc_feature (1540)..(1545): n is a, c, g, or t
  misc_feature (1550)..(1550): n is a, c, g, or t
  misc_feature (1552)..(1552): n is a, c, g, or t
  misc_feature (1554)..(1557): n is a, c, g, or t
  misc_feature (1559)..(1559): n is a, c, g, or t
  misc_feature (1562)..(1563): n is a, c, g, or t
  misc_feature (1565)..(1567): n is a, c, g, or t
  misc_feature (1569)..(1569): n is a, c, g, or t
  misc_feature (1576)..(1579): n is a, c, g, or t
  misc_feature (1581)..(1581): n is a, c, g, or t
  misc_feature (1584)..(1586): n is a, c, g, or t
  misc_feature (1588)..(1591): n is a, c, g, or t
  misc_feature (1595)..(1597): n is a, c, g, or t
  misc_feature (1599)..(1599): n is a, c, g, or t
  misc_feature (1602)..(1602): n is a, c, g, or t
  misc_feature (1604)..(1605): n is a, c, g, or t
  misc_feature (1607)..(1607): n is a, c, g, or t
  misc_feature (1611)..(1614): n is a, c, g, or t
  misc_feature (1616)..(1618): n is a, c, g, or t
  misc_feature (1620)..(1621): n is a, c, g, or t
  misc_feature (1623)..(1624): n is a, c, g, or t
  misc_feature (1626)..(1626): n is a, c, g, or t
  misc_feature (1629)..(1629): n is a, c, g, or t
  misc_feature (1632)..(1635): n is a, c, g, or t
  misc_feature (1637)..(1639): n is a, c, g, or t
  misc_feature (1641)..(1643): n is a, c, g, or t
  misc_feature (1646)..(1651): n is a, c, g, or t
  misc_feature (1653)..(1654): n is a, c, g, or t
  misc_feature (1659)..(1659): n is a, c, g, or t
  misc_feature (1661)..(1661): n is a, c, g, or t
  misc_feature (1665)..(1665): n is a, c, g, or t
  misc_feature (1667)..(1670): n is a, c, g, or t
  misc_feature (1674)..(1675): n is a, c, g, or t
  misc_feature (1677)..(1677): n is a, c, g, or t
  misc_feature (1680)..(1680): n is a, c, g, or t
  misc_feature (1682)..(1682): n is a, c, g, or t
  misc_feature (1685)..(1686): n is a, c, g, or t
  misc_feature (1692)..(1693): n is a, c, g, or t
  misc_feature (1695)..(1698): n is a, c, g, or t
  misc_feature (1700)..(1700): n is a, c, g, or t
  misc_feature (1705)..(1705): n is a, c, g, or t
  misc_feature (1710)..(1710): n is a, c, g, or t
  misc_feature (1713)..(1713): n is a, c, g, or t
  misc_feature (1775)..(1775): n is a, c, g, or t
  misc_feature (2855)..(2855): n is a, c, g, or t
  misc_feature (2857)..(2858): n is a, c, g, or t
  misc_feature (2867)..(2867): n is a, c, g, or t
  misc_feature (2870)..(2870): n is a, c, g, or t
  misc_feature (2872)..(2873): n is a, c, g, or t
  misc_feature (2877)..(2878): n is a, c, g, or t
  misc_feature (2880)..(2880): n is a, c, g, or t
  misc_feature (2885)..(2886): n is a, c, g, or t
  misc_feature (2888)..(2888): n is a, c, g, or t
  misc_feature (2890)..(2893): n is a, c, g, or t
  misc_feature (2895)..(2896): n is a, c, g, or t
  misc_feature (2898)..(2903): n is a, c, g, or t
  misc_feature (2906)..(2910): n is a, c, g, or t
  misc_feature (2912)..(2917): n is a, c, g, or t
  misc_feature (2920)..(2920): n is a, c, g, or t
  misc_feature (2922)..(2923): n is a, c, g, or t
  misc_feature (2925)..(2931): n is a, c, g, or t
  misc_feature (2939)..(2949): n is a, c, g, or t
  misc_feature (2953)..(2953): n is a, c, g, or t
  misc_feature (2955)..(2955): n is a, c, g, or t
  misc_feature (2958)..(2962): n is a, c, g, or t
  misc_feature (2964)..(2964): n is a, c, g, or t
  misc_feature (2967)..(2967): n is a, c, g, or t
  misc_feature (2969)..(2971): n is a, c, g, or t
  misc_feature (2973)..(2974): n is a, c, g, or t
  misc_feature (2977)..(2977): n is a, c, g, or t
  misc_feature (2981)..(2981): n is a, c, g, or t
  misc_feature (2983)..(2986): n is a, c, g, or t
  misc_feature (2988)..(2990): n is a, c, g, or t
  misc_feature (2992)..(2993): n is a, c, g, or t
  misc_feature (2995)..(2998): n is a, c, g, or t
  misc_feature (3000)..(3001): n is a, c, g, or t
  misc_feature (3003)..(3005): n is a, c, g, or t
  misc_feature (3007)..(3014): n is a, c, g, or t
  misc_feature (3016)..(3016): n is a, c, g, or t
  misc_feature (3019)..(3019): n is a, c, g, or t
  misc_feature (3021)..(3022): n is a, c, g, or t
  misc_feature (3024)..(3033): n is a, c, g, or t
  misc_feature (3035)..(3037): n is a, c, g, or t
  misc_feature (3039)..(3040): n is a, c, g, or t
  misc_feature (3042)..(3046): n is a, c, g, or t
  misc_feature (3048)..(3049): n is a, c, g, or t
  misc_feature (3051)..(3053): n is a, c, g, or t
  misc_feature (3055)..(3055): n is a, c, g, or t
  misc_feature (3058)..(3071): n is a, c, g, or t
  misc_feature (3073)..(3078): n is a, c, g, or t
  misc_feature (3080)..(3081): n is a, c, g, or t
  misc_feature (3085)..(3086): n is a, c, g, or t
  misc_feature (3088)..(3089): n is a, c, g, or t
  misc_feature (3093)..(3097): n is a, c, g, or t
  misc_feature (3099)..(3099): n is a, c, g, or t
  misc_feature (3101)..(3101): n is a, c, g, or t
  misc_feature (3103)..(3104): n is a, c, g, or t
  misc_feature (3106)..(3107): n is a, c, g, or t
  misc_feature (3109)..(3116): n is a, c, g, or t
  misc_feature (3118)..(3119): n is a, c, g, or t
  misc_feature (3121)..(3123): n is a, c, g, or t
  misc_feature (3125)..(3125): n is a, c, g, or t
  misc_feature (3127)..(3132): n is a, c, g, or t
  misc_feature (3135)..(3136): n is a, c, g, or t
  misc_feature (3138)..(3146): n is a, c, g, or t
  misc_feature (3148)..(3150): n is a, c, g, or t
  misc_feature (3152)..(3152): n is a, c, g, or t
  misc_feature (3156)..(3157): n is a, c, g, or t
  misc_feature (3161)..(3162): n is a, c, g, or t
  misc_feature (3164)..(3167): n is a, c, g, or t
  misc_feature (3169)..(3203): n is a, c, g, or t
  misc_feature (3205)..(3206): n is a, c, g, or t
  misc_feature (3208)..(3208): n is a, c, g, or t
  misc_feature (3210)..(3213): n is a, c, g, or t
  misc_feature (3215)..(3222): n is a, c, g, or t
  misc_feature (3224)..(3234): n is a, c, g, or t
  misc_feature (3237)..(3243): n is a, c, g, or t
  misc_feature (3245)..(3247): n is a, c, g, or t
  misc_feature (3249)..(3251): n is a, c, g, or t
  misc_feature (3253)..(3253): n is a, c, g, or t
  misc_feature (3255)..(3255): n is a, c, g, or t
  misc_feature (3258)..(3263): n is a, c, g, or t
  misc_feature (3265)..(3288): n is a, c, g, or t
  misc_feature (3290)..(3292): n is a, c, g, or t
  misc_feature (3294)..(3294): n is a, c, g, or t
  misc_feature (3296)..(3300): n is a, c, g, or t
  misc_feature (3302)..(3303): n is a, c, g, or t
  misc_feature (3305)..(3313): n is a, c, g, or t
  misc_feature (3318)..(3319): n is a, c, g, or t
  misc_feature (3321)..(3325): n is a, c, g, or t
  misc_feature (3327)..(3329): n is a, c, g, or t
  misc_feature (3331)..(3337): n is a, c, g, or t
  misc_feature (3339)..(3345): n is a, c, g, or t
  misc_feature (3347)..(3354): n is a, c, g, or t
  misc_feature (3356)..(3375): n is a, c, g, or t
  misc_feature (3377)..(3380): n is a, c, g, or t
  misc_feature (3382)..(3389): n is a, c, g, or t
  misc_feature (3391)..(3402): n is a, c, g, or t
  misc_feature (3404)..(3414): n is a, c, g, or t
  misc_feature (3416)..(3417): n is a, c, g, or t
  misc_feature (3419)..(3445): n is a, c, g, or t
  misc_feature (3448)..(3460): n is a, c, g, or t
  misc_feature (3463)..(3467): n is a, c, g, or t
  misc_feature (3469)..(3470): n is a, c, g, or t
  misc_feature (3472)..(3472): n is a, c, g, or t
  misc_feature (3474)..(3475): n is a, c, g, or t
  misc_feature (3477)..(3480): n is a, c, g, or t
  misc_feature (3482)..(3484): n is a, c, g, or t
  misc_feature (3486)..(3505): n is a, c, g, or t
  misc_feature (3509)..(3519): n is a, c, g, or t
  misc_feature (3521)..(3521): n is a, c, g, or t
  misc_feature (3523)..(3533): n is a, c, g, or t
  misc_feature (3535)..(3543): n is a, c, g, or t
  misc_feature (3545)..(3545): n is a, c, g, or t
  misc_feature (3547)..(3556): n is a, c, g, or t
  misc_feature (3558)..(3568): n is a, c, g, or t
  misc_feature (3570)..(3575): n is a, c, g, or t
  misc_feature (3577)..(3585): n is a, c, g, or t
  misc_feature (3587)..(3594): n is a, c, g, or t
  misc_feature (3596)..(3613): n is a, c, g, or t
  misc_feature (3615)..(3655): n is a, c, g, or t
  misc_feature (3657)..(3680): n is a, c, g, or t
  misc_feature (3682)..(3707): n is a, c, g, or t
  misc_feature (3709)..(3709): n is a, c, g, or t
  misc_feature (3711)..(3715): n is a, c, g, or t
  misc_feature (3717)..(3720): n is a, c, g, or t
  misc_feature (3722)..(3723): n is a, c, g, or t
  misc_feature (3725)..(3736): n is a, c, g, or t
  misc_feature (3738)..(3756): n is a, c, g, or t
  misc_feature (3758)..(3762): n is a, c, g, or t
  misc_feature (3764)..(3765): n is a, c, g, or t
  misc_feature (3767)..(3769): n is a, c, g, or t
  misc_feature (3771)..(3780): n is a, c, g, or t
  misc_feature (3782)..(3789): n is a, c, g, or t
  misc_feature (3791)..(3833): n is a, c, g, or t
  misc_feature (3835)..(3852): n is a, c, g, or t
  misc_feature (3854)..(3871): n is a, c, g, or t
  misc_feature (3873)..(3873): n is a, c, g, or t
  misc_feature (3875)..(3878): n is a, c, g, or t
  misc_feature (3880)..(3892): n is a, c, g, or t
  misc_feature (3894)..(3916): n is a, c, g, or t
  misc_feature (3918)..(3919): n is a, c, g, or t
  misc_feature (3921)..(3952): n is a, c, g, or t
  misc_feature (3955)..(3958): n is a, c, g, or t
  misc_feature (3960)..(3977): n is a, c, g, or t
  misc_feature (3979)..(3999): n is a, c, g, or t
nnnnttnnnnnnnnnntnnnnnnnnnntnnnnnnnnnnnnnnnnnnnnnnnnnnnnnnnnnnnnnnnnnnnnnnnnnnannnnnnnnnnnnnnnnnnannnnnnnnnnnnnnnnnnnnnnnnnnannnnnnnnnnnnnnnnnnnnnnnnnnnnnnnnnannnnnnnnnnnnnnnnnnnannnnnnnnnnnnnnnnnntnnnnnnnnnnnnnnnnnnnnnnnnnnnnntntnnnnnnnnnnnnnnnnnnnnnnnnnannnnnnnnnnnnnnnnnnnnnnnntnnnnnnnnnnnnnnnnnnnntnnnnnnnnannnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnntnntnnntannnnnnnnnannnnnnnnnnnnnnntnnnnnnnntntnttnnnnnnnnnnntnnnnnnnnnnnnnnnnnnnnnnnnnnnnnnnnnnnnnnnnnnnnnnntnnnnnnnnnnnnnnnnnnnnnnnnnnnnnntnnnnnnnnnnnnnnncanannnnnnnnnnnnnntnnntnnnnnnnnnnntntnnnnnnnnnannnnnnnntnnnnnnnnnnnnnnnnnnnnnnnnnnnnnnnnnnnnnnnnntnnnnnnnnnntnnnnnnnnnnnnnnnnnnnnnnnnnnnnnnnnnnnnnnnnnnnnnnnnnnnnntnnnnnnnnnnnnnnnnnnnnnnnnntnnnnnnnnnnnnnnnannnnnnnnnnnannnnnnnnnnannnnntnnnnnnnnnnnnnnnnnnnnnnnnnnnnnnnnnannnnnnnnnntnnnnnnnnnntnnnnnnnnnnntnnnnnnnnnnnnnnnnnntnnnnnnnnntnnnnnnntnnnnnnnnnnnnnnnntnnannnnntnnnnnnnnnnnnnnnnnnntnnntntnnnntnnnnnnnnnnnntnnnnnnnnnnnnnntnnnnnnnnnnnnnnnnnnnntntnntnnnnnnnnnnttnnnnnnnnnnnnnnnnnnnnnnnnnnnnnnnnnnnnnnntnnnnnnnnnntnnnnnnntnnnntnnntnnnnnnntnnnnnnnnnntnttnnnnnnnnnnnnnnnnnnnnnnnannnnnnnnnnnnnnnnntnnnnnnnnantnnnnnnnnntntntnnnnnnnnntnnnnnnnnnnnnnnnnnnannnnnnnnnnnnnannnnannnnnnnnnnnnnnnnnnnnnnnnnnnnnnnnnannnnnnaaanntannnnnnnnnnanaannnnnntntnggntntncnnnnnnnnnnnnnnnnntnnnnnnnnnnnantnnntnnannnnntnnnnnannnnnnnannnnannntnntantannnnnnnnnntnnnnnnannnnnannnnnnnttnnntttnnnnnannnntnnnnnnnnttnnnntnnnnntnnngttnncnttnnnatatnnnntnnnnntnntggtnntnnnntntttnttnntgcnnnnnntatanantnnnntnaannannntnatattcnnnntntannncnnnntttnnntnctngnntntttnnnntnnntnntnntnatncannnntnnnannnaannnnnntnnaattntnctantnnnnaaanntnttntnganntatttnntnnnntnttttngttanagngttatagttagcaaagtttttgtgatagatgcttacctatcaatattcaaaaagatgttcanctataactgtactatagtcgtacacagtacacacgaattgtgccacaaaaattttagtagagcctatctatattgtgtagagataacaataatctgatatatattctattgtagttggcagtgtaaatctatcaaaatattctttattttctccttctaaattattgaataaatctttaataatttcttctcggatatttttattttttaacagaaaaacattaccatctgcttttctgatagtgtttagaaaaaaaggtagtaaatatttcgtgtatacttcatatctatgattctttatagaaggtgaatctatctctctcttagaaaaattaataagagtatttacaacatctgtttcaataagatttctaatttttttctcacttgcttccaaaaatatatcggtcatcgtattagccttagatatctctaacttaatgttagcagagagactactcaaactgtcatcaggaaaacaaataggtccaacccaaagatttattctaaaaacctcaacgggattatttttataggcatctataataatgtaacaataatgaatatcatctaaacgttttataaaggataccatatttttatgccaaaaccttttaggtgttttaaaaccgaatgaatttattaaaagtgtgaattttttaagtattaattgagaatctaacataatataataactatttattattgttataagtagaaccacttgaatattcaataccattatcttttaatctttttaagattggttccatatctggtactccttttgggtcattaagaaagtgccaatgagggtttgcttctccagattgtttgtacttaatatccttatctatttgcttattcatatgatcaatctcgctttgagtcctctctcttttaaaattagctgatttaaactctatatctttaccatcgtattccttatcataaactctatcttttaacctttttccttttccttctccaaaaattttagtggcttcatcatcatgaaattttcgtgcgtaataccaccagcttgataaccccagcacatccacccacgcattggtatcncnnacataagcnaanannttanncncaccnnanannnnannannnnnntcnnnnntnnnnnnccncnncnnnnnnngatgatannnnnnnnnnntgtngnagnnnnntnctncnnnannatnatantnnnntnnntnntnnnnannannncnnnnnnnntnttntnnannnnnnnnnngnnngnngnnnnnanngnnntnttnnnnnnnnnnnnnnannnnnncnncttnntnntagnnnnntntngnngnncnnnnnnnntnntnnntnannnnnnagnntnnnnnnnnntnnntntttnnacannannnnannnnnnnnnnnnnnnnnnnnnnnnnnnnnnnnnnntnntnannnnannnnnnnnannnnnnnnnnntannnnnnntnnnannntntnttnnnnnntnnnnnnnnnnnnnnnnnnnnnnnnannnanannnnntnntnnnnnnnnnaaaanntnnnnntnnntnnnnnnntnnnnnnntnnnnnnnnannnnnnnnnnnnnnnnnnnnannnnannnnnnnncnnnnnnnnnnnntnnnnnnnnnnnannannnnnnnnnnnnnnnnnnnnnnnnnnnttnnnnnnnnnnnnnttnnnnntnntntnnannnntnnntnnnnnnnnnnnnnnnnnnnntcannnnnnnnnnntntnnnnnnnnnnntnnnnnnnnntntnnnnnnnnnntnnnnnnnnnnntnnnnnnannnnnnnnntnnnnnnnntnnnnnnnnnnnnnnnnnntnnnnnnnnnnnnnnnnnnnnnnnnnnnnnnnnnnnnnnnnntnnnnnnnnnnnnnnnnnnnnnnnntnnnnnnnnnnnnnnnnnnnnnnnnnntntnnnnnannnntnntnnnnnnnnnnnntnnnnnnnnnnnnnnnnnnntnnnnntnntnnnannnnnnnnnntnnnnnnnntnnnnnnnnnnnnnnnnnnnnnnnnnnnnnnnnnnnnnnnnnnntnnnnnnnnnnnnnnnnnnannnnnnnnnnnnnnnnnnancnnnntnnnnnnnnnnnnnannnnnnnnnnnnnnnnnnnnnnnannannnnnnnnnnnnnnnnnnnnnnnnnnnnnnnnctnnnnannnnnnnnnnnnnnnnnntnnnnnnnnnnnnnnnnnnnnnt

SEQ ID NO: 1280 - DNA, 4000 bp, Escherichia coli
  misc_feature (1)..(1166): n is a, c, g, or t
  misc_feature (1208)..(1211): n is a, c, g, or t
  misc_feature (1213)..(1214): n is a, c, g, or t
  misc_feature (1218)..(1230): n is a, c, g, or t
  misc_feature (1232)..(1239): n is a, c, g, or t
  misc_feature (1241)..(1248): n is a, c, g, or t
  misc_feature (1250)..(1258): n is a, c, g, or t
  misc_feature (1260)..(1261): n is a, c, g, or t
  misc_feature (1263)..(1265): n is a, c, g, or t
  misc_feature (1268)..(1269): n is a, c, g, or t
  misc_feature (1286)..(1286): n is a, c, g, or t
  misc_feature (1561)..(1561): n is a, c, g, or t
  misc_feature (1725)..(1725): n is a, c, g, or t
  misc_feature (1983)..(1983): n is a, c, g, or t
  misc_feature (1990)..(1990): n is a, c, g, or t
  misc_feature (2155)..(2155): n is a, c, g, or t
  misc_feature (2278)..(2278): n is a, c, g, or t
  misc_feature (2326)..(2326): n is a, c, g, or t
  misc_feature (2329)..(2329): n is a, c, g, or t
  misc_feature (2350)..(2350): n is a, c, g, or t
  misc_feature (2428)..(2428): n is a, c, g, or t
  misc_feature (2857)..(2857): n is a, c, g, or t
  misc_feature (3878)..(3878): n is a, c, g, or t
  misc_feature (3966)..(3966): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctaattaggtgtgtagtagattatatataatagtggggnnnnannttannnnnnnnnnnnnannnnnnnnannnnnnnntnnnnnnnnntnntnnnctnnaccaatctctacctttnaattttcaccctttaacgccttgttcttagattgttttaattatcagaccactccggatttttaatccatatccccttatgatcttgaatgaatttaggagtcgtttcggagattactttaggtttctcttctttttcctgatcatcaagagatataatcttgtcgtcccgaagaacttttccgctaaaagtaattttcatattcaaatttcctttcctcaggtttcagcgtcaactctcatatccaatggttttattatttcaaatcaaacaanaaacataacaaccagaaaatatcttttatttagtaatacaactctaaatataagtcaacaatttactaataaagaatatttgacaaatacggctctcttactttttataaaaaagttaccacctttaagatagattttatagactaagttttttctcttgaatntctgctcttcttgtctttgctagtttaccaagctctcccagtgcttttcgggctctagctgcagctgcttttatattcttagtttcaaaactctcattttccgaaagataggtttcataagcagatacaatttgatcgtgggtcatacgtacactctcctattttttaaataattaaaatttagtctcaagacatgtaactatcacatgtagctagttaaatccaagtaaaaaattctacccgtaaaataatcggaanagacgtncatcaagctactttttgcgtttttgccgctcgtttccgttcattctcgtccaagtgccttttacgtagacgaatactggtaggagtaatctccgcaagttcgtcatcattaagataaccaagaacttgctcgaggctcattattctaggaggcgcaatacttacngtatcatctgatccagatgcgcgcacatttgtgagctttttccccttacaaacattaacaacaagatcattatctttattgttttcgccaataatcattcctgtatacacttcctcagccggncctaggaacataactcctctatcttgcaagttaaataaagagtgcgtngtngtgcttccgttctcaagaganattaatactccgttattacgacgagccaattctccgcaatacggaacataatcatgaaagctatgattcaaaataccngttcctcgggtaagagttaacagttgtgagcggaaaccaaacaaaccacgtgttggaatgacaaattccagccgaaccgattccgttccagtgtgaatcatatttttcattacacctttacgttggcccattgcctccatcaccgttcccatgtactgctcttcaacatcaattattgcaaattcttctggctccattgtcttgtcattaattttctttaaaacaacttgtggtctggaaatagaaaattcaaaatcctcccgcctcatagtttctataagaatagtaaggtgtaattctcctctacccgaaactttaaatgtgtcattggagcttgcttcttcaactcgtaaagctacattttgtttaatttctttaaataatctttcacgcaattgtcttgatgtaacaaatttcccttctcgcccngcaaatggtgagctgttaacaagaaagtttatggataatgttggctcatcaatttctattaaaggcaacgcttctaggttgttacgatcagtaatggtttcccctatatccacttctttcattccagcgataccaacaatatctcctgttaccgcatcctgcacctcttttcgttgcaaaccttcaaaagtgaataatttagaaactttaaaatcctctttatcgcctgatcgtttaattaaagtgtattgtttgcttgaatcatagcaacccctttgaatcttccctactgcaattcgccctacgtagtcattataatcaatgttggagaccaacatttgaaatgcaccttttggatcaccttcatgtggcgcaactttatcaattatcaagtctaataaaggtttcatattctggtcttctccacctggttccactcgacaaaaaccatgtttagcagacgtgtatatcgtggaaaaatctaactgctcatctgatgctcctagattaacaaaaagatcgaaaaccagatttagtgcgttttctggattagctccagggcgatcaattttatttacaacaacaattggttttagtcctaagtcgagtgatttttttaatacaaaccgtgtctgcggcatgggaccttcataggcatcaactataagcaagactccatttaccattttaagaatacgctcgacttctcctccaaaatcagcatgccccggggtatcaacaatattaattttatattcattatgttcaatagaagcattttttgaaaaaatggtgatgcctcgttctttttctaaatcattgctgtccatgatgcacgaccctgacaattcattagctctaaacataccactttgccttaatagacaatcaacaagtgtggttttcccatgatcgacatgggcgataattccaacatttctaatatgttcgttgttcataatattacgaatattctttctctaaagttaaattctaaaaaagatcacttgattagcacaanagccaaaccattcattatatgcattttttataaaaataaaaggtaaatactaggttcagaactatttaaatatcaatgtttaagcggntctgatatagattttgaaggtatttggcatctca

SEQ ID NO: 1281 - DNA, 4000 bp, Escherichia coli
  misc_feature (82)..(82): n is a, c, g, or t
  misc_feature (2368)..(2368): n is a, c, g, or t
  misc_feature (2866)..(2866): n is a, c, g, or t
  misc_feature (2893)..(2893): n is a, c, g, or t
  misc_feature (3597)..(3597): n is a, c, g, or t
  misc_feature (3627)..(3627): n is a, c, g, or t
acttttgagtactaagcttatgcttggccaaggtattcatgtagaaggtattaattttttcacaggcttttgtgtggaaggncatacgcatgcgattcgcaaacaaaaaagtgacaagccaaagcgtaataatgcactgtgggtggcagagcaacttggcattaaattacacattattgatgtgattgaagagtatcgagacgttcttttaaatccaaaacatggttatggaaaaaacatgaatccttgtttagattgcaaagggttcatggtgaaaaaagccaagcagtggatggaggagaatgattttgactttattattaccggcgaggtaatgggtcaacgtcctatgtctcagcgcaaagaaaccatgccagtggtgcaagaagaatccggcgcaggtgatttgttattacgccctttgtgcgctaaacacttaccactaactaaggctgaaattgaaggctgggtggatcgtgaacggttgctagacttttcgggacgcacccgtaagccgcaaatggcgttggctaaagaatacggttttgatgactatgccactcctgcaggtggctgttgttttttaaccgataaacaatattcggataaattagtggatatgtggcaagcccgcggtaatcgtgattaccaacttgatgatcttatgatgcttaaggtgggtcgacacattcgccctaatcagcgtttcaagatgattattgctagagaagagggtgaagtgaaatttttagagggttatcgtaatcagtacgctcatttgtattcaaccagctgtaatggcccgatagcattaatagatggagagcccaatcaagaagatataaagattgctgctaagattttggcgagatattcccagggtagagatgaagacagtgttgatgtagaagttaaattgcaggctggcgtagctcagcaattaagtgttaaacctttttcagcagaagagattgataaaaactggatggtttaaggtgttataatagtaatacttatttaattacttaagtattatgaaaacaattactttaaaaaccaaagatgatttttttgatcaaatcaatcaaatggcgttagacgcccatatatccaaaagtgcgttgatacgaaaagcaattagatcgtatcaaaaaaaccttgaaaagcaaaaaattatcaaacaaatgcaaaaatcttcttttgaaactagaggtttggacgctgaattaaaacatgattttgaagcactagacgatgaacaccttttgccaccttgggaagattgatgaattttattaggggtggaatttatttggccaaccttaatccaagtagaggcgctgaaattggtaaaattcgtccagttttagttattcagtctaatgggttaaatagcattaaacatccaacagtaaatattttgccacttactacaaatttgaaaaacaacacttttttgcattttagagttaataaaagagatgagttaaagcataattcagatattgtttgtgattatattcgtgcaattgatagtagtaaattcacatcaagtatattaactcaacttagtaaaaatgaaatgcaacaaatagaagaaaaattaagttggatactaggctttaatgattaaccaccaccaacagctttaatgacctcaatcttatcaccttcatttaagctaaattcaatatgttttgacttgggaataatagcttcattaacttctagcgcgatacgctgatcttgataacccaatttagtgattaaatcctgtacattcgagcattcatctatttttagattttcaccattaacaactagattcattgatccatttttcctatcgcacaagagacgaatgatttagctttagctttagtagaatcaaatccatgaacagaatcaaccttggggtagcctaaacctagtaaaacctcagttaactccttccttttagattcgtcaatatcaatatcaataatgccctgttcgatattaatttcaatattttcagtatcgaaaaccttggttaattttttagtgattgtgcctgcacaaccaccgcatttaatattttcaacagtaatgttcataacactccaaaaattgacaattcatgacatcattatatcactctaatttatttatttgagtatcagcttgaatgacgattgtggtaaaattttcggagttttggattcaggagtgtttggtgtcgcaagttgcattattagccgtgttagctttggaagatggtacgattttccacggtaaatcgattggtgctagtggcaatacagtcggcgaagtggtgtttaatacttcaatgaccggctatcaagaaatccttactgacccttcttangcacaacaaattgttgcactgacttaccctcacatcggcaatacaggtactaatttggttgatgaagagtctagtcaaatttacgcttcaggtttgatcattcgtgatttgccgctcatggtaagcaattggcgttcgaacatgcctttagatgagtatttatcctcgcacaatattgtggccattagcgacattgatacccgtgcactaacgcgtcatttgcgtgaaaaaggctctcttaagggttgtattatcagcggtgacgatgttgatgaagcagaagccatcgaaaaagcacagtcttttgcaggtctaaaaaacatggatttggcaaaagtagtttctactactaagacttatgagtttaataaaggttcgtactcgttagaaagtaatgaatttagaaaacttgatgcaaaatttaaggttgtggtttatgactatggcgttaagaaaaatattttaagaatgttggtggatcgaggctgtgatttaacngtggtgaatgccaaaactccagtggangaggttttgtcaatggatcctgacggtgtattcttatctaacggaccgggtgatcctgaaccgtgtgattatgccattagcagtattcaaactttattggaaaaaaacacgccaatttttggtatttgtttgggtcatcagttgttatcgttagcgagtggcgctaaaacccagaaaatgaaatttggtcatcatggcgctaatcatcctgtgcaagacttaaacaccaaacaagtaatgattacttcgcaaaatcacggctttgccgtatcagaggacaatataccggatacactggaaattacacatcgttcgctatttgacaattcaattcaaggtgttaaagtagccaataaacctgcttttagttttcagggtcaccctgaagcttcaccaggtccgcacgatgtaagcggtttatttgatgtttttattgaggagatgaaaaaatgaaaaatatattgatgagcttattattgctattgatggctaacacagttgttttagctgaagaagacattgatccatttgaggatatgaatcgagttatttatgattttaatgaaacaattgatgataatctgcttgagcctgtttctagagcgtataaagaacatgcacctggaattctacaaagtggagttagtaatttctttggtaatttgcgtgatgtgtctacattggctaatcaaatattacaattnaaacccgttgaaagtgtaaccacgttgggncgtgttattgtgaattcaaccattggtttgtttggcttatttgatgtggcctctgagatagacttgactaagagtacagaagattttggtcaaacattagccgtatggggtgtcggcgatggtccgtacgtaatgataccgctgttaggcccgtcaaccgtaagagatggtgttggcctttatgtggatttaacatccgatgcaaatatgattaatgagatgaatgatatcggctttgtcagcgctagtatgatgaatatagttgataagcgtgtggagctcttacccgcgactgatttgttagatcaatcggatgacccgtacattaccatgcgttcatcgtatttgcaaaaaagacaatttgacattttcg

SEQ ID NO: 1282 - DNA, 4000 bp, Escherichia coli
  misc_feature (1)..(1): n is a, c, g, or t
  misc_feature (5)..(6): n is a, c, g, or t
  misc_feature (17)..(17): n is a, c, g, or t
  misc_feature (27)..(27): n is a, c, g, or t
  misc_feature (34)..(34): n is a, c, g, or t
  misc_feature (40)..(40): n is a, c, g, or t
  misc_feature (43)..(44): n is a, c, g, or t
  misc_feature (46)..(46): n is a, c, g, or t
  misc_feature (50)..(51): n is a, c, g, or t
  misc_feature (54)..(55): n is a, c, g, or t
  misc_feature (61)..(61): n is a, c, g, or t
  misc_feature (67)..(67): n is a, c, g, or t
  misc_feature (71)..(71): n is a, c, g, or t
  misc_feature (79)..(79): n is a, c, g, or t
  misc_feature (81)..(81): n is a, c, g, or t
  misc_feature (85)..(85): n is a, c, g, or t
  misc_feature (88)..(90): n is a, c, g, or t
  misc_feature (92)..(94): n is a, c, g, or t
  misc_feature (96)..(98): n is a, c, g, or t
  misc_feature (108)..(110): n is a, c, g, or t
  misc_feature (113)..(114): n is a, c, g, or t
  misc_feature (123)..(123): n is a, c, g, or t
  misc_feature (126)..(127): n is a, c, g, or t
  misc_feature (129)..(130): n is a, c, g, or t
  misc_feature (137)..(137): n is a, c, g, or t
  misc_feature (139)..(140): n is a, c, g, or t
  misc_feature (145)..(145): n is a, c, g, or t
  misc_feature (149)..(151): n is a, c, g, or t
  misc_feature (153)..(153): n is a, c, g, or t
  misc_feature (155)..(155): n is a, c, g, or t
  misc_feature (158)..(158): n is a, c, g, or t
  misc_feature (164)..(164): n is a, c, g, or t
  misc_feature (167)..(167): n is a, c, g, or t
  misc_feature (173)..(174): n is a, c, g, or t
  misc_feature (177)..(179): n is a, c, g, or t
  misc_feature (182)..(184): n is a, c, g, or t
  misc_feature (186)..(194): n is a, c, g, or t
  misc_feature (196)..(199): n is a, c, g, or t
  misc_feature (201)..(201): n is a, c, g, or t
  misc_feature (206)..(206): n is a, c, g, or t
  misc_feature (210)..(210): n is a, c, g, or t
  misc_feature (215)..(215): n is a, c, g, or t
  misc_feature (218)..(218): n is a, c, g, or t
  misc_feature (220)..(220): n is a, c, g, or t
  misc_feature (222)..(223): n is a, c, g, or t
  misc_feature (227)..(227): n is a, c, g, or t
  misc_feature (229)..(229): n is a, c, g, or t
  misc_feature (232)..(237): n is a, c, g, or t
  misc_feature (239)..(240): n is a, c, g, or t
  misc_feature (243)..(246): n is a, c, g, or t
  misc_feature (248)..(250): n is a, c, g, or t
  misc_feature (252)..(252): n is a, c, g, or t
  misc_feature (256)..(257): n is a, c, g, or t
  misc_feature (262)..(265): n is a, c, g, or t
  misc_feature (268)..(268): n is a, c, g, or t
  misc_feature (270)..(271): n is a, c, g, or t
  misc_feature (275)..(275): n is a, c, g, or t
  misc_feature (279)..(279): n is a, c, g, or t
  misc_feature (281)..(281): n is a, c, g, or t
  misc_feature (283)..(287): n is a, c, g, or t
  misc_feature (289)..(289): n is a, c, g, or t
  misc_feature (292)..(295): n is a, c, g, or t
  misc_feature (299)..(299): n is a, c, g, or t
  misc_feature (301)..(304): n is a, c, g, or t
  misc_feature (307)..(307): n is a, c, g, or t
  misc_feature (313)..(314): n is a, c, g, or t
  misc_feature (316)..(317): n is a, c, g, or t
  misc_feature (319)..(319): n is a, c, g, or t
  misc_feature (323)..(323): n is a, c, g, or t
  misc_feature (325)..(327): n is a, c, g, or t
  misc_feature (333)..(335): n is a, c, g, or t
  misc_feature (339)..(342): n is a, c, g, or t
  misc_feature (346)..(346): n is a, c, g, or t
  misc_feature (348)..(349): n is a, c, g, or t
  misc_feature (355)..(355): n is a, c, g, or t
  misc_feature (364)..(365): n is a, c, g, or t
  misc_feature (367)..(367): n is a, c, g, or t
  misc_feature (374)..(378): n is a, c, g, or t
  misc_feature (380)..(384): n is a, c, g, or t
  misc_feature (387)..(387): n is a, c, g, or t
  misc_feature (389)..(392): n is a, c, g, or t
  misc_feature (399)..(403): n is a, c, g, or t
  misc_feature (405)..(405): n is a, c, g, or t
  misc_feature (409)..(410): n is a, c, g, or t
  misc_feature (412)..(413): n is a, c, g, or t
  misc_feature (418)..(428): n is a, c, g, or t
  misc_feature (430)..(433): n is a, c, g, or t
  misc_feature (438)..(438): n is a, c, g, or t
  misc_feature (440)..(441): n is a, c, g, or t
  misc_feature (444)..(445): n is a, c, g, or t
  misc_feature (450)..(451): n is a, c, g, or t
  misc_feature (453)..(455): n is a, c, g, or t
  misc_feature (457)..(458): n is a, c, g, or t
  misc_feature (463)..(466): n is a, c, g, or t
  misc_feature (468)..(472): n is a, c, g, or t
  misc_feature (474)..(477): n is a, c, g, or t
  misc_feature (479)..(480): n is a, c, g, or t
  misc_feature (485)..(500): n is a, c, g, or t
  misc_feature (502)..(502): n is a, c, g, or t
  misc_feature (505)..(505): n is a, c, g, or t
  misc_feature (508)..(510): n is a, c, g, or t
  misc_feature (512)..(512): n is a, c, g, or t
  misc_feature (514)..(519): n is a, c, g, or t
  misc_feature (523)..(524): n is a, c, g, or t
  misc_feature (526)..(527): n is a, c, g, or t
  misc_feature (531)..(532): n is a, c, g, or t
  misc_feature (534)..(535): n is a, c, g, or t
  misc_feature (538)..(538): n is a, c, g, or t
  misc_feature (543)..(543): n is a, c, g, or t
  misc_feature (546)..(549): n is a, c, g, or t
  misc_feature (551)..(552): n is a, c, g, or t
  misc_feature (554)..(556): n is a, c, g, or t
  misc_feature (559)..(559): n is a, c, g, or t
  misc_feature (562)..(562): n is a, c, g, or t
  misc_feature (564)..(569): n is a, c, g, or t
  misc_feature (571)..(577): n is a, c, g, or t
  misc_feature (581)..(582): n is a, c, g, or t
  misc_feature (584)..(584): n is a, c, g, or t
  misc_feature (588)..(588): n is a, c, g, or t
  misc_feature (591)..(592): n is a, c, g, or t
  misc_feature (594)..(594): n is a, c, g, or t
  misc_feature (597)..(598): n is a, c, g, or t
  misc_feature (602)..(604): n is a, c, g, or t
  misc_feature (608)..(609): n is a, c, g, or t
  misc_feature (611)..(613): n is a, c, g, or t
  misc_feature (615)..(615): n is a, c, g, or t
  misc_feature (618)..(620): n is a, c, g, or t
  misc_feature (625)..(626): n is a, c, g, or t
  misc_feature (632)..(632): n is a, c, g, or t
  misc_feature (638)..(638): n is a, c, g, or t
  misc_feature (641)..(642): n is a, c, g, or t
  misc_feature (644)..(645): n is a, c, g, or t
  misc_feature (647)..(647): n is a, c, g, or t
  misc_feature (652)..(652): n is a, c, g, or t
  misc_feature (655)..(656): n is a, c, g, or t
  misc_feature (659)..(659): n is a, c, g, or t
  misc_feature (662)..(664): n is a, c, g, or t
  misc_feature (673)..(673): n is a, c, g, or t
  misc_feature (678)..(678): n is a, c, g, or t
  misc_feature (685)..(685): n is a, c, g, or t
  misc_feature (690)..(690): n is a, c, g, or t
  misc_feature (699)..(699): n is a, c, g, or t
  misc_feature (702)..(702): n is a, c, g, or t
  misc_feature (704)..(705): n is a, c, g, or t
  misc_feature (707)..(719): n is a, c, g, or t
  misc_feature (721)..(721): n is a, c, g, or t
  misc_feature (724)..(728): n is a, c, g, or t
  misc_feature (731)..(734): n is a, c, g, or t
  misc_feature (738)..(740): n is a, c, g, or t
  misc_feature (743)..(743): n is a, c, g, or t
  misc_feature (747)..(751): n is a, c, g, or t
  misc_feature (756)..(757): n is a, c, g, or t
  misc_feature (763)..(763): n is a, c, g, or t
  misc_feature (766)..(766): n is a, c, g, or t
  misc_feature (769)..(769): n is a, c, g, or t
  misc_feature (772)..(772): n is a, c, g, or t
  misc_feature (778)..(779): n is a, c, g, or t
  misc_feature (781)..(781): n is a, c, g, or t
  misc_feature (783)..(785): n is a, c, g, or t
  misc_feature (787)..(787): n is a, c, g, or t
  misc_feature (789)..(791): n is a, c, g, or t
  misc_feature (793)..(793): n is a, c, g, or t
  misc_feature (796)..(796): n is a, c, g, or t
  misc_feature (798)..(799): n is a, c, g, or t
  misc_feature (801)..(804): n is a, c, g, or t
  misc_feature (806)..(806): n is a, c, g, or t
  misc_feature (809)..(810): n is a, c, g, or t
  misc_feature (814)..(814): n is a, c, g, or t
  misc_feature (817)..(817): n is a, c, g, or t
  misc_feature (820)..(820): n is a, c, g, or t
  misc_feature (822)..(824): n is a, c, g, or t
  misc_feature (826)..(831): n is a, c, g, or t
  misc_feature (833)..(835): n is a, c, g, or t
  misc_feature (837)..(846): n is a, c, g, or t
  misc_feature (848)..(849): n is a, c, g, or t
  misc_feature (851)..(851): n is a, c, g, or t
  misc_feature (853)..(854): n is a, c, g, or t
  misc_feature (862)..(863): n is a, c, g, or t
  misc_feature (865)..(865): n is a, c, g, or t
  misc_feature (867)..(868): n is a, c, g, or t
  misc_feature (870)..(871): n is a, c, g, or t
  misc_feature (873)..(877): n is a, c, g, or t
  misc_feature (879)..(880): n is a, c, g, or t
  misc_feature (882)..(888): n is a, c, g, or t
  misc_feature (890)..(890): n is a, c, g, or t
  misc_feature (895)..(895): n is a, c, g, or t
  misc_feature (898)..(900): n is a, c, g, or t
  misc_feature (902)..(906): n is a, c, g, or t
  misc_feature (908)..(909): n is a, c, g, or t
  misc_feature (912)..(914): n is a, c, g, or t
  misc_feature (916)..(926): n is a, c, g, or t
  misc_feature (928)..(932): n is a, c, g, or t
  misc_feature (934)..(935): n is a, c, g, or t
  misc_feature (939)..(941): n is a, c, g, or t
  misc_feature (944)..(948): n is a, c, g, or t
  misc_feature (951)..(965): n is a, c, g, or t
  misc_feature (969)..(972): n is a, c, g, or t
  misc_feature (974)..(978): n is a, c, g, or t
  misc_feature (980)..(982): n is a, c, g, or t
  misc_feature (984)..(987): n is a, c, g, or t
  misc_feature (989)..(992): n is a, c, g, or t
  misc_feature (994)..(995): n is a, c, g, or t
  misc_feature (998)..(1003): n is a, c, g, or t
  misc_feature (1005)..(1005): n is a, c, g, or t
  misc_feature (1009)..(1010): n is a, c, g, or t
  misc_feature (1015)..(1015): n is a, c, g, or t
  misc_feature (1017)..(1017): n is a, c, g, or t
  misc_feature (1019)..(1020): n is a, c, g, or t
  misc_feature (1023)..(1023): n is a, c, g, or t
  misc_feature (1025)..(1025): n is a, c, g, or t
  misc_feature (1031)..(1034): n is a, c, g, or t
  misc_feature (1036)..(1037): n is a, c, g, or t
  misc_feature (1039)..(1045): n is a, c, g, or t
  misc_feature (1048)..(1053): n is a, c, g, or t
  misc_feature (1055)..(1055): n is a, c, g, or t
  misc_feature (1057)..(1057): n is a, c, g, or t
  misc_feature (1059)..(1062): n is a, c, g, or t
  misc_feature (1064)..(1065): n is a, c, g, or t
  misc_feature (1070)..(1073): n is a, c, g, or t
  misc_feature (1075)..(1077): n is a, c, g, or t
  misc_feature (1079)..(1083): n is a, c, g, or t
  misc_feature (1086)..(1088): n is a, c, g, or t
  misc_feature (1090)..(1091): n is a, c, g, or t
  misc_feature (1094)..(1100): n is a, c, g, or t
  misc_feature (1104)..(1107): n is a, c, g, or t
  misc_feature (1109)..(1111): n is a, c, g, or t
  misc_feature (1114)..(1115): n is a, c, g, or t
  misc_feature (1117)..(1125): n is a, c, g, or t
  misc_feature (1128)..(1146): n is a, c, g, or t
  misc_feature (1151)..(1158): n is a, c, g, or t
  misc_feature (1160)..(1160): n is a, c, g, or t
  misc_feature (1162)..(1164): n is a, c, g, or t
  misc_feature (1166)..(1172): n is a, c, g, or t
  misc_feature (1174)..(1175): n is a, c, g, or t
  misc_feature (1177)..(1180): n is a, c, g, or t
  misc_feature (1183)..(1184): n is a, c, g, or t
  misc_feature (1186)..(1186): n is a, c, g, or t
  misc_feature (1189)..(1190): n is a, c, g, or t
  misc_feature (1192)..(1193): n is a, c, g, or t
  misc_feature (1196)..(1199): n is a, c, g, or t
  misc_feature (1203)..(1203): n is a, c, g, or t
  misc_feature (1205)..(1207): n is a, c, g, or t
  misc_feature (1209)..(1212): n is a, c, g, or t
  misc_feature (1214)..(1215): n is a, c, g, or t
  misc_feature (1217)..(1221): n is a, c, g, or t
  misc_feature (1223)..(1225): n is a, c, g, or t
  misc_feature (1227)..(1228): n is a, c, g, or t
  misc_feature (1231)..(1231): n is a, c, g, or t
  misc_feature (1234)..(1234): n is a, c, g, or t
  misc_feature (1238)..(1241): n is a, c, g, or t
  misc_feature (1243)..(1247): n is a, c, g, or t
  misc_feature (1254)..(1254): n is a, c, g, or t
  misc_feature (1256)..(1256): n is a, c, g, or t
  misc_feature (1259)..(1260): n is a, c, g, or t
  misc_feature (1262)..(1263): n is a, c, g, or t
  misc_feature (1265)..(1266): n is a, c, g, or t
  misc_feature (1268)..(1275): n is a, c, g, or t
  misc_feature (1277)..(1278): n is a, c, g, or t
  misc_feature (1280)..(1281): n is a, c, g, or t
  misc_feature (1283)..(1287): n is a, c, g, or t
  misc_feature (1289)..(1290): n is a, c, g, or t
  misc_feature (1292)..(1292): n is a, c, g, or t
  misc_feature (1294)..(1297): n is a, c, g, or t
  misc_feature (1300)..(1301): n is a, c, g, or t
  misc_feature (1303)..(1307): n is a, c, g, or t
  misc_feature (1309)..(1309): n is a, c, g, or t
  misc_feature (1311)..(1311): n is a, c, g, or t
  misc_feature (1314)..(1315): n is a, c, g, or t
  misc_feature (1318)..(1320): n is a, c, g, or t
  misc_feature (1322)..(1326): n is a, c, g, or t
  misc_feature (1328)..(1331): n is a, c, g, or t
  misc_feature (1333)..(1335): n is a, c, g, or t
  misc_feature (1338)..(1353): n is a, c, g, or t
  misc_feature (1356)..(1360): n is a, c, g, or t
  misc_feature (1362)..(1364): n is a, c, g, or t
  misc_feature (1368)..(1368): n is a, c, g, or t
  misc_feature (1370)..(1370): n is a, c, g, or t
  misc_feature (1372)..(1374): n is a, c, g, or t
  misc_feature (1376)..(1379): n is a, c, g, or t
  misc_feature (1381)..(1392): n is a, c, g, or t
  misc_feature (1394)..(1395): n is a, c, g, or t
  misc_feature (1397)..(1398): n is a, c, g, or t
  misc_feature (1400)..(1400): n is a, c, g, or t
  misc_feature (1402)..(1407): n is a, c, g, or t
  misc_feature (1409)..(1416): n is a, c, g, or t
  misc_feature (1419)..(1419): n is a, c, g, or t
  misc_feature (1421)..(1421): n is a, c, g, or t
  misc_feature (1423)..(1423): n is a, c, g, or t
  misc_feature (1425)..(1428): n is a, c, g, or t
  misc_feature (1430)..(1438): n is a, c, g, or t
  misc_feature (1442)..(1442): n is a, c, g, or t
  misc_feature (1444)..(1445): n is a, c, g, or t
  misc_feature (1449)..(1453): n is a, c, g, or t
  misc_feature (1455)..(1463): n is a, c, g, or t
  misc_feature (1465)..(1474): n is a, c, g, or t
  misc_feature (1476)..(1476): n is a, c, g, or t
  misc_feature (1478)..(1478): n is a, c, g, or t
  misc_feature (1481)..(1481): n is a, c, g, or t
  misc_feature (1486)..(1486): n is a, c, g, or t
  misc_feature (1488)..(1489): n is a, c, g, or t
  misc_feature (1491)..(1494): n is a, c, g, or t
  misc_feature (1497)..(1497): n is a, c, g, or t
  misc_feature (1499)..(1500): n is a, c, g, or t
  misc_feature (1502)..(1503): n is a, c, g, or t
  misc_feature (1506)..(1506): n is a, c, g, or t
  misc_feature (1508)..(1509): n is a, c, g, or t
  misc_feature (1513)..(1516): n is a, c, g, or t
  misc_feature (1518)..(1523): n is a, c, g, or t
  misc_feature (1526)..(1528): n is a, c, g, or t
  misc_feature (1530)..(1540): n is a, c, g, or t
  misc_feature (1542)..(1543): n is a, c, g, or t
  misc_feature (1545)..(1545): n is a, c, g, or t
  misc_feature (1547)..(1547): n is a, c, g, or t
  misc_feature (1549)..(1549): n is a, c, g, or t
  misc_feature (1551)..(1558): n is a, c, g, or t
  misc_feature (1560)..(1560): n is a, c, g, or t
  misc_feature (1563)..(1565): n is a, c, g, or t
  misc_feature (1568)..(1569): n is a, c, g, or t
  misc_feature (1574)..(1574): n is a, c, g, or t
  misc_feature (1576)..(1577): n is a, c, g, or t
  misc_feature (1580)..(1580): n is a, c, g, or t
  misc_feature (1582)..(1582): n is a, c, g, or t
  misc_feature (1584)..(1586): n is a, c, g, or t
  misc_feature (1588)..(1588): n is a, c, g, or t
  misc_feature (1591)..(1593): n is a, c, g, or t
  misc_feature (1599)..(1604): n is a, c, g, or t
  misc_feature (1606)..(1609): n is a, c, g, or t
  misc_feature (1613)..(1615): n is a, c, g, or t
  misc_feature (1619)..(1622): n is a, c, g, or t
  misc_feature (1624)..(1631): n is a, c, g, or t
  misc_feature (1638)..(1640): n is a, c, g, or t
  misc_feature (1642)..(1644): n is a, c, g, or t
  misc_feature (1647)..(1648): n is a, c, g, or t
  misc_feature (1651)..(1654): n is a, c, g, or t
  misc_feature (1658)..(1659): n is a, c, g, or t
  misc_feature (1663)..(1667): n is a, c, g, or t
  misc_feature (1986)..(1986): n is a, c, g, or t
  misc_feature (1990)..(1990): n is a, c, g, or t
  misc_feature (3223)..(3223): n is a, c, g, or t
nttgnngaaacgagagnaaaaggaggnagcgaanaaagtnatnnanaagnnatnnagaganagaaanaganaaaaagananaganagnnntnnngnnnggcagcgaannnttnngtcttaaanagnntnnacttgtntnnatatnaacnnntntnttntatttntanaacttnnttnnnatnnntnnnnnnnnnannnntntattnttantactntantntnntttntnctnnnnnncnncgnnnntnnngntttnngcacnnnnggngnngaanaganangnnnnncntcnnnntcgnannnntcntcttcnncnncntcgnannngttgtnnnctannnnttgntnnttcttnttcttttcnntngtgttgnnnnntnnnnnttntnnnncggcggnnnnngnggtnntnntcatnnnnnnnnnnnannnnttttncnncannttgannannnannctttnnnntnnnnntnnnntnntaatnnnnnnnnnnnnnnnncnctnatnnncncnnnnnnctcnncnnctcnncnnttntttcnctnnnntnntnnnctnttntnnnnnnannnnnnngcgnngncgtnttnngngannaacnnntggnntnnncntcnnngcgcnnctactncttctnctnntnntntttcnctnnttnttnnntcttctttnttttnttctttnttttnttcttcttnttntnntnnnnnnnnnnnnntnttnnnnncgnnnngacnnnacnaacnnnnntcttnnttgatnttnttnttntttttnntntnnntntnnntnttntnntnnnntnatnnttcntcntcntnnntnnnnnntnnncnnnnnnnnnntnntntnntctcttgnngngnnanntnnnnngnngnnnnnnntngttcnacnnntnnnnncnncgnnnannnnnnnnnnncnnnnncnncggnnncgnnnnntcnnnnnnnnnnnnnnntctnnnngnnnnntnnntnnnngnnnncnntcnnnnnncnctcnncctcntncnnctntntgtttnnnntnncnnnnnnnttnnnnnntncnannnntnntttcnnnncnnngnnnnntcnnncnnctnnnnnnncccnnnntnnntcnntnnnnnnnnntcnnnnnnnnnnnnnnnnnnngtccnnnnnnnntngnnntnnnnnnncnncnnnnatnncntcnntnnctnnnngttntnnntnnnntnnannnnntnnntnnttnatntttnnnncnnnnncatcttntnctnntnntnntnnnnnnnntnntnntnnnnnannantnnnncgnngnnnnngngnagnngannngnnnnngnnnngnnnatnnnnnnnnnnnnnnnncgnnnnntnnntgtntntnnntnnnntnnnnnnnnnnnngnngnngnannnnnntnnnnnnnnttntntntnnnntnnnnnnnnnatanannaatnnnnntnnnnnnnnntnnnnnnnnnntntntgnttttntnncnnnngtntnnanngtngnnaatnnnngnnnnnnaannnannnnnnnnnnntnnantncnannnnnnnntnttnnntannacaanannacnangnnngnagnnnctactnnnnnntnnnntaannngtannnntnnnnnnnncatcatnnntnnnggnngcnnnngaannaccnnnnnttgttgttgttgttcacggcatcttttcctctttttttcttattacgttcaatcaaccttttcatctcctcgtccgagggtggatccggcgcactcgccgggtacacgacgtacattcggttccgaatgatttcctctaaattgctcgggttcatggcgaaaaaaaccgtcatcgcgattggaatggagaggtagacggagaatttgaacgcttccagggagaaggatttcgccatgcttgtgagttcgttgtgttgaatgggcgagttgttgatgaaaatcaaagaaaaaaataaaatttagggtacgtttacaattntttnttgtattctaaaatttgtgttagtaagcacattcgactctgaatagagttcaaattaagcgaatggccatgggttcgacccccatacgcggtacacgcattgtattgcctcgttagctcagtaggtagagcgttcgccttttaagcgttttttttgcattaatgtgcattctattacattctattacgttctattacgttctactaatcatcacgacagacatccatactcaaaaccatctcgcaaaacgttctgtgctttcctcgaaattgccgcaacggcatttgatcgagcccgtagcaccggtcgtcttcgccgcagttcgcgcacgtcgaattccatcccccgtcgccaatccaccacggcgacccacacgctaagcaaggcatctttggaaaataatgtcccgtaagatttctgttattcgagaaaactttcgtttcgccttgttgtttggtcggtcgcaaaaacgcttcgggaacgcgaacgccaattttgccgccgagtggcaataattttttcccctctttttgttcttctttttcttctacatcttcttttgctgatagtttatcctgcgataacaacgaagaagacgttttgtctttcaaaaacactcgttctttttgttgcatcagtgcgacgcaaccggcgccgcctcgaccttcggcgatgacgccacatcgctccatggtgtctggaaccgactcccaaacttgttggcacgcgatgaaaaagttagcttctttcttctcgcaaaaatcgtctccatcaaaagcggtatcgtactcgcacaagcacgcgtctaacatttcgcgaagcttttcggcatctttgacgccttcaaagaccaaatgattccttcgatcgccgcacaaactaaagcttcgtcgaaacaacaactgttttcgtttttgttcatcatcgtcttcgtctgcgtcgtctttaaaccacggcttttcgttcacggcatacacgcgaacgggttccgagtgtttatgaagccactgcagaggtgttgttaagcgcgagtttacccaaacgacgccttgtgaacgcaagctggatgacagcaacgtagcggtagcgttgattttatctttgttgttattatcgtcatcatccaaatctaaatcttccgtgaacgagaccttcccgtactcttttcggagcattaagaacaacttcctggaatcaaacggtcgtcgcgccaggtacacgaccggtggcggntcctcttcgtcctcttcttcttcttctacctctgctatttttatttctcgctccttgttcccgagcgcctcggagtacgtctccgtgcactccacgcaaacctgctcaatctgtttatcgtacttgttgtgttcgaaagtgattttagaaacgaacaactcggcgtagttttccgacgccttttcggtttctaatatccactcgtccactctgttgctcaacccgtgaatcgtacttccagaagcgtctctctctcgcaccgcatccgcgactgcttcgcccaactttgcgccttcacctttaacgagcacagagacgtcttcgtttctagaagcactctcgacaaatatacgctcaattctctccctctctcggacgtactcttcccctctggaagagagcacgacgaatatttttaccgttccaatcgctccttcccgaatctcctcgcacgccttcgcaaactctctagaactactactagacgacgacgcgtcatcgttggtaggaatcggattcatcaaaacaacgctcatcaccgattccattttatcgtgttgcatgagcgcgttcaaaacgattaaactctctttactcccgaacgcaatcgaaatcgctcgatccttcgcgttgattcttttcaacacgttgtgcaactgtttgctcgttttcttcctcccgtctacatcgtcttcaattttgttgttgttgttaatgttactgctgaaatcaatcgcgtggacgcagctcgcgcactttgaactcgcaaaaatgtgc

SEQ ID NO: 1283 - DNA, 4000 bp, Escherichia coli
  misc_feature (2864)..(2864): n is a, c, g, or t
aagcaggcgaatattccccatacgggcggagagttctttccattcattgcggatagctgtcgttttggaatagaccgtattcgagataacagaatagatttcagtaccggtcagtttttcgagtacttcggccttttcttctttccgggctttgaggaatcgggcaaattcattttgtgccaataaaacggtacgggtgaattgattataattcagaccgatgagttgaatcaatttattctccgattcactgattcctgtagtgataggagacggatctccaagggggtatacccggagttctgcaggttgaagtttcccgcttattttattattggctcgccatacccgccataccgagcgataactttttccgtctacagcaataaattctacagcagccatcgcttcggcagtacctctgcggagtatttgacgacgatctccctgttgaatgaattcttgtccgacatccggcattttagtaccttcaataccggtggtgcggggcatattgttgaataaggccagacagatagcatccagaatagtcgattttccggcaccggtgggaccgcatattgcgaagatcccggcagatcgcagaggagctgccgtaaaatcgatatcgaattctccggcaatagatgccagattttttccttgtatacgtaatattttcattgtttttctcccattttcagctgtgattcttcaatgacttcccggaataaatgagccaattcttcgggcagaggattttgatatcgcctttcgtatactcggttcaacagcttccagggatccagtaattcttcggtggtgagcgtattctcgttttttgtaagttgtactgtatccggataaaaggggagtacccgggttaaacgcacctgtttggtgcgtagggcttcctccactttattgcgcaaagcaggttccggttcggtgagtagtaccctgacttcgaggaaaggggccggatgatcgtctctctcttccgggagctgagagaggcgattcaacacttcgtccaagggggccggatgtttagggatacgaagtaaagtgactaaaggattaaaaataattttagtctgatttagaagtattcctttgtcgatctccagtaagatcactccgtggcggtaattttcttctgcaaaagacatgggtaacggactgccggcatagcgtatctcgttgcggttggcaatctgctgttcccggtggatatggcccaaagctccgtaagtgatttgggaagggaagacactggaaggaatcccttcgagtccgccgatgatcaggcgttcactttgatcaccttcggaaatctgacttcctgcggcttgcaggtgtcccatagcaatgatggcttcttgtttttgcctgcgttcttcgacgcaggcaaccagcttgtcgtacatggccttaacccctgcctgataaggatctccttcactctcgactgccggatagtctccctgtcggagatagggtaccgccagacaccaaccttgccgtttccccgatctgtctttcagttcgatgattaattcctccgtatcgattgtgccgtctgctcttttacgtactgtaccccgaatttgtatgttcatttcttcgagtaaaggaatcggggtttcgagccgactggcagaatcatgatttcctgcaatcaggatgatttgtaagcccggattttgttctgttacccggcgtaggaaccgataaaattgacgttgtgcctgagcagaaggattagctacatcgaatatatctcctgaaataagaagcacatcgatttgttgtgtggtaatttgatctgtcagccaatctaaaaaatactgatgttcctgaaaacggtcatagccgaaaaaggtctgcccgatatgccagtctgctgtatgaatgattttcatgtcctgtcatttggacaaaaatagtaagatttgcagatataaccaaatagctcacgggctatggtaatcctaccatagcccgtgagctatagccggtgataatggcaagtcatcagcttaccggattcatcgtgtaggtgcatgccatttccttcgcaataacggaacaggttgcaatcggcacattcgccctgacgggcccattcccggttccggaatttttcgaagcggttgttccacacttccataaaatcatcctggtaaatattcccttggtcgtagttggcccggatactgggacaacccgatatcgctccgttaatgcggatagatccgacagaaattccggcatggcaacgataaaattggtcacggacttcagcttcataaggacctaaaaaaccttcacaagcgaaattgacgtgaatacgaccttcttgccgggtttgacggataaaatccaatacttttttgaattgggaagaagatagttgtaattcaggcacttgtgctgctctgcctgcgggaaagatggtaaagatacgccattgtccgactcctagttcgatcaaatattctttgaaaacggggagagtatcgatgttttgttgattgatacaactgacgacatcccatacgatttctttttcccggctcagcattccgatagcctgactggcccggcgaaagctttccggatgtcggcgtaaccagttgtgggcatcttccggtccgtccagacttacggtaatgctgtgcaggcctgcttgtaaaagtctgtccagcctctgacgggataataacaaaccgttggttaccaatccccaggggtattcccggcgataacatgcccggccacactcttccagatctttgcgcatcagaggttctccacccgtgaaaatgataaaaacccggtggggatcgacctgtggagtnatgttgtccaaagcctttaagaagtcttcttttggcatatcgggttgcccggaaatcgctttgcaatcactgccacaatgccggcaagcgagattacagcgaagggtacattcccaaaaaagagtatgtaattcgtgtttttgccggatcagctgttctttttgtcggaagagttccaggcccaggcgtttccggaggctgatggaattattcatgatcttcttctttttgaggagtcagtatgatttttacttcttgtgttgtatttcccctattccagccttcacctccctgtaaatctttacgaaggaaggttactttcagagaatcggcctggtagtacggattattttcgtcggggttgatttttaaattatacttcaccgtatcgatcgggaacgctgcttgccgggtttcgaattctccttcttttccggagtataacgtatcgttgaccgggtggcttccatagggggtatcggggataaaatcaggacggggttcgtaactgaattccatatcggacacgataatctgaatatcggatagcgcctgacctgcctgatcggtgacttttcctttgatggtataggaagctgtcggcgtaccgtacatacatatgatgttaccgggatcgtccccgttatcctcacaggaggagaaacctaaaaatcctaataaagtagtcaatatccagttcaggctacgattccagcgataatgtaatgttttcatggtttgtttttttatgattaaactgtttaaatgccttgattttcttgaggtcggcctttccggacaggttgacggtgagaaatcgaaggtctttcatataatgagttgtatttaaaagttcaaacggaatccgatttgccccgtgaggttgaaaaactgttccgagcgaatcgtttgtatttcactggccggggtcagattccataaaaatcctccttctgcatagaccgatacatggcgaataatggggtaggcaatacctattcgtgtgttcgctgaccaaagcgtacccggtattcgtcgacgctgacttttataggccgaatagattttgcctgaaagattaacttcacagacaataccggcagaccaataacagtagaaacgttcccaatgggtca

SEQ ID NO: 1284 - DNA, 4000 bp, Escherichia coli
  misc_feature (2)..(2): n is a, c, g, or t
  misc_feature (7)..(12): n is a, c, g, or t
  misc_feature (15)..(15): n is a, c, g, or t
  misc_feature (17)..(22): n is a, c, g, or t
  misc_feature (24)..(29): n is a, c, g, or t
  misc_feature (31)..(31): n is a, c, g, or t
  misc_feature (33)..(40): n is a, c, g, or t
  misc_feature (44)..(48): n is a, c, g, or t
  misc_feature (51)..(51): n is a, c, g, or t
  misc_feature (53)..(53): n is a, c, g, or t
  misc_feature (55)..(59): n is a, c, g, or t
  misc_feature (61)..(64): n is a, c, g, or t
  misc_feature (66)..(68): n is a, c, g, or t
  misc_feature (70)..(70): n is a, c, g, or t
  misc_feature (72)..(73): n is a, c, g, or t
  misc_feature (75)..(81): n is a, c, g, or t
  misc_feature (83)..(83): n is a, c, g, or t
  misc_feature (86)..(90): n is a, c, g, or t
  misc_feature (93)..(94): n is a, c, g, or t
  misc_feature (96)..(100): n is a, c, g, or t
  misc_feature (105)..(105): n is a, c, g, or t
  misc_feature (107)..(109): n is a, c, g, or t
  misc_feature (113)..(117): n is a, c, g, or t
  misc_feature (119)..(124): n is a, c, g, or t
  misc_feature (126)..(127): n is a, c, g, or t
  misc_feature (130)..(135): n is a, c, g, or t
  misc_feature (138)..(138): n is a, c, g, or t
  misc_feature (140)..(140): n is a, c, g, or t
  misc_feature (143)..(148): n is a, c, g, or t
  misc_feature (150)..(151): n is a, c, g, or t
  misc_feature (153)..(153): n is a, c, g, or t
  misc_feature (155)..(158): n is a, c, g, or t
  misc_feature (160)..(163): n is a, c, g, or t
  misc_feature (165)..(165): n is a, c, g, or t
  misc_feature (167)..(169): n is a, c, g, or t
  misc_feature (173)..(176): n is a, c, g, or t
  misc_feature (179)..(195): n is a, c, g, or t
  misc_feature (198)..(199): n is a, c, g, or t
  misc_feature (201)..(203): n is a, c, g, or t
  misc_feature (205)..(208): n is a, c, g, or t
  misc_feature (210)..(214): n is a, c, g, or t
  misc_feature (216)..(219): n is a, c, g, or t
  misc_feature (221)..(224): n is a, c, g, or t
  misc_feature (226)..(227): n is a, c, g, or t
  misc_feature (230)..(235): n is a, c, g, or t
  misc_feature (237)..(242): n is a, c, g, or t
  misc_feature (245)..(247): n is a, c, g, or t
  misc_feature (249)..(249): n is a, c, g, or t
  misc_feature (253)..(258): n is a, c, g, or t
  misc_feature (260)..(260): n is a, c, g, or t
  misc_feature (262)..(267): n is a, c, g, or t
  misc_feature (269)..(272): n is a, c, g, or t
  misc_feature (274)..(276): n is a, c, g, or t
  misc_feature (278)..(285): n is a, c, g, or t
  misc_feature (287)..(294): n is a, c, g, or t
  misc_feature (296)..(296): n is a, c, g, or t
  misc_feature (298)..(299): n is a, c, g, or t
  misc_feature (301)..(302): n is a, c, g, or t
  misc_feature (304)..(308): n is a, c, g, or t
  misc_feature (310)..(315): n is a, c, g, or t
  misc_feature (317)..(318): n is a, c, g, or t
  misc_feature (320)..(320): n is a, c, g, or t
  misc_feature (322)..(327): n is a, c, g, or t
  misc_feature (329)..(329): n is a, c, g, or t
  misc_feature (332)..(332): n is a, c, g, or t
  misc_feature (334)..(335): n is a, c, g, or t
  misc_feature (337)..(338): n is a, c, g, or t
  misc_feature (340)..(346): n is a, c, g, or t
  misc_feature (348)..(353): n is a, c, g, or t
  misc_feature (355)..(362): n is a, c, g, or t
  misc_feature (367)..(367): n is a, c, g, or t
  misc_feature (369)..(370): n is a, c, g, or t
  misc_feature (372)..(372): n is a, c, g, or t
  misc_feature (375)..(375): n is a, c, g, or t
  misc_feature (377)..(387): n is a, c, g, or t
  misc_feature (391)..(397): n is a, c, g, or t
  misc_feature (399)..(399): n is a, c, g, or t
  misc_feature (401)..(412): n is a, c, g, or t
  misc_feature (414)..(414): n is a, c, g, or t
  misc_feature (416)..(416): n is a, c, g, or t
  misc_feature (428)..(428): n is a, c, g, or t
  misc_feature (455)..(456): n is a, c, g, or t
  misc_feature (469)..(469): n is a, c, g, or t
  misc_feature (493)..(493): n is a, c, g, or t
  misc_feature (713)..(713): n is a, c, g, or t
  misc_feature (725)..(725): n is a, c, g, or t
  misc_feature (890)..(890): n is a, c, g, or t
  misc_feature (917)..(917): n is a, c, g, or t
  misc_feature (929)..(929): n is a, c, g, or t
  misc_feature (1010)..(1011): n is a, c, g, or t
  misc_feature (1016)..(1016): n is a, c, g, or t
  misc_feature (1073)..(1073): n is a, c, g, or t
  misc_feature (1157)..(1157): n is a, c, g, or t
  misc_feature (1190)..(1190): n is a, c, g, or t
  misc_feature (1193)..(1193): n is a, c, g, or t
  misc_feature (1358)..(1358): n is a, c, g, or t
  misc_feature (1394)..(1394): n is a, c, g, or t
  misc_feature (1433)..(1433): n is a, c, g, or t
  misc_feature (1496)..(1496): n is a, c, g, or t
  misc_feature (1517)..(1517): n is a, c, g, or t
  misc_feature (1520)..(1520): n is a, c, g, or t
  misc_feature (1791)..(1791): n is a, c, g, or t
  misc_feature (1793)..(1793): n is a, c, g, or t
  misc_feature (1826)..(1826): n is a, c, g, or t
  misc_feature (1829)..(1829): n is a, c, g, or t
  misc_feature (1847)..(1847): n is a, c, g, or t
  misc_feature (1868)..(1868): n is a, c, g, or t
  misc_feature (1874)..(1874): n is a, c, g, or t
  misc_feature (1984)..(1985): n is a, c, g, or t
  misc_feature (2740)..(2740): n is a, c, g, or t
  misc_feature (3283)..(3283): n is a, c, g, or t
  misc_feature (3695)..(3695): n is a, c, g, or t
  misc_feature (3721)..(3721): n is a, c, g, or t
  misc_feature (3826)..(3826): n is a, c, g, or t
  misc_feature (3989)..(3989): n is a, c, g, or t
anaaaannnnnnaanannnnnncnnnnnntntnnnnnnnnagannnnnaantntnnnnngnnnntnnntntnntnnnnnnnanacnnnnngtnnannnnnttttntnnnctcnnnnngnnnnnncnnaannnnnnccncnctnnnnnnannanannnngnnnntntnnngggnnnngcnnnnnnnnnnnnnnnnngtnnannncnnnntnnnnnannnngnnnntnngtnnnnnntnnnnnnggnnntntctnnnnnntntnnnnnnannnngnnnannnnnnnngnnnnnnnnananncnnannnnngnnnnnnanntntnnnnnngngananngnngnnnnnnnannnnnngnnnnnnnnaaaanannanatntnnnnnnnnnnnagannnnnnnanannnnnnnnnnnntntntttttgtggggngagtgatgaagtcttaacaaaattggnnaaatgcccagctnagactcgtcaaagagcctcacttntgctatactatctcccaataagggcttttaattccatcccgtgaggtggagaaggctaaatcactttaccgagcccttggaataaattcagagggctctttgtcatgtcttggagcccggaaaagaggttatgatggaactacaaacgtccaaagtccgcatgctgcttgatgtcgagcagaagccgcctttcctacaagggctcttgttgagcgcccancacgtctttgcnatgtttggggcgaccattctggtgcccctgattctggggatgccggtttcggtggcgctctttgcctcagggattgggaccctcatctacatggtctcgacccagttcaaggtgccggtctacctagggtcgtccttcgcctttatccaggccatggccttcgcnaatagtcagatgaatggcgatgtctcngctgcccaaacnggggtggtgctagttgggctagtctatgttggaatggccctcttgattcgggcaattggaactacttggattgatcgcttnntgccncctattgtgattgggcccatgattatggtaatcggtttgggcttagccaactcagcngttaagaatgctggttttgtggaggggggcgacatcaaacatatcctggtcgcccttgttaccttcttaatcacggccttcatnaataccaaagccaagggttttctcaaaatcatnccnttcctctttgggattattgggggctacttggtggccgttgtctttggtttggtagactttaagccagtcctagaggcagcttggtttgaagtgccacatctctatttgccatttgaaactgggggcttcttcagtcgctatcacctctactttgggccagagacntgggcgattttgccggtagcggtcgtgaccattgcngaacatattggggaccatacagtgttggggcaaatctgnggccgtaagttcttggaaaaaccaggcctccatcggaccttgattggggatggggtggcgacngctgtgtcagcctttatcggnggnccggccaataccacttatggcgagaacactggggtggtagggatgacccgtatcgcttccgtctctgtcattcgcaatgctgccctctttgctatcgggcttagctttatgggcaaattcacggccatcatctccaccattcctaaacccgtattaggtggtatggccatcctactctatggggttattgcttctaacggtttgaaagtgctgattgagaagcaagttgacttccaccaagtccgcaacttgattatcgccagttccatgntngtgctaggcttgggcggcgcggttctcaaattnggnccggtgaccttatccggnactgccctctgcgccttggcnggcgtnctgctcaacttaatcttgccacacgaagaaaaattccaagaccagaaggttgaagaattacttggtgaagcgtaaataaggagctccctttccagggggcttttcttgtnnggaaaaagccaagcatgagcagaatcttgcagagcaaaaaaatctctcgaaatcaggccttaaggcattgcatatttgctggagtatgctataatagtacggtgcgcaaagtacgcacactgagtgggaggaggcttaggcttccatgaaccacatcacgaaccaaaaattaaggaggaatgtttcgtggctaaaaaagtcgtaaaacaagttaaattacaaatcccagccggcaaagcaagccctgctccaccagtaggtccagcgctcggtcaagcacaagtaaacatcatggggttctgtaaagagttcaacgctcgtacacaagatcaagcaggcttgattattcctgttgttatctctgtatacgaagaccgttcatttactttcatcaccaaaactccaccagctccagtattgttactgaaagctgctaaagttgacaaaggttcaggtgtacctaacaaaactaaggttgccactgtaaccaaagatcaagtacgagaaatcgcagaaactaaaatgccagacttaaatgcagccaatgttgaagctgcaatgcgcatggttgaaggtactgctcgctcaatggggattacagtccaagactaagcacaatgtagcttctcaacccgaattctatcgggtgtgggaggtcaaaccgttataaccacaacataggaggaagaaaaatggctaaaaagagcaaaaacttacaagcggctcttgcaaaagtagaccgcaacaaaaaatangaagctaacgaagctgttaccttagcaaaagaaatcgacttcgctaagttcgacgctaccgttgaagtttcttacaacttaaacatcgacgttaagaaagctgaccaacaaatccgtggcgcaatggtattgccacacgggactggtaaaaccagccgtgtagttgtaatcgcgcgtggcgaaaaagctaaagaagcggaagcagcaggtgctgactttgttggtgaagcagacttaatccaaaagatttctgacggttggttagaattcgacgtgatggtcgctacccctgacatgatgggtcaagtgggtcgccttggtcgtgtcttagggccaaaaggcttgatgccaaaccctaaaaccgggactgttaccatggacgtaaccaaagcagttaacgacatcaaagctggtcaagtaacttaccgtgctgacaaagctggtatcgtgaacgtgccaatcggtaaagtatcttttgaagacaacaaattggttgaaaacctcaaggcgcttcacgagcaaatcttgcgtgtgaaaccagcngctgctaaaggtacttacatcaacaacttgactttgagcactacttttggtcctgggatcaagttggatgttacttctctctaatttttagcgagaaatccgcgaagaggcttgacatgatggcccttcttcgctacaataacatacgttaatataacgaccgaagacagtaagtggcgcaggccttaatttcttaccgaggaagttccacgaatggaagctatctctatgtctaaggtgacatagagattttttatggcaacataaaaatctctatatcaaactagcggaggtgaaattatgacaaaagcaattctcttgaaaaagcaagaagaagtttcaaaagttgctgaagaactcaaatctgcagcatctgtagtcgttgttgactacttaggcttaaccgttgaanaagtgactaacttacgtaaagagttncgtgataacggcgtgcaaatgaaggttgtgaaaaacaccatcttacgtcgtgctgctgctcaagctgaaatcgaaggcttggatgcccactttgtaggcccaacngctatcgtgttcagcgaatcagaagttgtagcgccagcgaaagttatcgcagaattcgcgaagaaagctgaaaagcttgaaatcaaaggtggcttaatcgaagggaaagcagcttcagcagaagacgtgaaggctcttgcagctcttccagaccgcgacggcntgctctctatg

SEQ ID NO: 1285 - DNA, 4000 bp, Escherichia coli
  misc_feature (177)..(177): n is a, c, g, or t
  misc_feature (564)..(564): n is a, c, g, or t
  misc_feature (685)..(685): n is a, c, g, or t
  misc_feature (1062)..(1062): n is a, c, g, or t
  misc_feature (1129)..(1129): n is a, c, g, or t
  misc_feature (1218)..(1218): n is a, c, g, or t
  misc_feature (1395)..(1395): n is a, c, g, or t
  misc_feature (1738)..(1738): n is a, c, g, or t
  misc_feature (1740)..(1740): n is a, c, g, or t
  misc_feature (1921)..(1921): n is a, c, g, or t
  misc_feature (1976)..(1976): n is a, c, g, or t
  misc_feature (1988)..(1988): n is a, c, g, or t
  misc_feature (2035)..(2035): n is a, c, g, or t
  misc_feature (2864)..(2864): n is a, c, g, or t
  misc_feature (2921)..(2921): n is a, c, g, or t
  misc_feature (2987)..(2987): n is a, c, g, or t
  misc_feature (3209)..(3209): n is a, c, g, or t
  misc_feature (3527)..(3527): n is a, c, g, or t
  misc_feature (3530)..(3530): n is a, c, g, or t
ccgcgggcattggtttcgttcacgaaactacccaccaccacgctgaatgccttcaaaggctcgccgtcgatgacgcgcttctcgccttggatggtacgcacgggggtgttgtcttcctccaccaccacggtgcgctgcaccacaggtgcggcaggttgctgcacgggagcgggctgnacgggctgcggctgcgtgttttggggaatgatggtaaccgtctgagtgggcttgttcatctcttgtgctctggcccgttcgtaagcctggcgataggcgctctcctgtgatttgcaagaagcggcgaacagggctacggcgcagagacttagagcgaggatagcagggttcttcatttcagtgacgttttatttctgtagatgtttgttgtcctggtggtctgctcatcccgtttccgaggatgacgcatataatacgacgcaaaaatacaaggaaatgaaggatcagatgcgatacgtaatcataaaaaacagtaaacaactcctttttcctcccttgtttgcggtattctgaagagaaagtgctatttttggactcgaaacattntcaatttaatctcagaacgatatgaaaggtctcagtattttagcagctttcttaggcggtgcagcagtaggcgccgcatgtggcattcttttcgcacccgaaaaaggcgagaatatgcgtncacgcattgcagacgctatccgcaagcgtggcattaagctcaacggcaaagagctcgagagcctggtcgacgacattgccgacgaacttaacacgtccaacgactaagcacgcgcaggcgtgtcccctttgaaaaactgacgcacgatgatgtcgagtgatcagaatgtgagaatcttggagcggctggtgcgcaatctcaagcgctacgtcgatctcaagttggaaaccctgcgcttagacgccgtgagtcgcatcactatgctactttcggccatactcatcggcgtagtcttcttttgtctcgcatcgttggtggccatcatgctctcgtttgccgctgtggtctatttggcccccatcgtgggcggctacgtngtatccgcaggtttggtggctttgttctacgttgtggtggcgttgctgctcattctcttccgcaaancgctcatcatcgatcccatcacccgctttctcgtggcgctcctgctgtcggaagaaggagagatgggcgtgcgcgatgaacgagggggnaccactgtcggcgacaccactgctttcaattcgtctcagccatgagcacatacatttccctcgaacaagtgcgatggcaccagaagcgactccaattggagctgcaaaaagtgggcgaagagatcagcaaagatctcacaaccctcacggcgccgccggccggcgacggcaatgtgntggaaaccctcatgagcacggccacccgtgcgtggtggatcttcgacggagcgctcaccggctacaagctcttccgccgtctgcgcgggtttaccggacttttcggcaaacgcaaaggcagacgctgagccgtcgcgcggcagttcctgctgcgatgccggcacattccaattcccgccctcggtctattttcgtagaccgggggcgtttttgtttcccttcgccgcagcagccggtcgatgtgcccgcgaatgatgcgcgttcgtcgcgtgtccaacgcaaaccgtcccggcagctgctcgatgcgcagcgggctgcaaagttcggccacgacatcgattcngncggtcggaggcgcggggcgaaaagacaccggctgagagaacaggggaggcgtcgcgatgggaaaaacaggggaggaggcaccgaaaaagtgggagttgtttctgttttcttccccatttttcagccaaaattcccctcttttcgccggcaatgcgaaggcagaaaactttggcgcgaagcnggagagagattggcctgagaagacgagccgtcatacggagccaacacacgatctnagggagcaaacngaacgttgccccccaccgaaagcacgatggagggcatcgaaacgaancgccaaggtattttcccccgatagaaacacagcgccgagtgagaaagtggctcagcggggcttaaaagtgccattgtgggcttgtgcgcgcgaaaaaaacgcaagatcgcgtgcgcgtgtggagcgaaatgcttatatttgcacaagttatatggccccgattcggcatccggctcacccattgccgaaccgttgagcggctgcaaacgcccaaacaatgatccaagaaacagatagaatcaaacaagtgaatatcgaggaggaaatgaagtcctcgtatattgactattcgatgtccgtcatcgtgagccgtgcgctgcccgatgtgcgcgacggcttcaagcccgtgcatcgccgcattctctacggcatgatggacatgggaatcacgcacgataaggcgacgaaaaagtcggccgccatcgtcggtgaggtgctcggtaagtatcacccccacggcgacagctcggtctacggcgccttggtgcgcatggcacaaccgtgggccatgcgctatcccctggtgatcggacaaggtaactttggttcgatggacggtgacggggcggcagccatgcgttacacagaggccaaaatgagtctcgtgggcgaagccatgatgcaggacatcgagaaggaaacggtcgacatgaaccgcaactacgacaactcgcgcgacgagccctcggtgttgcccacccgcattccttccttcttggtcaacggcgccaccggtattgccgtgggtatggccaccaatgtgcccacacacaacctcggtgaagtgatcgatggctgtgtggcctatgtcgacaaccccgatatcgangtcgacggcctcatgcagcacatcaagggccccgatttcccgaccggagcctacatnttgggcaacgcaggcatccgcagtgcctacgaaaccgggcgcggtcgcgtcatgctgcgtgccaangccgaaattgaagccggaaccttgcacgacaagatcgtggtgcgcgccgtgccttacgggaccaacaccggcgacctggtgaaatccatcgcccaattggccaaagagggcaaggtcgagggcatcaccaatgtcaacgacgagtcggaccgcgaaggcatgcgcatcgtggtggacgtcaagcgcgggcaaaatgccaatgtggtgctcaacaagctctanaaactcacgggcctgcaaaccagcttcgccgtcaattgcattgcgctggtgcccattcccggcacgagtcccgccaagatgcgcccgcagttgctcaccctcaaggactgcatccgccacttcatcgaacaccgccacgatgtggtgattcgtcgcacgaagttcgacctgcgcaaggccctcgaacgtcagcacatcctgcgcgcactgatcatcgcctccgacaacatcgacgaggtggtggccatcatcaaatcgagccgcaacacccaggaggcgcaagagcgcttgatgcagcgctttgccctcgacgaaatncangccaaggccattgttgatatgcgtttggcgcagctcaccggcctgcaacaggagaaactccatgccgaatatgacgaactcgaacagcgcattgcctatttcaatcagatcctctcggatcccgaactttgcaaaaaggtgatcaaagacgagttgctcgaggtcaaagccgcctatggcgacgaacgcaaaacggaaatcctgcccgatctctcgaacttcaacgccgaggacttctattccgacgacgaagtggtgatcaccatcagccacctcggctacatcaagcgcaccccgctggccgaattccgcgcgcaaggacgcggcggagtcggagccaaaggcggatccacacgcgatcaggacttcatcgagtacatctatcatgccacgatgcacaacacgatgctgttcttcaccgccaaaggacgctgctactggttgcgtgtctacgaaatcgaggagggcac

SEQ ID NO: 1286 - DNA, 4000 bp, Escherichia coli
  misc_feature (84)..(85): n is a, c, g, or t
  misc_feature (120)..(120): n is a, c, g, or t
  misc_feature (147)..(147): n is a, c, g, or t
  misc_feature (169)..(169): n is a, c, g, or t
  misc_feature (214)..(214): n is a, c, g, or t
  misc_feature (216)..(216): n is a, c, g, or t
  misc_feature (236)..(236): n is a, c, g, or t
  misc_feature (799)..(799): n is a, c, g, or t
  misc_feature (1980)..(1980): n is a, c, g, or t
  misc_feature (2022)..(2022): n is a, c, g, or t
  misc_feature (2454)..(2454): n is a, c, g, or t
  misc_feature (2505)..(2505): n is a, c, g, or t
  misc_feature (2689)..(2689): n is a, c, g, or t
  misc_feature (2817)..(2817): n is a, c, g, or t
  misc_feature (3426)..(3426): n is a, c, g, or t
  misc_feature (3449)..(3449): n is a, c, g, or t
caggccgtcagcaaagagaatttccgcactgccgtattcaccgccgctgccatgtccggccgcagcgtgcgcatcctgcaccanntgacgcagcccgccgaccacccggtaagcatctancaccccgaaggcgaatacctgaaaggncttgtgctatacgtggaataancaggaaccggcttctgtacaggaaggacagaaaaagcccttcatntnctaaacattgttaatatacnaaagaaaacaagcaaaacattatgttttataacataaatccctttatctttgcaccgtgtttttcatggtattagatttaaggttaataaagattggctgtctgggatagatagccttcttttttttatacctcccgccttccctttttttgatgctttatacatcgccttttccgataatttgtctacatttgcgttttattaattagttcaacttcgaaagacacgttaatttatagaaagcattatgagcatcaagattcgcttaatcattatgaatttcctacagtttgccgtgtggggagcatacctcacatcaatgggcagttacctggtaaacgtaggcctgcacgagcacatcggtatgttttacgccatgcagggaatcgtatcgttgtttatgcctgccgttctcggcatcattgccgaccgctggataccggcacaaaagctgttaagcttcagtcacttcaccgcagccctgttcatggccgcagccggatactacggcatgacgaaaggtgcggaggtagatttcggtactctgttcacactttactcgntaagcgttgctttctatatgcctacattggcattgtcgaactccgtggcctacaccgcactcgacaaagccggactggataccatcaggacattccctcccatacgtattttcggcacaatcggattcatctgctccatgtgggtggtggacctgctcggactgcaaaataattacgggcagttctttgcctgcgccatcatcggagtagcgtatggcgtatatgcgctgaccctgccggaatgccccaccagcaagggcgacaatgccaaatcattggtagaggcactgggcttacgcgcctttacgctattcaagcagaagaaaatggctgttttcttcattttctccatgctgctgggcgtttccttgcagattaccaacggatttgccaatccctacatcagcagtttcggcagtattcccgaatatgccggcactttcggagtgcaacatgccaacatcctgatttcgctgtcgcaaatatccgaaacactctgcatcctgctgatacctttcttcctgaaacgcttcggcatcaagcaggtgatgctgattgccatgctggcatgggtattgcgcttcgggctcttcggcatgggcaatcccggaagcggcgtatggatgtttgtactttccatgattgtgtacggtgtggcattcgatttcttcaacatatccggttcgctgtttgttgacagagagaccgaccggggcatccgttccagcgcacagggactgttcgttatcatgacaaacggtttcggtgccactatcggcacactgggtgcacaggcggtagtgaatcactttgtagatttcaacagcaatgtcccgcagatagcgcaatggcaatcggcatggtacgtatttgcaatctacgcgctgaccgtagcagtggtgtttgccatcgtattcaagtacaaacaccatccggaagatttaaagtaactacagccgatgaacaaaaaaaagattgagctgcaagtattgaatatctcaaacagccaggcacaggccggcgcttatgccatggtgctgggcgagataaacggcatgcggcaactgccggttatcataggcagtgccgaggcacaatccatgatgattgaaatgagaggcatcgttcctccccggccgctgacgcatacgctgtttgcctcagttctcaaggtactgggngcaaccctgctgcgcgtgcttatttacaaagtggacaacggngttttctattcttacctctatatgaaaacggaagagaccatcctgcgcatcgacgcacgtaccagcgatgccgtggccctcgccttgcgcatggatgcccccattttcatatacgatgatattttagaagccgaatgcctgaaaacagagcacagcatcactcccacccaacagacggatgatgccgccgcagatgccgctacacagaaaaagaccctgaaacaattaaaggaagcccttcaaaacgccatagacgcagaagactacgaacgggctgcacaactaagggatattatcaaccagcataagaaaccataaacaatcatgcacgtattctacacccccgacatacaatcgcaagccgaactgcccgaagaagaagccgctcacgcagtccgcgtactgcggctgcaaacaggcgacgaggtaacnctgaccgacggcaaaggcaacttctaccgtgcggaaatcagtaccgccacnaccaagcgttgccttgtcaacatactcgaaaccatcccccaagcgcctttatggagcggacacctgcacattgcaatggctcccaccaagaatatggaccgcacggaatggtttgcagagaaagccaccgaaataggctttgacgaactgactttcctgaactgccgtttttccgaacgtaaantaatcaaaacggagcgcattgccaagatactggtatccgccatcaagcagtcgctgaaagcacgcctgccccgcctgaacggaatgaccgacttcaaccggttcatcagccagcctttcgaaggccgnaaattcatcgcgcattgttacgaaggagaaaaacctttattgaaagacgttgtccgtaaaggagaagacgcgctggtgcttatcggaccggaaggcgacttcagtgaagaagaggtgaaacaggccattgaaaacggattcgagcccatcagcctcggccgttcccgactgcgcactgaaacggcggcactcgtagcctgccacatattgaatctacaaaaccaataatacgatatgagaaagagtatttccttctatttgctgccggttttattaacagtgctatgcctgagctcatgcagcgaaaccgggcaaaaaacagaatacacgcatgtaatccccgccaatgccacagaagtggcggcactcgacctaaaaagcatcgtcgataaagccggattgaatacctcagacagccgggccaccttgcagaagttcctggggctgctccttgaaggcgggagcgccaacctgaaacaagaagcggaaactcttctgaaagaccctgccgaaagcgggatagactggaacgccccgctctacgtattcgaagcccctacgctgcacaacacggcaatcaccctgaaaattgccgatttaaagaagttngaagccatgctccggctgcttgnccaggaacagttgtgcaccgccccggtcgaggccggcggttaccggagcgttgaaataaaagacgcaggagtactgcttgcctacaacgacggcactctgctgggagtttacggcggcagtacggaacagttgaagaagctgcaacccgccatcaccgccctcatgcaacaacctgccgacaaaagcatccgcaccggcaaatacttcaccccgatgatgcagcaaaaaggagacatacgcctgctggcaactcccgatgccctccccatggacgttcgcggtgtactgacctggccgcacggcacgcaactgttgggttatgtcctgtttgaaaacggacgtatatacgctaccctgcaaaacgccgatttcaaaggaaataccaaagaaagcaaccagcctttccaccctcaaaattcgcgggagctgcaacaggccatgctgaacatgatgcacggacgagccttcaacatttcattgaccagcaacgaattgcttactttaagcaacctgcgggtgcttatggaatatgctccgaacgaaccggaag

SEQ ID NO: 1287 - DNA, 4000 bp, Escherichia coli
  misc_feature (353)..(354): n is a, c, g, or t
  misc_feature (356)..(356): n is a, c, g, or t
  misc_feature (358)..(359): n is a, c, g, or t
  misc_feature (361)..(361): n is a, c, g, or t
  misc_feature (363)..(364): n is a, c, g, or t
  misc_feature (366)..(373): n is a, c, g, or t
  misc_feature (376)..(376): n is a, c, g, or t
  misc_feature (378)..(379): n is a, c, g, or t
  misc_feature (382)..(387): n is a, c, g, or t
  misc_feature (392)..(394): n is a, c, g, or t
  misc_feature (398)..(398): n is a, c, g, or t
  misc_feature (400)..(401): n is a, c, g, or t
  misc_feature (403)..(403): n is a, c, g, or t
  misc_feature (405)..(406): n is a, c, g, or t
  misc_feature (409)..(409): n is a, c, g, or t
  misc_feature (412)..(413): n is a, c, g, or t
  misc_feature (415)..(417): n is a, c, g, or t
  misc_feature (419)..(421): n is a, c, g, or t
  misc_feature (424)..(425): n is a, c, g, or t
  misc_feature (427)..(427): n is a, c, g, or t
  misc_feature (432)..(432): n is a, c, g, or t
  misc_feature (441)..(441): n is a, c, g, or t
  misc_feature (448)..(448): n is a, c, g, or t
  misc_feature (452)..(453): n is a, c, g, or t
  misc_feature (456)..(460): n is a, c, g, or t
  misc_feature (462)..(464): n is a, c, g, or t
  misc_feature (466)..(484): n is a, c, g, or t
  misc_feature (486)..(490): n is a, c, g, or t
  misc_feature (493)..(494): n is a, c, g, or t
  misc_feature (496)..(497): n is a, c, g, or t
  misc_feature (499)..(500): n is a, c, g, or t
  misc_feature (502)..(509): n is a, c, g, or t
  misc_feature (511)..(512): n is a, c, g, or t
  misc_feature (514)..(518): n is a, c, g, or t
  misc_feature (520)..(538): n is a, c, g, or t
  misc_feature (540)..(543): n is a, c, g, or t
  misc_feature (546)..(551): n is a, c, g, or t
  misc_feature (553)..(554): n is a, c, g, or t
  misc_feature (556)..(558): n is a, c, g, or t
  misc_feature (560)..(566): n is a, c, g, or t
  misc_feature (568)..(568): n is a, c, g, or t
  misc_feature (570)..(579): n is a, c, g, or t
  misc_feature (581)..(594): n is a, c, g, or t
  misc_feature (596)..(600): n is a, c, g, or t
  misc_feature (602)..(602): n is a, c, g, or t
  misc_feature (605)..(605): n is a, c, g, or t
  misc_feature (608)..(608): n is a, c, g, or t
  misc_feature (610)..(612): n is a, c, g, or t
  misc_feature (616)..(616): n is a, c, g, or t
  misc_feature (618)..(620): n is a, c, g, or t
  misc_feature (622)..(622): n is a, c, g, or t
  misc_feature (626)..(631): n is a, c, g, or t
  misc_feature (633)..(633): n is a, c, g, or t
  misc_feature (635)..(635): n is a, c, g, or t
  misc_feature (637)..(640): n is a, c, g, or t
  misc_feature (642)..(643): n is a, c, g, or t
  misc_feature (650)..(650): n is a, c, g, or t
  misc_feature (652)..(652): n is a, c, g, or t
  misc_feature (658)..(658): n is a, c, g, or t
  misc_feature (815)..(815): n is a, c, g, or t
  misc_feature (1152)..(1152): n is a, c, g, or t
  misc_feature (1386)..(1386): n is a, c, g, or t
  misc_feature (1520)..(1520): n is a, c, g, or t
  misc_feature (1749)..(1749): n is a, c, g, or t
  misc_feature (1879)..(1879): n is a, c, g, or t
  misc_feature (1985)..(1985): n is a, c, g, or t
cgcgccttaaggtgcaaattgatgtgattgcatgcgaatcgaagcaccgatcggtcgccacagtgcgacagctggcgttcgcctcgcttctcgaagtggcctcttcgtgaatagtgccgcgatgcgcgatgcgaacgcggaccgcagacaggggcaaaccgccgttctttgagcggaacacttttccacacagagacgtcgtcttgagggtgcaagatgcgttgccgcatctgtacgggctgtttcgtgtacacgcgatgcgcgcggagaacgaagacgtggaccgcgcatcgctcgcgaaagatgctctgtggcgaataatacgcaagcgttttagattgcacgagcactgnngnanngngnngnnnnnnnncgncnnacnnnnnntttgnnntcgntnnancnnccncgnngnnntnnnagnncngcgcnctcgcgccnatctcgnttgnnacnnnnngnnncnnnnnnnnnnnnnnnnnnncnnnnntcnncnncnngnnnnnnnntnnannnnntnnnnnnnnnnnnnnnnnnntnnnnggnnnnnngnngnnntnnnnnnncngnnnnnnnnnncnnnnnnnnnnnnnngnnnnnanggncgngnnnaggncnnncngggnnnnnngngngnnnnanncgcgcgncnacgcgntcgagagccgttaaaccgccgcgcgtcgacggtgagcgacaccgaacgtcgtccgaagagagcgcgaacgcgaatggctaaagcaatcttctttgacctcgacgacacgctcgtgcgaacgagcgatgcggatcgagtcgcgtacgatgcggtgaancgtcgtctcgagcgtgaactcggcgcggcggtcgatgcggaggcgtgcgtggagcgttacaagcgcggtgtcaagaagacgccgtgggatacgcaaacggcggaagcgagcgaggagggcgcagagacgtcgagtgagtgcgtcgataccgacgaaatggcggctgccaagacgccgatgcacgtgtggtcttggagacgcgtgctgtgggagcgagcgctcgaggaatcggtttccctcggcgatgaggacgcgagacgcaaattggactattgcgcgtacgtagcgaacgatacctttcgcgacgttcgactgcgggagctgaagattccacgcnccgtgaaggatgagatcgaagctctcaagtgcgcgggcgtcatcgtgggcgtgattaccaacggcgatccagtgattcagagagagaaactcgcggcgtgcggcgcgtacaaggtcttcccaaatgagctcatactcgtcggcggtgaggaaatcctagccgggcgcgaagagaagcccggacgcggcgtattcgagcgcgctctcgcgctcgcgggcgcatcggccgaccgcnccgtctttatgggtgataattggaacgccgacatcgtcggcgcgtccgccgccggctacgcgggagcggtttggatcaaacgcgacgacgaaaaagacgacgagcgatccgttgtcgacgcgtggaacggtggnaaaccactcgaaaatttcttattcatccgagcgaattccgtcgtcgacgcgtgtcgcgacgcccaccttgaggagtgggtcaccgacggctgacgacgacgtttcgcaacaaccgccgcgcgtcaacgccaccaccaccatcacggcggctgcagcggcagtggcggaaaacatcaccctaggtaataatattcatgtaacaccaaccgatagcacccagaagtagtcntgatcaagtccatcgcatccatcctccagccagccagcgcgacgactcaccgctttccaaccaacagttaaaatccaatccatatccaaaaatggacccattgtcccaattcttgagttatgaacggtcnaatagagataaaatcgccgccaggctgtcgacgtcacgcggaatgcactacgcgaccgttcacccgttcgcgcgtcacacgcggtcgcggacgaaggcactctcgnagacaactcctcatcctcacttcagtcgccacgatgatgctcgcggcgagacacagcgggatgatgcgcgcgggaagcgcgatgcgtttgaacgacaagtataagatggatcaaaagattatgaaaaaggctgtcgtcggtcgtggacggtgcgcgacgacgagcgcgagcgcggtgaagcgaaacgaaaacgcttcgaccaagctcgcgatgggcgtcgcgtgcatgacgattgttggtgacgcgggcgcggcgcgggcgggcgcggtgagcgatcggttggcggcggcgttggacgccgcggatagcgcggcggagagcgcgtccgcggtgtttgaacgcgtcggtgcggtgatcgaccagggcgtggatttggcgcaacaagcggcgccggttgtgttgccggcggcagaacgcgcggtgaaggcggtgcagccgatcggtgaggcggtcgggtcctacgccggtcgggcgttggcgcccgtggcggacgaggcggtcaaggcggcggcgagcgccgggtcacaggctgtcggcgcggcagacagtgcgctcaaggcgcaaggcgtcgatgtgtccccggcgctcaaggtggtcggggacggcgccgaggccacggcgaaggttgcggtgccgttggcggaaaaggcggttgattacttgtcgcacgcgtctggcgccgaattggcgcaaaccggtgccgagctcttcgccgcctacctcttggttccggtgttcttcaaggtgctcgcggacattggtcgcggctaccgcggtgacttgcgcccgatcgaagcgtacgatatgcttctctctggcgacgccgtcatcgtcgacacgcgcggcgcggacgtcaccgtccaacttcccgggggcgccaaccgccgcgtgctcgtctgcgatctcggcgccgccggtggattttccggcgccgcctccggcaaggtggctgcgctcaagattgcctccctcaagggtgtcaagcgcaacaggcgcatcattcttctcgaccaaggcggcggcaacaagtcgctcgccaagtcgctctccaagcaaggtttcggcaaggtgtacgtcgtcaagggtggtttcaacgcctggcgcagcaccggtctcgccacttcggcgtaatcgcgacgcccatctcgagcgacccattccttttgcgccgcgaaacctgtcaataataaacacacgacaaagtcatgaaacacatccatttcccaaatcaaatgtgcgaaggaatgaaacaacgaagcgaagcgacgcggtttggacgccgaacgatcgcacccgcgtcacacgtcgccgcgcgacgcgccgcacccgatcgcgaagacggatttgaagacttgaaaacttttccaatcgaaactcccgccgcgcctcgacgaaacgggcggtctagacgcgatacgccgtcgacgaacgcgttgacgcgtcgacggttttcactcgatttgaaccgacaacggtttggttttggtttttatcgaggcggtgtttgaaaacgcgcgcgcgacggcgcgatggatgcggcgcgacacatcgttcgggcgtcagaggcgttggatgacgcgttatccgtgggaacgagcggacaggcgagacgggcggtggaggaggcgcgggaagcggtgagacaaatggcggcggcgtgcgtttcgtctggtttggttcgttcagaggaggaggaagaggaagggtctcgctcgaaaagggatgcggaaacgcgaagacttaagaaacggtgtgatgcgttggagcgggcgttggtgcgggaacgcgagaggagcgccgagttggagcgggaggttatctctggacgaagcgcgtggtttgaaagggcgagacgcgagttggacgcggcgctgagaagagggcaggcgaatgcgagcgcgaacgcgaacgcgagggatgacgaggtgaagagaatggagagagagattgcgaggttgacggcggtgaataatgcgttgcgtgaggaggcgctggcgctcgaagcagacgtggtg

SEQ ID NO: 1288 - DNA, 4000 bp, Escherichia coli
  misc_feature (1070)..(1070): n is a, c, g, or t
  misc_feature (3113)..(3113): n is a, c, g, or t
ttacaaaccaataagtttctgtaatgaccagagagtccattaataaagttatgggagtcaaaaccattttcaacaatttcattaaataataataaacatgatggaatgtcttctttgtctgcaaattcggtgaacttgaaaaagtaatcgtagtctagaatatgaaggttattaattacatcttgatatgtgatattattttcagaaaacgtaacgatttgatcaaatacggacaatgcatccctcaatgcaccatcggctttcatggcaatcatgtgtagagcttcgggttctgcttttacattttcttttttagcaatttctaccaaatggtcagtaatgtcttttactttgattcttgagaaatcaaaaatttgacatcttgatagtatggtaggtattattttatgtttttctgttgttgctaaaataaatatagcgtgctttggtggctcttcaagcgtctttaaaaacgcattgaatgcaaaattagatagctggtgaacctcatcaataatgtatactttaaagtcgcctagttgaggagcaattcgaacttgatctgtcagctcacgaatgtgatctacaccgttattggaggctccgtcaagctcatagatatttagagatgctcctgaattaaagctttcgcacgaatcacaattatcacatgcttcagtttcttcagtccgattaaaacaattgatggttttagctaatattcttgcggttgtcgttttccctacacctctggtgccacaaaacaaaaaagcttgtgccaaatgttcattcttgatggcattttttagggtgctcgtaattgatttttgtccaactactgtgtcaaaagtctgaggtcggtatttgcgtgctgaaacaataaaatcacccataaaacaaagatattgatttatatcaatcaaatgataaaatcattttatcttcttggataaatctcgactagggttccgttatttggtccccaaagctttaagttactaggtattataaatcgagagtcttctgtgttttcttcgattaagtctacattttcgtagagaacagttctnaattcaattttttctttagaaataaaaatgagattgaattgattcacggcttcagcgtctctcgtccatgatttttgatcatctgcagctctcaatggtgctccccagcatccttctccggcataaacgataccaatactgtcattccttataaatccttcgtctgcctgatctgaatcatcactaatgatgggccaagtgaccttacaagtatgagaatcattttcaagacataatcttacattattgaatttttcaaattcgggaacgaaatttttgtattgggtgttcatttcctttttcgcttttacatgagcacgtataggacgatggtattggggtatttgccagtaatagtccttgtgttcctttagtgtttttcttaaaaataatcgttgagagccaaatttccatatttcagagtttagcgaaattaaattcaataaatctccgccaaatgtagttgagtaaaatactttcgaatgaggaacatcgaacaaacgaagcatgactcgatttcccaattcgtgattccctctcgttaccaccaagggagttattcttccatctgaagagatactattttcccagtcaataaaccattccttccattgtctctctgtatctatacctgtaaagtctccgttaaaaagaacggcatgcgctttgagcttgcttaccatgcgattggcctttactctaacgattcttgtgtctctcgagtctccgcctgcgataaatgatatcttttcattggaatcatcacttactgtagtgaaataatagacttggtttttaccttcagaatcttcaatataaaagtaataacgtgtatttggatttaagtttttaagtcttacaacatgattaaacatgcctttgtaatgattttgatcactcaggacatatgttagcgtattttggttgggataagatttatccatgaagaaattcacgaattcaccactttgttgattccatatgatcgttgcctcataagaagcatttttattaaagaccacccgaacaaaattagttttacaactagagccgaaagcgtcgacacagaacaggacaataagtaaagctctcaataaagtattcacaaggtttaattatttttctttgaattcactaaaatcaatgtcagagttaatctgatttgatttaacagtgcctgagaaagtaacgtttccaaatgacataatttgagtttgtggaaaaaggattccattaacttccttgtagtcggagtattcaacagagttttctgcaggttctccaccttcaggagccgtgacaatacttaatgtattggccaaaagaaaatcatttttattaaaatattgaaactcttcattttcaccatcaatgattttaatcacataatattcgtcagatccttttggttcaatcccaatggcttcaacagtaatattgtttttagcataattaagctgaggaaacaaaccaaacgattttttcttttcctctacctcatcttttgtgaggtctttttttcctgtttgcatgttttgattaaatccttttttaccagtaaaatagcctgattggagtaccataccattcatttccattttcattgaggatgttttaggagacttgaacattttagttaaagtcaatgcaccaggcatttgtgccatactcaattcagtcacctccttgtaggttttgatgcttttaattttctttaagacctctttcatcgttgcagaaccagtcaccttcattaaataattatttattacttgattacctgttaaatcgcttgggcgcattctttcttttggattgccataagggtctaacagttcgatattgttatcaccatcaaagggaagtagcttgtcaataatctctgaattaccaacaacaacgatattacagttttcaaaaggaatgtgcttttgagcaacatccaaaaccatttctttactcataccattgagtttttgaagatacttctgatagtaatctttatctaaattgtacttgatgctgtttaaagcaaaccttgcnatagtcgaaggttgttcaagtgatcttgcaaatcttcctgaagaggaagcttttgtcatgctcaactctttatcactaaccatattggtagcaatgtttttaagttcatacataatttctgtaatggcagagtcagtaaccgcatttctgaaattaccgccagcagatagccatgacccattgtcagttaaagaaagtcttgaataacagccataagtataagctttgtcttctctcaggttttgcatcaatctatttccaaaacccccacctccaaggatattaaaaagaagcttcgtttctatttgatcagagctactcaaatccatgtcaacaggaaatgtaatataaatcacggattgtactgcgccaggtttgtccacaaaatagactttatttccacctgtatttctatttgtagatggatattttttcttataaggtttttttccttcccaagatccaaaatgcttattgaccaaattctctgcggattctctattaatatctcccacaattacaatataactttcttgaggtgtgaaagtgctttggtaatatgcaataaggtcgtcacgagaaatatttgctaatgaagcttctgtcatcacattactgtatggatgtccggcaaaattcacttttacgacagcattatttgccatttcatcagcactcgatttagttgctgaaaggtttgattctgcttgttttttaattcgatttacttcgtctttaggaaaacttgcgtttttcgccacatcttccataagggataatccagtagaaaagtgtttggtaagacagctcagtcgaattgaattttcgctggcacttaaatttgcaccaatgaaatctattttattgtcaagttcatcttttgttaa

SEQ ID NO: 1289 - DNA, 4000 bp, Escherichia coli
  misc_feature (344)..(344): n is a, c, g, or t
  misc_feature (582)..(582): n is a, c, g, or t
  misc_feature (602)..(602): n is a, c, g, or t
  misc_feature (1484)..(1484): n is a, c, g, or t
  misc_feature (1600)..(1600): n is a, c, g, or t
  misc_feature (1631)..(1631): n is a, c, g, or t
  misc_feature (1660)..(1660): n is a, c, g, or t
  misc_feature (1714)..(1714): n is a, c, g, or t
  misc_feature (1736)..(1736): n is a, c, g, or t
  misc_feature (1822)..(1822): n is a, c, g, or t
  misc_feature (1885)..(1885): n is a, c, g, or t
  misc_feature (1927)..(1927): n is a, c, g, or t
  misc_feature (1973)..(1973): n is a, c, g, or t
  misc_feature (2399)..(2399): n is a, c, g, or t
  misc_feature (2513)..(2513): n is a, c, g, or t
  misc_feature (2847)..(2847): n is a, c, g, or t
  misc_feature (2850)..(2850): n is a, c, g, or t
  misc_feature (2881)..(2881): n is a, c, g, or t
  misc_feature (2996)..(2996): n is a, c, g, or t
  misc_feature (3089)..(3089): n is a, c, g, or t
  misc_feature (3275)..(3275): n is a, c, g, or t
  misc_feature (3401)..(3401): n is a, c, g, or t
  misc_feature (3452)..(3452): n is a, c, g, or t
  misc_feature (3470)..(3470): n is a, c, g, or t
  misc_feature (3479)..(3479): n is a, c, g, or t
  misc_feature (3512)..(3512): n is a, c, g, or t
  misc_feature (3614)..(3614): n is a, c, g, or t
  misc_feature (3650)..(3650): n is a, c, g, or t
  misc_feature (3662)..(3662): n is a, c, g, or t
  misc_feature (3956)..(3956): n is a, c, g, or t
  misc_feature (3974)..(3974): n is a, c, g, or t
ttatgaagacagatgtgcgtattgtagccgcaacgaatgtcaatatgcacaatgctgtcagtgaaggtaagttcagagaagacttgttttatcgtctaaatactatcccaatacagattcctcccctacgagataggggcgaagatattgttcttttgttccgactttttgccatgcagatggctgaaaagtatcagattccaaagataacactaacagacgaggccaagaaattactcatgcaatacaagtggccgggtaatattaggcagttaaagaacattactgagcagatgtctatcctcagtaaacaacgcgaaatcgatgcaaacacgctgttacantttatccctcacgatgaagaaagcacgcaattagctacgatttcaaagcccggtgagcactcttatgaaacagaacgcgagatactatataagatattgtatgaacttcgcggtaatgtcaacgacttaaaacgcgacatgaatttgctgaaaaagcagataaatgacaacaatatgattgccaacgtgccgagtttccaagggaatgccatcgtccctgcacagagttcatcactcnttcgcaatgaaagcgctcanccttatggcattatcagcaccccgacacaagaggttcagcccgacacttacgatgccgtcgccgaagaaatcaacaagcctgagtgccttaatcttaatgatttaggacgccaaatggtagtaaaagctttggaacgcaatggaggaaaccgcaaaaaggcagcgcaagagttaggtatttcagaccgaacgctctaccgacgcatcaaacaatacggactcgattaaggcttatggccttactaaagctcacgaaaatgaagaaactaaaatacatcttagcgctttgtttgcttgtttttatggcctcatgtgcctttaaaggctacaagtttaacggcgcaagtattgattatagcaaaacaaagacgatacaaattgccgagtttcccgttcgctccagctatgtttggggacctatggggccgttattcaacaaccggttaaaagaccaatttgccgaccatacgaagctaatccaagtgaaaaggaacggagatttgaagctggaaggggagataacacaatacactcagcgtaataagtcggtgacaagtgacggaagatctgcacaaacagaacttgcaatgactgttaatgtgaggtttacgaacacgaagaatcacgcagaagactttgaaaaacaattcacatcaactgccagttacgagacaacaaagagcttaaatgccgttcaagaagaactcgttacacagatgacaaaagacttagtggaccagattttcaatgcaacagtagcaaattggtaagtaaatatggatattaagcgccttattctacatcccgaaactatggaccgagagaccctttacgatctccgcagcttcattgcgctccatccttactgccaaacagcaagantgttaatgctgcaaaacctctatattctacatgattcggcgtttgatgaagagttgcgtaaggccgcaatctgcatcacagaccgtcgcattctctttgacatgattgaggcagcncactataaagtgcacgcaggaaagtccactntgacgcagaaaaagcttcatgaaacaacntcagagaatggagaccgcactacaaaacttatcgatacgttcctcgattctatncccgaagacaccgaagataagncaaatgacaagaccaagcgccccactccagccgatgctaccgtggactatgtggcctacttgcttaatcttgaagaggaagaagancaggaacaacatcgtcataaggcacaagaccgcacgtcaacacttattgataatttcatcgangatggcggattcaacctcagtaccgaagagaacacagaggangaactgtcaaaatactacacacccaattatcgtttagaagacctgncgcatggagatgtaacgcaaaatgaagctcctcaacagcctattgataatgaagaagtagacgatgtagatgaaaattatttcacagaaacccttgctcgcatctacattaaacagagaagatatgagaaggctttggaaattattaagcgtttaaatttgaataatccaaaaaaaaatgcttactttgcagaccaaatgcgtttcttagagaaattgatcataaataataaaaacaaaaaataaagcaatgatttacacattattagtcgtattgatcgtacttgcagccattcttatggtctttgttgtattgattcaagagtcaaaaggtggcggtttggcatcaaacttctcatcttccaatgccatcatgggcgtgaggaagactaccaatatgattgaaaaactaacctggggactcgcnatttcaatggttgttcttagcgttctttgtgctcgtgtggcaccaagtgcaccaacagatcaaagtgttatggagaagaatgctactgaaacacagactactaaccccataaanacacagggttttggggcaagtcagcaagtgcctcaagctcctcaatcacctgctaaataaaaaattagtaaaaaatataaggaaaagtttggtgtttccaaacttttcttatacctttgcacccgctaaacaacaatagcaaacgcattaaatggtggatgtagttcagttggttagagcgtcagattgtggttctgaatgtcgtgggttcgagtcccaccctccacccttaaacgggaattctctcacgagagttcccgtttttcgtgttataacgaatgaggtctggagctgcatccctatgaatcaagtccaaacaacgctgttcaagcgngantcataagggtgaaactccagacctctaaggncaaaacaagcccgaaggcttatcgctttgctttcaaaatcaagcgaagactctgcttataattcatgtaactccacatccaattcaggaaaacaatcgtcttattctttactccnaagattgaacgtagatgcactataagccataaaagccatgcaaagaagccaccaaacttaagctttcctatttcaactacagccttcttgcgnccgattgtagccatagtaccgagattatgatagctaaatggctgctcagtttcgcctttttcttgcctgattaggttctttgcaagtgtctttgcctgctgaatggcaacctgagccaactgaggatggccataaggataagcctcatcaccctctacaatgcattgatcgccgatggcatatacntctttcaagcccttaactcgattgaaacgatccactaaaatgcggccagcgtgaccgatactttcagtcggaataccatcgatattgttggctttgataccactaacccatattactgtctctgcngaaatacgctgaccatctttcaatactaattctttgtcaacataatctgtnaccatgcagttggtcatnacctccacnccaagttctttcaacgccttttcggcctcacgngatgaacgttctgacattgcacctaataggcgcggagtggcattaatgaggtagatgtgcatgcaagatgtatctaaatcgggataatcgcgaggcagaatngtttgtttcatctctgccaacaccccagcaatctcnacacctgagggnccaccgcctacgatagcaatgttcattaaggcttgttttcgcgcctcgttatcctcagtttccgcgcgctccagattctgaagaatcgtatttctcagtcgcattgactcactaaccgacttcatcggcagtgcagaagcctcgatattcttgtttccaaagaagttggttgtcgcaccagctgccagcaccaagtcgtcataatgaatcgttccaatggatgttttgatagctttctcttcagtatctatatgctgaacttcggccattctgaagaagaagttcttccaaccntggaataatcgacgaaanggaaaagagatattactcggttcaag

SEQ ID NO: 1290 - DNA, 4000 bp, Escherichia coli
  misc_feature (64)..(64): n is a, c, g, or t
  misc_feature (667)..(667): n is a, c, g, or t
  misc_feature (1139)..(1139): n is a, c, g, or t
  misc_feature (1208)..(1208): n is a, c, g, or t
  misc_feature (1454)..(1454): n is a, c, g, or t
  misc_feature (1580)..(1580): n is a, c, g, or t
  misc_feature (1951)..(1951): n is a, c, g, or t
  misc_feature (1953)..(1953): n is a, c, g, or t
  misc_feature (1958)..(1958): n is a, c, g, or t
  misc_feature (1965)..(1965): n is a, c, g, or t
  misc_feature (1967)..(1967): n is a, c, g, or t
  misc_feature (1977)..(1977): n is a, c, g, or t
  misc_feature (1988)..(1988): n is a, c, g, or t
  misc_feature (1991)..(1991): n is a, c, g, or t
  misc_feature (2065)..(2065): n is a, c, g, or t
  misc_feature (2067)..(2067): n is a, c, g, or t
  misc_feature (2587)..(2587): n is a, c, g, or t
  misc_feature (2643)..(2643): n is a, c, g, or t
  misc_feature (2679)..(2679): n is a, c, g, or t
  misc_feature (2814)..(2814): n is a, c, g, or t
  misc_feature (2858)..(2858): n is a, c, g, or t
  misc_feature (2961)..(2961): n is a, c, g, or t
  misc_feature (3013)..(3013): n is a, c, g, or t
  misc_feature (3066)..(3066): n is a, c, g, or t
  misc_feature (3378)..(3378): n is a, c, g, or t
gtgggttgccggggtaaaccccacggtctccttgtcgtcggagaggttcatgaccacgcatcgncgcgcctccgtgcgaataatcgcctcgcgctgggcgtccagcagcaggtgcggcagaaccgaggtgcgccacgagccggggccgagcacaatccagtcggattcctcaatagcggagagcgcctccgggcagggacgcgcatgctccggggacaggccaatatcgtgcacgcgctcctccttggagaggttcacctgccccacgaccttgacccgctcgattccgccaccggagtgctcgcgcaacacggtaccgtaaatcaccatggggtccagcgccatggggagcacgcggccgcgggcgttcagcagggcgcccgcccagtccaggccggccacagggtcgtccagcagctgccagagcgtcgcgatgagcaggttgccaagcgcgtgatagtccaggggaaactccccctcgtagccttcgggcgcggcgaaacggtgctgcatgacgtcgcgccaggtgcggccccaatcggtgtcgtcgcagagcgccgagagcgccatgcgcaaatctccgggaggaagaatacccatctcctcacgcaggcgacccgaggagccgccgtcgtccgccacggttaccacggccgtcaggtcgggngtcacgtggcgcagagccgaaagcgatccgtacaggccgtgcccgccgcccatggccgtcaccttcggtgaacggtgcgtggtcttcagcagacgcagagcctgggtcgggagcgcgggcaggcggggaatcccctgagtgtcataactggttgaatgagtgttcatagtctgtatctcacatacccggaagcggccggccctccgctcggggtgcgaagggcgaccggtagctgattatgggttgccggtcagtactgcggggctattcgcggcccttgtcgcggtgctgcacgttcacgttgacatcggggaaggcggagaggcggcgggccagctcctcggtcacggccaccgagcggtgcttaccaccggtgcaaccaatcgcgatggtggcgtagtacttaccctcgcggcggtagccctccagcacgggacgcagggcggccaggtagttgctgatgaactcctcngtgccggcgtgctccagcacgtagtcgcgcacgggggcgtcctggccggtcagcgggcgcagttcgggnacccagtgcgggttcggaataaagcgcatgtcggccatgtagttggcgtccgaaggcgcaccgtacttgaagccgaagctcatgacggtcaggttcagcttcttgtccgcaccctcggcgaacatctcgcgcacggtgcgggccagctcgtgaacgttcatgccggtcgtatcaatcgtgcggtccgaggccaggcgcaggccctcgaagagggtgcgctcggcgcggatgccgtcgagcacgcgnccctcaccctgcagcgggtgcgggcggcgctgagcctcgtaacgggcgatgatggtctcgtccttggcatccaggaagagcatggagaagtcaatatcggacttgcgcaacgtctcgatggcggcnggcaaatcagagaacagcgcgcgggcgcgcacgtcaataccgagagccaccttcggcacgcgagcgccgtcgcgggtcaccagctcggccagggacccgagcatctgcggagggatgttatcgataacgtaccagccctcgtcctcgagcacgttagcgacggtgctacggcccgcaccggagataccggtaatcaccagaatctgcgggcgctcatcgctctggacggaatgtgcggcggcatggtgctgattgtctgccatggtgtctcttcccctttgacgcgaactactctataagccatgatacaagaccttgattagacggtccgggcccgtgctcacatatttcaggacatgacaaaaaagagncnccccncccccancncccccgagcnttaacgcgaancgncccgccgcaaagaatgcgacgggtcgaatgttccgctcgtgaaaagcgccgtaaaaatgttatgaaaacgttgngnagagcgccacgaatctgctcggatgcgtctgccgcgggaacggccgcgggctaggagcagtccgggccgaagaagccgctcacgtactccagcaggcgcaccgaaacgtccttcttcgagccgatcagcaccggctcctcatcggtcagcgcagagagcagggtaatcgtgttctcgtccgtaccgaagcccaggttcacgcccaccgtgttcacggccaggaagtcggcgcccttgcgctgcatcttctcgcggcccagctccagcggggtcttttctgccgagccggtctccgcggcgaaacccacaataatctgcgggcccatgcaggtctgaccggcctcccgagcctgagcgcgacgcaccacaacctcacgcaggatatcggggttgcgcaccaggttgatgaccggcgcatcctcggaatcggcgctcttcttaatcttgaactcggcgaactcggcgggcctgaaatcggccaccgccgcggacatcaccagaacgtccgcggatgcgctcncctccaggactacctcgcgcagctccagggcgcgctcaacgcgggtcacccgcacnccctcgggggcgggcacctcgatgttcgcggcgatnaggtgcacgtgcgcgcccaggtcgcgggccgcctcggccagggccacgccctgcttgccggtcgagcggttacccaggtagcgcacggggtcgaggggctcgcgggtgccgccggcggtaatcaccacggtgcgnccggccagcggaccggatgcggcgggcacctcccgggccgcgcnctcgacggcctcggggccgccatgaccgtcgatgctcaccgaccccagggtcgccaggcgtgcggcggccgcgcgctcctgctccgtatcggcgtacaggggntgggtcggggcgtagccgggcgtgtacaccgggtgcgtggaacgcttcgggnaccgcgcaatgacctcctgcgccaggcggaagatgtcctcgggttcgggcatncggccggggccggagtccgggcccgtcagacggccaatcgccggctcaatcacgtggtagccccacgaacgcagggtctgcacgttcgcgcgggtcgccgggttctcccacatctgcgtgtgcatggccggggccagaatcacgggcgcgtgcgtggtcagcacggtcgccgacaacaaatcgtccgcgcgtccggcggccaggcgggccagcaggtcggcggtggccggggcaatcaccacggcgtcggcctgctcggcctggcgcacgtggttcacctcgggcacgcgctcgaacacgtcggtcgaaacngggttgccgctcagcgcctccagggtgggtacccccacgaacttggtcgcgttcggggtgggcatggcgataacctcgtcaccattcttcgcaaaaaggcgaaggagcatcgccgccttgtacgcggcgatgccccctcccataccaacgataatgcgcatggtacgtcagataatccttaaactagccggtcggctcgttactcggcgtggtcgtcgaggatgacctcttcaatcgcgatgacctcgtcgctaccggcgggaatgtactcctcctcgatagcgtcggggtactcggtgacgctgaagtcaatcagagcgttcggctcttcagcgatcgggtaaccgtcctcgttgaacttggtgccgggcttgtgctcagcctcaacgcggtcggtaatgatttcgcgcatagcaaccgacagggacttctcagtcgagtcagcgtcgaccagcgggccgatgtgagggttcttggaatcctgcaggttagcgtagtacgcgttgatctggcgggcgcggcgggcaccgaaaatcaccaggccgtacttggactctgccttctcgatcagcgagtctgcgctggggcgcacgatgccctcgggagtaacgccgtcaacgaa

SEQ ID NO: 1291 - DNA, 4000 bp, Escherichia coli
  misc_feature (1)..(4): n is a, c, g, or t
  misc_feature (6)..(6): n is a, c, g, or t
  misc_feature (10)..(28): n is a, c, g, or t
  misc_feature (30)..(30): n is a, c, g, or t
  misc_feature (34)..(39): n is a, c, g, or t
  misc_feature (43)..(47): n is a, c, g, or t
  misc_feature (50)..(51): n is a, c, g, or t
  misc_feature (53)..(53): n is a, c, g, or t
  misc_feature (56)..(59): n is a, c, g, or t
  misc_feature (62)..(66): n is a, c, g, or t
  misc_feature (68)..(69): n is a, c, g, or t
  misc_feature (72)..(73): n is a, c, g, or t
  misc_feature (76)..(76): n is a, c, g, or t
  misc_feature (79)..(80): n is a, c, g, or t
  misc_feature (83)..(87): n is a, c, g, or t
  misc_feature (90)..(90): n is a, c, g, or t
  misc_feature (92)..(99): n is a, c, g, or t
  misc_feature (102)..(110): n is a, c, g, or t
  misc_feature (113)..(114): n is a, c, g, or t
  misc_feature (116)..(123): n is a, c, g, or t
  misc_feature (126)..(128): n is a, c, g, or t
  misc_feature (132)..(132): n is a, c, g, or t
  misc_feature (134)..(145): n is a, c, g, or t
  misc_feature (149)..(150): n is a, c, g, or t
  misc_feature (157)..(157): n is a, c, g, or t
  misc_feature (160)..(163): n is a, c, g, or t
  misc_feature (165)..(169): n is a, c, g, or t
  misc_feature (173)..(175): n is a, c, g, or t
  misc_feature (178)..(179): n is a, c, g, or t
  misc_feature (185)..(190): n is a, c, g, or t
  misc_feature (194)..(195): n is a, c, g, or t
  misc_feature (201)..(207): n is a, c, g, or t
  misc_feature (210)..(211): n is a, c, g, or t
  misc_feature (216)..(226): n is a, c, g, or t
  misc_feature (229)..(231): n is a, c, g, or t
  misc_feature (234)..(235): n is a, c, g, or t
  misc_feature (242)..(244): n is a, c, g, or t
  misc_feature (247)..(247): n is a, c, g, or t
  misc_feature (252)..(255): n is a, c, g, or t
  misc_feature (259)..(260): n is a, c, g, or t
  misc_feature (263)..(263): n is a, c, g, or t
  misc_feature (266)..(266): n is a, c, g, or t
  misc_feature (270)..(270): n is a, c, g, or t
  misc_feature (277)..(278): n is a, c, g, or t
  misc_feature (284)..(285): n is a, c, g, or t
  misc_feature (288)..(288): n is a, c, g, or t
  misc_feature (294)..(302): n is a, c, g, or t
  misc_feature (304)..(305): n is a, c, g, or t
  misc_feature (307)..(320): n is a, c, g, or t
  misc_feature (324)..(326): n is a, c, g, or t
  misc_feature (335)..(335): n is a, c, g, or t
  misc_feature (338)..(345): n is a, c, g, or t
  misc_feature (348)..(350): n is a, c, g, or t
  misc_feature (354)..(365): n is a, c, g, or t
  misc_feature (368)..(379): n is a, c, g, or t
  misc_feature (382)..(382): n is a, c, g, or t
  misc_feature (384)..(388): n is a, c, g, or t
  misc_feature (390)..(392): n is a, c, g, or t
  misc_feature (394)..(410): n is a, c, g, or t
  misc_feature (415)..(426): n is a, c, g, or t
  misc_feature (428)..(437): n is a, c, g, or t
  misc_feature (442)..(444): n is a, c, g, or t
  misc_feature (448)..(449): n is a, c, g, or t
  misc_feature (453)..(462): n is a, c, g, or t
  misc_feature (465)..(481): n is a, c, g, or t
  misc_feature (485)..(489): n is a, c, g, or t
  misc_feature (491)..(493): n is a, c, g, or t
  misc_feature (497)..(518): n is a, c, g, or t
  misc_feature (520)..(555): n is a, c, g, or t
  misc_feature (557)..(558): n is a, c, g, or t
  misc_feature (562)..(562): n is a, c, g, or t
  misc_feature (564)..(572): n is a, c, g, or t
  misc_feature (574)..(576): n is a, c, g, or t
  misc_feature (578)..(585): n is a, c, g, or t
  misc_feature (587)..(588): n is a, c, g, or t
  misc_feature (592)..(596): n is a, c, g, or t
  misc_feature (600)..(602): n is a, c, g, or t
  misc_feature (607)..(608): n is a, c, g, or t
  misc_feature (613)..(617): n is a, c, g, or t
  misc_feature (619)..(619): n is a, c, g, or t
  misc_feature (623)..(636): n is a, c, g, or t
  misc_feature (638)..(641): n is a, c, g, or t
  misc_feature (643)..(648): n is a, c, g, or t
  misc_feature (650)..(669): n is a, c, g, or t
  misc_feature (672)..(675): n is a, c, g, or t
  misc_feature (678)..(683): n is a, c, g, or t
  misc_feature (686)..(690): n is a, c, g, or t
  misc_feature (692)..(694): n is a, c, g, or t
  misc_feature (696)..(698): n is a, c, g, or t
  misc_feature (700)..(701): n is a, c, g, or t
  misc_feature (704)..(714): n is a, c, g, or t
  misc_feature (718)..(723): n is a, c, g, or t
  misc_feature (729)..(731): n is a, c, g, or t
  misc_feature (736)..(737): n is a, c, g, or t
  misc_feature (740)..(752): n is a, c, g, or t
  misc_feature (754)..(760): n is a, c, g, or t
  misc_feature (762)..(769): n is a, c, g, or t
  misc_feature (772)..(772): n is a, c, g, or t
  misc_feature (775)..(778): n is a, c, g, or t
  misc_feature (781)..(785): n is a, c, g, or t
  misc_feature (790)..(790): n is a, c, g, or t
  misc_feature (792)..(795): n is a, c, g, or t
  misc_feature (798)..(798): n is a, c, g, or t
  misc_feature (800)..(800): n is a, c, g, or t
  misc_feature (805)..(808): n is a, c, g, or t
  misc_feature (810)..(811): n is a, c, g, or t
  misc_feature (814)..(814): n is a, c, g, or t
  misc_feature (816)..(817): n is a, c, g, or t
  misc_feature (820)..(821): n is a, c, g, or t
  misc_feature (824)..(824): n is a, c, g, or t
  misc_feature (827)..(828): n is a, c, g, or t
  misc_feature (832)..(833): n is a, c, g, or t
  misc_feature (835)..(838): n is a, c, g, or t
  misc_feature (840)..(840): n is a, c, g, or t
  misc_feature (842)..(842): n is a, c, g, or t
  misc_feature (844)..(845): n is a, c, g, or t
  misc_feature (847)..(862): n is a, c, g, or t
  misc_feature (864)..(865): n is a, c, g, or t
  misc_feature (867)..(870): n is a, c, g, or t
  misc_feature (872)..(872): n is a, c, g, or t
  misc_feature (876)..(878): n is a, c, g, or t
  misc_feature (880)..(890): n is a, c, g, or t
  misc_feature (892)..(895): n is a, c, g, or t
  misc_feature (897)..(905): n is a, c, g, or t
  misc_feature (907)..(911): n is a, c, g, or t
  misc_feature (914)..(929): n is a, c, g, or t
  misc_feature (931)..(931): n is a, c, g, or t
  misc_feature (934)..(934): n is a, c, g, or t
  misc_feature (936)..(936): n is a, c, g, or t
  misc_feature (938)..(938): n is a, c, g, or t
  misc_feature (941)..(944): n is a, c, g, or t
  misc_feature (946)..(946): n is a, c, g, or t
  misc_feature (948)..(948): n is a, c, g, or t
  misc_feature (951)..(951): n is a, c, g, or t
  misc_feature (953)..(960): n is a, c, g, or t
  misc_feature (963)..(963): n is a, c, g, or t
  misc_feature (965)..(967): n is a, c, g, or t
  misc_feature (971)..(971): n is a, c, g, or t
  misc_feature (973)..(977): n is a, c, g, or t
  misc_feature (979)..(979): n is a, c, g, or t
  misc_feature (983)..(985): n is a, c, g, or t
  misc_feature (988)..(989): n is a, c, g, or t
  misc_feature (991)..(998): n is a, c, g, or t
  misc_feature (1003)..(1003): n is a, c, g, or t
  misc_feature (1006)..(1019): n is a, c, g, or t
  misc_feature (1026)..(1026): n is a, c, g, or t
  misc_feature (1029)..(1029): n is a, c, g, or t
  misc_feature (1031)..(1033): n is a, c, g, or t
  misc_feature (1036)..(1043): n is a, c, g, or t
  misc_feature (1045)..(1055): n is a, c, g, or t
  misc_feature (1058)..(1058): n is a, c, g, or t
  misc_feature (1063)..(1064): n is a, c, g, or t
  misc_feature (1067)..(1067): n is a, c, g, or t
  misc_feature (1073)..(1073): n is a, c, g, or t
  misc_feature (1087)..(1088): n is a, c, g, or t
  misc_feature (1092)..(1092): n is a, c, g, or t
  misc_feature (1097)..(1097): n is a, c, g, or t
  misc_feature (1103)..(1103): n is a, c, g, or t
  misc_feature (1107)..(1116): n is a, c, g, or t
  misc_feature (1122)..(1123): n is a, c, g, or t
  misc_feature (1127)..(1139): n is a, c, g, or t
  misc_feature (1142)..(1142): n is a, c, g, or t
  misc_feature (1145)..(1157): n is a, c, g, or t
  misc_feature (1162)..(1163): n is a, c, g, or t
  misc_feature (1166)..(1166): n is a, c, g, or t
  misc_feature (1174)..(1176): n is a, c, g, or t
  misc_feature (1180)..(1180): n is a, c, g, or t
  misc_feature (1184)..(1197): n is a, c, g, or t
  misc_feature (1201)..(1201): n is a, c, g, or t
  misc_feature (1204)..(1206): n is a, c, g, or t
  misc_feature (1209)..(1209): n is a, c, g, or t
  misc_feature (1212)..(1215): n is a, c, g, or t
  misc_feature (1218)..(1221): n is a, c, g, or t
  misc_feature (1223)..(1225): n is a, c, g, or t
  misc_feature (1227)..(1227): n is a, c, g, or t
  misc_feature (1229)..(1231): n is a, c, g, or t
  misc_feature (1234)..(1234): n is a, c, g, or t
  misc_feature (1236)..(1236): n is a, c, g, or t
  misc_feature (1239)..(1239): n is a, c, g, or t
  misc_feature (1241)..(1242): n is a, c, g, or t
  misc_feature (1245)..(1248): n is a, c, g, or t
  misc_feature (1250)..(1252): n is a, c, g, or t
  misc_feature (1256)..(1260): n is a, c, g, or t
  misc_feature (1262)..(1262): n is a, c, g, or t
  misc_feature (1264)..(1265): n is a, c, g, or t
  misc_feature (1269)..(1270): n is a, c, g, or t
  misc_feature (1274)..(1274): n is a, c, g, or t
  misc_feature (1276)..(1276): n is a, c, g, or t
  misc_feature (1278)..(1278): n is a, c, g, or t
  misc_feature (1281)..(1283): n is a, c, g, or t
  misc_feature (1287)..(1289): n is a, c, g, or t
  misc_feature (1293)..(1293): n is a, c, g, or t
  misc_feature (1295)..(1295): n is a, c, g, or t
  misc_feature (1299)..(1299): n is a, c, g, or t
  misc_feature (1307)..(1307): n is a, c, g, or t
  misc_feature (1311)..(1311): n is a, c, g, or t
  misc_feature (1314)..(1316): n is a, c, g, or t
  misc_feature (1319)..(1319): n is a, c, g, or t
  misc_feature (1333)..(1338): n is a, c, g, or t
  misc_feature (1342)..(1351): n is a, c, g, or t
  misc_feature (1353)..(1354): n is a, c, g, or t
  misc_feature (1356)..(1357): n is a, c, g, or t
  misc_feature (1359)..(1361): n is a, c, g, or t
  misc_feature (1363)..(1364): n is a, c, g, or t
  misc_feature (1366)..(1366): n is a, c, g, or t
  misc_feature (1369)..(1369): n is a, c, g, or t
  misc_feature (1371)..(1371): n is a, c, g, or t
  misc_feature (1373)..(1378): n is a, c, g, or t
  misc_feature (1380)..(1380): n is a, c, g, or t
  misc_feature (1382)..(1382): n is a, c, g, or t
  misc_feature (1384)..(1384): n is a, c, g, or t
  misc_feature (1386)..(1389): n is a, c, g, or t
  misc_feature (1391)..(1391): n is a, c, g, or t
  misc_feature (1393)..(1393): n is a, c, g, or t
  misc_feature (1395)..(1396): n is a, c, g, or t
  misc_feature (1398)..(1401): n is a, c, g, or t
  misc_feature (1404)..(1405): n is a, c, g, or t
  misc_feature (1409)..(1409): n is a, c, g, or t
  misc_feature (1411)..(1412): n is a, c, g, or t
  misc_feature (1414)..(1415): n is a, c, g, or t
  misc_feature (1417)..(1417): n is a, c, g, or t
  misc_feature (1420)..(1420): n is a, c, g, or t
  misc_feature (1422)..(1422): n is a, c, g, or t
  misc_feature (1424)..(1424): n is a, c, g, or t
  misc_feature (1426)..(1426): n is a, c, g, or t
  misc_feature (1428)..(1428): n is a, c, g, or t
  misc_feature (1433)..(1434): n is a, c, g, or t
  misc_feature (1439)..(1440): n is a, c, g, or t
  misc_feature (1442)..(1444): n is a, c, g, or t
  misc_feature (1449)..(1453): n is a, c, g, or t
  misc_feature (1456)..(1456): n is a, c, g, or t
  misc_feature (1458)..(1459): n is a, c, g, or t
  misc_feature (1464)..(1465): n is a, c, g, or t
  misc_feature (1468)..(1468): n is a, c, g, or t
  misc_feature (1471)..(1471): n is a, c, g, or t
  misc_feature (1473)..(1473): n is a, c, g, or t
  misc_feature (1476)..(1476): n is a, c, g, or t
  misc_feature (1478)..(1479): n is a, c, g, or t
  misc_feature (1481)..(1482): n is a, c, g, or t
  misc_feature (1490)..(1490): n is a, c, g, or t
  misc_feature (1495)..(1496): n is a, c, g, or t
  misc_feature (1498)..(1498): n is a, c, g, or t
  misc_feature (1502)..(1502): n is a, c, g, or t
  misc_feature (1504)..(1504): n is a, c, g, or t
  misc_feature (1506)..(1507): n is a, c, g, or t
  misc_feature (1510)..(1510): n is a, c, g, or t
  misc_feature (1512)..(1512): n is a, c, g, or t
  misc_feature (1515)..(1515): n is a, c, g, or t
  misc_feature (1519)..(1520): n is a, c, g, or t
  misc_feature (1522)..(1523): n is a, c, g, or t
  misc_feature (1525)..(1528): n is a, c, g, or t
  misc_feature (1530)..(1530): n is a, c, g, or t
  misc_feature (1532)..(1532): n is a, c, g, or t
  misc_feature (1534)..(1534): n is a, c, g, or t
  misc_feature (1541)..(1542): n is a, c, g, or t
  misc_feature (1544)..(1547): n is a, c, g, or t
  misc_feature (1550)..(1550): n is a, c, g, or t
  misc_feature (1552)..(1552): n is a, c, g, or t
  misc_feature (1554)..(1555): n is a, c, g, or t
  misc_feature (1557)..(1557): n is a, c, g, or t
  misc_feature (1560)..(1560): n is a, c, g, or t
  misc_feature (1564)..(1565): n is a, c, g, or t
  misc_feature (1567)..(1567): n is a, c, g, or t
  misc_feature (1574)..(1578): n is a, c, g, or t
  misc_feature (1580)..(1580): n is a, c, g, or t
  misc_feature (1582)..(1583): n is a, c, g, or t
  misc_feature (1587)..(1587): n is a, c, g, or t
  misc_feature (1589)..(1589): n is a, c, g, or t
  misc_feature (1592)..(1598): n is a, c, g, or t
  misc_feature (1601)..(1604): n is a, c, g, or t
  misc_feature (1606)..(1606): n is a, c, g, or t
  misc_feature (1608)..(1608): n is a, c, g, or t
  misc_feature (1612)..(1612): n is a, c, g, or t
  misc_feature (1615)..(1615): n is a, c, g, or t
  misc_feature (1619)..(1619): n is a, c, g, or t
  misc_feature (1621)..(1622): n is a, c, g, or t
  misc_feature (1624)..(1624): n is a, c, g, or t
  misc_feature (1626)..(1627): n is a, c, g, or t
  misc_feature (1630)..(1630): n is a, c, g, or t
  misc_feature (1632)..(1632): n is a, c, g, or t
  misc_feature (1634)..(1634): n is a, c, g, or t
  misc_feature (1636)..(1637): n is a, c, g, or t
  misc_feature (1639)..(1639): n is a, c, g, or t
  misc_feature (1641)..(1642): n is a, c, g, or t
  misc_feature (1647)..(1647): n is a, c, g, or t
  misc_feature (1649)..(1649): n is a, c, g, or t
  misc_feature (1654)..(1657): n is a, c, g, or t
  misc_feature (1659)..(1665): n is a, c, g, or t
  misc_feature (1668)..(1669): n is a, c, g, or t
  misc_feature (1671)..(1671): n is a, c, g, or t
  misc_feature (1673)..(1673): n is a, c, g, or t
  misc_feature (1675)..(1675): n is a, c, g, or t
  misc_feature (1681)..(1684): n is a, c, g, or t
  misc_feature (1686)..(1689): n is a, c, g, or t
  misc_feature (1691)..(1692): n is a, c, g, or t
  misc_feature (1694)..(1694): n is a, c, g, or t
  misc_feature (1701)..(1702): n is a, c, g, or t
  misc_feature (1704)..(1705): n is a, c, g, or t
  misc_feature (1708)..(1709): n is a, c, g, or t
  misc_feature (1712)..(1712): n is a, c, g, or t
  misc_feature (1714)..(1717): n is a, c, g, or t
  misc_feature (1719)..(1719): n is a, c, g, or t
  misc_feature (1723)..(1723): n is a, c, g, or t
  misc_feature (1725)..(1726): n is a, c, g, or t
  misc_feature (1729)..(1730): n is a, c, g, or t
  misc_feature (1738)..(1739): n is a, c, g, or t
  misc_feature (1742)..(1742): n is a, c, g, or t
  misc_feature (1744)..(1744): n is a, c, g, or t
  misc_feature (1746)..(1746): n is a, c, g, or t
  misc_feature (1749)..(1749): n is a, c, g, or t
  misc_feature (1751)..(1751): n is a, c, g, or t
  misc_feature (1754)..(1754): n is a, c, g, or t
  misc_feature (1758)..(1758): n is a, c, g, or t
  misc_feature (1760)..(1763): n is a, c, g, or t
  misc_feature (1766)..(1769): n is a, c, g, or t
  misc_feature (1772)..(1773): n is a, c, g, or t
  misc_feature (1776)..(1778): n is a, c, g, or t
  misc_feature (1780)..(1781): n is a, c, g, or t
  misc_feature (1784)..(1784): n is a, c, g, or t
  misc_feature (1991)..(1991): n is a, c, g, or t
  misc_feature (1996)..(1996): n is a, c, g, or t
nnnntnaaannnnnnnnnnnnnnnnnnntnaaannnnnngggnnnnnggnntnggnnnnaannnnngnnttnnttnttnnaannnnnggnannnnnnnnaannnnnnnnnggnntnnnnnnnnggnnnaaancnnnnnnnnnnnncccnnaaaaaanaannnnannnnncccnnnccnnaaaccnnnnnngggnnttgggnnnnnnnttnnaaggnnnnnnnnnnnttnnnggnnaaggaannnggnaaaannnncccnnaanttngggnaaagggnncccccnnttngggggnnnnnnnnnanngnnnnnnnnnnnnnntttnnnaaaaaaaanggnnnnnnnnaannnaaannnnnnnnnnnnggnnnnnnnnnnnnccngnnnnngnnngnnnnnnnnnnnnnnnnnttttnnnnnnnnnnnntnnnnnnnnnnccccnnnaaanngggnnnnnnnnnnaannnnnnnnnnnnnnnnnaaannnnntnnngggnnnnnnnnnnnnnnnnnnnnnngnnnnnnnnnnnnnnnnnnnnnnnnnnnnnnnnnnnngnnaaantnnnnnnnnngnnnannnnnnnntnncccnnnnngggnnnaaaannccccnnnnncntttnnnnnnnnnnnnnntnnnncnnnnnnannnnnnnnnnnnnnnnnnnnggnnnnttnnnnnnggnnnnncnnngnnntnnggnnnnnnnnnnnaaannnnnncctttnnnttttnnggnnnnnnnnnnnnnannnnnnnannnnnnnnggnggnnnnttnnnnnggggngnnnnccncnaaaannnnannggngnnttnnaanggnncccnnannnngntngnnannnnnnnnnnnnnnnnanngnnnnangggnnntnnnnnnnnnnncnnnnannnnnnnnngnnnnnaannnnnnnnnnnnnnnncnggngntnccnnnngnanggncnnnnnnnnaangnnnaaangnnnnncngggnnnaanngnnnnnnnnccccnaannnnnnnnnnnnnnggggggnttngnnnccnnnnnnnngnnnnnnnnnnnccnggggnnggnaaaggncccaagggttgggnntttnccccnttaaangggnnnnnnnnnngggttnnaaannnnnnnnnnnnnttnggnnnnnnnnnnnnnggggnnttnaaaatttnnngggntttnnnnnnnnnnnnnngggnccnnnttnaannnnccnnnngnnncncnnnttntnccncnnggnnnntnnngggnnnnntntnngggnngggnanangcnnnaaannnatanangcgnaaaccccnccanaannngantttttttaaagggnnnnnnggannnnnnnnnntnnanngnnnanngntanangnnnnnnantntntnnnncngngnnannnnaanncccnanngnntngcncncncncnccccnngtttnngnnnggggnnnnncanannttttnnctnttntnttntnnanntttttttntaaanngngtgngnannttntnccncacnntnncnnnntntntnaaaaaanngnnnngtntntnngnggnaaanncnaaaaaannnnncnanntttnanggnnnnnnnggnnnngngncccnccntttncnntncnnaanangnanntnannctcancngcgcnnnngnnnnnnntanncnangngggagnnnngnnnntnncnttttttnnannccnnaanannnnantgtntnnggnntttttttnnccntntnccnanggnaatntnnnntannnncannttnnnanncanaaaaaaagggaacccaacgggttccctttaaaaagcaattactgatggtccagttagattctcggtaaatcgccttctccttttaatggtaagttagagctccccatgagatagctatctatatggtgtgcagcctgtcttccttctgcaatggcccaaacaatgagtgattgtccccttctttgatcgccagcagtaaaaacaccngctanattggttttatagttgtcctcagttgcagcaatatttgttctttgatccattgctacccccaactgttctgctactgtattctcagagcctgtaaagcccatggctaataaaaccatttctgccttccatattttctctgttccagctacttctaccaattttgaacgctgtcctgggctgtgctcccaatgtacctcaatggtttttaaacctgtgaggtttccattcgcgtctccaacaaattctttggtattaatgctaaagaaacgcgaggcaccttcttggtgagagctagttgtcttgagtcgcattggaaaaaatggccaaggctggttttctggtcgttcgctagtgcctttaggcataatttcaaagttagacacggtattagccccttgtctaatagaggttccaatacaatcagatcctgtatctcctccgccaattacaatgacatctttccctgtagctaaaatgtcttcattggtgtaggtctcttttcctacgcgtttattgctttgttttaaaaagtccatggcctgaaccaccccttttaggtctgctccaggaatatctaatgtccttcttatagttgcaccaccgcttagtaatacaacatcgtagtcttttttaagatcagctgcgtttaggtcttttcctatttcaattcctgttttaaaaacaatgccctcttcttctaatatagccaaacgtctgtctatgacatttttctccatcttaaaatctggtataccaaaccttaataatccgcctggtttagagtctctttcgtaaacggtcactaaatgccccgccctgtttaattgttgtgcagcagctagtccggcaggaccagatccaacaacagccactttttttccagttcttatggctggtttatgaggcacaacccagccttttgcaaaggctgtttctgctacgcttttttcaatattttctatagttactggatcttcattaatacccaatacacaggcttcttcacaaggtgcgggacacagccttcctgtaaattcaggaaagttgttggtggcgtgtaatatcttagctgccttttcccattttcctttgtaaacggcgtcattgaaatctggaatcaagtttcctaatggacacccactgtgacaaaatggtataccgcagttcatgcatcttgcaccctgatctttgaggtctttctcttctaaaggaaccgtaaattctttataattctttacgcgctcttctggcttttcgtaagattctacttttctgtcgaattctaaaaatcctgttatctttcccattttcctataaagtttgagcggtttctgctgctattctaactagtgcgagtcggtattcttctgggaatactttaatgaaatgccccagctgagactcccattgttctaatatttcttgagccctaggactttgtgtggcgtgatagtgattttctatcagtgtctttaattggtctatgtctgtctgatcttctacagccagtagatttaatccttcttctttacaaatagacttaaaggtcttattagggtcatagacataggcaattccaccactcatacctgcgccaaaatttcttcctactgccccgagtattaccgctgttcctccggtcatatactcacaaccatggtctccaataccctctactacagctatagctcctgagtttctcacacaaaaacgttcccctgctttaccgttaatataggcttctcctgccgtagcaccgtataaggtcacatttcctgtaatgacattgtcgtgcggaacaatagtagcttctacaggtactttcacgactaattttgccccagaaagtccttttccaaggtaatcgtttgtgtttccatacaccgtcatggttaaacctttggtggcaaatgcaccaaaactttgtcctgctgctcctgtaaaattaagtttcaaggtgttgtctggcattcctgctgcgccatattttttagatatctcat

SEQ ID NO: 1292 - DNA, 4000 bp, Escherichia coli
  misc_feature (579)..(579): n is a, c, g, or t
  misc_feature (1035)..(1035): n is a, c, g, or t
  misc_feature (1068)..(1068): n is a, c, g, or t
  misc_feature (1427)..(1427): n is a, c, g, or t
  misc_feature (1465)..(1465): n is a, c, g, or t
  misc_feature (1775)..(1775): n is a, c, g, or t
  misc_feature (1978)..(1978): n is a, c, g, or t
gagttctgtgactccaactgatattcatgcagtattccacgaaaccattgcacatcgactcgtatttaatcctgtttatgaaatgcgaagaactgtaattgctcgggatttaaccaatggcattttgaacgttattaaagcaccctaaacaagatgacacaagtaactccactatttgattaccacatcagttggaaatctaaaggcaagcatcctggtcgtcacaaaagtaaccaaagaggtatgggtattgagttcgccggttatacaacacttctctcatatccagatccaagaagaattgacattcgtcaatcaattcgagatcccttaggtgagatttacgtcaaaatgtttaatcagcgaagtgcaacacccgtcatgattgtgtgcgacttatctgccagtatgaattttggtgggaaaaataaaaaaattaatcttgcggccgaagtcgctcaatccattgcacattcagcgattgatcgtcatgatgctttagggcttgtaggttttgatgatgaaattagagaggattggttggcgcctatttcatttagatcacaacatgcaatgacnctcatcaatgaacttaaaaaatttacatcaacaaataaatcaaacagagcaatcaaagatctttatcaatacatgccgcgagagcgtgcgcttattttctttatttcagactttcatataccagaagttgatttggaaaattgcttatcgaatcttatgaggcatcatgtcgttcctatcgtgctatgggataagaaagaatatatcaacttacctaattttggtattgtgaccatcactgatcctgagagtggcaaaaaagatacactttttttaagaaaagaattgaaagaaaaaattatagattcatttgaaaaaagacgcgccgccattacaaaatcttttatgaattttgatattccacctttttttgtggacgaacatttcgatgccaataaaatgactgaatactttaatcaatttgtgggcgcctaagattatgaaataccttatttncctctggatacttttactttcaaccacgggctntgcgcttgatgctcaagaatggcctgatattgaagagggtatcgtctctatcaaaataaaagagcccctccagcaagtgggttacaccatcggtgataaaccttcaagatatatcgaaatcaccattaaaaagccttatgtactgattaaagagtctcttcctattccgggctacgaaagaaaataccaaggtcaagatttgggtattgttctagacaccatgaagcatgtaataaaagaaagtaacacatcaactacactaacacttgatctcacctaccaaatttttacaaataaggttgtcgttaagccaggatttctaccctctgaatatattcgactcttaaaccctaataatnctaaaaaacaagtatttaaatatagaattccggagcgncgcatcgcaatctctcctctttctattttcggcaatgttaaaattgaagaagatatgagcccgttaagaggtgtttttttaatggatgaagaagcttctattaaaattctaaaaatttctggcatcatcgcacttctcgcatttatcggccttatttatatttatagtcaatatgcttggctacctaataagagaggtgtatttgcaagaacacatcgtacgattgtaaagctgaaagctacccctgcttctgttcaaaaagccataactgatatgcatcatgctttcgatcttgtgacaggaaaaatantttttaaagacaatctttctgatctttatataaaaaatacttcatttgaaaatattgactcagaacttcgtgagttctttaaactttcaacactcgtattttttaacgcctcatctaaaaaatatgatcacgaagaaatactcaaatggcttaaaaatttctcgagacattgtcgagattgtgaaagaaaacttatcgtcganaaaagtgcactcgtggtaggggttgctaaatgacattttcatttccatgggtcttatggtttatgcctttagcatttattccacttatttttaaagagacttctcttcaatattattcatggaacgaaatgattccaaaagatcgtctctcaagcatcattgcaatcattttaaaatttatcgccacgcttattttaatcatgattattataggattaagtggtccgcattcacgtcaaaaagaaattgaaaaaacaggtataggtgcccaaattggtcttgtgctagatcgaagtgctagtatggatgacccttttgctgggaatgatcaaacaaaagtaggagaaattaaatctgctgctgctgcaagacttattattgaattcgttcaatctagagcaaatgatatgattgggatggttacttttagtaactctgcgatgtatgttttaccattgactgacaataaaaatgcgattatttctgcggtcagagccacagctggtaatgcattatttcaaactaatataggcagtggacttacgacaggtgcagaattgtttaataaagtgcctgactcaggctcaagggccgtgattttactttcagatggtggcggtcgcattgacgctgcgacgcaagaaaaaattaaagattggtttggccgatttaaaattagtctctattggatcgtattaaggcagcctggtggtatcagtatttttaatacatcattcaaaccaaaagatgatgatcctttgccccctcaaattgagttaaatgaattctttaagacacttccttcgtctttccaggcatacgaagctgaagaccctaaaacactccaaaaagcgattgaagatattaatcaaaaagaaaagaaaccaattaaatatttcgaaaaaattcctgggcaggattattcaacccattgctttgtaacggcagctcttttgatgattgctttgctgacgcttaaattgatagaggttaagtcatggctttaataacaaaaaatatttttagcaccaaaaaacttacttggctttttgtcatgctcctcatagcttctctcggtatatttattaagcaatttatcgaactaaaaaatattcaagtgtttaatcaaaatattaaggaaggcaaatcgcctcgcatgtttctaaatagttttgaagcacgctatgcaactgcctactggctcaccactaaagaaagatataaagaggcaagccttcttttttcaaatcttttacctgttgcatcaccatcacaaaaagcagcgattcactacaatactggtaacattttctttaagcgcgcattagctattaatggcacagatatgactgtaaaaaatgaaactgaatatttatttagacaagcaaaagccgcttatatgctctctattaaaatagataatcatgcgtgggatgtgaaacataatctcgatcgcgtcctgatgatacttcctgctaatccagctccaggtgttggcgactccgaatcacctggacttattttgggtaatattcctgtaggcttgccttagacttatgaaagagtggctgaagacaatacaatcgagatcaaatctcgatttggacaccctctcacttatattatcgatcggattgatagtgctagctattatcaatccatcgataccgcttaaacataatatttataactatgtgtttgtggctgacatctctcaaagtatgaacacaatagatatgtccgttatgaataaacccttaacaagactcgagcacatgaagcatagtcttcatgaaattatgtctgaactcccctgtggcacgaaggtaagtattggaatttttgttggtgtcagtgtttcagcatcttataccccaattgaaatctgtgaaaattttgatgccattgaagataccatcgatcatttagattggcggtcgggctggtctggcaattctcgtataagagaatcttttttcaatctagcccgcctcattagaagtttccctgaaaactctcaag

SEQ ID NO: 1293 - DNA, 4000 bp, Escherichia coli
  misc_feature (1)..(2): n is a, c, g, or t
  misc_feature (4)..(6): n is a, c, g, or t
  misc_feature (8)..(11): n is a, c, g, or t
  misc_feature (13)..(17): n is a, c, g, or t
  misc_feature (19)..(20): n is a, c, g, or t
  misc_feature (23)..(23): n is a, c, g, or t
  misc_feature (26)..(31): n is a, c, g, or t
  misc_feature (33)..(34): n is a, c, g, or t
  misc_feature (36)..(36): n is a, c, g, or t
  misc_feature (38)..(38): n is a, c, g, or t
  misc_feature (40)..(48): n is a, c, g, or t
  misc_feature (50)..(51): n is a, c, g, or t
  misc_feature (54)..(55): n is a, c, g, or t
  misc_feature (57)..(65): n is a, c, g, or t
  misc_feature (67)..(67): n is a, c, g, or t
  misc_feature (69)..(69): n is a, c, g, or t
  misc_feature (73)..(79): n is a, c, g, or t
  misc_feature (82)..(83): n is a, c, g, or t
  misc_feature (86)..(86): n is a, c, g, or t
  misc_feature (90)..(91): n is a, c, g, or t
  misc_feature (94)..(95): n is a, c, g, or t
  misc_feature (97)..(97): n is a, c, g, or t
  misc_feature (99)..(102): n is a, c, g, or t
  misc_feature (104)..(107): n is a, c, g, or t
  misc_feature (110)..(114): n is a, c, g, or t
  misc_feature (116)..(118): n is a, c, g, or t
  misc_feature (120)..(120): n is a, c, g, or t
  misc_feature (122)..(125): n is a, c, g, or t
  misc_feature (127)..(133): n is a, c, g, or t
  misc_feature (136)..(138): n is a, c, g, or t
  misc_feature (140)..(140): n is a, c, g, or t
  misc_feature (142)..(145): n is a, c, g, or t
  misc_feature (147)..(147): n is a, c, g, or t
  misc_feature (149)..(149): n is a, c, g, or t
  misc_feature (151)..(152): n is a, c, g, or t
  misc_feature (154)..(156): n is a, c, g, or t
  misc_feature (159)..(159): n is a, c, g, or t
  misc_feature (161)..(161): n is a, c, g, or t
  misc_feature (163)..(163): n is a, c, g, or t
  misc_feature (166)..(167): n is a, c, g, or t
  misc_feature (169)..(169): n is a, c, g, or t
  misc_feature (171)..(184): n is a, c, g, or t
  misc_feature (186)..(192): n is a, c, g, or t
  misc_feature (194)..(195): n is a, c, g, or t
  misc_feature (198)..(203): n is a, c, g, or t
  misc_feature (205)..(206): n is a, c, g, or t
  misc_feature (208)..(215): n is a, c, g, or t
  misc_feature (217)..(228): n is a, c, g, or t
  misc_feature (230)..(234): n is a, c, g, or t
  misc_feature (236)..(240): n is a, c, g, or t
  misc_feature (244)..(246): n is a, c, g, or t
  misc_feature (248)..(249): n is a, c, g, or t
  misc_feature (251)..(252): n is a, c, g, or t
  misc_feature (254)..(257): n is a, c, g, or t
  misc_feature (259)..(261): n is a, c, g, or t
  misc_feature (264)..(266): n is a, c, g, or t
  misc_feature (269)..(272): n is a, c, g, or t
  misc_feature (274)..(279): n is a, c, g, or t
  misc_feature (281)..(283): n is a, c, g, or t
  misc_feature (285)..(287): n is a, c, g, or t
  misc_feature (290)..(292): n is a, c, g, or t
  misc_feature (297)..(297): n is a, c, g, or t
  misc_feature (301)..(301): n is a, c, g, or t
  misc_feature (306)..(308): n is a, c, g, or t
  misc_feature (310)..(310): n is a, c, g, or t
  misc_feature (313)..(313): n is a, c, g, or t
  misc_feature (317)..(322): n is a, c, g, or t
  misc_feature (325)..(325): n is a, c, g, or t
  misc_feature (329)..(332): n is a, c, g, or t
  misc_feature (335)..(336): n is a, c, g, or t
  misc_feature (338)..(342): n is a, c, g, or t
  misc_feature (344)..(344): n is a, c, g, or t
  misc_feature (346)..(346): n is a, c, g, or t
  misc_feature (348)..(350): n is a, c, g, or t
  misc_feature (354)..(361): n is a, c, g, or t
  misc_feature (365)..(366): n is a, c, g, or t
  misc_feature (368)..(369): n is a, c, g, or t
  misc_feature (371)..(371): n is a, c, g, or t
  misc_feature (373)..(375): n is a, c, g, or t
  misc_feature (377)..(378): n is a, c, g, or t
  misc_feature (382)..(383): n is a, c, g, or t
  misc_feature (386)..(388): n is a, c, g, or t
  misc_feature (390)..(390): n is a, c, g, or t
  misc_feature (395)..(395): n is a, c, g, or t
  misc_feature (397)..(398): n is a, c, g, or t
  misc_feature (400)..(400): n is a, c, g, or t
  misc_feature (402)..(403): n is a, c, g, or t
  misc_feature (405)..(407): n is a, c, g, or t
  misc_feature (409)..(414): n is a, c, g, or t
  misc_feature (416)..(418): n is a, c, g, or t
  misc_feature (420)..(422): n is a, c, g, or t
  misc_feature (425)..(426): n is a, c, g, or t
  misc_feature (429)..(431): n is a, c, g, or t
  misc_feature (433)..(437): n is a, c, g, or t
  misc_feature (439)..(439): n is a, c, g, or t
  misc_feature (441)..(441): n is a, c, g, or t
  misc_feature (444)..(444): n is a, c, g, or t
  misc_feature (446)..(447): n is a, c, g, or t
  misc_feature (450)..(451): n is a, c, g, or t
  misc_feature (456)..(458): n is a, c, g, or t
  misc_feature (460)..(467): n is a, c, g, or t
  misc_feature (469)..(469): n is a, c, g, or t
  misc_feature (472)..(472): n is a, c, g, or t
  misc_feature (475)..(476): n is a, c, g, or t
  misc_feature (478)..(478): n is a, c, g, or t
  misc_feature (481)..(482): n is a, c, g, or t
  misc_feature (484)..(484): n is a, c, g, or t
  misc_feature (487)..(488): n is a, c, g, or t
  misc_feature (490)..(490): n is a, c, g, or t
  misc_feature (493)..(495): n is a, c, g, or t
  misc_feature (497)..(498): n is a, c, g, or t
  misc_feature (500)..(501): n is a, c, g, or t
  misc_feature (504)..(505): n is a, c, g, or t
  misc_feature (507)..(514): n is a, c, g, or t
  misc_feature (517)..(517): n is a, c, g, or t
  misc_feature (519)..(520): n is a, c, g, or t
  misc_feature (527)..(527): n is a, c, g, or t
  misc_feature (529)..(530): n is a, c, g, or t
  misc_feature (534)..(534): n is a, c, g, or t
  misc_feature (536)..(537): n is a, c, g, or t
  misc_feature (544)..(548): n is a, c, g, or t
  misc_feature (550)..(554): n is a, c, g, or t
  misc_feature (556)..(556): n is a, c, g, or t
  misc_feature (558)..(559): n is a, c, g, or t
  misc_feature (561)..(565): n is a, c, g, or t
  misc_feature (567)..(568): n is a, c, g, or t
  misc_feature (570)..(570): n is a, c, g, or t
  misc_feature (572)..(573): n is a, c, g, or t
  misc_feature (576)..(576): n is a, c, g, or t
  misc_feature (580)..(580): n is a, c, g, or t
  misc_feature (582)..(583): n is a, c, g, or t
  misc_feature (585)..(585): n is a, c, g, or t
  misc_feature (587)..(591): n is a, c, g, or t
  misc_feature (594)..(595): n is a, c, g, or t
  misc_feature (597)..(597): n is a, c, g, or t
  misc_feature (599)..(602): n is a, c, g, or t
  misc_feature (605)..(605): n is a, c, g, or t
  misc_feature (608)..(617): n is a, c, g, or t
  misc_feature (619)..(622): n is a, c, g, or t
  misc_feature (624)..(626): n is a, c, g, or t
  misc_feature (628)..(634): n is a, c, g, or t
  misc_feature (636)..(637): n is a, c, g, or t
  misc_feature (643)..(644): n is a, c, g, or t
  misc_feature (647)..(647): n is a, c, g, or t
  misc_feature (649)..(654): n is a, c, g, or t
  misc_feature (656)..(656): n is a, c, g, or t
  misc_feature (658)..(663): n is a, c, g, or t
  misc_feature (665)..(666): n is a, c, g, or t
  misc_feature (668)..(670): n is a, c, g, or t
  misc_feature (677)..(677): n is a, c, g, or t
  misc_feature (679)..(684): n is a, c, g, or t
  misc_feature (686)..(687): n is a, c, g, or t
  misc_feature (690)..(690): n is a, c, g, or t
  misc_feature (695)..(698): n is a, c, g, or t
  misc_feature (700)..(700): n is a, c, g, or t
  misc_feature (703)..(704): n is a, c, g, or t
  misc_feature (706)..(707): n is a, c, g, or t
  misc_feature (710)..(710): n is a, c, g, or t
  misc_feature (712)..(722): n is a, c, g, or t
  misc_feature (725)..(727): n is a, c, g, or t
  misc_feature (730)..(736): n is a, c, g, or t
  misc_feature (738)..(741): n is a, c, g, or t
  misc_feature (743)..(743): n is a, c, g, or t
  misc_feature (745)..(746): n is a, c, g, or t
  misc_feature (748)..(760): n is a, c, g, or t
  misc_feature (763)..(766): n is a, c, g, or t
  misc_feature (768)..(771): n is a, c, g, or t
  misc_feature (773)..(773): n is a, c, g, or t
  misc_feature (776)..(781): n is a, c, g, or t
  misc_feature (783)..(783): n is a, c, g, or t
  misc_feature (786)..(791): n is a, c, g, or t
  misc_feature (793)..(793): n is a, c, g, or t
  misc_feature (796)..(800): n is a, c, g, or t
  misc_feature (804)..(810): n is a, c, g, or t
  misc_feature (812)..(812): n is a, c, g, or t
  misc_feature (815)..(819): n is a, c, g, or t
  misc_feature (822)..(823): n is a, c, g, or t
  misc_feature (825)..(826): n is a, c, g, or t
  misc_feature (829)..(830): n is a, c, g, or t
  misc_feature (832)..(838): n is a, c, g, or t
  misc_feature (840)..(843): n is a, c, g, or t
  misc_feature (845)..(846): n is a, c, g, or t
  misc_feature (848)..(848): n is a, c, g, or t
  misc_feature (850)..(850): n is a, c, g, or t
  misc_feature (852)..(855): n is a, c, g, or t
  misc_feature (857)..(858): n is a, c, g, or t
  misc_feature (860)..(861): n is a, c, g, or t
  misc_feature (863)..(863): n is a, c, g, or t
  misc_feature (866)..(871): n is a, c, g, or t
  misc_feature (873)..(873): n is a, c, g, or t
  misc_feature (875)..(875): n is a, c, g, or t
  misc_feature (877)..(877): n is a, c, g, or t
  misc_feature (879)..(879): n is a, c, g, or t
  misc_feature (882)..(883): n is a, c, g, or t
  misc_feature (888)..(888): n is a, c, g, or t
  misc_feature (890)..(890): n is a, c, g, or t
  misc_feature (892)..(892): n is a, c, g, or t
  misc_feature (894)..(901): n is a, c, g, or t
  misc_feature (906)..(906): n is a, c, g, or t
  misc_feature (908)..(908): n is a, c, g, or t
  misc_feature (912)..(912): n is a, c, g, or t
  misc_feature (915)..(915): n is a, c, g, or t
  misc_feature (918)..(918): n is a, c, g, or t
  misc_feature (920)..(922): n is a, c, g, or t
  misc_feature (925)..(930): n is a, c, g, or t
  misc_feature (932)..(934): n is a, c, g, or t
  misc_feature (936)..(937): n is a, c, g, or t
  misc_feature (940)..(941): n is a, c, g, or t
  misc_feature (943)..(943): n is a, c, g, or t
  misc_feature (945)..(945): n is a, c, g, or t
  misc_feature (947)..(947): n is a, c, g, or t
  misc_feature (949)..(953): n is a, c, g, or t
  misc_feature (955)..(955): n is a, c, g, or t
  misc_feature (957)..(958): n is a, c, g, or t
  misc_feature (961)..(965): n is a, c, g, or t
  misc_feature (968)..(976): n is a, c, g, or t
  misc_feature (978)..(980): n is a, c, g, or t
  misc_feature (983)..(987): n is a, c, g, or t
  misc_feature (989)..(993): n is a, c, g, or t
  misc_feature (995)..(997): n is a, c, g, or t
  misc_feature (999)..(999): n is a, c, g, or t
  misc_feature (1015)..(1015): n is a, c, g, or t
  misc_feature (1079)..(1079): n is a, c, g, or t
  misc_feature (1107)..(1107): n is a, c, g, or t
  misc_feature (1165)..(1165): n is a, c, g, or t
  misc_feature (1366)..(1366): n is a, c, g, or t
  misc_feature (1459)..(1459): n is a, c, g, or t
  misc_feature (1660)..(1660): n is a, c, g, or t
  misc_feature (1843)..(1843): n is a, c, g, or t
  misc_feature (1859)..(1860): n is a, c, g, or t
  misc_feature (1985)..(1985): n is a, c, g, or t
  misc_feature (1994)..(1994): n is a, c, g, or t
  misc_feature (2008)..(2008): n is a, c, g, or t
  misc_feature (3279)..(3279): n is a, c, g, or t
nntnnngnnnncnnnnngnnttncgnnnnnncnncngngnnnnnnnnncnnganngnnnnnnnnnanancaannnnnnntcnnacngccnnctnncnannnngnnnnccnnnnntnnngngnnnncnnnnnnnccnnnanannnngntncnngnnnatncntnggnncngnnnnnnnnnnnnnnannnnnnncnncannnnnnanngnnnnnnnntnnnnnnnnnnnncnnnnngnnnnngccnnntnntnngnnnngnnntannngannnngnnnnnngnnngnnncgnnnttttntttnccgannngnggnttgnnnnnnggntttnnnnctnntnnnnntncnannnatannnnnnnnttannannangnnngnnttgnngannnanaaggngnncngnngnnntnnnnnngnnntnnncgnngcnnngnnnnngntngantnngannagtgnnntnnnnnnnntntcnccnntnccnntncgnncnttnnngnncnnttnngnnnnnnnngtntnncctcgcngnngacncnngcggtgnnnnnannnnngnanngnnnnngnntnanngtngttncnntntnnnnnttnntngnnnnttntannnnnnnnnntnnnnannngnnnnnnntnnttgcgnncangnnnnnngngnnnnnncnntnnnccgtttncnnnnnnannttngtttnnnngnagnnanngtncnnnnnnnnnnngtnnnggnnnnnnntnnnntntnngnnnnnnnnnnnnntgnnnnannnngnatnnnnnngngcnnnnnngnatnnnnnccgnnnnnnncnggnnnnnaannanncgnnannnnnnntnnnngnnantngnnnnannanntngtnnnnnncngngnantannaggancnanannnnnnnnattgncngaanaancantnnnttnnnnnntnnnannagnngngntngnnnnntngnngannnnngcnnnnnnnnntnnnatnnnnntnnnnngnnncnggggttcgaatccccntctctccgcaaacgaccgggaggtcggctgggttgcaaacgatattcgtttgcaacctttttgnttttcggaggcaacgaatttattcggancgtttcgggatcgtccgtagtgcggacggccgacggccgggtattggcagggatatgnggctcttcggtcggtcgcgggaaggcgggccgcaactcgatctttgtcttgtctgtcggaagttgggaaaagttattatccggggtttcgaaatcgactacccggtgacggacgagatgtttgcccggccggaatagcgtttttttagctggtgcgggtatcggcgttgtgaagattcgtgttaaagaaaaaagcctccgntcgaacggaggcttttttcttgcaggcggaaggatctacttcgtagaagcggctctcttctccttgatacgggctttcttacccgtcaggttncgcaggtagtagatgcgtgcgcgacgaaccacgccctgcttgtttacctcgatgctctcgatgtggggcgaatagagggggaagatacgctcgacgccgatgccgttggagatcttgcggatcgtgaacatcttggtcttgcccgtacccttgatctggataactacgccgcggaagctctgcaggcgctccttgttaccntcgacgatcttgtacgtaacggtgatcgtatcaccggcctggaacgacggaacatccgtcttggtccacatctgctcgttgacgagccggattactgcatccttgttcattgttgcaacaatttttttgatgatttctgcgttcaacattatcgctgtgtttgcctaccatgcagggatcttnctctgcaatcctccgnnaatcaacggattgatgttcccggtcgtggcttcgcacccaatataagaggttgatacggtccgcaaatatagaaactttttcccaaacgggcaatcggctgtctaaaaaatagatgactccgcanccggaccgnttgtgcggcgatgncggctgcggcgggtgtgggaggtgaacgggtttcatcttgaatcgtgtcgggaggtgcggattgcttcgacgggcggtgcgtatggatggctctcgaactttgaggcacatggtttgcggttagtctgcaactccctgccccgatcctttttgtttacaatggaattttccgacgggatcggcatgcggggaatttcccgggtgcagggaaggaagtatgtatgttgtatggaatatgggaggcggttcggacattcttttcgaacgagttcgacgaatgtcgcccgccttttcgtatatttgtcactaaaatcggagaaaaatatgatgaaagagaagttggtattcgtcaccaacgacgacggttacaattcaagaggtattcaggcgctccttgaggtcgcacgcaagttcggccgggtggtcgccattgcccccgaaacgccgcagagcggtatgagtcaggcgataacgatcaataatccgcttttcctgcgcgaagtgtcgaaaggcgacggtgtggaggtttatgctttttcgggaaccccggtcgattgcgtgaagatcgctttcgactactttctcaagggccgcaaggtcgatctggcgctttcggggatcaatcacggctcgaattcggcggccaatatcctctattcgggtacgatgggcggtgcgatcgagagcagtttctacggttgtcctgccatcgggctttcgctggacgatcacagtctggaggcggatttcgaagccgcgaagatttacagcgagcgcatcgtgcgtgcggtggtcgaggccaatccccccacgccgttctgtttgaatgtcaatatacccaagggacggcccgaagcggtgaagggtattcgggtgtgccgccagaacaaagggtattggcgcgaggagtttttccgtcgccacgatcctcggggccgggagtatttctggctgacgggtgcgttcgtcaatagcgaacccgaatcgaccgatacggacgagtgggcattggcgaacggctatgtttcggtggttcccgtgcagacggatatgaccgactatgcgcagatggctccgctggagcggatactcggataggatttatcggaccggaggctggtgccggagattgggcgatcctgttttgcggcggaagctgcccggggcgtaattccggatttcggtccgaagtcggaattgccggagtcgcaggaatgtgccgaggcgattttcgttcgtttcgaggtgaatagagggtgtttgaaccggcngtccgaaaataaattttcaattactcccgtcttttcctatatttgtattcgtgaagacgggaagcggttcgggccggtgcgtcggagcggaagaattcgaattttagcggaatattcaatatgctgatcaaaattttactcatcgtggccatcgtcatccagacgatcgcgactctgttcgccatccgtttgatccgtacgaccaagtacaattcgatctggattctgttcaccatcggatttacgctcctttccgtcgaacgggtcgtgcaattcctgcgtgccaacggtcagacgctgccttatgaggtgttcgtctggttgggactggtcatttcgatcagtatgtcgatcggcgtgatgtatgcccataagcttttcaagtacatcgcccggctcaaccgccagcggcagttgctcaacaagcgcatcctgacggccgtgctgcgcaccgaggagaaatcgcggtcgcgtttcgcgaaggatttgcacgacgggctggggccgttgctctcgtcggcccgtatgtcgctgtcggccctgcaacgggagtcgctgccggccgatcagcaggagatcatcggtaatacgacttatgtgatcgacgaggcgatccgctcgctgcgggaaatttcgaacaacctttcgccgcatgtgctcaacgatttcggcctggcgcggggcatccagaacttcgtgggaaagagttcggcgatgcacg

SEQ ID NO: 1294 - DNA, 4000 bp, Escherichia coli
  misc_feature (2298)..(2298): n is a, c, g, or t
gtgacgccgatcgcctcgccatcggcctgggcgaggtgcttgccgatgcggctgagccttgtgtccgtggtcacgactttcatgtcgtcggcatcgtagagcggcttgcggtcgatcgcgatcaggatcggcaccggcgcggccgtcagcaggtcgccgagcacgccgtcctcgaacagcacgtcgccgttgagcaggagggtcgaatcgtcggtgaaatggtcgcgcgcggcgtggcaactcgcgagattgtctgtcgtcgcatggtcgaggtttcgcacgctcaggacacccggccgcgcggcgaggtgcgcctccaccgtctcggcggcgtggccggtgacgaccgcgacctcatgcacgccggcgcgggccagcgcatcgagctgtcgatcgaggatggcgcggccaccgaccggcaacaggcatttcggccgctggtcggtgagcggcgccagccgcgcgccgcgtccggcggcgaggatgacggcgctcagcaccatgactcggggccgccatgcgcgggccaaccatgacaggacggagcgcggtggctacagtgccgcctcgtcgcgatgccgcccgattcctcagccgagtctcgacccggcatggccacccccgactccgaaccgacctccgccgtcgcggctgacgagcgactgacatattggtcgccgttgcgcattccggcgttccgtcggctgtggtgcggcaacgtgctctccaatatcggcggttggatgcagaccgccggcgccggctgggtgatgaccgagctggcgccgcacgaccaccgcgagatgttcgtggcgctgctggcggcggctggcacctgtcctgtgttcctgttcggcttcctcgccggcgtgctcgccgaccgcttcgaccggcgcaaatacctgatcgtcacgcagctgtggatgatgctggcgtcggccgtgctggcggtgctggcgttcaccgggctcttgagcgcctggaacctgatcgcggtgatgttctgcatgggcatcggtaacgccatgaacgggcctgtctggcacgccgtcgtgcctgaaatggtcggccgacgctacctgcccggcgcggtggcgctcaacagcgccggcttcaatttcggccgcaccattggcccggtgatcggccagatcctgcagggcgtggccgggaccttcgcgctcttcgccatcaacgccgccaccttcgccggcgttatcttcgccgtgttcacctggaagcggccacccgaggccagcgccgcgcagcgccgcgagggcttcatcgccgccttcggcagcggcatccagttcatccgcgccacgcccgcgctgtgggcgatctgggcgcgcgcggtgtgcttcttcatcccctcctgcgccttcgccaccttgctgccgctcaccggccgcgatcgcctccagctcgacgccgccgagtatggcgtgctgttctccagcttcggcgtcggcgcggtgctgggtaccatgctgatcccgcggctcaacagatggttcggctcggaccgcgccaacctcgtggcgatgctggcggtcgccttcggcatggggatctcggcgatgatcgccaacgccatcgtcgtcgggctggcgctggcgctggccggcggctgctggatgatcgtcaacgccaacaacaacgtcgccacccagcaccatctgccgtcctgggtgcgcgcccgcggcatggcggtgcaccagctcgtcttcttcggcagcctggccgtgggccagacggcgtggggcgtcgtcgcctcgcaggtcggcaccgcctgggcgctcgcctgcgccgccttcctgctcgtggtgctgaccggagtcgccgcggcgatccgcctgccggccgccggcgcgccgcccggcggcggctgagcggacgagtgtggcgaacgcgccacgctggacacagaaatttacggatgtgagtcgattctcacttgcgtcgtggcgcaatcggcgtatctacattccttagacgcccacgcacgtgcctatggcccattagtggttatgcaacgacggaaagcgtccttcttggaaatgccggcaatagaccggcgccgaaagggacctttgtcatgcatacgatccgtgcggggcggaagcacccgcccattgtcggactgaccttcacgctcgagccctcgggctacggcctgttgttcggtcggaagaaccctctctcgagtatgtgccgctcccggtagcgcatccccagggatgacccgggagtgttggtccgtcgtgttccggcgcctggcgccgcgacgcggtcctncgcaccccgtttgaggctggttctttcgaaatgaccgaccgtatccgacgtttcctcgccgacaagcaacccgagaccccctgcctggtggtcgatctcgacgtggtggagttcaactaccgccgcatgcgcgagctgttgccgcaggcgaagatcttctacgccatgaaggcgaacccggcgaacgaggtgctcgcgcgcctgggcaagctcggctcgaacttcgacaccgcctcgcgcggcgagatcgagctgtgcttcgcgcagggcgtcggcgccgagcgcatctccttcggcaatacgatcaagaaggagaaggacatcgcctgggcgcaccagaacggcgtgcgcctgtacgccttcgacagcgaggcggagctgcagaagctcgcccgctcggcgccgggcgcacgcgtgttctgccgcgtgctggtcgattgcgacggtgcggagtggccgctgtcgaaaaagttcggctgcgcgcccgacatggcgcgcgacctgctgaaacgcgccaacgacatgggcctggaggcctacggcgtctccttccatgtcggctctcagcagaccgacctcgaccagtgggaccgcgcgctcgcgcaggtctcgcagatgttctacgcgctcgccgagaccggcatcgacctgaagatggtcaatctcggcggcggcttccccgcgcgctaccgcaaggacgtggcgccggtcgaggcctattgcgaggcggtgcagcgcgcgctggtgcggcacttcggcaaccgcatgcccgaggtgatcatcgagccgggccgctcgatggtcggcgacgccggcgtgcttcagagcgaggtggtgctgatctcgcgcaagtcggccaacgaccgcaagcgctgggtctatctcgacgtcggcaagttcggcggcctggccgagacgatggacgagagcatcaagtaccgcatcaccacgccgtacccggcgggcggccgctcgggcccggtggtgctcgccggcccgacctgcgacagcgccgacatcctgtacgagaagaccgagtacaagatgccgctggcgctgaaggtgggcgacaaggtcgagatcctctcgaccggcgcctacaccaccacctacgcgtcggtggcgttcaacggcttcgcgcctttgaagacctactgcatctaatccagtagcccacacggtctgcgacgacggggccttgaaaaaggccccgtcggcgtttcagtttccccgcccacccgctatttccggagaccttcgatggccgctccccgcaagtcgaagaaggaggtcgcgttcggcggccgcatggtgatgatcggcttcggctcgatcggccagggcgtgatgccgctgatcctgcgccatatcgccatcaagccgaagcagatcacggtgatctcggccgaggatcgcggcggcctgcccgagctcgagaagtacggcatcaccttcatccgcaagcggctgacgcgcgccaactaccgctcggagctatcgaagctggtgagcaagggcgacttcatcgtcaacctgtcggtcgaggtcgcctcgacggcgctgatcgagttcgcccaggagaagggcgcgctttacatcgacacctgcatcgagccgtggccgggcggctataccgaccccaacctctcggtctcgcagcgctcgaactacgcgctgcgcgaggcggcgctgaagctgcgcc

SEQ ID NO: 1295 - DNA, 4000 bp, Escherichia coli
  misc_feature (53)..(54): n is a, c, g, or t
  misc_feature (98)..(98): n is a, c, g, or t
  misc_feature (104)..(104): n is a, c, g, or t
  misc_feature (134)..(134): n is a, c, g, or t
  misc_feature (143)..(143): n is a, c, g, or t
  misc_feature (153)..(153): n is a, c, g, or t
  misc_feature (288)..(288): n is a, c, g, or t
  misc_feature (294)..(294): n is a, c, g, or t
  misc_feature (303)..(303): n is a, c, g, or t
  misc_feature (327)..(327): n is a, c, g, or t
  misc_feature (546)..(546): n is a, c, g, or t
  misc_feature (568)..(568): n is a, c, g, or t
  misc_feature (657)..(657): n is a, c, g, or t
  misc_feature (744)..(744): n is a, c, g, or t
  misc_feature (750)..(750): n is a, c, g, or t
  misc_feature (1137)..(1137): n is a, c, g, or t
  misc_feature (1155)..(1155): n is a, c, g, or t
  misc_feature (1166)..(1166): n is a, c, g, or t
  misc_feature (1172)..(1172): n is a, c, g, or t
  misc_feature (1182)..(1182): n is a, c, g, or t
  misc_feature (1245)..(1245): n is a, c, g, or t
  misc_feature (1314)..(1314): n is a, c, g, or t
  misc_feature (1674)..(1674): n is a, c, g, or t
  misc_feature (1954)..(1954): n is a, c, g, or t
  misc_feature (1985)..(1986): n is a, c, g, or t
  misc_feature (2033)..(2033): n is a, c, g, or t
  misc_feature (2036)..(2036): n is a, c, g, or t
  misc_feature (2072)..(2072): n is a, c, g, or t
  misc_feature (2180)..(2180): n is a, c, g, or t
  misc_feature (2267)..(2267): n is a, c, g, or t
  misc_feature (2312)..(2312): n is a, c, g, or t
  misc_feature (2327)..(2327): n is a, c, g, or t
  misc_feature (2342)..(2342): n is a, c, g, or t
  misc_feature (2485)..(2485): n is a, c, g, or t
  misc_feature (2561)..(2561): n is a, c, g, or t
  misc_feature (2633)..(2633): n is a, c, g, or t
  misc_feature (2642)..(2642): n is a, c, g, or t
  misc_feature (2863)..(2863): n is a, c, g, or t
  misc_feature (3212)..(3212): n is a, c, g, or t
  misc_feature (3287)..(3287): n is a, c, g, or t
  misc_feature (3303)..(3303): n is a, c, g, or t
  misc_feature (3323)..(3323): n is a, c, g, or t
  misc_feature (3665)..(3665): n is a, c, g, or t
  misc_feature (3731)..(3731): n is a, c, g, or t
  misc_feature (3740)..(3740): n is a, c, g, or t
  misc_feature (3945)..(3945): n is a, c, g, or t
tgatttttattcaagagggtgattacgtaaaaatgtcattgcgctctaaaggnnctaccgatgtaaatcgtttggcacgcgagcatttcaacggtggnggacanatcaatgcggcaggcggcagatatgatggnactatagangaagcagtancctacttcagaagtgtacttcctgatttcatacaaaagaacagttaataaaacgatgaatatactaaaaaaaataggcctcctaagtgcccttggcatagttttggtaggttgtgctgaccgacaagcacgccancctgtnagtaagaanactagcactttcttgaaagaatcngctgtaaagaacaaagccctcttagcaaaagagcaagcgctgatagacgatatcatcaaaaaggatacactacatactttcttagactctcagcacggatttaagttttactacctacaccaaaaccctgaagctgattacacagcacagtttggcgatatagtaacttatgactatagcctgtcagacctaaatggcaatgagctgtaccaagaaaancccgatggcgaataccgctatnacgtagataaagaagaggttttccaaggcttgcgctcagctctcaaactattaaaagagaaagaaagcggggtgttcttttttccgtcnagtgtggcgtatggctatcgaggcgataaagataaaataagctataaccagcctattatagccaaaatagaggtttttaaaataganaagaanccagagaaggtattacctcgccctgaataagtaattttatttaaataagtatatatgagacaaatgaatttaatcgcattgctatcggcaatgtttgtattctttagttgcaattcgcaaaagaaagcctataaagatttaggcgatggtctttttgctgacatcgaaactactaaaggacatattgtggtaaaactcaactacaaagaagtacctactacggtagctaactttgtaaccttagccgaaggtaaaaacaatttcgtaaaagtagaatacaaaggaaaacctttctacaatggtactattttccaccgtgtgatagatggttttatgatacaaggtggtgaccctaccggcactggtatgggcgatcctggttaccgnttcgaagatgaatttgtnccctcacttangcacancaaaaaaggnattttatcaatggcaaactctggccctaacaccaatggcagccagttcttcatcactcaagtncctaccccacacttagacggcagacacacagtatttggcgaaacagtaaaaggtgaagaggtgatagangctatcgctaaagctccaagaaatggtcaagaccgccctaatgaagacatcaaaataaagaatatcaccattgtagccaacggaaaagacgctgaaaagtttgatgctgtaaaggtattcgacagctacttcaaaagtgtagctgaaagagaaaaagaaaaagaagagcgtgtaaaacgtgcttctgctaagtttttagaagaaataaaagtgcaagaacctcaagctaaagtactgccttctggagtaaaaatctttactataaacaatggcgaaggtaaacaacctaagcaaaccgaatttgcaatggtaaactatgcaggttatttgcgcaacggagctctttttgactctaacatnaaagaagtagaagaaagttatggcaaataccaagctatgcgcgagcaacaaaacggttatcaacctattcctttcccttatactccttcagctcaattgatacctgggttcaaagaagctcttctcactatgaaagtaggcgataaaatacgcgtatttatcccagcaactttaggatatggcgaagcaggagcaggtgatgttatcccacctaatagcgatttgatttttgatatagaaatcactggcactatggctgcacctaaaatgaattaagaantttagataattagtaaataaagagacgatgnncaaaaacatcgtctctttatttttaggggtatacagggcttaaatcngtngtttcataaggaggctggtcttttaagaaaacacgngcagtaagattgccttttagttctatttggtcatcagtaattcgtagccaactgccttctcgcaaacctattacgggtatatcgttaaacttatgaaactctttaatncgggtttcacgcgtttcgcccttgtgcttgctatgagggtcagggtctaaataatgcggattgatattaaaaggcacagcccctagngtctgaaaagaaggcggatagataataggcatatcgttagtggtntgcatcgtctgtccngctatattactaccngcgctagtacccatataaggtgtccctccagctaccacctcgcgcaaaatagacatcaaaccgagttcgtacaagcgtgtaacgagcaaaaaagtattgcctccccctgtaaagatagcttttgcttgcactaatgctgcttnagggtcggcaaaggtatgtagccccactaccctcttctgtatcttttcaaagccttgctgtgcaatagcggtatantcatcgtgagtgataccactggggcgtgcataaggtataaagagtatttcatcaattcctgcaaaaaagtcngtaagttcntcttgtaaataagatagataggtacctccataaacagtagaggtactggctaataaaagtcttttcattagtataatacgtttttaggttatcagtggcaaagataaaaaataattgtcaattgataattattttttatctttgcctaaaattaagtaagtaatgaaaaagacatacaatacagatttattgcaaactgtcgttttgcgcaatgctaacgntatggaagtgagtgtgatgaactttgggggcatcattaactctataaaagtacctgtaaaaggtaaaaaagtagaatgtgtattagggtttgataccttcgaagaatacataagcgatcgttatagagctgaatatccctatctgggtgccgtaatagggcgtaatgcagggcgcatcaagtatgggaaagcctatatagacggcaaagaggtacaagtaaattgcaatctgggcgaaaaccaaatacacggaggcgttacaggatttgatagtgtattttgggaagtaatagcgcaagaaaaaggcgagaatccttctgtaactctgcaatatattagcaaagatggngaagagggctacccaggggaagtagtagtacgtgtaacctacactctcaccgaagacaataaactgcgtatagantaccaaggcactaccnatgcccctacaatcttaaancttacccagcatacatacttcaacctaaatgaaagtgacactgatattctgggcaatacgctgcaaataactgctgataaatatgtacctttagaagaaggctttttcacccccacaggcgaacgaccctctgtagcaggcacacctttagattaccgcaagggtcaaaaagtatatgcacataccgacaactcttttgtgcgcgaaatagatgctgaaaaaataatggctaccctaaccaacagcgagggcagcttaacgatgacggtacgcactaatcaccctgtgctacacatctacgcaggctattacctgcccctattagaggtagcccatcgcaanactataggacaaagcagaggtatctgttttgaagcacaaggctatgccgatgctactaaacacccncattttganagtgtaatactcagacctgaagaaaagtacgaatactttactgaatttcagtttctaagtaatgattagaaaaagaataccaataacaagtaacacaaaaagtgaatgaaaaagatttattttatattgtttttagggctactcttatcgtgtacccaaactcataaaaacgcaccgttacaacctgtaaaagtaacggtacctnctgaactacaagcctattaccaaggagttgatttcaacaaaacaggaaaagcctt

SEQ ID NO: 1296 - DNA, 4000 bp, Escherichia coli
  misc_feature (159)..(159): n is a, c, g, or t
  misc_feature (344)..(344): n is a, c, g, or t
  misc_feature (459)..(459): n is a, c, g, or t
  misc_feature (1033)..(1033): n is a, c, g, or t
  misc_feature (1056)..(1056): n is a, c, g, or t
  misc_feature (1253)..(1253): n is a, c, g, or t
  misc_feature (1571)..(1571): n is a, c, g, or t
  misc_feature (1574)..(1574): n is a, c, g, or t
  misc_feature (1577)..(1577): n is a, c, g, or t
  misc_feature (1802)..(1802): n is a, c, g, or t
  misc_feature (1808)..(1808): n is a, c, g, or t
  misc_feature (1811)..(1811): n is a, c, g, or t
  misc_feature (1986)..(1986): n is a, c, g, or t
  misc_feature (1988)..(1988): n is a, c, g, or t
  misc_feature (2060)..(2060): n is a, c, g, or t
  misc_feature (2456)..(2456): n is a, c, g, or t
  misc_feature (2498)..(2498): n is a, c, g, or t
  misc_feature (3925)..(3925): n is a, c, g, or t
  misc_feature (3990)..(3990): n is a, c, g, or t
  misc_feature (3999)..(3999): n is a, c, g, or t
gaaataaaagtacccgtttttccagaatccattacagatgctgttgtagtagaaatcaataaaaatgttggcgatgaagtaatgactggcgacactgtgttttctctagaaactgataaagtcgtattagatgtggtgagtgaagaaagcggagtcatnacaaaaatttctgtcaaaaatggcgatactgtaatagaaagtcagctacttgcagaacttgagattaaagatattagcgtcaacaaaaaggaagctgcagtggcagaagacaacaaaacccctcaaacaagccctgctgtaagacaagcgctaatagacaacgatttatcaaaagaagaggtggntggctctggcaaaaacaaccgcatactaaaagaagatgttacaagccacaaaagcagcaccacaaccccagtagaagacacccctatgagagctggagaaaggctagaagaaagngtaccaatgagtagaatgcgccaaactatcgccaaaaggcttctggatgcaaccaaccaaagtgcaatgctaactacctttaatgaagtagacatgacaagtattatgtctatgcgcaaaaaacaccaagaaaaatttgtaagtgaacacggtgttaaattaggctttatgtctttgtttgtcaaagcagccacaaacgcccttaagaaattccctgcagttaactcatttattgatggagatgacattgtgtatcacggctattgtgatatcagtgttgctgtatcaacagacagaggcttggttgtgcctgttttaaaagatactcaagaattatcgcttgcagatgttgaaaacaaaattattgatttttcaacaagagctaaatctggaaaattagaattatcagaaataagcggtggaacattcaccattaccaatggcggtacttttggtagcctcatgtcaactccaattatcaacccgccgcaaagtgcggttttgggtatgcataacatccaaaaaagagcggttgtgatagacaatgaaattgtcattagagatatgatgtatntagcgctatcttatgatcatcgnattattgatggtaaagatgctgtaatgttcttgagtcatattaaagacacaatagaagatccaactcgcatagttttagatttataactttaggcaataatatgaactacgatatcataattataggtggcggtcctggtggttatgtgagcgctatacgcgccgcacaattaggttttaaagttgggtgtattganaaatggattgacaaaaaaaacaacccatctttaggcgggacttgtttaaatgttggctgtattccatcaaaagctctgcttgaaagttctcatttatttaaaaacatacaaaatagtgagcatctaggcatcaaagccaacgccaaaattgatgtaaagaaaatgctggccaacaaagataaaatagtgggtgagctcaccggtggcatagcatcactctttaaagcaaacaacatcacctggctacaaggcacaggaaaactgcttaaaaacaaacaagtgtcattcatagatggcaaaaataatgaagaaattctnacngcnaaaaacattgttttagcaactggatcagtgtctgtcataccccctaatatgaagcttggcaagagagttatagattcagaaggcgctcttgatttggacaaaatcccaaagaagctatgcgttataggagcgggtgctattggtttagagctaggaagcgtatggagaaggcttggtagtgaagttgttatcttagagcgagatggatttttgacaacagcaganagcaangtntctagaacctctgcttcgtattttaaaaaacaaggattaaacatttttaccggggctgaagttatcagtgtcagtgaaaccagtaaatttgcaacggttaagtataaaaaagcgcaagaagaaataacagaaaaatttgataatgttatcgttgcagtaggaagaaaaccttatntngaagggtgtatagacaaagattctggcgtcaaaattaacgatagcggtagggttgaagtggatgacttttgncaaacaagtgtagagggtgtatatgcaattggcgatattgttaaaggcccaatgcttgcccataaagcatcagaagaaggggttgtagttgcacagagaattgctggacaaaagagccaaataaaccatgacttagtgcctatggttatttatacgcatccagaaattgcatgggttggtaaaactgaaaaagatctaaaaacaagtggggttgactataaagttggagagtttagctttatggcaaatggccgtgcaaaaagtgcaagtgaaactgacggcttcgttaaagtacttgcagatagcaatactgacagaatattaggcatgcatatcgttggacacaatgcatcagaactaattgcaaatggagtaataaccatggaatttgaaggnacaagtgaagatctttcaaggatgatttttgctcatccaacnttgtctgagagtattcatgaggcagcacttgcagtagacaaaagagcaatacacaccattaacaaaaagtaggtaatatgaatttacacgaatatcaagcaaaagatttatttagaagttttaatataccttgctccactggtacaactattacaaaaacacatgaaatagcagatgccataaaacaactcaaaggaaataagtggattattaaagctcaggttcatgctggaggcaggggtaaagctggaggtgttaagcttatagagtctgttgatgaagcgcaagagtttacagaaagccttttaggtaaaaaccttgtgacctatcaaacagataaaaatgggcaacaagtaaacaccatcttaatagaagaagtctgcaatatatctagtgagttctatttaagtatgcttgtcgataggggcagtgaaagcattgcaatcatctcatcaactgaaggtggcatggaaattgaagaggtgtcaagaaacacccctgagaaaatcattactacaagaataaatcctgcaattggcattatgccttatcaagtaagaaaaatatttaccacgcttgggctagaaggaaaagacctgtatagagaattacaatccatgcttgtaaatatgataacaatgtttaagcaaaacgacttatcactccttgaggtaaaccctttagttttaaccaaagaaaacaatttactatgtcttgatggcaaggtttcagtagatagtaatgcactttatagacaaaaagaattagagaaaaagcacgaccttactcaagaagatgaaagggaaatagacgctgaaagctttgagcttaactatgttgcgcttgatggcaatgttggttgcatggtaaatggtgcaggacttgctatggcaaccatggatcttatcaagctacatggcggagaccctgcaaactttctagatgttggtggtggcgcaacagttgaaagggttactaaagctttggaaataatcctatccgataaaaacgttaaaagtattttgattaacatctttggcggtattgtacgttgcgatattattgctgacggcataattgaggcgctcaagaagattcaaactgatgttaagtttgttgtgcgcttagaaggcaataacgccgaacttgggctgaaaaaattagaagatgaagatttagatatattggttgcaaaagaccttacaaaagcaaccaaacttgcaattgaaagcgctgcgttataggaataaaaatgagcatattaattaataaagacacaaaagttatttgccaaggctttactggagcgcaaggcacatttcactcaactcaagcaatagaatacggcacaagaatggtaggcggggtaacaccaggtaaaggtggcacaacccaccttgacttgccagtatttaatagcgttgagnaagcggttaatgacacaggtgcaaatgctagtgttatttatgttcccgctcctttttgcaaaganagtattatng

SEQ ID NO: 1297 - DNA, 4000 bp, Escherichia coli
  misc_feature (281)..(281): n is a, c, g, or t
  misc_feature (287)..(287): n is a, c, g, or t
  misc_feature (290)..(290): n is a, c, g, or t
  misc_feature (293)..(293): n is a, c, g, or t
  misc_feature (323)..(323): n is a, c, g, or t
  misc_feature (419)..(419): n is a, c, g, or t
  misc_feature (462)..(462): n is a, c, g, or t
  misc_feature (482)..(482): n is a, c, g, or t
  misc_feature (521)..(521): n is a, c, g, or t
  misc_feature (551)..(551): n is a, c, g, or t
  misc_feature (620)..(620): n is a, c, g, or t
  misc_feature (626)..(626): n is a, c, g, or t
  misc_feature (894)..(894): n is a, c, g, or t
  misc_feature (1073)..(1073): n is a, c, g, or t
  misc_feature (1076)..(1076): n is a, c, g, or t
  misc_feature (1142)..(1142): n is a, c, g, or t
  misc_feature (1226)..(1226): n is a, c, g, or t
  misc_feature (1331)..(1331): n is a, c, g, or t
  misc_feature (1352)..(1352): n is a, c, g, or t
  misc_feature (1466)..(1466): n is a, c, g, or t
  misc_feature (1553)..(1553): n is a, c, g, or t
  misc_feature (2420)..(2420): n is a, c, g, or t
  misc_feature (2639)..(2639): n is a, c, g, or t
  misc_feature (2756)..(2756): n is a, c, g, or t
  misc_feature (2801)..(2801): n is a, c, g, or t
  misc_feature (2822)..(2822): n is a, c, g, or t
  misc_feature (2825)..(2825): n is a, c, g, or t
  misc_feature (2831)..(2831): n is a, c, g, or t
  misc_feature (2928)..(2928): n is a, c, g, or t
  misc_feature (3178)..(3178): n is a, c, g, or t
  misc_feature (3215)..(3215): n is a, c, g, or t
  misc_feature (3267)..(3267): n is a, c, g, or t
  misc_feature (3309)..(3310): n is a, c, g, or t
  misc_feature (3312)..(3314): n is a, c, g, or t
  misc_feature (3318)..(3318): n is a, c, g, or t
  misc_feature (3320)..(3321): n is a, c, g, or t
  misc_feature (3323)..(3323): n is a, c, g, or t
  misc_feature (3325)..(3325): n is a, c, g, or t
  misc_feature (3327)..(3327): n is a, c, g, or t
  misc_feature (3329)..(3332): n is a, c, g, or t
  misc_feature (3338)..(3338): n is a, c, g, or t
  misc_feature (3341)..(3341): n is a, c, g, or t
  misc_feature (3345)..(3346): n is a, c, g, or t
  misc_feature (3348)..(3352): n is a, c, g, or t
  misc_feature (3354)..(3355): n is a, c, g, or t
  misc_feature (3357)..(3358): n is a, c, g, or t
  misc_feature (3361)..(3364): n is a, c, g, or t
  misc_feature (3366)..(3368): n is a, c, g, or t
  misc_feature (3371)..(3374): n is a, c, g, or t
  misc_feature (3376)..(3376): n is a, c, g, or t
  misc_feature (3379)..(3379): n is a, c, g, or t
  misc_feature (3381)..(3381): n is a, c, g, or t
  misc_feature (3383)..(3383): n is a, c, g, or t
  misc_feature (3385)..(3385): n is a, c, g, or t
  misc_feature (3388)..(3391): n is a, c, g, or t
  misc_feature (3394)..(3394): n is a, c, g, or t
  misc_feature (3396)..(3396): n is a, c, g, or t
  misc_feature (3399)..(3399): n is a, c, g, or t
  misc_feature (3401)..(3405): n is a, c, g, or t
  misc_feature (3411)..(3415): n is a, c, g, or t
  misc_feature (3422)..(3425): n is a, c, g, or t
  misc_feature (3428)..(3429): n is a, c, g, or t
  misc_feature (3431)..(3431): n is a, c, g, or t
  misc_feature (3434)..(3436): n is a, c, g, or t
  misc_feature (3438)..(3439): n is a, c, g, or t
  misc_feature (3443)..(3447): n is a, c, g, or t
  misc_feature (3449)..(3451): n is a, c, g, or t
  misc_feature (3455)..(3459): n is a, c, g, or t
  misc_feature (3461)..(3461): n is a, c, g, or t
  misc_feature (3464)..(3466): n is a, c, g, or t
  misc_feature (3468)..(3469): n is a, c, g, or t
  misc_feature (3471)..(3472): n is a, c, g, or t
  misc_feature (3475)..(3476): n is a, c, g, or t
  misc_feature (3478)..(3479): n is a, c, g, or t
  misc_feature (3481)..(3486): n is a, c, g, or t
  misc_feature (3488)..(3488): n is a, c, g, or t
  misc_feature (3492)..(3500): n is a, c, g, or t
  misc_feature (3502)..(3506): n is a, c, g, or t
  misc_feature (3509)..(3509): n is a, c, g, or t
  misc_feature (3517)..(3519): n is a, c, g, or t
  misc_feature (3521)..(3524): n is a, c, g, or t
  misc_feature (3527)..(3528): n is a, c, g, or t
  misc_feature (3531)..(3531): n is a, c, g, or t
  misc_feature (3533)..(3537): n is a, c, g, or t
  misc_feature (3539)..(3541): n is a, c, g, or t
  misc_feature (3543)..(3548): n is a, c, g, or t
  misc_feature (3555)..(3559): n is a, c, g, or t
  misc_feature (3561)..(3561): n is a, c, g, or t
  misc_feature (3564)..(3564): n is a, c, g, or t
  misc_feature (3567)..(3574): n is a, c, g, or t
  misc_feature (3579)..(3579): n is a, c, g, or t
  misc_feature (3582)..(3584): n is a, c, g, or t
  misc_feature (3587)..(3589): n is a, c, g, or t
  misc_feature (3593)..(3594): n is a, c, g, or t
  misc_feature (3596)..(3604): n is a, c, g, or t
  misc_feature (3606)..(3608): n is a, c, g, or t
  misc_feature (3610)..(3611): n is a, c, g, or t
  misc_feature (3613)..(3614): n is a, c, g, or t
  misc_feature (3617)..(3621): n is a, c, g, or t
  misc_feature (3624)..(3627): n is a, c, g, or t
  misc_feature (3631)..(3633): n is a, c, g, or t
  misc_feature (3636)..(3642): n is a, c, g, or t
  misc_feature (3644)..(3644): n is a, c, g, or t
  misc_feature (3646)..(3646): n is a, c, g, or t
  misc_feature (3648)..(3648): n is a, c, g, or t
  misc_feature (3650)..(3650): n is a, c, g, or t
  misc_feature (3652)..(3652): n is a, c, g, or t
  misc_feature (3656)..(3656): n is a, c, g, or t
  misc_feature (3658)..(3659): n is a, c, g, or t
  misc_feature (3663)..(3663): n is a, c, g, or t
  misc_feature (3666)..(3668): n is a, c, g, or t
  misc_feature (3670)..(3670): n is a, c, g, or t
  misc_feature (3673)..(3679): n is a, c, g, or t
  misc_feature (3683)..(3689): n is a, c, g, or t
  misc_feature (3691)..(3693): n is a, c, g, or t
  misc_feature (3698)..(3699): n is a, c, g, or t
  misc_feature (3702)..(3702): n is a, c, g, or t
  misc_feature (3705)..(3708): n is a, c, g, or t
  misc_feature (3712)..(3714): n is a, c, g, or t
  misc_feature (3717)..(3718): n is a, c, g, or t
  misc_feature (3720)..(3721): n is a, c, g, or t
  misc_feature (3723)..(3724): n is a, c, g, or t
  misc_feature (3726)..(3741): n is a, c, g, or t
  misc_feature (3743)..(3746): n is a, c, g, or t
  misc_feature (3748)..(3750): n is a, c, g, or t
  misc_feature (3752)..(3754): n is a, c, g, or t
  misc_feature (3759)..(3761): n is a, c, g, or t
  misc_feature (3763)..(3769): n is a, c, g, or t
  misc_feature (3772)..(3773): n is a, c, g, or t
  misc_feature (3775)..(3777): n is a, c, g, or t
  misc_feature (3779)..(3779): n is a, c, g, or t
  misc_feature (3781)..(3781): n is a, c, g, or t
  misc_feature (3784)..(3784): n is a, c, g, or t
  misc_feature (3787)..(3787): n is a, c, g, or t
  misc_feature (3789)..(3792): n is a, c, g, or t
  misc_feature (3794)..(3795): n is a, c, g, or t
  misc_feature (3797)..(3798): n is a, c, g, or t
  misc_feature (3800)..(3802): n is a, c, g, or t
  misc_feature (3804)..(3804): n is a, c, g, or t
  misc_feature (3809)..(3810): n is a, c, g, or t
  misc_feature (3812)..(3814): n is a, c, g, or t
  misc_feature (3816)..(3822): n is a, c, g, or t
  misc_feature (3828)..(3835): n is a, c, g, or t
  misc_feature (3837)..(3837): n is a, c, g, or t
  misc_feature (3842)..(3843): n is a, c, g, or t
  misc_feature (3845)..(3845): n is a, c, g, or t
  misc_feature (3849)..(3857): n is a, c, g, or t
  misc_feature (3859)..(3866): n is a, c, g, or t
  misc_feature (3869)..(3871): n is a, c, g, or t
  misc_feature (3873)..(3875): n is a, c, g, or t
  misc_feature (3878)..(3878): n is a, c, g, or t
  misc_feature (3880)..(3880): n is a, c, g, or t
  misc_feature (3882)..(3882): n is a, c, g, or t
  misc_feature (3884)..(3887): n is a, c, g, or t
  misc_feature (3890)..(3890): n is a, c, g, or t
  misc_feature (3892)..(3892): n is a, c, g, or t
  misc_feature (3894)..(3895): n is a, c, g, or t
  misc_feature (3897)..(3897): n is a, c, g, or t
  misc_feature (3899)..(3900): n is a, c, g, or t
  misc_feature (3902)..(3904): n is a, c, g, or t
  misc_feature (3908)..(3909): n is a, c, g, or t
  misc_feature (3911)..(3912): n is a, c, g, or t
  misc_feature (3914)..(3915): n is a, c, g, or t
  misc_feature (3917)..(3917): n is a, c, g, or t
  misc_feature (3922)..(3922): n is a, c, g, or t
  misc_feature (3924)..(3929): n is a, c, g, or t
  misc_feature (3931)..(3932): n is a, c, g, or t
  misc_feature (3934)..(3934): n is a, c, g, or t
  misc_feature (3938)..(3940): n is a, c, g, or t
  misc_feature (3942)..(3944): n is a, c, g, or t
  misc_feature (3946)..(3947): n is a, c, g, or t
  misc_feature (3951)..(3953): n is a, c, g, or t
  misc_feature (3955)..(3957): n is a, c, g, or t
  misc_feature (3959)..(3960): n is a, c, g, or t
  misc_feature (3962)..(3968): n is a, c, g, or t
  misc_feature (3970)..(3973): n is a, c, g, or t
  misc_feature (3976)..(3976): n is a, c, g, or t
  misc_feature (3979)..(3979): n is a, c, g, or t
  misc_feature (3981)..(3981): n is a, c, g, or t
  misc_feature (3984)..(3984): n is a, c, g, or t
  misc_feature (3987)..(3992): n is a, c, g, or t
  misc_feature (3995)..(3995): n is a, c, g, or t
  misc_feature (3997)..(4000): n is a, c, g, or t
gtgtccaaagctctagtaagctagctcgcactagcctggctgccctagaaaaagcggtcgaaaagcttggcggcaccccgcgtgctggccaagagctgatggctcaaaccgtggcggaaatagccgatgagggtggacacctgctagtgcaggcaggtaccggcaccggcaaaagtttgggttatctgatcccggccatggtctacgcggtgcaaaacgagcaggtggcggtagtttccacggctaccttggcgctgcagcgccaaatcgtcaccaaagangcgccnttngcngctgaggtagttgagcaggtaaccggtaancaacccaccgtggccctacttaaaggctggcaaaactacctgtgcgtccataaggttaacggcggctacccaagcgacgatgatctatttgccgcngccggccttaatatgcgccgcaaacgtaaaggtgaagaaagcntaggtgaccaggttctgcgnctaaatgagtgggctagcctcacccaaagtggggaccgngatgatctagttcccggggttagtgaccgngcctgggcgcaggtgtctctagaccgcaccgcctgcctgggtaaaacctgcccagtctatgagcagtgntttgcntacgctgcccgtgagcaagccgctcaagcagatattgtggtcaccaaccacaccatgctgggggtggccgccgctggcaacactggcttgatccccccacaccagctgctagttgttgatgaagcccatgaactggcctcacgtgtacgcagccaaggcgccatcacgctatcagccacctccatcaaccaagccgctaaagctgcccggcgttgccaagtaattgccacagagctagagaccgccgccaaaaccctgcaggaggccntagaaaacctgccgcaggggcgcctggccgcacttactcccagcttgcaagacgccctaatcttgctagatgcagcggtgcgtcaagctctcgaagacctcaaagacggcaaaaaaccaggcgaagctcccagccctgaactagtgctagctaaaagcgagctaactaaaatcaatgangcnctctcgcggctgctatcaaattcgattgctagcgctaaagatgtgctctggtgtgaacaaaccacnagctctaaagacccagtaaggctgcgtctagcgcctatcgaggtggcctccaccatggccaacaccctgattgaagaccacagngtcatcatgaccagcgctaccctcactttgggcggatcgtttaacgctatggctaatgaggtgggtttaagctttgccggtggctgggaccagctagatgtgggntccccatttaactaccccaancagggcattctttacgtggccgcgcacctgccaaaacccacccagggcatttccccggccgcactagaagaaatgtgccaattagcgcaggctgcaaatgggggcatgctgggnttattttcttcgcgccaagccacccaggaagctgccaaatatttacgtgagcacactgatttgccggtgcttgtgcaaggagaagancagctacccactttggtggaagaatttaaggctgatgaaaacgcttgcctgctggggaccttgagcctatggcagggggtggatgtgcccggacaaacctgtcgtttggtggtgattgaccgtattcctttcccgcgccctgatgatccgctagctcaggcacgcatccaggcggtgcaagacgggggcggcaatgggttcatgcaggttagcgccaaccatgcggcgctgttattggcgcaggctgcaggcaggttgattcgctctagtagtgatcggggagtggtggcagtactggactcgcgtctgcgtacggcccgctacgggagttatctaattaaatcgatgccagatttttggcgcactactgattcaaagttggttcatgccgctttggaacgtttggcggtctaacgtcctatttggctccgctcgctgcatgcatttgatctgtcaaagtcctaagaaataattagcaatttgttttaggggcttagcaagaagagattttcgctttaggcttgtacttgtcaggtacaagggataccttgtcagaccgaattcagctttatttaggagttcaccgtgtcagacaccattaccaacgcagcacagggtggctaccctaccgcgcagggtcgcccctctaaggttgccattatcggcgccggtgcagttggttccactcttgcctacgcttgtgtcaacaagggtgttgcccgcgaaatcgttttgcaggacattgctaaggaaaaggtagaagctgaggcgatggacatcgcccagggtattcagttcacctctgccggttctgttgccggtagcgatgaccctgagatctgccgtggcgctgacgtaatcgccatnactgctggtgccaagcagaagcccggccagagccgtattgagctagccggcgctaccgttggcatcatggagaagattctgcccaagctggtcgaggttgctcctaacgctatcttcgtgctggttgccaacccggttgacgtagttacctactgcgccaagaagatcactggcctgcccgagaaccagatcttcggttccggtaccgtgctggacacngcccgtatgcgttacctggtctccctggagaccggcactgccgtacagaacatccacggctacatcgctggtgagcacggtgactctgaggtggctctgtggtcgagcgcccagatnggtggcgtgccgctaacccagtggggccccacccttgacggtggncacttcgaccaggagaagcgngancgcatngcttacgacgtagtgcgcagcgcctaccgcatcatcgagggtaagggcgttaccaactacgctgtgggtctggctgtacagcgcatcatctccgccntcctcaacgacgagcagcgcgtactgaccatttccccgctgctggagcagtggcacggcatctccgacgtgtgcatgtccgttcccaccatcgtgggccgcgagggcgctggccgtcgtctggacctgccgctgaccgtggaagagcgcgacaagctgaccgagtctgcagaccgtctgcgctctgtggctcgctcgctgggctactgatctaaatagctgatcacttaaaaaggctggcgcccgcttgnggcgtcagcctttttgtttgtgccggtttgcgttgtnctggcttgctttgtggcgcgctagcgttggttgtagcgttttttaacgacgncgccgctaaggcttttgctgacgacggcgccgctagctgagnnannngttncnntngngncnnnnaaggcnccngctnntnnnnntnngnncannnncnnnacnnnntngcncntnancannnnctngncgncnnnnntggggnnnnnggcgttnnnncgnngnagnnncnnctgnnnnncnnngcgnnnnnanagnnncnngnnggnngnngnnnnnncntcannnnnnnnnannnnngcngccacaannncnnnnttnntgncnnnnngnnngnnnnnnaccaccnnnnngncgncgnnnnnnnnggcgncgnnnatnnngganncnnnnnnnnncnnnannannaannnnnctnnnnagcnnnttnnnnnnngngngntntngtantnntccnccnnntnctnnnnnnncaannnnnnncnnncggcnncgnttnnnnccannnggnngnngnngnnnnnnnnnnnnnnnncnnnntnnntnnncaccnnntnnnnnnnggnntnnncngnggngtngnnnncnntnncnnngncaacnncnnnannnnnnngcgggnnnnnnnngncgcgnngnagcnnnnnnnnncnnnnnnnnttnnncnnntgntntntnnnngangngnngntnntnnncccnncnncnncnccaancnnnnnnanngnaggnnngnnncnnttgnnncnnncnncnnnnnnnannnngtngtntncgnccnnnnnnctntnnnn

SEQ ID NO: 1298 - DNA, 4000 bp, Escherichia coli
  misc_feature (371)..(371): n is a, c, g, or t
  misc_feature (3509)..(3509): n is a, c, g, or t
  misc_feature (3627)..(3627): n is a, c, g, or t
cttgtatttcttcattttttcttaaaaggccattattaacaaaaatacaagttaaattttttccaattgctttgcttaataattgtgcaaccacactactatccacaccacccgacaatccacaaattactttgttgtcacctacttggtctttaatttcattaattaattttaatttttgatcttttgatgaccagttttttttaattttacaaataagaaaaacaaaatttcttaataaaattttacctttattagtgtgtgttacttcagggtgaaattgtacaccataaaaattttctttaatattttcaataattgttaatttagagttttttgtagaagctataattttaaaattttttggcatntttgatacttgatcagcatggctcatccaaacatcacttctattatttttattaaaaaaattcttagttaaagtactattggatactttgtttatagtggctaaaccaaattctctatgttttgattttttaactttgccacctaatagttttgacaatatctgatgtccaaaacatatacccaggattggaattccaagttttaatatcttcttatcaaatttaaatttatcattttcataaacattaagaggtccaccagacagtattattccagcaatattatcttttgtaatttgagctatttttatttttttatgacttacaatttctgaaaaaacccctaattcccttactcttcttgcaattaattgtgtaaattgagaaccaaaatcgattattaagattttacttaaattattactaagactcatttttaggttccaaattctttaaggattctaaaatagaatttttcttatcacacaatttattgcaaatttttgaaaaattatctgctagttcttttactttggaataattagatctttttaactctatttccataagcatgtagtttgcttcttcattttttggatcaagtaataacactgtatctatatttttttgttcttctcttttgttctcttcaaaattataaatttttgctaaatacaaatatgaatctttgtccttagggttaaaaacaatacttctttgaaataaaaatttagattcttcatatttttgttcatcgtatttattttttccttcttcaaaaaagttattttctgcaaaagaagaacttccaaaatttaaaattataaataggacaattattaatttatttattgttctcattaatacttgctctcatttttaacttgatcaacattatgaaccatactttcataaaaaccagccttagttatttttacaaaatttggtttatttttaaggtttggtactttttttgcacctagatatcccatagatgattttaatcctccaattaatttataaattatacttttcacatcacctttatatttcacaaaaccttctactccttctggaacatatttagatatatctttttgtttggtttgaaaatatctatcagctgatcctttattcatcgcaccaactgatcccattcctctaaaacttttaaataacttaccattttttttaattagttttccaggtgtttctaagcttcctgcaaacaaagatccaatcattatagcatcggcacctgctgacaatgctttagctaaatcacctgaatatttaattccaccatctgaaattatttttactttattgtttttaacaccttttttaactgcaaggatcgcacttaattgtggtacaccaatgcctgcgactagcctagttgtacaaattgatcctggccctattccaactttaataatatctactcctaattttattaaaaattttgctgcttcagctgttgcaatatttccagcacatagagttgttttgtttgtttttaatttttttatagctttaataatttcagctacttttttgctatgtccatgagctgtatccacaacaattaaatcaactttttcttttaaaattgcttttgctcttttaagttctaaaggaccagctccaactgccgcaccaactaataagtttaattttttaacttttttaatttcttcaacttgttttttaatatccaaatttctatgaattacaccaatgcctcctgctttagctattgctatagccattttactctcagtaactgtatccattgcagaggataataaaggtatttttaatgttaaattagatgataatttagtgctggtatcaacttcagaaggtaaaacttctgagtattttggtgccattgtaacatcgtcaaaagtgagagcttcttttataggatccataatcatttatatatgattcccctcaaaaaaaaagtccctatcttaagattttacaaataataaaactttccttagattcttttctgctagacttgggtttaaacaccttcacttctttaaataattttttgcccaaagcaacaatttcgttaaatgatgagcctagaaaaatcttagagacaaatcgtccttctttaaccaacatttctttggaaaaattcatagcctccattgcaagttcaccagtataaattgcatctatatcttttatacccgttgtatttacagccatatcagagacaacaacatccacttttgatttgaataaagcttttattttttcttgagattctaaatcagtaaaatcacctttgatttggattgtattctcaatttcttccataccttttaagtcgattgaaaccaaccttccactttttactgttcttgaaatatattgagaccagctaccaggtgatgcccctaaatcgattacagatattccatttttaaatatcttaaatttttcatctatttctattaatttatatgctgatctggctcgatacccgtctacctgagattgtctaacataaatatctcttttttgtttattaatccagtttttagaaattctattttttttcaattaatgaccaaaccttaagctttttgataaaattttaccctctaaagtttttatatctatctttacttctctatgtaatctcatgtctttatctccatcccaaatcccagatgcaagatgtattatacccagtttatgattgggcaagtaaggctccacaaagcttttttctttttcattaaattttggtaaaagattactaactaaccaattgcaattatgaggtaggaactctgtttctaaatcgtcaatgtaaactgacatgttaatagccaattgttctgaaccaaaaatatttccagctttaagtgtttgttctaaatttttttgccaagtcgtccagccaactgaatttttttctaaagaaaaaacaccaatattaatatgtggggcgaaagcaagcttccgcgctttatctattccaatttttgactttattgcatgtttaaaattttgagatttaattattgctaattgtccaaatatccatttaactttggacattattttatatcctggtgtaaaggtttgagtaattcctaattttccatnttcacaggccttaaaataaagctctattgaattccaatcccctacccaagcgtcacaatctatccataagaatttttcataactaggaaaatattttggtaagaaagctctagatacntgactctttagccattctcttcctttaactttaaatgctggaacatcaatatcccattcagctgatttaatttcatctacttttttagataatatatttctttgttgctcggataaacctgcatctaaaatgcaaattgctgtatctttgctttgttcaaaacttttaatagaatcgaccaattcattaagtaattcaaagtaatttgagtctgccagagatacaattacattttttttcatctatagaatgtcttcaaggtcttctttagtgtcactttcaccatttaaaattttctgtttataaattttttgataactaaaatatccaactggaattaagcaaatatagattaatccacaaatgaccaaaa

SEQ ID NO: 1299 - DNA, 4000 bp, Escherichia coli
  misc_feature (179)..(179): n is a, c, g, or t
  misc_feature (479)..(479): n is a, c, g, or t
  misc_feature (482)..(482): n is a, c, g, or t
  misc_feature (866)..(866): n is a, c, g, or t
  misc_feature (882)..(882): n is a, c, g, or t
  misc_feature (917)..(917): n is a, c, g, or t
  misc_feature (1641)..(1641): n is a, c, g, or t
  misc_feature (1992)..(1992): n is a, c, g, or t
  misc_feature (2637)..(2637): n is a, c, g, or t
gattaattttccttgttttgggcaccctctacaacatgattatttccaaatggtttatgccctcacggtccattatttcctctcttaccagaaagtatcacatgggtagttttttaacagaattcaaagtgggggaagattcacccctaattgggaatgcctataaagacttggatatntcccaaaaatataatcttcaagtgtacaaaattattcgtgattcagaaaatatccgctttaatttgcaaaatattattatccgcgaaggtgatatttttctggttcatataaatgtgaaagatatgttgaaattcaaagatgaaatgaaagttctccttctaacagatgtgaaaatgaacgtggcagaattaaccgggaaaaaccatgtaattgtggaagggctcgtttcccagcaatctgcattaattggtaaaacgctccaagaatttgattttagaaatcgctatggatcctttgtnttngctgtaaagagacaacgtgaattacttcgggataaaattgcccatatccgcctgaaattttctgacacccttttaataatggttccgaaggaaaggttagaaatacttcgaacaagtaataacctcattgttttggaagaattggatattcatctcaggtatgagcgctattggtggttttctattttagtaatccctgctgtaatgttactggctgcattcggtgtaataccaattgtgaaagccgccattttgggggccattttattgttggttatgcggacactttcaatacaggatgcctatgagtctattagctggtcagttatttttctcattgcttccttagtccccatgggaattgccattcaaaaaacaaatctngatgaggtaaccgganatctcattattggaattggtacactcattggaggnggagaagggttggacccggttattattttagcagtactgtatggggttacatttattttgtcagcattcatctcaaatgtagctgtggcagtgatgcttacacccatcggtataatgttggctaccattcttaatgtggatccacgcccatttttggtggcaatctgtttcggagcctcctgtagtttcatgactccaatgggatatcaaaccaatatgatggttttcgctccagggcaataccgattgaaagatttcttccaaatgggtattccccttacattagtattttggattaccgcagtatattggattccaagattttgggcattttaatcaagggaattaattcatgctaaagttcatgttaattatattggatggctttggacttcgccaagaaaaggagggaaatgccattgcccaggcaaatactcctactttagatagaatgatgaatgactgccctctctcaaaaattgaaacctcaggaaaatttgtgggcttgccagatggaataatgggaaattcggaggtgggtcacatgaatatgggtgctggaagaattgttaagcaagatttagtccgaataaacgattccatcaaatccaatgaattaaaaaataatactcaacttcagaatgtatttaatcatgtgcaaaataatactagcacccttcatataatgggcttaataagtgatgggggagtccatagtcatttngaccattttgaatatatcctatcaacagcacgagaaagtggagtggaaaaaattgccatacatgcctttatggatggtcgtgatacttcgcctgtgagtggcattaatttcataaatacattagaaactttcattacttccgatgatcaatacagggtaacaaccgtttgcggtagatattatgccatggatagagacaatcgctgggagagagttgaaactgcatatcagatgctcatccattccgaaggagaaaaatttcctgatgcagctacagccattcaggcttcttatgataatgacattacggacgaattcataaaaccaactgttattggtgaggattgcccnattcaaaatggagatgcgctgctgtcaatgaatttcagggcagatagaatgcgccagattgttacagccattaatcattcaaaatattcccattttaaaacaaaaccattggatattttatttacatccatcactaagtataaggagaatttcccttttccggttttatttgaacctgaaaagataaataatatttttcctgaaatattagcccaaaataattatcgtcaatttcgaattgcagaaacggaaaaatatgctcatgtaacctatttttttaatggaggaagtgaacagccatttccaggtgaaactcgaaaactcataccttcgcctaaagttgctacctatgacctccagccggaaatgagcgcccatgaagtaactgatgaagtactcttcgcaattgaaggtgatcagtatgaagccatcattatgaattttgctaatcctgatatggtagggcatactggaaatattaccgcagctatctccgccatcgaaaccattgatgcctgtttggagaaaatccaacatgccacaaaagagaagaatgcagctatatttctcaccgcggatcatggcaacctggaactcatgcatgacccccagagcggaatggcacacacagcccatacaactttnccggttcctttaattttggtgggagtgaatggaaattacagtttggcagaaaggggaaaacttgccgatattgcaccaacaattttagattatttaaaaattgaacagcctcaagaaatgactggaaatagtctgctaatttctacgaatgattaaatgcggtatatttttattttcataaatgttttcggcttattggaagcacaaaattttagatatgtccctgaggattggtatatcataaccaagccgggagctattactgctattgcagaagataatttcaacctctattttgcaactgaaaatggagtatatcgttacgataaggctcgggaagatttccaatatgattatacattttctgtacaattagaatttccgaaaattacccatttttattttgattcctatcgtgattatttctggatggtgcacggacagggtataagttttaaatcttctgtgagtacaaattggcgggatatgtccctcataaattctggtattttcagtatatatgaaattggtgatattgggtcatctccagaatatttttggattcgttcgggagcagaattcatcccctttgatccattctctgggcttcctgctgattgggaggatgctcagaatgaagttgattttatagattgggggcattctagccaaggtaatgccgggtatgagttagaaatatcaaagtattccattgaaggtgattggacagttggattgcataagataacccataaagatggtcgtacaataagagtaaccatgcacatggaagatgacgaaggaaaccagtggtttggtacagattcgggttttattttaaaaggatgggttcattcttcaagattaaaaatgatttctattggcttactttccgagaatgtcacagaggcatattttgattcagaagaaaattggtggtttacagacagcagatttaaacgtacagggcagtttttatcttttaatagtctttaccaaacgaatcacactccatttattagccagtggaatgaacccacaaaccaatggacatattactaccacaatgaatctatagttattgaaaatacggatgttaattctattttgcgcatcggcagtaccatgtattttggtactatgtctgggcttctctatcttgacctgtataatcgggattggaatattataactgcaaccaatggattaaatgattctgcagtatgggatatgattgaacatgacggatccatttatttagcaacctcaaatggaattaatgaagtttctataataaatcataatgtcattcctgatagagacaataaatttgataaattaacccaatttaacatttatgata

SEQ ID NO: 1300 - DNA, 4000 bp, Escherichia coli
  misc_feature (1)..(3): n is a, c, g, or t
  misc_feature (5)..(5): n is a, c, g, or t
  misc_feature (7)..(7): n is a, c, g, or t
  misc_feature (10)..(15): n is a, c, g, or t
  misc_feature (18)..(18): n is a, c, g, or t
  misc_feature (20)..(24): n is a, c, g, or t
  misc_feature (26)..(29): n is a, c, g, or t
  misc_feature (32)..(34): n is a, c, g, or t
  misc_feature (36)..(36): n is a, c, g, or t
  misc_feature (38)..(40): n is a, c, g, or t
  misc_feature (42)..(45): n is a, c, g, or t
  misc_feature (47)..(48): n is a, c, g, or t
  misc_feature (50)..(51): n is a, c, g, or t
  misc_feature (53)..(57): n is a, c, g, or t
  misc_feature (59)..(61): n is a, c, g, or t
  misc_feature (63)..(63): n is a, c, g, or t
  misc_feature (66)..(67): n is a, c, g, or t
  misc_feature (72)..(72): n is a, c, g, or t
  misc_feature (74)..(74): n is a, c, g, or t
  misc_feature (76)..(84): n is a, c, g, or t
  misc_feature (87)..(88): n is a, c, g, or t
  misc_feature (90)..(90): n is a, c, g, or t
  misc_feature (92)..(92): n is a, c, g, or t
  misc_feature (96)..(101): n is a, c, g, or t
  misc_feature (104)..(105): n is a, c, g, or t
  misc_feature (108)..(110): n is a, c, g, or t
  misc_feature (116)..(117): n is a, c, g, or t
  misc_feature (119)..(120): n is a, c, g, or t
nnncngnttnnnnnncantnnnnngnnnnatnnngngnnntnnnnanngnngnnnnnannncngcnngcatncnannnnnnnnncanntnanagcnnnnnnaanngcnnnaaaaanntnnccaaaaaactgaccagaaaactaaatagggagaataaaaatggaaatcactataaccccgtctggccaagcatgtggcgcatcgataacaggagtggatctatctcaaccgcttgcagacgagcagatagccgaaatacgcgcggcatggctcgagcataaagtgctgagttttcctcatcagtctatgacagacgatgacctcgagcgtttcactctttcattcggcgcatttggaaacgatccctttatcgcaccaattgagggtcggaaaaatattattgctgtggaacggagagcggacgagaaggcgccgctattcgcagaaaactggcacaccgactggagctttcaaaaagcaccgccggctggaacatgtctttacggaataaaaataccttcgaaagggggcgatacactatttgcgaatcagcaaaaggcatggcatgacatgccggcatatcagcaggagaaataccgtgatcttgtcgcaatacattctgctaagtcggcgtattctccagagggcatgtacgggaaagaagatcagacgagtgatcgcagcatgaatatccggccctctgaggatgcacgcaaactgcaaacacatccgcttgtgcacaaacatcccgaaacaggcgtcgaaggtttttacagttgcctcggttatatagttggtctggtcgacaaaacagaagaggaggctttcacgcttctcaaagagctaagcgactggcagggaaaagaagagtttgtttatacccacaaatggcagccgcagatgctagttatgtgggacaaccgcgcgttgttgcatagagcaacggggggtcatgagggagaggacaggctgctgcatcgcaccaccattgccgcgtactagtgcgaaagccgcgctgccttctataactcttgaaggcagcacgttttctcgtttacttttgagggcagactaaaaacttcttgcctgtagattttgagttgtactgcgcaacgatgtcagcgtctaacgcctctgcgagggagatctcgttagtgtagtggctggcgaatgttgttttcatctcagtcgcaacgcgtgtgcgtaaacgagtcgccacttcttggccgacacgcgctaggaaattaggcaacaaccagccgccaactccccaagccatgccatagccacggttgagtgttgtgggtgaagtatcgagcccaccatacaaatacacctgcttgtgcttaaccgagccatagatgctgtatgcgcctggtgtgcgcgccgcagcagcctccatggccgagaggattgttgaggctaatgtgccgccgccagttgcgtcaaaggcgagtgtcgcgcctgttgcgtgaatagcgtcggtgaggtcggccataaaggtgtctttgctgctgttaacaacgtattttgcgcccatctcacgaagcaaggtttcttgctcgtctttacgcacaatgttgacgagatcgatgccgccgtcgagacaaatgcggttaagcatctggccgagattcgacgccgctgccgtgtgcacaagcgcagtatgaccctcgaggttcatcgtctcgatcatgcataatgcagttagggggttaacgaaactcgacgcaccgtctttcgcggtatgaccttcgagaagcggcaagcaaacagaggcatccacacagcgatactggccatacatgccgccgcccatcgcagcgactactttaccgtcgagactctttgcgagctcactagtaccggtcgcgacaactgtgccggcgccttcgttacccacggcaagcgattgcccgattcttgccttcatcaccgccatgccttgttcggaaaccggcgcggttaatactgtgtctgcaccgctgcccgacgagatcgcgcttgccatcgacgcccaaccaaacatgacaccatggtcagaaggattgattggcgtagcctcaatgcgaataagcacttcgttctcgcctggaataggcattggctgctctttgagttcgaggcgaagttcgccctcggctgtgagcgttgaaaacatctgaaggtaggtcgaatccgatgacatagcgcgcctctttgttgatttaattaaggcaaagattagaacacactttgtcgcggaatatcagccaaagaggcggagcttacaccttgtcaaaaatgggaagcgtcgcctgagttagtctttccgcgtcatagaccaaggtgcctcggcgcccattgcccgtgcgatgccgacgatagtcgcaccgttaacagtgccactcatgtcgtaaaccattggagagccatctctgtctatcctaaaagtgatttcattggttgatgccacgccctcttcgatcgcccagagacggccgttacccaaatcaaatgtgccaacgagagcatcgcccgaagtgtcgagcgttacgacagcgtttaccgcaccgaaggggctgctcatagtgaaatcccagatgccgtcggcagtgggagttgcagtggaggaagtgcttgtggcgcaagcagatagagttgagagtgaaaataagagcgatagaaagagtggttgaaagcgttgtctgaccatgggttttctccttgttgattaattttcttatagttagaattcaacgtactaatggttcctctataaaaacgcccacagtgatgaagtagattattgaacactatatccatctgaggaataacgaatagcgctcggaaaatgaagagtttctataatcgagtgcccgacaaaaatggcctcttcatttttgcgccgactgccatacgcgcgcataaaagcgccttcctcggctctgcttggaatcccaccgttaagggcaagttgaattatctgggcaacttcgtttggtttttcgcgctgcggatagtgcccggcagtagggagtaaccaataggtgctttcggcagctctgtcattcagataagtggcccatacgtgattagaaatccgtacaggattaatgtcgtcgagcagtccccagaggtaagcgacaggaatatcgcttcgagacaagttgttgagccagcgtaattcgttttctgcgcgctctaacagatatcgggctacatggataagcgcgctgtcgccatcgttaaatttaaaaatatctgcgtaggcgagcgcctccggattgccttgggtcattctaggcactgatttccgcgcttgaatgagtgcattcccacggacagggtcgagcaaggcggtttgcatgggcattaggttagcaagtggtaagaacatgccgctgttagataaaaagtggtaattaatactgtattccgcgggctgtgtgtcgagatagttgccaagaaaagcgaggccaatactgacacctctgtcatgcgtataaagagcgaaatcatcgaaactaattatctctgttacgaaataatccaaaatttcggcattctcttccagcatatagctgaaattaggcgcaggtttgtctgagaaaccggagccggggaaatctagcacagcgatatgaaaatcgttttccaacagtggaactaatttgtagaagtcgaagctcgaattaggaaaaccatggaccatgactaattgcggtttgtctttactgccaaaggtacgatagaagacattaactttagcctgctggttattctttgtcgttgaagtccactcgaaatagtcaccgccctcgaaccaggattctgctaggtctgagtgaaatacaaaatcagactcttctgccaaagaaaaaaaggagagagacgaaaaagcggcaataaaaaaagttaaaacgagcttcgctttcatagcgtacagcaccttagttaatagattaattagtagactaatcaatagttcggttaatacattgatttactgatcgatagc

SEQ ID NO: 1301 - DNA, 4000 bp, Escherichia coli
  misc_feature (1252)..(1252): n is a, c, g, or t
  misc_feature (1428)..(1428): n is a, c, g, or t
tcgtctggctgatcatcgtggtactttacggtatcaaagcatatcgcggcgagtacatcaccattcctttcgtcaccaatttcgtcaaacagcaaggctgggcttaagacccctgtcgtgcaatatttttccgccttcgaggacagatttctcgaaggcggtttctttattcctatccttggatcgttgtggctaaccttctggattacaaaagcagagattcggagtttgcgctaaaattagcccatccacttatggttgaaaccgaaactcaaaaagcgatcgatcttgaactcgcccgtgctgaccaggcgcaccaggccggaaatgagggtatggcgcgggtctgcgcccggcgggcagccggaatcgcggttcgggaatactttgtgcataaaaaccttggaattgccgacccgagtgcctttaccttgctgacccgcttacaaaagttggaatcaactccggctgatatcaagatagccgctgataatctgttgactcgcgtcacgccggactaccgtttgccaattccgatcgacctgactgcccaggcgaagctattaatcaattgggcggctgaccaaatcaaaggagatcaacttgactgactccaatccaatcatcattatgtacggaaccacctggtgcttcgactcgcgccgcgcccgccgaattttcgacgaactggaaattccttatcaatggattgatattgacaaggatcctgaagcgcgtagctacgtagaagaagtcaaccacgggttccggtcagtcccgaccattatctttccggatggcagcatgttggtcgaaccttctaatgaaatcttgcgtgagaaattaaccgaattaacccgcggctaaagtgccagcggcggctgttattttttgcctttgctgccgagaatcagccaggtcaccagaccagctaagaaacctatcccgatccataccagccaatcaaccgattgggatgtccgtccaagaactgtctgatccgagcgggtcaagcggcggctcagcgtgctaataaaatccggatccgggtctatcggccgaaagtagctatataaatcgtcttcaattccagaaatttgtgacaaatctgcctgcatccttcaccttccccctgctaaattcgatttaacaagcgaatccaccgccaccgtcgcaaaagattgcggcatccggaagttcatcttggtggaacgctcatctttgtaaaacattcatccttctccttgagaantgctcgtcagatcgcttcgcagtgaaagtagggtgcggtgatataagctcttgatggcgccttcgctgcgtcccataattcgggcgatctcgtcattggacatgtgctcaacaaacttcagaatgatcaggttttgccggtcttccggaagtttttggatggcttccaacagcacntgaacttcttgatttttaaccagagccacctctgggtaatcaccgccctggcgcagtgtgtgggtgtgatcctcgagtggcacttcccgccgacggtgactgtcgcggtgccagtttgccaccaggttatgagcgatgcggtaaagccaggcggtgaagggtaatccacggttgtggtaattgtggatgtggttcatcgcccgaaagaaaacacgctcagtcaaatcttcggcgtcgtgttggctgcccgtgcggtagtaaatatagttataaatgcgcttgacatagcgctggtaaagaacgctgaacgcattcttgtcgccttgtcctgccaggatgatggcttcgtcgtcacttaattcatccaagagagttccctgtcaggtctttctatccctaattaacccgaaattgctggataagttacatcaacgccagtaaatcaacaaacccgatggactataccagttccatcgttcccattatagcggtaaatttcgagcttttccggtaagtttctaccagacagcctggtttttggttcgggtgtacacttatcccaccccaaatattagattggtatcgatccacgaggttgcatgcaaaaaattgaattttcctggaaaacgccgaaaaacatacccatatttgcctgtgaatggaaaccggttgggcctgtcaaggctgtgatcgtattagtgcatggcattggcgagcatatcgggcgttatgagcatgttgcgcagatgttcaccgataaccattacgcctttttaggcgccgatctgattggacatggcaaatccggcgggcagcgtgggcacgtagacgcctatgatgaatatttggaaattatcgattggttgctcctcgaggctcataaccgttaccccggattacctcagtttatttatgggcatagcctgggtggtaatttagccctatattacagccaaaaacgctctccgcgtatcgccgggatgattgtctcctctccaggattggaaccaaccaatgtgccgccactaaagttggcacttggaaagctgatgtatgcgctttatccccgctttaaaatgaccaatagtttggatgtaaccggcctttcccgtgatgataatgtgatagcagcctaccaggcagatccgatggtacatccgttcgtttccgcccggttaggtatagatttactgtcgaccggcaaagtgatccgtgagaacggaggcgaaacccaaatcccgctcctgatgttgcatggtcaacaggatcgccttgtgaaaatcgcaggcacacgagagtatgccagtcatcggaccggagatgttaccttcatcgaaatcccgcagggctatcatgaacttcacaatgaacccaacaagcaagaaatcttccagatctggttagcctggctagataaagtactgaatgttgctgataaatagcgaataatagtctgagcgtgggatgctaaatatcacttgaccgggatatcccggctgaatacaatagatatggaattggcgcgccaactcattagttttttgcgcctcaatccaatatcccctaaattgcacatcctagaaggagaaagctgatggctgatttcctgacccgtggcacgcttgctgaggttgatccggaagtaagtgaactcattcgactggaagctgaacgtcagtaccggaaactcatccttatcccaagtgaaagcacggctccggtagctgtacgtgaagcgcttggctcggtttttcaaaatatatatgccgaaggatatccggatgatgagacccgcttgatgagtgaagcggaaatcctggattacaccgcccgcctcagctactaccgccgctatgccgacccgcgctattacaaaggcgtggaatatgccgatgtgatcgaatctcttgcacgccggcgctgcgcggaagtgtttgccaccgacaagttctcagccgaccaattctttgtcaacgttcagccgctctccggcgcccctgctaataacgctgtttacaccgccttgatgaacccaggtgagaccgttttgggaatgaacctgctgcacggcggtcacctgactcacgggtcatcggtcaaccgctccggcaagctgtttaaagccgtgcactacactgtcgacccgcagactgaacaaatcgattacgagcaggtggaagctctggcgctcgaacataaacccaaaatcatcattgccggctattcgtcttacccctgggtgccggactgggcgaaattccgtgccgccgccgataaagttggcgctattttcctggcagatgtttcgcatatcgcggggctgattgcagcgggagccattccctcaccagttggccatgcccatgtgatcaccttcaccacccacaaaaccctgctcggaccacgcggcgcagtcgtcatgaccacggatgctgccctgggtcgcaaactcgaccgcgccgtcttcccgggcgagcaaggtggaccgcatatgcacgccattgctgccctggcatccacattaaaaatcgccaagactgattcgttcaagaaattgcagcatcaaatcatc

SEQ ID NO: 1302 - DNA, 4000 bp, Escherichia coli
  misc_feature (1720)..(1720): n is a, c, g, or t
  misc_feature (3299)..(3299): n is a, c, g, or t
  misc_feature (3343)..(3343): n is a, c, g, or t
tcgagccggcctttctgctcctcggtcgccgcaggaaccgaaagccgcacgagcatcgagcccgaatcgtcgggcacatcggccgacaatgccggatggccgcgtccgtccttcagatggcagttctggcaagcacgcgagttgaataggggtccaagcccgtcggatgagtccgttgaagagggcgccgacacccagttcttgcggaagatgccgttgccgaccttgaagtcgagctcgcgtttgaaatccatattgccggaggatagcgagaaggcgttaggcgtgttggttgtgccgcgtgacgtggcgccgccgccgggcttgtcctcgccctcctcgagcttggtgaaatcggtggtgggggccacgacgctgcgcacggctccatcaccgccggcgccgtaggtccgcgcgatgccggcaaagagcggcagggccgcgccgaaggcaatcgcgccggcgagaagtgcgcggcgtgcgctttcctgcgatgactccttggatgactttcctgagcgatcgcgagactggggctggagtgagtacactaatcctaacgtcagaagctgatgctggtgcgcgcccccaacaccaccgcatcgtccgcgccgggcacattgcccccgggctgccagaagtattggaaatccggttgcagtgtccaaccgggcttgagttgagccgtatagcagatttccaaaagagcctcgtggttgtgaagaacggacaggcctgaatcgctatcgaagccacgcactcggtcggaaatgccggtataggcgaaaccgatgccgatggcgtcgtcggtgcgatgcggaaccattccggtgaaagtgatcccgccctctgcatagaagtctacgacattctggtcggtcggtgcgcccatgacacgcccaaacaagccgacgccctttgggtccttgctgtcgggcaggcgccaaatcagctggtcaacgatgccataaatagcccagtcgccatcgatggggcgtccgggttttcccgtcagagcaatcggcacgccgcctgaatcgaagcgctggtcgggaaatgagccaaaatgattccagcctccaacctttaccactccaggaagctgtccactttggttgtacttatatctaccctcgatcatcagaagcggagggctgtcgagactgaaatcaagcccgtcgctgttgcattcctgcgggtttgggtcgggacagttcgggtcagcaggatcgccgttgaagactccaatcataagtttcaattgatcgctgggcctaacggcaacgcgcacggcgggggtcgctaacggataggcggggccgcctcccggcagatcggcagtcgcaattgaaggccacccccaagtgccattcaagaagtacgaatagctttcggagaggataaattccatgtcggcggcgagctggccgatcttgacggcgagcttgtcgttgaagagatgctgctcgaaccacatctcgtcgagacgcgtcgcaggcgtggcctcaagattggataccggcattagaccgccgatattgtcggcggtgatactacggccgtgaatctggaaggcattcatgtgaaagcagaggcccttccacaggccgagcttcttcatgtccgcgtcgagacgcatgtcgagcacgccgtcataggtgacgccctgcctgaagcccccccagttgccgaacgactccccgtaatatgtgccgctcancatgacgccgcctttcgcgagagcctggcgcacgccgccaggatcaagcttgaacgccacatcgtcggggatgccggtgtcggtcacctcgcaatcggcgcgcgccggaggaggcgctccacagatcgcaacgacgatggcgaaaaggccgatggcccgcagcatgaaagcgctccagaccggattgctccggctaccgcgtccgcttgacgatggcattctagctagcccctcaggcgagttcggcctggcaatcacaaatttaggccccggccttcacgtttttagcccaatttcacatttgacgcgcggccgctggcgtcaatgctgttctccacccccgtcgcctaccgctttgctttgctgctgcacctcgtcgggattgtcgaggctcgccgagccttcgaatttgatggccttcaggtcgagcgttgccaccgcgcgctcgagcgacgtcgtttggtcgagcagagcgtcgattgcgtgctgaaccacggcgttgccctcatcgttgtcctcgccaatcatctggtcataggactcggtggtcagcgcccggaggtacagcgcgttcatcgcctccatggtggcgtcgagcttggccctcacctcagcatcaacctccggcgacttcgccttcaccaggtccgagatgctcgcgccggtaacgagcgacctgtcggcgcggcgataggtgccgagatagacattgcggatgcctagcgcgtcgaagaagtgcgaggcatgcgtgttgtcggagaagcagtcctgctcctcctcggggtcgtggatcataaggccgagcttcatgcgctccccggcgagctcgccgtaagagagactgccgagccccgtcatgatcgcggtgagcccagcctcgtcgccgccatccataatgtgcttgcgcgcgtcgccgccaagctcccattgcgccgccatccaggcgaggtcatcgacgagtagatcagtggcggtgcgaagatactcagcgcgccgttcgcaattgccattgctgcacttcttgaggtcgtagtcgctcgccgggcgattgccgttacccggatccgtaccgttgaggtcctggccccacagcagaaactcgatggcgtgatagccggtggcgatgttggcttcgacgccgcctgcctcttgcaggtggtcggccaggagctccttggtgatcttcgatgtatctagcttcttgccgccaacgatcagcgtcttgttggcgacgacgttggctgtatagaggtcgttctctgccgagtctatgccgtaggacgcggacacataatcgatcaggccttcgtcgagcggccaggagttcaccctgccctcccaatcgtcgacgatggcgttgccgaagcggaaagcctcggtctgcatgtacggaatgcgcgcggcgatccatgccgcacgcgcgccgcgaagattgtcctcggtcggcttggcgaggaaggcgtcgactgcgagcttgagcgtgcgcgcggtgtcgagagagtcgccgtaggccgcttgcgcgatatcggcgtaaatcttgagcacatccttcggcgtgggatcggcgaaagcgggtgangtcccggtgccggcggcaaaagcaacgcaaagagcggcggcggnaagaggccgggcaagcgcaaatcgtctgaacatcagcatcccttgttgccgaagcttgtccgcggtcttggcgagcgccagcaaacaacatgattgcgacggccctccggcctacgacctcggggccgccgcaaggttgagatgaggaggcgtccgcgctttcgcttggacgcctcgggcgccgggctgggcggccggtcgccttgtcaaaacctaccgcggagaataacatgcataaagtgaactcttttcaggagaattattgcaggcagtgcaccttagggaagtcgatgccaatttgctggtaacgctcgacgcgcttctcgtcgatgcgagcgtcacccgcgccgccgagaggctcggccggagctcctccgcgatcagccatgcccttgccaagcttagagaaatcttcgccgacgagctgttcgtgcgcgccggccagaaactcgttccgactgccaaggcggtcgagcttgcgccgacggtgcacgtcatcctagccggcatggagagcctgcttcggccgagcaagccattcgacccgtcactcgccatccgtgacttttcggtggcggcgagcgaggctgccgagctcattttgctgcaacctcttcgtcagcgcctcaagcctttggccccgagtgtgcgcgtcga

SEQ ID NO: 1303 - DNA, 4000 bp, Escherichia coli
  misc_feature (1946)..(1946): n is a, c, g, or t
  misc_feature (1951)..(1951): n is a, c, g, or t
  misc_feature (1960)..(1960): n is a, c, g, or t
  misc_feature (1963)..(1963): n is a, c, g, or t
  misc_feature (1966)..(1967): n is a, c, g, or t
  misc_feature (1970)..(1970): n is a, c, g, or t
  misc_feature (1975)..(1975): n is a, c, g, or t
  misc_feature (1990)..(1991): n is a, c, g, or t
  misc_feature (1997)..(1997): n is a, c, g, or t
  misc_feature (2006)..(2006): n is a, c, g, or t
  misc_feature (2015)..(2015): n is a, c, g, or t
  misc_feature (2024)..(2024): n is a, c, g, or t
  misc_feature (2059)..(2059): n is a, c, g, or t
  misc_feature (2078)..(2078): n is a, c, g, or t
  misc_feature (2116)..(2116): n is a, c, g, or t
  misc_feature (2132)..(2132): n is a, c, g, or t
  misc_feature (2185)..(2185): n is a, c, g, or t
  misc_feature (2210)..(2210): n is a, c, g, or t
  misc_feature (2212)..(2213): n is a, c, g, or t
  misc_feature (2261)..(2261): n is a, c, g, or t
  misc_feature (2821)..(2821): n is a, c, g, or t
  misc_feature (2829)..(2829): n is a, c, g, or t
  misc_feature (2911)..(2915): n is a, c, g, or t
  misc_feature (2917)..(2921): n is a, c, g, or t
  misc_feature (2924)..(2925): n is a, c, g, or t
  misc_feature (2927)..(2930): n is a, c, g, or t
  misc_feature (2932)..(2934): n is a, c, g, or t
aagccaaacttgacgtcttcaccaaaaactaccaaaaaggcaaatacaaaaccgccctgaacaatatcaacgccttcatcaacgaactcaatgctcaacggggaaagcatgtttctgaatccgcctatcaaatgttaaaagcctacgccgatactattgttctgtctttaaatgcccttatgtagggggttgaagtccaaccgtccgaaaacgtacgctaaggtcaggtttcacgaactagtcatggatgaagcgcttctcccagtttgtttccaagcgcccgaccagaatatgatgaactaccctgtcacggaagtcagcggcgaagatctcccgccgcttcggcttctcaaccagaaatgccaccgatgggcccggccgatacgtgcctgcagacaactcttcgtgcagacccacaagattcccctccaggttctgctcgaaacggagggcatttattgtcccacgtttgcggcggcggcaacgctgatacgcccggaagacactttccatactgaatagcggatgcccttcaaacacgaagaacctcctttaccgaaaaaaaaaggggggggacggcaagaccaccattatccaccgcggaccggccacacatagttggtattcgtcttattgtcgttgttcgcgttaccgtcgttcaggttcacgttccacgcgttgcctgtattggccgcgttcgtagtgctcgaccagtagtaattcgactggacatcagcaaacgaaaaattaatccgtccacttctcccgaccccagcaaagcgctgggtcaggaccaccggttgccgaagcccgcaaggggatacaccccgaaacgatacgccatccatggctttttcgaggtatacaccccatggggatacgaccacctgaatgaccatgcccgccagacttagcctgccaagaacaccaggtttcatccgaccaggcgggacggacgcacaatgatgaaacacgcactctcgaaaaagcctttcagccatcccgattccggcctgcctcaccgccccaaaatcaaatttccccacttttcctttccttggccccgaagtcttcagtttttatcgtttgcttcaaccaaccctcgttctgccgcgccaatcccgttaatcgttcggccagatgcaggtaacttttggcgccgccgccgaacgcgcccgaatcgttgcacagacgacacaacacctttagcttctccaactgatttcgcagatctgcgagacgctccctgcgttctgatgtgttgttcgcatctataatcgtctccagcgctgcccgcatcctgttacgcaggtctgttcccaacgtaaatttgttataacggctgaagttttgcacgattttctcgatatgtaccgtcaggtcataggcttcccgatagatcggaaggtgttcatacctggccatcagtcgcatgccttgatagctggatcacgcaaacggatgaattccgtcagtcctcgttccttgttttcgccctgcattgcaatcgccaccgaatgacccgaccttaccagtctgcccacataggcatccagcccgctcctgggaaaacctcccagcacaaccggcgcatcaacatccccggtcatctgcagcttcaaaccagtcactgccgataccgcacgtgcgtcatcggccatcacctgcatgaacgcccctacctgcatcagcaggaggcagtccgaccctgcggtggttttcaatgcattatattgttcgaccagtttctttgaaaaaaccatgaaaacacctcaaaagcttcgcccttaagaggctgtaagaaaacacaaaacattttctaacagcctcaaaaaaaaatcgcgagcagggggcttcgccccctgcacccccaaaaagaatcaaagaactcaaagcaccaaatcaccaaagaatcattgtccaccgcggaccggccacacatagtnggtantcgtcttantgncgnngcncgcgntaccgtcgtacaggnncacgcnccacgcgtngcctgtatnggccgcgtncgtagtgctcgaccagtagtaattcgactggacancagtgaagggatctcccgncgtccactgtccagtccctgccgtattcggcaacgccngattgaaatactgaanagcaatcaggctgtccagttccttccggttcggcaggcgccagtcgcccgcgntggaaccgtctgtaagaccacctgncnngtctgcaagaccagcacaatcgtccagggcctgtgcccaagttctcgntcctgccatgaaattcgcattcttcagccagatcaaccccgtcagattgtcagtcaccgtaccgttggagttatcggtgaaacgcgggttcggccaagccgcgcccatttggaggtcgccatcggagccggctggcgcagtaaaaggcaccgttgacgtctgccccgttttcggaaccgcgttgctggatgcggaagtgcccgctacgccgaaaatggtcacgcctgacttgatgttgcccgtgaccagattcgtatccgccgccgtggttttctcggttccggcatatatgccggccgggatcgtgacagtcgtggtgccgtttgtaccgtttgtgttagcggcgcctgcggcaatagtacctgtcacttccacccctgcaacatacgctttcttgcctgaacgcaaatccgtcgccgccgcatcaccactggtcgtgtcaaccacttcggtcttgcccgctacgccgaagatcgtcgcacctgacttgatgttgcccgtgaccagattcgtatccgccgccgtggttttctcgtttccggcatatatgccggccgggntcgtgtcngtcgtggtgccgtttgttccgtctgtgttagcggcgcctgcggcaatagtacctgtcacttccacccctgcaacatacgctnnnnngnnnnngcnnannnncnnntcggaggtactggcacccgcagcgtcgatggccggggccttttccatgatctggttaaggttgtgcatggtgctgccgggcccggaagttggctcggtaaagctgccagtccgtttggctcccgtgacccccgacagaagccggttgtagagatcctcgaaggtaaacatggcgctagcagagtcagacggcgcggcgggggaattcaaatcgcccgcgaaggccacggctgcaagcattcccagcatcaaaataaccagaggtgttgcgaggcgctttttcatttcgttcatggtattctccttacttgtttcatcgattgcccttgcggacaacagcattcggggggggcgtggtgattacatcacaaactgaacaccataggacgacccggaaaacttgatccagccgaagttttctgcccaggctgggccactcatggcaccggtctgcggatcaagggtcacagccgcattggtggcgctgaagttgatccagccagcggtttcgcaccaggcataacccgaaagtttcccggtgccgtccaggttcacaccccagttggtcgcattggtgttgccgtaaggggacgttgccgaagtggcggcgaatttgatccagcccaaattttcgctccaggccatgcctgacagatagccgttcgcgccgagtttggcggagatgttgccatggatcggtgccacatcgatccagccagaattttccgcccaggcatatttgttcgtcccagggatttttgcgtccatcgccacgaagttagctgttacggtgacattgccggttacgttggtgtcggtgcgcgggttatcggtgcgggcgtcgctccaattcacgaatttgaagccaaccgtggccactgcggttaccggggtgccattcgcaccgaagacgattgtctgagtcgaagttcccgtgactaagccgttagccccggcggtgtaggtcagggtatactgtgctggcgtccatttggcatagagagtgacgtttgcagcgccgatggcaaaggtcgaggcggcggcacgatcggtaccggttccgtcgg

SEQ ID NO: 1304 - DNA, 4000 bp, Escherichia coli
  misc_feature (567)..(567): n is a, c, g, or t
  misc_feature (576)..(576): n is a, c, g, or t
  misc_feature (599)..(599): n is a, c, g, or t
  misc_feature (606)..(606): n is a, c, g, or t
  misc_feature (609)..(609): n is a, c, g, or t
  misc_feature (612)..(612): n is a, c, g, or t
  misc_feature (639)..(639): n is a, c, g, or t
  misc_feature (690)..(690): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (783)..(783): n is a, c, g, or t
  misc_feature (831)..(831): n is a, c, g, or t
aatatcacattcattgattaatgatagtgtcttatacgattttagttaaatggtatgtttgttactgttgctaaccttgaaccccaaggagtatctacatcaacttttgaaccgatagagttaaaacctttatctatcgttgcaatggctatgttttttttcaatcgaggtgaggatgcagcgctagtgacttttccacatattttgttgttatttttaacttcccaaggacttgcgcaaccaccaacgaatgcttcaccttggataattaaaccaaccaccttcctagtaaccccctcagatctaattttgtggagggcattacgactcaagtattcagcactcttgtcgagttgacaaaacttttcaagtggcaattcaagtgcgttagtgtttacatccatatcattaccccaagagaatagagctgattcaactctttcaatgttatttggagagcctggtttgatgtcatattttttacctgcttccataactatatcccagagcctttcgccctgagagctatcccttaggtagagttcaaagccgccctgtttactccancctgagcgntgaacaattagaggaataccttntaattcncantcnctgaaaaagaaatacttaatatccttnatccagtcaccaaaaagatcaagcattaaaggtaagttgttcgggccttgnatagctaaaggggagacgtctggctcactaatttgaacatcccatcctaagccacatgcgagtcctcgagtccaaagnagnacgtcactntcngctattgaaagccagaagtgattgtcacccagccttaaaataattggntcattaataattccaccattttcatcggtaataagggcgtatttcccttgtccaatctgcaattttgaaaggtctctcgaagtaatatattcgacgaatctgtatgcatcacttccgcttatttctacttgacgctcagcagcaacatcccacagagtgacgttattcattaagttccagtaatcagcttcttcaccctcgtaagaggtcggcataatcatgtggttatagatagtgaatgtttgagcgccagcgcgaattgttgcctcgtaaaaaggggattttcttaagcggtctgatagcgtaaagttgacgtgtccttccatttaatactccgaggttattgagctaaactcttaatcaagtaatatgctcttgataaagataaaaaatgtatttttaccctattttattagcaattcaactataaatttttcgttgaaatattatttgtttccagccagtctttgaacttattttttatctccttaagtgttttatcatcgctagcttcgaatcttaaaactaaacatggggttgtgtttgaagccctaacaagaccccaacaattttcataatccaccctgacaccgtcgatagtattaatgttggagcctggaaaattaatgttatttgaaagttttttcattgcatcgaattgttgaccatgcttgttaaagtgaatattaatctctggagtgctaacattgacgggaatttcatcaaaaatctcggagcaggtcttattgctttttgagactatctcaagaagccttgctccggtatagagtgcatcatcaaagccataccagcgctctttgaagaaaatgtgacccgacatctctcctgcaagctcggcacctgtctccttaagttttttcttaataaaactatgtccagttctagacataataggttcgccaccattctcaaaaatatctcttgggagcattgaagtgcacttgacatcgaaaataatttttgcacctttttttcgactaaggacatcccttgaataaagcatcatctgttgatcagcccaaacgatctgtcctttattatcaaccaaacctagcctgtcaccatcaccatcaaaggcaagccctaagtcagacccagtatcaattacttctttaattaagtcctctaggttttgcggtttggatgggtctggatgatgatttggaaatctaccgtcaactaaacaaaacagcttagtaactttggctccgagcgattcaaaaagttgaggtgctatgtttcctgcgacaccatttccgcagtcgacaactattttaagctctttttctaaaacaatatcagatctgatggtgtcgatatagtcttgatcaatattgatcgaggtggaggttccagaaccaactgaaaattgttcttcaataattcttgtatacagagcttcaattctctcagcagaaagggtttctcctgcaaccatgatttttagaccattgtattcaggtggattgtgtgagccagtaaccataactcctgagcttgcacctttagtgtgagttgcaaaataaacaagtggcgatggaaccattccaatattaacgacgtggcaaccactctcaataagccctgatattaatgattcagataactctgtgctagatagtcgaccatctcgaccaacaacaacgcctcgctcacctttagcaattgactcactaccaacagcctttccaatcaatttgactatctcaggagtaagttctgtttcaacaattcctctaatatcatatgctttgaagatcgaacttaaaatattcattaaaatagtggttaaaatagaagtagcgttcattttaacaaacatttattttagataatgaaagaagatttccaagtagttgaaataactcatgactcaatgattattaagtccaatagagaagttggttgtagttcatgctcttcaaaaaatgcttgcggtactggcgttctttctgatttattttcaagctttagtttatttaaaaaacctcttcaaaatggtgtcaaagcgggcgacatgattacattagagatttcatctaaagagctatttttacgtgctagccagttgtacttaatgcctttgttggcattatttatcggtgcctctatttcaaatatcttttaccctgcaaatgacgtcattcaaacatttgtaggtttgtcttctttatttgtcgttctattatttcttaaactttcattaaagtaatttagttgtaatttttttagggataataccctcgaaagttgaaatatataagattccttattgaattaaactaaatatttatgtctcaaaaagatattgatccccaagaaactattgagtggctagaggcctttaggtcggtagccagatttgagggaaaagatagagctaaatacatacttcaaaagcttatggatatggcccatgaagacggcatggacttgccagaaggtgttaatacagcctaccttaactcgataccagtagaaaaagaatccgagttagtcgttatgcatgagattgagcatagaataaagtcaattattcgttggaatgcgatgatcatggttgtaaaagcaaaccaaacctcttccgagcttggtggtcatatcgcctcttttgcatcaagcgcaacactttatgaagttgggtttaaccatttttaccgtggaaacaatctagaccagggcgctgatttaattttctttcaggggcatatcgcgcctggaatctattcaagggcatttttagagggaagaattactgaagagcaaatgcttaattttaggcaggaggctaaccaagaaggactttcatcatacccacacccatggttaatgcctaatttttggcaatttccaaccgtttcgatgggtttaggtccaatcatggcgatttatcaagctcgctttatgaagtatcttcagcatcgagatattattaaaactgacaaaaggactgtttgggcttatataggggatggcgaaactgatgaaccagagtctcttggtgcaatctctttagccggaagagagaagcttgataatcttatttttgttattaactgtaatcttcaaaggcttgacggtcctgttcgtggtaatggaaaaataattcaagaactagaaggaatgtttcggggtgccggctggaatg

SEQ ID NO: 1305 - DNA, 4000 bp, Escherichia coli
  misc_feature (24)..(24): n is a, c, g, or t
  misc_feature (43)..(43): n is a, c, g, or t
  misc_feature (118)..(118): n is a, c, g, or t
  misc_feature (221)..(221): n is a, c, g, or t
  misc_feature (281)..(281): n is a, c, g, or t
  misc_feature (412)..(412): n is a, c, g, or t
  misc_feature (652)..(652): n is a, c, g, or t
  misc_feature (704)..(704): n is a, c, g, or t
  misc_feature (837)..(837): n is a, c, g, or t
  misc_feature (887)..(887): n is a, c, g, or t
  misc_feature (982)..(982): n is a, c, g, or t
  misc_feature (984)..(984): n is a, c, g, or t
  misc_feature (1017)..(1017): n is a, c, g, or t
  misc_feature (1086)..(1086): n is a, c, g, or t
  misc_feature (1101)..(1101): n is a, c, g, or t
  misc_feature (1171)..(1171): n is a, c, g, or t
  misc_feature (1193)..(1193): n is a, c, g, or t
  misc_feature (1247)..(1247): n is a, c, g, or t
  misc_feature (1255)..(1255): n is a, c, g, or t
  misc_feature (1985)..(1985): n is a, c, g, or t
  misc_feature (1992)..(1992): n is a, c, g, or t
  misc_feature (2235)..(2235): n is a, c, g, or t
  misc_feature (2520)..(2520): n is a, c, g, or t
  misc_feature (3517)..(3517): n is a, c, g, or t
  misc_feature (3529)..(3529): n is a, c, g, or t
tgacttatcttgaaattaagggcnaatggcatggaaattacgnttaccttgcacttgctggaacgggaaagattaatgcgatttttacacatttgaagcaggagccgcaaattaaccncattgttctttgtcttgaccaagatgaagccggatgtgcggcggatgaaagagtgcttgaaagattaaagaaaattgagtttccgggacgctgtgacataaanaaacccccagtcaaaagctgtaaggattggaacgattacattatgacgttgcagtaagtngttttccattctgaaaacaaagagaggagatattttatgaatgtcgctgaaactgttgtacgtaagaattcgcacaatttttccatccatgttactgataagggggcgttgaccttttcaatggatggggnaaaagagaaacatgcaaaagctttgaaagacggcaaactcttctttatcggtttgcaagaggtgattgtaaagggaaaaatacaggagtggaaggaaatggagctgccggaagaagattttgctctactttccgacgcacaggaaagggttattgctgctttagcggaagaacgcacaatatccggattaaaaaacgaggataaaagcactctattaaagcgtgtcgataagtggaaaanacggattcgccattatcgtaaaaatggaagaggggaactacttgattatgcngtacacgactttaccattggggcgcagtcatatcgcttctacgagcgtcgcatgaataccacttgggcgtgggatggtattattataaatccggtatacaaagtgagccattctcttgatggcattggtgcanttcctgttcataaaggggcgttgaccttttggtactactatgacgatgancaaggttggtataatgttcgtgaacttactcttaatgaaatgatttgcattgagatcatccactctcatgggatggttcgagaagggaaaatttnangaaggatcgttatgaatttgaaagaacagttcnggaatagaagagacgtttttggaacatcaaactcacgtgacggatacagaaaagtcattttcctatttnttgctttcttatttnttattctttttcgaacatttctactagagagaatcatcatagaaggtagttcgatgtatcctacgctgangaatgaagatgtgtgctttgtntggaaggtaaacaagaagccgataaggtatgagattgttacggcgaatgtgagnggaaaaantgtggtaaagcgtgttgtaggagttccgggagatgagctttcggtcagagaaggaacggtgtatatcaatggatgtccagtgtcacaggaatatgattttataacagaagaacctggagttttgagtggggggtatgttgttagaaaagatgaatacttcctactgggagataatcgggcagaaagcaatgatagccgtgtttatggtgctgtttcattgaaacaaattaagggagtagttgttgtaaggatttatccattgacacaaatagcaatgtattcattgagaagaagctacgcagagggaagtaaatagcggaggtaaattaatgtttgattttttcaaagaaatgacgttggagttatttggaacagatagtgattcggtgagagaaatagaaaaagagaaggcggaagagaagcgcaaaagtagattcatcttttctaagacaacaaaagttgttgtctatgtgctaggagttctctatcttgctattggtggttttggaatttatgttagtttacaagttgcaaaattaacgcaagacgcaactgctggatcgaacatatggcgatatgtcaaatatggccttctttctctgattgatattgctgcaatgagttgtctttttagtggaaaaaagaaaggagaaattgtagcacttgttctgatcttggtattcgttgtgacaatgtatttcacaactatgatacttcctgttatgtgagnagtccgngaacttcaaatgaaattatcttttaaggttggaggtgaatcaaatgcctaagaagaagcaaatgaaagataaatatgatggattgcatgggcaagaactgattgacgctattatgaaggatggaacctttggaaaacctgttacggaaagtcaagcgagagagaatgataagcttattgccaaaatgaacagacggtatgagaaagagcaggaaattaaatccaagatctgtttggcattgangacgattttctttacaccgttgtctattatgttttgtgttcttacttttgttttccgtgtgattggtggagttacatctgtggctctgccttttggaatttactttacttataagtgccttatgcaatggaggactaatggagttgccacagaaaggctgcgtgcttctatcgcgagcatattgtttccttttattgctagtgcttttgccatactcacagaaaaactttggaactattttgaggaaaacaagtaatgaggcaacaaaattagccttgtatgttnacatagcaagcatagcctttgtatatccactttatggatatacaaaggcgcttgttagtcgcttccgctggggcaatgccccctaaaacccccattatccggatttgacgaactccggaatttcaaaaatgacacggttgaatatcctcacggtgaggatgaagagagcggtaaaatgaaaattgttatgtactactatattgtatgttcgatagcggcagcattgtatttcgcggctgagtttgaattgaatagcgggagaaaagcgacagcttatcttttctattttgtgatttatttagatgttctatttttggcgtaaggagaagtggaatggcacaaaaacgaaatagaggaagaagtaaagcagtttacgttcgattgtttcaagaagagtggaatatccttgaaaagaaagcacggttaattggaaaaacaaaatctgattatttgagagatatcattcttcttggagaggtaaaagaaaaaccggtttggcaagatgaaaattttaagcggttactatatgagatcaacaaaatcggtaataatctcaaccagattgcttataattcaaacttgaaaaaatcaactggacgtgaagagatatatgcgttgagagaacagtacgaaagtttattgtctttatatgaagatacgttcttgtacccagaaagtgaagtgaagaatggcgacgacgaagaatcataagattacaacaagtttgaaaagagcaatagactatgcgatgaatgacaaggtcgaggacaccctcaaagatgatataagggatagcgttgcatattctattgatgataagacgggaagagtgacatatcccacttattatacaacgatgaattgcaaaccggggcatccagttaacaccttcaatcagattatttcagaatatggtaaagatgaattggaaaatggaagcgcaagaacaaaagacggtgcacctgttcttgcgtggcattatcatcaaaactttgangggcacgttgancctgcgattgcaaatgaaattggacaacgacttgcgaaagaagtatttggaaactttcctgttgtaattggtacacatacaaatacagaaaacacccacaatcatattattgtttgtgcgtgggatttagacggaagaaagtggcatcagcacaatgctgcataccgccatattcgagaagtatctgatagtctttgcgaggagtatgggctgtcggtattgcgcgatacacggaagcaaagacttgtaaaatggaaagataataatggacaagttcattattatgaaccgacagtgcgaaaaaatgaaattatcaggcagagagaatccggagaaatgacaacagatgatgttggaagttacagaaataccatcccttatgaaatggctgtaagcaaagaagaaaccaattgtgaaattgtaaagagagacattgataagttgcttccggttgccacttcttatgagcac

SEQ ID NO: 1306 - DNA, 4000 bp, Escherichia coli
  misc_feature (1473)..(1473): n is a, c, g, or t
  misc_feature (1486)..(1486): n is a, c, g, or t
  misc_feature (1985)..(1985): n is a, c, g, or t
  misc_feature (2141)..(2141): n is a, c, g, or t
  misc_feature (2247)..(2247): n is a, c, g, or t
  misc_feature (2259)..(2259): n is a, c, g, or t
  misc_feature (2935)..(2935): n is a, c, g, or t
  misc_feature (2983)..(2983): n is a, c, g, or t
  misc_feature (3065)..(3065): n is a, c, g, or t
  misc_feature (3134)..(3134): n is a, c, g, or t
  misc_feature (3163)..(3163): n is a, c, g, or t
  misc_feature (3426)..(3426): n is a, c, g, or t
  misc_feature (3951)..(3951): n is a, c, g, or t
ttgaaagaaaaaatctcctaaatccaggaaagaaaccggaaaaatcatatatagaaaaatgcttaggaaataaagagggtctgattgttgcagcttctgattatattaaaacttatgctgatcaaataagaccttacatttccagatctttttattcttttggaaccgacggatatggcagaagtgatggtagaaaaaacctgagaaaattttttgaagttgataaagaatatattgtaacttatgcattaagtgcattggctaaagaacaactcatttcttcaaaatatgctgaagaagcaatgaaaaagtataagatagataaagataagcctattccaacggtattgtaaagatgtctgataaaaaacaaatcattagtgcaagtccaaaagtaagaaagtttgcaagagagctaggagctaacctatatcaaatacatggatcgcagagggaaggaagagtttctgaaaacgacgttaggtcttttatcaaagaatcgctttcgggagaaattgcaaaaaaacgaactgtaacacctcaagaatatgagcattcagaatttggcgaaattgatgtccagccaattcctagaatcaaaaaaattgctagatcacatttagaaaaatcttggaatgaaattccgcacgttacccaccatgatgaagcagatattactgaaatggataaatttagaaaaactttaagagacttgtatacgggagaaaaaatttcaattacaccattgacgtttattataagagcggttgtaaaagctttaaaagattatccaaattttaacgcttctttagatttagaaaatggaaaagtaatctataaaaaatatttccatgtaggaatagcagtagatactccacatggtttaatggttcccaaaattagagatgcagataaaaaagatataacggcattaggaaaagaattaaaaaaggtaagtacactttgcaaagaacttaaaattgataaaaaggaattttttggaggatcaattacaatttcaagcttaggaaatatcggaggaagtttttttactcctatcattaatcaacctgaggttgctattcttggtgttggtagagcagaaactaaacaagtatttatggatggaaaatatcaaagtagaatcatgcttccattgtcgctgtcttacgaccacagaatcattgatggagctgaaggcgctcgtttttgtgtacatttaagagaaagtttaggaaaggattttgcttataaattagcagtatagtccttccccaatgaaaaaaacaatatcgcttatttgtttagttgtttgtaccttcatttgggggacgacgtttattgctcaagatacgggtatggataatataggcccgtttacttttaactctgttagattttttgtgggctttttaacagtaactccatttgttttattattagagagaaaaaaaattaatgaacaaataaaanctaaaccaaaaantttttcaaaacttataataattattggagtatttttatttttcggaactgtattccaacaagtttcattgctttacaccgatgtagccaattctgctttcttcactattttttatgtaccaatggttccaatcattgtttatttcttattttccaagaaattacattggtctatatggccttctgtattagcgtgtataattggaggctatcttttaagcgacattagtaatgccaatattagatttggcgatggtttagtattaatcggcgctttattttgggcccttcacattatttatataggaaaaataatagaacactttgatttacctttttttattgctttattacaaaatctgattgttgccacattatcctttttattagcaattatatttgaggaaatagatatttcaaaaattaaattggaaacttttgaaatcttatacgcgggcatactatccggcggtgctgcatttgctttacaaatttttggncagagaaatattgcaccagctccagcagcaattgttatgtcacttgagggagtttttgcagcaattgctgcatggttaattttaagccagattttaggtttaaataatattattggttgtacgctgatccttggaggtgttttattgtctcaggtngcaccaatttatgaaaaaaattataagtaagcaataaacagcaatagtaatgaaagtaaaattctataaattacaaatatattcaaactaaattttttaatatagnttagaaagactncgattgtaaaatatgaaaaaataaaagaaaatataacagcgataattgctaaaaagttaagttcagcgctacccaccttgtaaatattataaatccctaaaagactagcggccgctaaagttggtattgataagaaaaatgaaattttagctgaatcaaacctattaaatcccaatagtcttcctgaggtgatagtaattccggttctgctaactccaggtattaaagctataacttgaaacaaaccaataataattgccgatttattattaaattctgtatcaattttttttgtaattttaaccttatcactaacatataaaagaaggccaaatatcaaacttgtccatccaataatttctaagcttcttaaatgattaattaatcctgtttgataaagaatgtaaccgacaggaattattggaatggtgcttatgagaattttgattaagaaagttttattttgaatgaaattaaataagtcttttctaaaataaaatatgattgctattaaggacccaagatgtaagcagatatcgattaataagttttgattgttaaatgcataatattttgaaactaaaactaagtgagcaacagaacttactggtaagaactcagaaataccttgaatagccgctaaaattaaaatttctatggatgaaagcattgattncaggcattgcataacagatatgcaaaaataaatcattaatttattggntttttcaatatataggtcagcttttatgtcctaaaaatccttttagccttatttttattggtataaaagataacggttatanggaaaatattatgtcggataaaatgcttaaatttgtaaacgttggaatgcaaatgccagctaaaagagncggtggtttaagaactaaagattttaaanaaatctatgatcaatttattcacgagaaagctaaagaacaatcgagccgatgttcacaatgtggagttcctttttgtcaagttcattgtcctttgcataataatattcctgactggttaaagttgaccgccgaagggaggcttcaagaagctcatgaattagttcatagcacaaataatatgcctgagatttgtggaagcatttgtccgcaagatcgtttatgtgaaggtaattgcgttattgaaagagcaggacatggaacngttacaatcggatctgttgaaaaatacataacagatactgcatgggaaaaagggtggattaaaccaattaaagttttgaaagaaatagatcaatccgttggtatcattggagcaggaccagcgggattagcttgcgcagaagagctaagaaaatcaggatataaaataactatttacgatcgatacgaccgaccaggtgggcttttgatttacggaataccaaactttaaactagaaaaatttactgttgaaaggagaaccaatcttttaaaagagagtggaataaagtttaaacaagattttgaggttggaaaagatatatcgctcgatgaattaagaaaaaaacatgatacaatacttattgcaactggcgtttataaacctcgagaaatcgatttgccgggctctgatttaaaaaatatttttccagctatggaatttttaacggcatccaatcgaaaaggtttgggagatagagtaaacaattttgataacgggacactcaatgctgaaggcaagaacacnattataattggcggaggtgataccgggatggattgcgtgagaactgcag

SEQ ID NO: 1307 - DNA, 4000 bp, Escherichia coli
  misc_feature (816)..(816): n is a, c, g, or t
  misc_feature (826)..(826): n is a, c, g, or t
  misc_feature (2992)..(2992): n is a, c, g, or t
  misc_feature (3019)..(3019): n is a, c, g, or t
  misc_feature (3055)..(3055): n is a, c, g, or t
  misc_feature (3073)..(3073): n is a, c, g, or t
  misc_feature (3115)..(3115): n is a, c, g, or t
  misc_feature (3118)..(3118): n is a, c, g, or t
  misc_feature (3124)..(3124): n is a, c, g, or t
  misc_feature (3181)..(3181): n is a, c, g, or t
  misc_feature (3212)..(3212): n is a, c, g, or t
  misc_feature (3217)..(3217): n is a, c, g, or t
  misc_feature (3283)..(3283): n is a, c, g, or t
  misc_feature (3286)..(3286): n is a, c, g, or t
  misc_feature (3361)..(3361): n is a, c, g, or t
  misc_feature (3469)..(3469): n is a, c, g, or t
  misc_feature (3478)..(3478): n is a, c, g, or t
  misc_feature (3487)..(3487): n is a, c, g, or t
  misc_feature (3499)..(3499): n is a, c, g, or t
  misc_feature (3502)..(3502): n is a, c, g, or t
  misc_feature (3511)..(3511): n is a, c, g, or t
  misc_feature (3514)..(3514): n is a, c, g, or t
  misc_feature (3538)..(3538): n is a, c, g, or t
  misc_feature (3574)..(3574): n is a, c, g, or t
  misc_feature (3595)..(3595): n is a, c, g, or t
  misc_feature (3616)..(3616): n is a, c, g, or t
  misc_feature (3622)..(3622): n is a, c, g, or t
  misc_feature (3631)..(3631): n is a, c, g, or t
  misc_feature (3634)..(3634): n is a, c, g, or t
  misc_feature (3661)..(3661): n is a, c, g, or t
  misc_feature (3682)..(3682): n is a, c, g, or t
  misc_feature (3730)..(3730): n is a, c, g, or t
  misc_feature (3736)..(3736): n is a, c, g, or t
  misc_feature (3748)..(3748): n is a, c, g, or t
  misc_feature (3760)..(3760): n is a, c, g, or t
  misc_feature (3787)..(3787): n is a, c, g, or t
  misc_feature (3850)..(3850): n is a, c, g, or t
  misc_feature (3859)..(3859): n is a, c, g, or t
  misc_feature (3874)..(3874): n is a, c, g, or t
  misc_feature (3880)..(3880): n is a, c, g, or t
  misc_feature (3886)..(3886): n is a, c, g, or t
  misc_feature (3889)..(3889): n is a, c, g, or t
  misc_feature (3904)..(3904): n is a, c, g, or t
  misc_feature (3913)..(3913): n is a, c, g, or t
  misc_feature (3934)..(3934): n is a, c, g, or t
  misc_feature (3937)..(3937): n is a, c, g, or t
  misc_feature (3943)..(3943): n is a, c, g, or t
  misc_feature (3949)..(3949): n is a, c, g, or t
  misc_feature (3975)..(3975): n is a, c, g, or t
  misc_feature (3990)..(3990): n is a, c, g, or t
ttattgtcatcggcacgcacagtgtagacaaagtcaatcgtgtcttattctttgtgatgattgccacttttatcttagtactcgcattaatgctaccaaacattaaatttgataacttaatggcgatgcccattgataacgccttaattatttctgcaagccctgtatttttcacggcatttggcttccacggttcgattcctagcttaaataaatacttagacggtaatgtgaaatccttacgcattgcgattttagttggttctggcatcacgttatttgcttactttttatggcagctttcgacgcacggcttactcagccaaaatgagttcttacaaattttacgcgaagacgccacattaaatggcttagtgaaagcaaccttagaaatcacccaaagcccaattattgcaaatgcggtaaaaatcttctccactttggcgttggtaacctcattcttaggcgtggcattaggcttattagaatgtattgaagacttgctcaagcaatcttttaatattcatgcaggacgcatttcattaggtttaatgaccttcattccaccggtactattctcccttttctatccagaaggttttattctcgcactgggttatgccggtcaaatgtttgcgttctacgcggtagttttaccggtggcattagtctggaaagcacgctcaatttatccaaacttgccatatcgcgtatggggcggtaaagcgttgttagtgatcatattgatgcttggcgtgattattacttcaattccttttgctatccgagcgggttacttaccttttgttgtaggtnaaaatggaanaaaaaagaccgcacttttaaggtgcggtcttttttatttattttcgtataaatgggtgactaactgaccatttaaatattcaccgacatacacttggttaactgcaagattctgtttttctaactccgatttaacccattcctcgtcacgcccaacgacttctaaaatatcgttatctaattgcccatcaataattaatgggtaacgtaaattttcatcgccatattgaataatggaaagttgcccattttgttcgagtacagcacgttttacactattaatttcataaataccggcagcacgtaacttaaacatgagatcatgagcggtaataccatttctcatacattcagccgtctgaaccttaccatttaaaatgacccaaacaggtttaccatcaatcaaggatttaacaaattgattatgatttttgataaaacgcagggtaaaaatcaataacgtccaaagtacgagtacgagagagaattggagcactccaatactatcactataaattaccccaccaataataccgcccagcacgtaattttgtacctgatccattgcggaggtcggggcgagattacctttacccattaaattgatttgaagtacgagtccaataatacccatggccaatttcaagcctaataatgtatagccatccattagttttcctccttatcaataacagtaacattagggtttactaagttaattggggataaggtatatgcggtaaaatcattattaaaatggacttcgaaatactgatcccgaatatttaaaatcatgccgttacttaatgtacggctattggtacgaatatcttctttctgtaaattttgactgtctttcaccgaatttaaaaatgtcaccacgcgagaggtatcagctgcatagacttcacttcgctcatattggttatattgcacaccgagcaagaaaatgattaataaaagaaaaatgatactgagatcacggtatttggtttgtaaccgatgacgcaaatataagcttgtcaccacaaacaatgcacctaacgagacaaaaatggcgatatatttaagataaccttgaaaagacatcgcattttctaaaaaagcaaaagagaaaaaagacattttgcattcctaattttgaagagaaaaacagactgccaatgtagcacaacgaaaactgactagccatttttatcacataaattaaattcgtttttccgaaaaatcccttttataatgaccgcacttttgaaacaaaaagagaaaaatatgaaagcaattcagcccgaagatcagggatattggctgttcaccaaaggatcgatgatttattggcaggaaaatgatctgcctttcggatcagcaaaggaactcggcctcacaacacaaaaagcaatgttgctcgggaaatggaaatcacaacctttatggcttgtggcagaaaatgagcaagatgaacgagaatatctttccttacgaagtttgttgtccttactgactgaagattttcatttattaagccgaggcgtggaaatcaatcattttctgaaaacccaccaattctgcggaaagtgcggccaaaaagcggaacaaacccacgatgagctagcggttcaatgcacaagttgcagctatcgtacttacccagttatttgcccttcgatcattgtcgccgttcgccgtggcacagagattttattagccaaccataaacgccattacacaccaggcaaagccggtatttacaccacgctagcaggttttgtggaagtaggtgaaaccttcgaagatgccgttcgtcgcgaagtgtttgaagaaaccggcattcgcattaaaaatattcgctatttcggtagccaaccttgggcattcccaaattcacaaatggtgggttttttagctgattacgacagcggggacattcaactgcaagaaacggaactgcatgatgcacaatggttttctagcgctgcccccttgccagaattaccgccaacaggtactatcgcactcaaattaattaatgctacgcttgagctttgcaaagcggaataaaataaataaaggaaagcccatgtctgaattaaaaaatgatcgttatttaaaagccttattacgcgaaccagtggatatgacccccgtatggatgatgcgccaagcgggncgctatttgcctgaatataaagcaacncgtgcagaagcgggcgattttatgtctctttgccgnaatgcggatttagcttgngaagtcaccttacagccacttcgtcgctatgctttagacgcngcnattttnttctcagatattttaactattcctgatgcaatgggcttaggcttaagttttggtgcnggtgaaggcccgaaatttgctcatccaattnaaaanaaaagtgcggtcgaaaatttaccgattcctgaccctgaaggcgaacttcaatatgtgatgaatgcngtncgcacaattcgtcgcgaactaaaaggcgaagtgccactgattggtttctctggtagcccgtggacactggcaacntatatggttgaaggtggtagcagcaaaaccttcaataaaatcaaaaaaatgatgtatgccgaaccgcaaaccttgcatcttttattagataaagtggcggattccgtnattttatanttaaacgcncaaatcaaagcnggngcacaagcngtnatggtatttgatacttggggcggngtgttaggtcatcgtgaatatttagacttctctctncaatatatgcataaaatcgtngatggtttaattcgtgaacangatggncgtaaagtnccngtgactttatttactaaaggcggcggnttatggttagaagccatggcnaatacaggctgtgatgcgctaggattagactggacagttaatttggcngatgcnaaagcgcgtgtnggtcataaagtngcgctacaaggcaatatggatccaagngtgttatatgcacctgcagagcgtattgagcaagaagtgcggtcaattttagctgattttggncaaggcagnggacatgtatttaanttaggncatggnatncaccaagatgtgccngaaagtgcnccaaaaatcttcgtggatgcnatncatganttctcnaaagcctatcataaataagcgagaanaaaatgcgaaatccnattcacaagc

SEQ ID NO: 1308 - DNA, 4000 bp, Escherichia coli
  misc_feature (1524)..(1524): n is a, c, g, or t
  misc_feature (1877)..(1877): n is a, c, g, or t
  misc_feature (1989)..(1989): n is a, c, g, or t
  misc_feature (2027)..(2027): n is a, c, g, or t
  misc_feature (2163)..(2163): n is a, c, g, or t
  misc_feature (3211)..(3211): n is a, c, g, or t
  misc_feature (3589)..(3589): n is a, c, g, or t
  misc_feature (3730)..(3730): n is a, c, g, or t
  misc_feature (3914)..(3914): n is a, c, g, or t
tgtgcattttgaagggcgagtcccgcatgctctctcaagggatgaaagtgaattttcgggaacctctcttgcgccaagcgtacatcgtaaggcgaggtacaaagataggccagcgcatttgcagcatcgcttgccattctgctggggtaggcgtacaaaaactctttgagttcttggggggtgtcggcggtgatccaccgcgcccccgtgtacgggcagccttcgagtcgcacatcgcagtcgtactcggctttgagtcggtgttgaaccacttcgaactgaagttggccgatggcgcccaggagcatcaacccacccgcatcggggcgaaacacttgtatcgcaccctcttcgcccaattgagccaagcccgtttgcagttgcttggttctgagaggattttttaaaatcacggtcatgaagagctcgggtgcaaaaaaaggcaaacctgtgaactgcaaggaggcgccatcggtgatggtgtcacccaattgaacgccaccatgggtggtaaagccaatgatgtcaccggcataggcctcctcgacggcttctctgcgttggctcaaaaaggtcacgaccgaggtgggtctgagctctttggaggtgcgttgcactttgagcttcatgcccggtgcgtagcggcctgaggccacccggacaaaggcgatccggtctctgtgtgaggggtccatgttggcttgaactttgaacacaacacctgagaattgtgtttggtcgggttcaatggttttgagttgcgtttggccttgcgcgatgacggtgctttgtctggcttgtggcgctggtgccaagtccaccaaggcatccaagacctccatcacgccaaaattgttcacaccagaaccaaagaagaccggggtttgttggcctgatagaaaggcttctcgatcaaaggcgggggaggcccccgtggccaactccatgctttctaatgcggtggtgaattcgtgaccaaagcgctctttcaagcgagccagttcggtcaagggaacggtctcaaagtcttgtgggcgtctttcggagccggactcaaagaccttcatgctttgcgtgcgcaagtcaatgatgccgccaaaggacttgccctgcccaactggccaggtcatgggcacgcagggcatgcccagttcacgctcgacttcgtccaaaatgtccaaggggtcgcgcacctcgcggtccattttgttgacaaaggtgatgatgggcgtgtcacgcgttcggcaaacttcaatcagtcgcctggtttgtgcttcaacgccattggccgcatcgatcaccatcaaggcagagtcgacggctgtgagcacgcggtaggtgtcttctgaaaagtctttgtgacctggggtgtcgagcaaattgatcacatggtcgcggtagagcatttgcatgaccgaggaggccactgagatgccgcgctgcttttcaatctccatccagtcgctggtggcatgtcgactggcttttctggctttgaccgagcccgcaatttgaatggcaccngagaacaagagcaatttttcggtgagcgtggttttacctgcatctgggtgagagatgatggcaaaggtgcggcgacgtttgacctcagcggtcagagaggcgacttgcatggtgcgcaatcattgaaaaaatgaaacgatgaaaaggccaatttgaagcgacaagggcagatcccaagcagatcctagacatccgatgatctaggtgtgccagcccaactcccgaggattcgctgtgtcttggcttgggtgtgttgctcttcaaagaagaaagagaagtattttaacccttgtgcgacccaagtctgaagggtgccgatggcttgacccgccgaaggggaaaaccgcaaagancgcatttgggagatgcgccgcaaagggttggagcaccccccaagacccttatttttggggtttattgtgcccccagagctcttgagccttggcacttgggttaaaataatgncaccgaggagcgatgcaactctgtcgcagcgaaaaaangctttagatgttttacaacacgaagcctctttctcgcgggactgacaaagtgaggctcggtcacttttttcaaacggcgctcacccactgctagttgtgaggtgaggtgcccgtctcctttttctcgacaaggctnggatctcgtttgcttttgtgatttcacaagcgaaccgccttccttgctggcagtggttttttatcatccgatggagttaaaagacatgaacgctgtgatcaaacctttacatgccaacgatgccgtggtggccgatttgtccttggcggattggggtagacgagaaattaaaatcgctgaaaccgaaatgccaggcctcatggccattcggcaggagttcagtgcaagcaaggcgctcaaaggcgcacgcattacaggctctttgcacatgaccattcaaacagctgttttgattgaaaccttgcaagccttgggcgcgcaagtgcgttgggcttcttgtaacatttattcaacccaagaccatgcagcggctgcgatcgcggctgcaggaacccccgtttttgccaaaaagggcgagaacttgaccgagtattgggattacacacaccgtatttttgaatttggagcggcccatacagaagacgaaggccccaacatgattcttgacgatggtggggatgcaacgcttttgatgcacttgggtaaaaaggcagaaaaagacctctccttgttaagccacccaagcagcgaagaagagatttgtttgtttgcgtcgatcaaagaaaaattggcccaagatccctcatggtacagccgcaaaagcgccaagatcattggcgtgacagaggagaccacgacgggcgttcatcgcttgaatgaaatgtctgccaagggcgatttgatgttcagagccatcaacgtcaatgactcggtcaccaagagcaaatttgacaacctgtatggctgcagagagtctttggtggacggcatcaagcgcgcaaccgatgtgatgattgcaggtaaagttgccgtcgttgctggctacggagacgtgggcaaaggcagtgcgcaggctttgcgtgcgttgagcgctcaagtatgggtcaccgagattgaccccatcaacgcattgcaagcggccatggagggctacaaagtggtcaccatggattacgcaagcgacaaggccgatatttttgtcacggcnacgggcaacaaacacgtgatctcccacgagcacatgctcaaaatgaaagaccaggcgatcgtttgtaacattggacactttgacaatgaaatcgacatcacggccatggaacaataccagtgggaagaaatcaagccccaagtcgatcacattcatttgccttcaggccacaagatcatcatgctcgccaaaggacgtttggtcaatttgggctgtggcacagggcacccaagctttgtgatgagctcatcgtttgcaaaccaaacgattgctcaaatcgagcttttcaaattccaagaccgttacgagaacggtaaagtgtatgtgttgcccaagcacttggacgagaaggtggccaggttgcatttggcgaaggtnggagcaatgttgacggaactcaccgatgagcaagccagctacattggcgtgaacaagcaaggtccttacaaggccgacgcctaccgctattgatccaagtaggtgcaagcgtggcttttgaaccagtcaccttgcatcccnctttgtccaaggggcaagcttttgctggggttctcaaacattttttcccgctcccatgaatccaaccctcagtgttgaattttttccgcccaaaacgcctgaaggtgccgagcgtttgaagggggtacgacaagagttgtaccgcatcaagccacaattttgttcggtcacttacggtgccggnggctctacccagtcggggactttgagcacggtggcccaaatacaagccgagggacaagaggcggccgcacacctgtcttgcgtggg

SEQ ID NO: 1309 - DNA, 4000 bp, Escherichia coli
  misc_feature (2518)..(2518): n is a, c, g, or t
  misc_feature (2931)..(2931): n is a, c, g, or t
  misc_feature (3597)..(3597): n is a, c, g, or t
  misc_feature (3660)..(3660): n is a, c, g, or t
tcgacgaaggcatctgcctcaccgccacgctcgacatcctcaaggcgatcgcgcgcggcaacgggccggagagcgccatcctcgcgctcggctatgccggctgggcgcccgggcaattggaaaacgaaatccaggcgaacggctggctgcattgcgccgccgatccggaattgatcttcggcaccgacaccgacggcaaatacgacaaggcgctgcgcaagatcggcatcgatctgggccagctgtcgagcgaatccgggcacgcttagttcttcactgtcgtcccggccaagcgagcgttagcgagcgcgagccgggacccatggccaccggactatcgatgggctgcggagtatgggtccccgccttcgcggggcatgacattttaataatgatctagcgcgcgacttcgagcttttcgctgctgagcagcccgcccgccgcctgcgcgctcatcggctcgccgaaggcgaagccctgcgcgtattcgcagcccatctggtagagttcgaccgcgtcggaatcagtctcggcgccttccgccaccacttccatgccgagatcgtgcgcaagcgcgatgatcgagcgcaggatcaccggccgcgtgccgcgcgcggtggtgcgcacgaacgactggtcgatcttgatggtgtcgaacgggaagcgctgcagataggcgagcgaggaatgtccggtgccaaaatcgtcgagcgatagcccgacgccgagctccttgatgcgcgtgagcatctgcgcggcgtgctcgggattttccatcaccagcgattcggtgatttccagcttgaaggtgccgcgcgccagcgtcgagcgcgacagcacgccgcgcaggtcctggatcaggtcgtggcgcagcaattgccgcgacgacacgttgacgctggcgaagatcggctcgcgcgcgcggctggcggcctgccagattgcgagttggcgcgcggtgcgttcgagcacgaacaggccgaggtcggcgatcaggccgatttcctcggcggtggtgatgaactcggccggcgacaagcggccaagcttgggatgatcccagcgcgccagcgcctcgaaaccggcaatggcgcgatcctccagccgcacgatcggctggtagagcaccttgatctcctcgcgctcgatggcgcggcgcaattccgattccatggtcagccggtcggtcttgcgcgagcgcatggccggcttgaagatttcgatgcggtcgccgccgatccgcttggcgtgatacatggcgagctcggcgtccttgagcacttcctcggtgttgcgcgactggtcttcggcgagcgccagcccgatcgaggcggtgatgaagatttcgcggtcgttgaagccgatcggcgcgcgcaaggtgcggcgcatggtctcggcgaaggccacgatgcgcgcgggctcgcgttccgacagcaggatcaaggcgaactggtcgccggatagccgcgccagcgtgtcctgcggcttgagcagacgggcgagccggcgcgcgatggtgagcaggacggaatcgccgaccgcgatgccgaccgaatcgttgacctgcttgaaacggtcgagatcgatcaccagcaccgacggccggaattggctgtcggagcgggcgaagccgaaggccgcctccatgcggtcgatgaacagttcgcggttgggcaggccggtgagattgtcgtgcaccgcgtcgaacagcaatcgctcctcggccttcttgaaatcggtcacgtcggtgagtgtgccgaccaggcgcaccacttcgccgtcggagccgaccaccggccgtgctttgagcgagaaccacaggtaatggccgtcgaccgcgcgcagccggaaagtctgactgaggcgtccgcgccgctgctccacggcgctgtcgagcgaggcgcggaagcggtcgcgatcgagcggatgcagcacctcgagccagtccgccgccggtccttccagcgtgccgcgcttgaggccgagcagttgttctgtttccgggctggtgtaaaccttgtcggcggagacgtcccagtcccagatcagatcgccggcgccggtgagcgccagcgcgcggcgttcgacgtcggaaacgatgccgtgggtaatgccgccggcgaaggcgtgctgcatcaccgtgaatccgatcagcatcacgatcagcaccaggccgccgagcagcgccgggccgatgatgtcgttggtgacgacgccggtcaccgcaaagcctgcgcccagcgtccacaccaccagcaagagccaggtcggaatcagcagcacggcgcggtcgaagccgtgggtggaaagatagatcaccaatgcgagcccaaaaacggcaatgccgacgagcgacatgcgggcgatgccggcggcaaccgccggatcgaacaccgccaccgcgatcagcgcggcgagtactgcgagccagccgatggtgatgtgggcgtagcgcacgtgccagcgcgacagattgagataggcgaacaggaacaccagcagcgtcgccgacaggatngcctcgccgcaggcgcgccagacgcgctcggcgccggccgacatgtcgaacaccttgccccagaatccgaagtcgatgccgatatagatgagcaccgcccagccgagcgcggcggcggctgggaacatcaccgaacccttgaccacgaacaggatggtgaggaacagcgccagcagtccggcgatgccgatgacgatgccgtaatacagcgtgaaggagttgaccttgtccttgtaggcgtccggctcccataaataaatttgcgaaagcttgtcggtgcgcaattcggcgacgaaggtgatgacggtgccgggatcgagcgtgacgcgaaaaatatcggcggtcgtgttctcctgccgcagcggacggtcgcccgagctcggcgtgatggaggcgatgcgtgacaagcccangtcgggccagaacaggccggagccgaccatgcggtaatgcggcacgacgatcagccggtcgatctgctcgtcggaattgttggtgagcgcgaacaccgcccaattggtattggcttcgcgcgcgcgcacctcgatgcggcgcacgatgccgtccggaccgggcgcggtggagacctggatgcggtcgccgtcggtcttttgcacgtcggtggcggcggtgagatcgatggccgcggcatcgagccgcacgttcacggattcgacggcaagcgcggcgggcgtcgtcagcagcgaggcggcgagcgcgagcacggtgacaagcgcgcagcggtgcgagatcaatcgagaacccccggccgcagcagtgccagtcatgctgctgatccagctccgccgacggtaaaaatctgcaagcaaattcaccctgcccgattttgcttcgacattgcgccgatttcgcggccctggcgccccttgcgcacctgccaggagtatcggctccgctcccggcgggcaagagatcgaccgcgctttcaaagggttagcacgatcttgccgatatgcgcactggtttccatcagcgcatgggcggcggccgcctctttgagcgggaaggtcttgtagatcaccggtttgaccttgcccttggcgatcatcggcagcgcnttgtcttcgaccgcgcgcgcgatggcccctttgtcggcgaccgagcgcgagcgcagcgtcgancccgtgtgatgcaaccgcttgagcatgatgcggcggaaatccaccgtcgtcttcggtgagccttggaatgcgatctgcacgatgcgcccctccaccgcggccgcttcgtaattgcgcgcgatgtaatcgccgccgaccatgtccagtataacgtcggcgcccttgtcgccggtggccgccttgcaggctgcgacgaagtcatcggttttatagttaatggccacgtcggcgccgagcttgcggcaggcggcgcatttttccgtcgtgcccgcggtggtgatcacgcgcgcgccgagcgccttggcgagctggatcgccgtggtgccgatgccggacgagc

SEQ ID NO: 1310 - DNA, 4000 bp, Escherichia coli
  misc_feature (424)..(424): n is a, c, g, or t
  misc_feature (427)..(427): n is a, c, g, or t
  misc_feature (429)..(429): n is a, c, g, or t
  misc_feature (431)..(433): n is a, c, g, or t
  misc_feature (435)..(436): n is a, c, g, or t
  misc_feature (438)..(438): n is a, c, g, or t
  misc_feature (441)..(442): n is a, c, g, or t
  misc_feature (444)..(444): n is a, c, g, or t
  misc_feature (451)..(451): n is a, c, g, or t
  misc_feature (461)..(461): n is a, c, g, or t
  misc_feature (464)..(464): n is a, c, g, or t
  misc_feature (466)..(467): n is a, c, g, or t
  misc_feature (471)..(471): n is a, c, g, or t
  misc_feature (473)..(473): n is a, c, g, or t
  misc_feature (475)..(475): n is a, c, g, or t
  misc_feature (481)..(482): n is a, c, g, or t
  misc_feature (484)..(484): n is a, c, g, or t
  misc_feature (487)..(487): n is a, c, g, or t
  misc_feature (489)..(489): n is a, c, g, or t
  misc_feature (493)..(493): n is a, c, g, or t
  misc_feature (495)..(495): n is a, c, g, or t
  misc_feature (497)..(497): n is a, c, g, or t
  misc_feature (499)..(499): n is a, c, g, or t
  misc_feature (503)..(505): n is a, c, g, or t
  misc_feature (507)..(509): n is a, c, g, or t
  misc_feature (511)..(512): n is a, c, g, or t
  misc_feature (516)..(516): n is a, c, g, or t
  misc_feature (525)..(525): n is a, c, g, or t
  misc_feature (536)..(536): n is a, c, g, or t
  misc_feature (540)..(541): n is a, c, g, or t
  misc_feature (543)..(543): n is a, c, g, or t
  misc_feature (549)..(550): n is a, c, g, or t
  misc_feature (555)..(555): n is a, c, g, or t
  misc_feature (567)..(567): n is a, c, g, or t
  misc_feature (573)..(574): n is a, c, g, or t
  misc_feature (576)..(576): n is a, c, g, or t
  misc_feature (581)..(582): n is a, c, g, or t
  misc_feature (586)..(586): n is a, c, g, or t
  misc_feature (588)..(589): n is a, c, g, or t
  misc_feature (591)..(591): n is a, c, g, or t
  misc_feature (593)..(593): n is a, c, g, or t
  misc_feature (598)..(598): n is a, c, g, or t
  misc_feature (603)..(603): n is a, c, g, or t
  misc_feature (605)..(605): n is a, c, g, or t
  misc_feature (610)..(610): n is a, c, g, or t
  misc_feature (616)..(617): n is a, c, g, or t
  misc_feature (621)..(621): n is a, c, g, or t
  misc_feature (624)..(624): n is a, c, g, or t
  misc_feature (627)..(627): n is a, c, g, or t
  misc_feature (631)..(631): n is a, c, g, or t
  misc_feature (639)..(639): n is a, c, g, or t
  misc_feature (644)..(646): n is a, c, g, or t
  misc_feature (648)..(648): n is a, c, g, or t
  misc_feature (650)..(650): n is a, c, g, or t
  misc_feature (652)..(653): n is a, c, g, or t
  misc_feature (656)..(656): n is a, c, g, or t
  misc_feature (669)..(669): n is a, c, g, or t
  misc_feature (672)..(672): n is a, c, g, or t
  misc_feature (677)..(677): n is a, c, g, or t
  misc_feature (679)..(679): n is a, c, g, or t
  misc_feature (681)..(683): n is a, c, g, or t
  misc_feature (685)..(685): n is a, c, g, or t
  misc_feature (687)..(688): n is a, c, g, or t
  misc_feature (701)..(701): n is a, c, g, or t
  misc_feature (706)..(706): n is a, c, g, or t
  misc_feature (712)..(712): n is a, c, g, or t
  misc_feature (715)..(717): n is a, c, g, or t
  misc_feature (720)..(720): n is a, c, g, or t
  misc_feature (724)..(724): n is a, c, g, or t
  misc_feature (727)..(727): n is a, c, g, or t
  misc_feature (733)..(735): n is a, c, g, or t
  misc_feature (737)..(738): n is a, c, g, or t
  misc_feature (740)..(740): n is a, c, g, or t
  misc_feature (744)..(746): n is a, c, g, or t
  misc_feature (748)..(752): n is a, c, g, or t
  misc_feature (754)..(754): n is a, c, g, or t
  misc_feature (762)..(762): n is a, c, g, or t
  misc_feature (767)..(767): n is a, c, g, or t
  misc_feature (775)..(776): n is a, c, g, or t
  misc_feature (779)..(779): n is a, c, g, or t
  misc_feature (782)..(782): n is a, c, g, or t
  misc_feature (784)..(784): n is a, c, g, or t
  misc_feature (787)..(787): n is a, c, g, or t
  misc_feature (792)..(792): n is a, c, g, or t
  misc_feature (801)..(802): n is a, c, g, or t
  misc_feature (804)..(804): n is a, c, g, or t
  misc_feature (807)..(808): n is a, c, g, or t
  misc_feature (811)..(811): n is a, c, g, or t
  misc_feature (813)..(817): n is a, c, g, or t
  misc_feature (821)..(824): n is a, c, g, or t
  misc_feature (826)..(826): n is a, c, g, or t
  misc_feature (830)..(831): n is a, c, g, or t
  misc_feature (834)..(836): n is a, c, g, or t
  misc_feature (838)..(838): n is a, c, g, or t
  misc_feature (845)..(845): n is a, c, g, or t
  misc_feature (848)..(848): n is a, c, g, or t
  misc_feature (853)..(853): n is a, c, g, or t
  misc_feature (859)..(862): n is a, c, g, or t
  misc_feature (865)..(865): n is a, c, g, or t
  misc_feature (869)..(869): n is a, c, g, or t
  misc_feature (874)..(874): n is a, c, g, or t
  misc_feature (901)..(901): n is a, c, g, or t
  misc_feature (925)..(925): n is a, c, g, or t
  misc_feature (929)..(931): n is a, c, g, or t
  misc_feature (935)..(938): n is a, c, g, or t
  misc_feature (940)..(940): n is a, c, g, or t
  misc_feature (944)..(944): n is a, c, g, or t
  misc_feature (948)..(948): n is a, c, g, or t
  misc_feature (950)..(950): n is a, c, g, or t
  misc_feature (953)..(954): n is a, c, g, or t
  misc_feature (965)..(966): n is a, c, g, or t
  misc_feature (971)..(971): n is a, c, g, or t
  misc_feature (973)..(973): n is a, c, g, or t
  misc_feature (976)..(976): n is a, c, g, or t
  misc_feature (978)..(978): n is a, c, g, or t
  misc_feature (986)..(986): n is a, c, g, or t
  misc_feature (988)..(988): n is a, c, g, or t
  misc_feature (992)..(992): n is a, c, g, or t
  misc_feature (995)..(995): n is a, c, g, or t
  misc_feature (1000)..(1001): n is a, c, g, or t
  misc_feature (1008)..(1009): n is a, c, g, or t
  misc_feature (1011)..(1011): n is a, c, g, or t
  misc_feature (1013)..(1013): n is a, c, g, or t
  misc_feature (1016)..(1022): n is a, c, g, or t
  misc_feature (1024)..(1024): n is a, c, g, or t
  misc_feature (1029)..(1030): n is a, c, g, or t
  misc_feature (1035)..(1036): n is a, c, g, or t
  misc_feature (1038)..(1038): n is a, c, g, or t
  misc_feature (1041)..(1042): n is a, c, g, or t
  misc_feature (1044)..(1046): n is a, c, g, or t
  misc_feature (1048)..(1055): n is a, c, g, or t
  misc_feature (1057)..(1058): n is a, c, g, or t
  misc_feature (1061)..(1062): n is a, c, g, or t
  misc_feature (1064)..(1064): n is a, c, g, or t
  misc_feature (1071)..(1073): n is a, c, g, or t
  misc_feature (1075)..(1076): n is a, c, g, or t
  misc_feature (1081)..(1081): n is a, c, g, or t
  misc_feature (1084)..(1084): n is a, c, g, or t
  misc_feature (1087)..(1089): n is a, c, g, or t
  misc_feature (1091)..(1092): n is a, c, g, or t
  misc_feature (1095)..(1095): n is a, c, g, or t
  misc_feature (1097)..(1097): n is a, c, g, or t
  misc_feature (1099)..(1099): n is a, c, g, or t
  misc_feature (1101)..(1108): n is a, c, g, or t
  misc_feature (1110)..(1110): n is a, c, g, or t
  misc_feature (1112)..(1112): n is a, c, g, or t
  misc_feature (1114)..(1116): n is a, c, g, or t
  misc_feature (1118)..(1119): n is a, c, g, or t
  misc_feature (1121)..(1121): n is a, c, g, or t
  misc_feature (1125)..(1125): n is a, c, g, or t
  misc_feature (1127)..(1127): n is a, c, g, or t
  misc_feature (1129)..(1131): n is a, c, g, or t
  misc_feature (1135)..(1138): n is a, c, g, or t
  misc_feature (1140)..(1140): n is a, c, g, or t
  misc_feature (1143)..(1143): n is a, c, g, or t
  misc_feature (1145)..(1145): n is a, c, g, or t
  misc_feature (1147)..(1150): n is a, c, g, or t
  misc_feature (1156)..(1156): n is a, c, g, or t
  misc_feature (1158)..(1158): n is a, c, g, or t
  misc_feature (1161)..(1163): n is a, c, g, or t
  misc_feature (1166)..(1167): n is a, c, g, or t
  misc_feature (1170)..(1170): n is a, c, g, or t
  misc_feature (1172)..(1173): n is a, c, g, or t
  misc_feature (1176)..(1176): n is a, c, g, or t
  misc_feature (1180)..(1180): n is a, c, g, or t
  misc_feature (1182)..(1182): n is a, c, g, or t
  misc_feature (1185)..(1186): n is a, c, g, or t
  misc_feature (1188)..(1193): n is a, c, g, or t
  misc_feature (1195)..(1202): n is a, c, g, or t
  misc_feature (1204)..(1205): n is a, c, g, or t
  misc_feature (1207)..(1208): n is a, c, g, or t
  misc_feature (1210)..(1215): n is a, c, g, or t
  misc_feature (1218)..(1218): n is a, c, g, or t
  misc_feature (1655)..(1655): n is a, c, g, or t
  misc_feature (1985)..(1985): n is a, c, g, or t
  misc_feature (1989)..(1989): n is a, c, g, or t
  misc_feature (2821)..(2821): n is a, c, g, or t
  misc_feature (3264)..(3264): n is a, c, g, or t
ctctccgtacttgcagggctgccaacaagaatctatcagacaattcacgaaggggggctagcctttctcgtggtcatttcaccaaaagaaaaagcaccaggaatcccaaaaacgtccgtcttgacatggcggaggtcgccgatagttgctctacgtgcatgaagtttcattttggtccagcattgacaaaaaatcaagcaagacgcaaggactaccctgatcttaattaccctgattgaaatccttcgggtattactgctcctgcatctcctgctgagcagttggggacagcagctattaaattgtgcatgcgttcgtacggcactgacacgaacagtatgtctggctcaaatccctgctgttttcgtgccgtccaatcacccatcgttatgttcgtgcatccagtcattacgggatatgttanagngntnnngnntnatnntnctatganttgttgttgnggngnnatgncntnccagtnngngtncnaggntntnanccgnnncnnntnntctnggttacacngaaacaacacnatgnncngtcttnntgttnttttttcaagcngacatnncnctaannggtncnncnanccggnaggcngntgaancgtcanntttnacnttntctngaatgatncaatnnnantngnnagnctctctccttttnttnggaancncnnnantnnccttttttgttgncccgnaatttncgnnnaancacnatntctacnnncnncngggnnngnnnnnancttttcgncaatnacaaaacnntcnccntncgnagcangtttcaacnncntannaancnnnnntttnnnntncaannccnnngnaacttcntcnttggngaacgnnnntgncagnggttncttttttaaacccagcactttttttantagttctgcttgttctctaaactncatnnnctannnncnttantagntnatnnaatctggttanntaatnantangnctaacaanantaanacncccgnnaacatanntncnatnnnnnnnangaagnntaaanngnttnntnnntnnnnnnnntnntannancggacgnnncnncaatnttncannnanntgncntngnnnnnnnnangnannngnngntggnangnnntccnnnngnttncncnnnngccgtnantcnnnatnnaancnnttnttgntngannannnnnncnnnnnnnngnngnngnnnnnnccngctattttttgaattttcgctctaaacgcgcgctcagcagcagaaacgcgcccgtaaaaacgagcaagacaagggagtccacaagcaccccgtagacagtctttccctgaaacgcgtatgtaaccaggtcatttgcgtaggtgagcggagaaaacgccgccacagcctgtccccacgtcggcaggctttcaagagggataaagaggccgctgataaagatcagtggaaggcgaacgacgttgagcgccatcatgatatcgccggggttttccgttgggagcatggcgaatagtatccccagcgttgcaaagcagaacgccgggagaacgacaccgaggaataagccggtgaagctgacgatctgtgctgcaagccacgcgaggccgataataagaggaatgattgccacggcaacactaaacaaaaagccgctgagnatcttgccaagtgtgattgaataggctgatatcggtgccgatcgcaggcgttcgaacgtcctcactcgccgctcagtcgggatgaccatgggccctattgacgaggcgctgaagattatggtgatcgagagcaagcccggaagcagggttatcgccgggacgtttcttcctatcgcgaatgagaagaatatgacaaaggggaacatgatcccaaacattataggcgggggcttgaggtagtagatccgcatgtctttcttcgcgattgcccaggctgcgtcgatattgactcgcaactggctagccgccgatacgtttgcgctcatccanctcncccccgcattcacttctcccccgaggtggctcttatctccgtaagtcgcacgaacacgtcctcgagacttggcccgaatgtattgacgcttaggggccgcaagttattcttcgttgcatactcgcacaagcctgaaagggctcccgccgggtcatgggtgtagagcctgaatttgtcgccggctttgtgcacctcgctgatcaaagggaggttttgcaggtcgtgcacgatctcggaaggcgttcgttcaaaggctacctcgattgactgtacgctctcaatggtcgtttttagcttctcgggggcatcaatggcggcgattttccctttgtggataattgcaacccgctcgcacgtcacgctggcctcttcgatattatgtgtggtcatgaagatggtgacgccctcttcgttcagctgtttcatcacgtccttgataatcaaggtgctgtggacgtccagccccgaggtgggttcatcaagaaacagcaggcgcgggttgctcatcaaccccatcgccagcgtgatacgacgcttcatcccctttgaaaaacccttgaccttctcagttctgcggtcgaaaagatcaaagaggttgagaagttccgttgcccgctttgtcctctcgcgtcttccgacgtggtagagctccgcggtgaagataaggttgtcccacgcaggcagatcgtcatagatgttggagatctcggggacgatgcccaattgtctcttggcggcaagggcctcacgttggatgtcatagccaaataacgctgcgctgccctcgcttggctctgttaagccggtgagcatattcatcgtggtggttttnccggcgccattggggcctagaaagccaaatatctcgcccactcgtacattgaaactgacgtggtcaacgactggtatattgttgtagtacttcgtaagaccggaaacggcaacggcgttttccaaagggcatcatctcagccaaacaagtctatcggaacatgtgtaattaggcctcttcgcctgtgtaattggcttcctctgtgtcttttttcaagcgtaatacctcgaaatttgagtcccggattctaggcgcgaatcattgtcagaagcatcttgaaacggtttacggcttgaagcgcatgagggatgtttgcgggcaagacgaccatgtgtccctcactagcatggacagcattgcctccgatggtaatctcagcatcgccatcgatgatctgcacaaccgcatcgtacggcgcggcatgctcgctcaagccctgcccngcatcgaacgcaaacagcgtgatagtgcccgctttcgtgtcgatcagggtcttgcttactatcgaatcagccgaatattcgacaagtgtttttgtatcaactgctttacctttgtacatttcaatttggctcaagagtgtgcctccaaaatactaaccatcaaaacggttcttagttaaatgctgctttagaaattgccgtagcgttcaacaaccccctatgcgcattggtgtttctgttcatcagcgccactttgtcctttcgtcacttgggcaaataggtggtgagagtaaacaacgaagttgatgtacgcctcgacgaattcccgtcccgctctgacgtcgtttacgccatagttctttgttgaaatggtgcgtttaaaccgttgctgcaaatcgtcttcgatagcgcgcagaacgaagctaatcgcgtcagtcgcatcatttgtttcgatggccttttccgcccgtggcacgacagggccccaatcaagcccagccggtttgaggcccgtgaacggcgccccttcgcctgctctatgcaaacgtacaacgttttcgaaaaaccattcatcggccagagcttgcgcttctgggcctttctttctcacctcgagggtcttttcgaacacatctttcagctcactttctgcactctctggtacccagatgaggacaaaattcacatttcccgtgtctagcgctactcgtgcagcactgacaactggaccatctct

SEQ ID NO: 1311 - DNA, 4000 bp, Escherichia coli
  misc_feature (3719)..(3719): n is a, c, g, or t
tgggttcgttcattcgcacagtctcctgtcaagggggacgcaaaggaggctttgggtcatgcctgcgcctcttttgcagcttggcgcctgttgcgcatcaatatatccatggccgccatgcgcactgccacacccatctcaacctgttcttgtatgacgctgcggttcaaatcgtcggcgatttccccgtcgatttcaacgccgcggttcattgggcccgggtgcataacaatggcatctggcttggcgtggctcagtttctcagcattcaaaccatagcggtgataatattcgcgttcggaggggatgaagccgccgtccatacgctcgcgttgcaggcgcagcatcatcaccacatccacatccttcaaaccctcttgcatatcgtgaaagacttccgcaccaaactctccaattcccgccggcatcagcgttgctgggccgataaggcgaatgcggttttccattttgcccagcaaaatgaggttagagcgggccacgcggctgtgggcaatgtcgccgcaaatggcgatgttgaggcgatgcaagcggcctttggatcggcggatggtgagcgcatccagcagggcttgcgtggggtgttcatgccgcccgtccccagcgttgagcaccgcgcaattgactttctgcgccaagagatcgacggcgccagaatgcggatggcgcaccaccagaagatcggggtgcatggcattgagtgtcagcgctgtgtcgatgagggtctcaccctttttgattgagctggcttgcatggccatattcatcacatccgcccccaatctcttgcctgcgatttcaaagctggcttgagtgcgggttgagttttcgaaaaacatattgatctgagtgcagccagccagggctttactgtcgcgcgcacgggatctgttttgatcggcataatgatctgccaaatctaatatttcggtgatgctttggggatgtaggggttctatccccaatagatgctgaagctgcatatagacctctccggttggcgttttatagaaagagtggcggcccacggcaagggcagggggcaaggaaatgtcatttgagcctgaggcgggttatttttgacgcgctgcgtcactgattgaatgatttaccttcctctcagaagggcatagtttgaggccatggatcaattggattggcatatggcacgcgccgcgttgcagtggcaggcagagctcggagtgagcgatgccgtgggtgatgtgcccattgaccgctatgaggtgccggcgcaaaaccccaaacgatccactgcagcggcggcacccaccgaggcgccacaggctgcggagcggcctccggctgtgatggcagccgcgccggctgtggaccctgttgcagtagccgaagaggctgcagctgcggcgggggatttgccggcgttgaaacttgcgctgcaaaatttttcccattgtgatttgcgccgcggagcccgcaatttggtgtttggtggcggcagggctggggctcgggtgatgatcttggaagatgcgcccgggcgggcggaggatctgcaaggtctgccttttgccggcccggccggtcaattgctgggcaaaatgtgcgccgctattggtttggatcgggccgaggaagtctatgcagcctcagtgattccttggcgcccaccgcaggaccgagaggccagcgcggctgaaatcgccatgatgcagcctttcttgcgccgtcatatcatcttggccgcgccgcaggttgtcatatgtatgggcaatatcagttgtcaggcggttttgggcaaacgcggcctgagcaagctgcgcggagcctggcaagagggttttgccctgccagttttgccgatggtgcatccgcagggcctgttgcgccagcctaatcggaagaaacaggcatggcaggatttgttgatgctcaaggcttggctgcgcgcgcaatctgaagggggcaagacatgaccgatgcaccagcaaaaatagagtttatcgcggtgcgcatcgcggttttaaccctgtccgacagccgcagtttgagtgatgataaatccggcgacacgctggttgcgcgcttgcaagcggccggacatatcctggccgaccgtgacattctccccgatgatcgcgcagcgattgccgaaaaattgcgtcaatggtcgcgcgatccgtctattgatgtggttctgagcacgggcggcactgggctcacgggccgtgatgtgagcgtcgaggcacatcgggatgtctatgaaaaagagattgacgcgttctcaactctcttcacctttgtttccatgcaaaaaattggcacatctgcggttcagagccgagcaacgggcggtgtggccaatggcacttatatgtttgcattgccgggcagtccgggcgcctgcaaagatgcttgggacgaaatactcgtcaagcaattggatataagacataaaccctgcaattttgtcgaaatcatgccgcggcttgatgagcatctgcaaagaaaataagccccgctgtcgaatctgcgtgacgcggagaagttttgtactagaacaactgtaatgatgatcgagagggctgtcgtatgcggtttctacgcaaaagtttaatggggttgttcttactggcggcgactctggcgctgtttgcctatgccatcatgatggttcggggcgcgattgagaacaaaggtgacgatcagcggcgcggtggcggtggtcgtgagagaatttttgcagtgaatgccgtgccctttgagccgggccagcatattccggtcctacaggtctttggcgaggtgcaaagccagcgtagccttgatattcggccggcggttggcggaacggtcattgagttgcacccgaattttcaaaatggcggttctgttttggagggcgatgtactcctgagaattgatccgtcaaatgcacaaaccgccttggctttggtacaggccgatatggccgatgctcaagcggatttgcgagaggcgatgcgggcgctagacttggccaaggatgagatcagcgccgcgcaagagcaagccgccctgcgccaaaaagcattggcccggcaacaagatctcgtgacccgtggggtcggcactgcggcctctgtggaggctgcggaactggctgcttcctcggcgcgccaatccgttctggcgcggcgccaagctttgcaggccgctgaggcgcgtttggatcaagcgcgtgcgcgggtcatgcgggtggatatttctctggcggaagcggagcgcaatctgcgtgacaccgttgtacgcgcggccttttctgggctgctggccaatgtcactgttctgcagggcggaactgtgaccaacaatgaaaaaattggtcaattggtggatccattggctctggaagtggcctttcgtgtgagcacctcccagcatcggcgtctgctcgatgatgcgggcaaattgcgagcggctgaggtcacggtgacgttggatctgctcggcgcggagatgagctcaagcggccagatcacccgcgaagctgctgtcgtgggcgaaggtttgacggggcggcttctctttgccagccttgcaacctccaagggtctgcggccgggtgattttgtgactgtaaacataacggagcccgccttgaattgggttgcccgcctgccggccacggccgtgagcgggaataacaaggttctggttgtgggcgaagatgagcgcctgtnggaggccgatgtgacccttgtgcgccgtcagggggatgatgttttggtgcgctcgcgtgagctgagcggagcgcaaattgtagcggaacgatccccattgctgggtgcgggcatcaaggtgcgcgtgctgagcgctgagggagatgcgccgccggcggccccggagaccatcgcgcttgacccggagcggcgcgccaagttgattgcctttgtcgaggccaataaacgcatgcccaaacaggccaaggagcgggtcttggcgcagttgcaagagcccgaag

SEQ ID NO: 1312 - DNA, 4000 bp, Escherichia coli
  misc_feature (2231)..(2231): n is a, c, g, or t
gtatgaatggccccagcagtggctgctggtagatttccttgcgtgacacgttgtagatcttgcgcggcaccgcggcggcggcaagcatgggatccagatagctgcagtggttaccgcagatgagtcctggtccgtgcctcggtacattctcaagcccaatgacgtggagtttgaagaaggtcctgaaccagagcctgcctatcgggacaaccagctcatacagcatgctcaagcctcctgcgatactcggccaggatcgcctgcacgactccatcggagccgtcagcagagttgtccagcttgacgtgctcctctgtgcatcgaagaggcgagtcttctcgggacgagtctatcgcatcacgttccttgatgttggtcagcacggctccgtagtcggccgggctaccctgacgctccagctgggcgactcgccgcctggcgcgaacatccgggtccgcagtaatgaacaccttcagaaatgccttgggaagaaccgtcgttcctatgtcccggccaaccatgacaatatcctggagcaaggcgatgcgtcgcaactccctgttcacggctgcccgtacctgtggcaccgcactgacaggcgacacgaggctgtctactctcgggtcgtggagggacaaccggagaacgcgcccgtcaaacagaaccgtaccgccgggctcgtagcttatacaacgctcgaggatatccaaaaggcgatcgctccgcagacaacggtcagacggaaactgctcggcatatgcagcggtgaacactcggtacaacagcccagagtcgacgagcatgaagccaagctcatcggccacacgcagtcccaccgatgtcttgccagatccagacggcccgtcgatagcaatgtctcggttcacgaaacctctctcaagagtgccgcattcacgtccgcagaagagatactgccttcgcgcagcatggaccacgaccccgctgtcaatctgataaccgtcgatggccggccttccggacgccgtcggctgtccaggaccagatccgcctgttccagcaatccggcggccccaggcgcgtccagacgctcaatgacactctcaccgctctcattcagacttgtctgcgccatcacgaggccgccgacaagcaagcgaaggagtccagtgtggcggggcacccggaaaccgatgctggatgcttctgggtagggcaggggctgtgtgtggcaaccactccccgcaacatcgacgacgatggtaagcgctccgggccagaatgccctggcaagacgctgggccatcacatgtgccgcaggctcgatccacggcaggacacgatcgatatcaggtacgaacacgggcaacgccttggcaggtttgcgatgctttgctgcgaacaccctggcaaccgaagatacgcacgccgcgttgcagccaatgccatagacggtgtccgtcgggaacactgcgacggctcccaaagcaatgcgctcggacagccgccgaacatcggcgtctgagcaagtgtccaataggacaatcgcaggaagagacatctaccgcctccgaaaataggacggatcgagcttgggctctttcccggccctcaaccgaccgatgttcgcggcatgccgaacgatgcccaacacagcaagcagggcgtaaatcagaataagtttcggcggctgtctcagaataagcgcggcaactggaagagtggcgaacacggccactgatgccagcgaaacggtattgcggagcgccatgacgacaagccagatgcccaactccacgagagcgacgggccagctcagaacaaacacaactccgaaggtcgtagcaacacccttccctcccttgaatccggcaagaacggagaaatcatgacccatgaccacggcaacagccgccacaagcagtgcttcgcgcgatatggctggaaagaaccttgtcagcacgagcagaaggagtactgccttcagaaagtcgccagcaaaagcgaatgcggcaggaacagggcctgcggtgcgcaacacattcgtagctcccatgttcctgctgcccaccttcgtgatgtccacacccttgattattttggcgaagatgtagcttaacggcagagaaccgacgaggtatgcaacggcaaaaaccgcaagatcacgcaagatgtagttgaacgtgttcattttgctcgacgcgcctccgcgtagcgcggcaaccccctgaggtcaggcgaccagcgtcccncctgcagtccataccgcttaaacagcttcagtatgccctgttccagtccatcgtcaatctccagcagcagcaggccaccgggtcgcaaccagtcgcaagcctgtgcaatgatccgtttgtagaaaaccatgcctgacgtaccgccatagagtgcccggaccggttcaaagggcgaggacgcgtgcgccgagaacagacgctgctcacggacataaggaggattgctgacaatgacatcggtgcgactgtggaaatcggtgagagcaagaccccacgctgccagtacgttgccctggacgaacctgactcgctctgacagacccgcgtccaaggcggattcgcgggaacacgatatagatacagggtcgagctccagtcccacgaccgctacctgtggcagtctggcggccagtgccagagcgatagcccccgaaccggagcaaaggtccagtgcgatggggcgggggcgatcctgctcgataatgaagtccccggcgatctccaccagacgttccgtctccgaccgaggcacaagaacgccctcccgcactcgtacgacgatatcacagaaagcggcatagccggtgagatactccgcagggcatccatcggccagttgttgggcagcatgctccacagatatctgcatgccatgcttagcaggtagagccagttggatgagcagatctgaacggctccatcctctgctcgccgcaacaacgtactgcagttcaccgtgtttttgcaacgagagctgagcgcgctgctcagcatgcgcaagtacttctcgcagagtcaatcgtcgttgtcctgcacaatgggcgtctcaagagtcctctcccgggaagcccggtgaagagcgtcgactactggatcgaggtttccctccatgatgagaggcaaattgtacagggacagaccaatccgatggtcagtcaggcgaccttgaggaaaattgtaggtacggatacgcatgttgcgcatgccactgccgatctgagccctacgctcattgatcatctcactgtcggccttttctttcatgaactcatagacgcgggatcgcagcaccttgagagccttctccttgttcttcagctgggacctctcatcttggcatgacgcagtgatgcctgttggaatgtgcgtcatgcggacagccgtctctaccttctgaacgttctgtcctccatgtccagacgcatgaaacagctcaagcctgatgtcgtcgtcgtcgatatgcacgtcgacatcttcagcttcaggcagcaccgctacggtagcggtggatgtgtgaatgcgcccagaagcctccgtctcagggacacgctggacgcggtggacgccactctcgaacttgaagagcttgtagcttcctaccccaagcaccgagaagatgatttccttaaaccccccgatctcggtttggtgactcgagatgacctctatcttgaggccatgctgacttgcgaagtacgagtacatgcgaaacagatcggcggcaaacaaggccgcttcgtcgccaccaactcctccccggatctcgatgatgatattcttgtcgtcatccgggtctttgggaatgcgttcttcctcgatctgagcgtgaacagcttccagtccccgccgaagtcggaccttttcttctgcgatcatggcagcgaactcggaatccgttccctctacaagaagcgcatcgttgtcggcaagctgagccctcagagattcttcgcgagtgagaagctccaacagggagtccatcatgcggc

SEQ ID NO: 1313 - DNA, 4000 bp, Escherichia coli
  misc_feature (1)..(4): n is a, c, g, or t
  misc_feature (751)..(751): n is a, c, g, or t
  misc_feature (922)..(922): n is a, c, g, or t
  misc_feature (1112)..(1112): n is a, c, g, or t
  misc_feature (3069)..(3069): n is a, c, g, or t
  misc_feature (3071)..(3071): n is a, c, g, or t
  misc_feature (3074)..(3074): n is a, c, g, or t
  misc_feature (3079)..(3079): n is a, c, g, or t
  misc_feature (3084)..(3084): n is a, c, g, or t
  misc_feature (3088)..(3090): n is a, c, g, or t
  misc_feature (3093)..(3093): n is a, c, g, or t
  misc_feature (3095)..(3095): n is a, c, g, or t
  misc_feature (3101)..(3101): n is a, c, g, or t
  misc_feature (3108)..(3108): n is a, c, g, or t
  misc_feature (3111)..(3111): n is a, c, g, or t
  misc_feature (3113)..(3113): n is a, c, g, or t
  misc_feature (3115)..(3118): n is a, c, g, or t
  misc_feature (3122)..(3122): n is a, c, g, or t
  misc_feature (3127)..(3127): n is a, c, g, or t
  misc_feature (3131)..(3131): n is a, c, g, or t
  misc_feature (3133)..(3133): n is a, c, g, or t
  misc_feature (3137)..(3138): n is a, c, g, or t
  misc_feature (3140)..(3140): n is a, c, g, or t
  misc_feature (3142)..(3142): n is a, c, g, or t
  misc_feature (3146)..(3146): n is a, c, g, or t
  misc_feature (3148)..(3148): n is a, c, g, or t
  misc_feature (3152)..(3154): n is a, c, g, or t
  misc_feature (3156)..(3156): n is a, c, g, or t
  misc_feature (3159)..(3159): n is a, c, g, or t
  misc_feature (3163)..(3164): n is a, c, g, or t
  misc_feature (3168)..(3168): n is a, c, g, or t
  misc_feature (3170)..(3170): n is a, c, g, or t
  misc_feature (3175)..(3175): n is a, c, g, or t
  misc_feature (3245)..(3245): n is a, c, g, or t
  misc_feature (3293)..(3293): n is a, c, g, or t
  misc_feature (3297)..(3298): n is a, c, g, or t
  misc_feature (3300)..(3300): n is a, c, g, or t
  misc_feature (3302)..(3303): n is a, c, g, or t
  misc_feature (3305)..(3305): n is a, c, g, or t
  misc_feature (3307)..(3310): n is a, c, g, or t
  misc_feature (3312)..(3312): n is a, c, g, or t
  misc_feature (3314)..(3314): n is a, c, g, or t
  misc_feature (3318)..(3318): n is a, c, g, or t
  misc_feature (3321)..(3321): n is a, c, g, or t
  misc_feature (3323)..(3325): n is a, c, g, or t
  misc_feature (3327)..(3327): n is a, c, g, or t
  misc_feature (3333)..(3333): n is a, c, g, or t
  misc_feature (3336)..(3337): n is a, c, g, or t
  misc_feature (3341)..(3341): n is a, c, g, or t
  misc_feature (3354)..(3355): n is a, c, g, or t
  misc_feature (3361)..(3361): n is a, c, g, or t
  misc_feature (3364)..(3367): n is a, c, g, or t
  misc_feature (3369)..(3369): n is a, c, g, or t
  misc_feature (3371)..(3371): n is a, c, g, or t
  misc_feature (3373)..(3373): n is a, c, g, or t
  misc_feature (3375)..(3375): n is a, c, g, or t
  misc_feature (3377)..(3377): n is a, c, g, or t
  misc_feature (3383)..(3383): n is a, c, g, or t
  misc_feature (3386)..(3386): n is a, c, g, or t
  misc_feature (3392)..(3392): n is a, c, g, or t
  misc_feature (3404)..(3404): n is a, c, g, or t
  misc_feature (3407)..(3408): n is a, c, g, or t
  misc_feature (3412)..(3412): n is a, c, g, or t
  misc_feature (3420)..(3421): n is a, c, g, or t
  misc_feature (3424)..(3424): n is a, c, g, or t
  misc_feature (3427)..(3427): n is a, c, g, or t
  misc_feature (3434)..(3435): n is a, c, g, or t
  misc_feature (3437)..(3438): n is a, c, g, or t
  misc_feature (3440)..(3440): n is a, c, g, or t
  misc_feature (3442)..(3446): n is a, c, g, or t
  misc_feature (3448)..(3448): n is a, c, g, or t
  misc_feature (3450)..(3451): n is a, c, g, or t
  misc_feature (3453)..(3453): n is a, c, g, or t
  misc_feature (3456)..(3457): n is a, c, g, or t
  misc_feature (3464)..(3464): n is a, c, g, or t
  misc_feature (3469)..(3469): n is a, c, g, or t
  misc_feature (3471)..(3471): n is a, c, g, or t
  misc_feature (3475)..(3475): n is a, c, g, or t
  misc_feature (3478)..(3478): n is a, c, g, or t
  misc_feature (3480)..(3482): n is a, c, g, or t
  misc_feature (3486)..(3486): n is a, c, g, or t
  misc_feature (3490)..(3490): n is a, c, g, or t
  misc_feature (3493)..(3494): n is a, c, g, or t
  misc_feature (3496)..(3498): n is a, c, g, or t
  misc_feature (3501)..(3503): n is a, c, g, or t
  misc_feature (3506)..(3507): n is a, c, g, or t
  misc_feature (3515)..(3516): n is a, c, g, or t
  misc_feature (3519)..(3519): n is a, c, g, or t
  misc_feature (3524)..(3525): n is a, c, g, or t
  misc_feature (3529)..(3529): n is a, c, g, or t
  misc_feature (3533)..(3533): n is a, c, g, or t
  misc_feature (3536)..(3536): n is a, c, g, or t
  misc_feature (3539)..(3542): n is a, c, g, or t
  misc_feature (3546)..(3551): n is a, c, g, or t
  misc_feature (3553)..(3555): n is a, c, g, or t
  misc_feature (3561)..(3561): n is a, c, g, or t
  misc_feature (3563)..(3563): n is a, c, g, or t
  misc_feature (3566)..(3566): n is a, c, g, or t
  misc_feature (3569)..(3569): n is a, c, g, or t
  misc_feature (3572)..(3572): n is a, c, g, or t
  misc_feature (3574)..(3574): n is a, c, g, or t
  misc_feature (3582)..(3583): n is a, c, g, or t
  misc_feature (3586)..(3586): n is a, c, g, or t
  misc_feature (3593)..(3593): n is a, c, g, or t
  misc_feature (3596)..(3596): n is a, c, g, or t
  misc_feature (3599)..(3599): n is a, c, g, or t
  misc_feature (3604)..(3604): n is a, c, g, or t
  misc_feature (3607)..(3607): n is a, c, g, or t
  misc_feature (3610)..(3610): n is a, c, g, or t
  misc_feature (3615)..(3616): n is a, c, g, or t
  misc_feature (3618)..(3618): n is a, c, g, or t
  misc_feature (3622)..(3622): n is a, c, g, or t
  misc_feature (3625)..(3625): n is a, c, g, or t
  misc_feature (3627)..(3627): n is a, c, g, or t
  misc_feature (3629)..(3629): n is a, c, g, or t
  misc_feature (3631)..(3631): n is a, c, g, or t
  misc_feature (3634)..(3635): n is a, c, g, or t
  misc_feature (3637)..(3638): n is a, c, g, or t
  misc_feature (3642)..(3642): n is a, c, g, or t
  misc_feature (3644)..(3644): n is a, c, g, or t
  misc_feature (3649)..(3650): n is a, c, g, or t
  misc_feature (3660)..(3661): n is a, c, g, or t
  misc_feature (3669)..(3669): n is a, c, g, or t
  misc_feature (3672)..(3672): n is a, c, g, or t
  misc_feature (3675)..(3676): n is a, c, g, or t
  misc_feature (3686)..(3686): n is a, c, g, or t
  misc_feature (3688)..(3690): n is a, c, g, or t
  misc_feature (3692)..(3692): n is a, c, g, or t
  misc_feature (3694)..(3696): n is a, c, g, or t
  misc_feature (3700)..(3700): n is a, c, g, or t
  misc_feature (3704)..(3704): n is a, c, g, or t
  misc_feature (3707)..(3707): n is a, c, g, or t
  misc_feature (3709)..(3710): n is a, c, g, or t
  misc_feature (3712)..(3712): n is a, c, g, or t
  misc_feature (3716)..(3716): n is a, c, g, or t
  misc_feature (3719)..(3719): n is a, c, g, or t
  misc_feature (3721)..(3722): n is a, c, g, or t
  misc_feature (3725)..(3725): n is a, c, g, or t
  misc_feature (3727)..(3727): n is a, c, g, or t
  misc_feature (3730)..(3731): n is a, c, g, or t
  misc_feature (3733)..(3735): n is a, c, g, or t
  misc_feature (3738)..(3738): n is a, c, g, or t
  misc_feature (3743)..(3743): n is a, c, g, or t
  misc_feature (3747)..(3748): n is a, c, g, or t
  misc_feature (3751)..(3751): n is a, c, g, or t
  misc_feature (3753)..(3753): n is a, c, g, or t
  misc_feature (3755)..(3759): n is a, c, g, or t
  misc_feature (3761)..(3761): n is a, c, g, or t
  misc_feature (3763)..(3768): n is a, c, g, or t
  misc_feature (3773)..(3773): n is a, c, g, or t
  misc_feature (3777)..(3779): n is a, c, g, or t
  misc_feature (3781)..(3781): n is a, c, g, or t
  misc_feature (3784)..(3784): n is a, c, g, or t
  misc_feature (3786)..(3787): n is a, c, g, or t
  misc_feature (3790)..(3790): n is a, c, g, or t
  misc_feature (3792)..(3792): n is a, c, g, or t
  misc_feature (3795)..(3795): n is a, c, g, or t
  misc_feature (3798)..(3798): n is a, c, g, or t
  misc_feature (3801)..(3801): n is a, c, g, or t
  misc_feature (3804)..(3804): n is a, c, g, or t
  misc_feature (3806)..(3808): n is a, c, g, or t
  misc_feature (3816)..(3817): n is a, c, g, or t
  misc_feature (3819)..(3819): n is a, c, g, or t
  misc_feature (3824)..(3825): n is a, c, g, or t
  misc_feature (3827)..(3829): n is a, c, g, or t
  misc_feature (3835)..(3835): n is a, c, g, or t
  misc_feature (3840)..(3841): n is a, c, g, or t
  misc_feature (3844)..(3844): n is a, c, g, or t
  misc_feature (3851)..(3851): n is a, c, g, or t
  misc_feature (3860)..(3861): n is a, c, g, or t
  misc_feature (3863)..(3863): n is a, c, g, or t
  misc_feature (3868)..(3868): n is a, c, g, or t
  misc_feature (3873)..(3874): n is a, c, g, or t
  misc_feature (3876)..(3876): n is a, c, g, or t
  misc_feature (3878)..(3879): n is a, c, g, or t
  misc_feature (3883)..(3883): n is a, c, g, or t
  misc_feature (3885)..(3885): n is a, c, g, or t
  misc_feature (3894)..(3894): n is a, c, g, or t
  misc_feature (3899)..(3899): n is a, c, g, or t
  misc_feature (3901)..(3902): n is a, c, g, or t
  misc_feature (3905)..(3909): n is a, c, g, or t
  misc_feature (3911)..(3913): n is a, c, g, or t
  misc_feature (3917)..(3917): n is a, c, g, or t
  misc_feature (3920)..(3920): n is a, c, g, or t
  misc_feature (3923)..(3923): n is a, c, g, or t
  misc_feature (3926)..(3926): n is a, c, g, or t
  misc_feature (3928)..(3929): n is a, c, g, or t
  misc_feature (3931)..(3931): n is a, c, g, or t
  misc_feature (3933)..(3933): n is a, c, g, or t
  misc_feature (3937)..(3937): n is a, c, g, or t
  misc_feature (3941)..(3942): n is a, c, g, or t
  misc_feature (3947)..(3947): n is a, c, g, or t
  misc_feature (3949)..(3949): n is a, c, g, or t
  misc_feature (3951)..(3951): n is a, c, g, or t
  misc_feature (3957)..(3957): n is a, c, g, or t
  misc_feature (3960)..(3961): n is a, c, g, or t
  misc_feature (3965)..(3965): n is a, c, g, or t
  misc_feature (3967)..(3967): n is a, c, g, or t
  misc_feature (3970)..(3970): n is a, c, g, or t
  misc_feature (3972)..(3972): n is a, c, g, or t
  misc_feature (3974)..(3977): n is a, c, g, or t
  misc_feature (3979)..(3980): n is a, c, g, or t
  misc_feature (3984)..(3986): n is a, c, g, or t
  misc_feature (3988)..(3988): n is a, c, g, or t
  misc_feature (3990)..(3990): n is a, c, g, or t
  misc_feature (3992)..(3992): n is a, c, g, or t
  misc_feature (3994)..(3994): n is a, c, g, or t
  misc_feature (3996)..(3996): n is a, c, g, or t
  misc_feature (4000)..(4000): n is a, c, g, or t
nnnncacccacagactccgttacaccgagttgtgctgtccatgacacgccgcccttctcgccgcaattcagcacggcgagacataggcgagacccacaggcaacgtcactcatccgttcagaaggctcataattcgagtgtgcaggcatatgggccttgggagcatatgcaacaggaaattggcacaatacgaggagagcaatagggatggaagaaggcaaatagtttcttgtgtacaaccgcggcgcgcgcgtccatcgctcgcgtctccacggtcatctggacgtccgacctcttcatcgtgcccatggagtcgctctacttggtgacgcagagtgcaatgtaaaggaaccagagcaagacaaggaaccccgcggtgagcatggccaggtggggagggccgccgatctcgaagcccaacacggcgcggcgcagcagcagcactgcgagggtcgtggtgccgcagatcagaaagacgcccaccgaatagcccagatcgcctgcgggcactgcgaacgcaacgggcatgccaggcgagtaccacggctcttcagagtagcgcgcgcgccagctggcctctttgtcggggctgaacaggactccccagtagaccgcggccattgcccagggcagcccgaggccgaggaagacgttgacgctattggagccggtgatgttgccaatcgacgcgtcggcatactcctcattcgcggcggcggtcttgctcgcaaacgtgtcgggcagagaggtncccatcgcgacgagagtgatcgcggtcgtcgaggccttgatgcccatgcagcagcccagatgcgccgcaacgtcgccgatgacggcggtcaggatgccaatgatggacaggacgacccagaagcacgtccagccaccgtgcagccgcggcggcggcgcaaaggcgcagatnaagcgccagggcatcgcgagcacgtacagcagcgcctcgattgggctctcaccgtcgtagcggatcacgtcatcgaattgagctctccacgagaagccgacaacctgcatctcatcggcgttgataccgaggcgcaccaggaggccctcgcaaccgacctcatgatcgtcgcatttgatgttgaccgtcncgagcgcgcgctcgggcccgccgttgcactcttccgagaagcgagcgccgccctgggcgcctgagaagatcagcttgaagtcctcatcgccctcaaaggagctatcgttgacgatgttcacggtgacggagcgctcggtcacaccgtcgccaaactcaagcagctggtccacgatgggctcgtagtcgttcggtgcgatcgccgtgccgtcctgcgtcgagacaaggcagctcactgtgcccctgctcccgtcgatgcgccgcaccttgatggaataactgcctttgtgctccgggacctcgattaagtccttgttgagaatgaagacaccgggcgcgttcccgtccttgatgcgcgccgcgcacatggtaacagcgcctagcatgttgcccgcggacggcgccgagagctccaccgtgaagatcacgctgctgctcggcttcgccttgtcatcctccgaaatctcgaaccgcagattggcaagcagctggcccggcccaaattcgacggttcccttggcgactgttccgcccccctccgtgcacgtgtacgagactgacgcgggcgccagcacgctgccgtggcgcaccacgtgcacgtcgacccaaggctggaatgcggtggacgcggcgttgcacatcaccttcgagtgggcaaactcgaagacgcccttgttctcgagactcttttggttcaggttctcgtggggcagagacagtccaaactccttggcaatgtcctcgcgcgtcgccgcacccgtcgcttcgcgcgtcgcgccgatgcggtacgcggcatacgtcttcttagtggcggcagtggctttcgaggaagtctccacgcgacgcatacgtttccaggaagtctccgagactttcttgcctcggcagcaacgcctggagagggcggtgaaagacaagttattgaaggcgccgatgtcggtcatataggagagctggacgaaaatgaagaagaggacgaaggtgaagacaccctcgaacatcgtgacgatgtcgggcgtggcgatgacaaggatcacgtacaaccaaatgtacgccaggatagaccacgtggcggtcatgtagaagacgtttgtgtccttgatgtaccgcccctcgccattcgggatcgccatcacgcacaccgccgagatgaccatcaggttgaacgcggccgagcccacgatcgtcgacgggccgagctcgcccgcgtaaaagcccgagctcacgatctcgatgatcgagagcaggatctcgggcgaggaggagccgagggccatcagcgtgagattggcgacggtcggattccacacgcgcgacgtcacggacttcgtacggccgtttggcagcgtcgtgcgcgtcgtagtctcctgcgaggtgatggcctcgatcgcctccatgaagaggtcggccacgattgcgactgcgaggaacatccagagcagaatcgtcaggaagagcgcggcgttcgcgggcgtctgcacgggtcccgtgatcagcaggccgtctttgcatgtctccggctcagaatcgctgccgaaccaccagggcacaaagctctcgacggcagcatagatgccgaggctcttctcgacggcggtgaactcaggagtatcctcatcgtcgcgtgttaggtaggtcgccgcgtaggcaaccgccataaaggcgaggaccgcgagggcgcagcacgcaggcgtcacgtacttcacgaagctgctgggggcgctgctgtcatcctgaatctccatgttggatccaatcggctccctcttggctgcagcggcggctggggacccggcacgtgcaagggcgtcgctcctgggcgcgttcttgcttagcagcggcgaagcgtcctgcatgaacgatttcgggggggagccgccggagttgttgtagtccttcgcgggagagcccctcttgggcggcattgttaggcctgcagcccaaacgcttggtgtgtntncgngcaanaccanaaannncananaccctncaacgantananannnnaaanagaanttgngntttnncnanattnanaatnnngnganaagnnaacntnaactngaacttgaacttgaatacaagacaagtcaagcagtctgttgtgctcgtagtgacttgatttgactatttngcaggtgctctgcacggcgctaaacctgctttataccattatacgtgnccgnngncnnancnnnncncnccanggncnnngnggaganacnngtancacggctcagggnncacacncannnncncngngncnttgccnctncccctnccgttgcgggtntgnnccantacacatnntantgntcgtccnngnncncnnnnngngnnancannagaaagnggcgngngccnggngnnncggnctcngcnncnnncgnnngcnncgccagcnngancgagnngggngcgnacncgnnnnatgnnnnnncnnnatcgangncgncgnccncntcgcggtnnggngagagcncangcncccantcncgngaganngnggcnccncngngnggnncnncaangnccgcnngcggcgcgcnnggggcgcnctngcnnccgccgcccncnnncncnnnccgnggcncgncnncnagcncangnnccngnctnncnnngcnctcgngaannacngncnnnnncntnnnnnngtcgncgcnnngnctncnnctncngcnacngcngcngnnngcggcagnngnctgcnncnnnagctgngcctnntcnttgcggngcgcgcgcnngngctcnagccnnananncccngngccgctgcncgcgngnnggnnnnngnnngtgngcncgngtncnngnanctcnaaannctcangntngaggcnggnngcgngnggngngnnnngnncgannngngngncngncagn

SEQ ID NO: 1314 - DNA, 4000 bp, Escherichia coli
  misc_feature (248)..(248): n is a, c, g, or t
  misc_feature (320)..(320): n is a, c, g, or t
  misc_feature (347)..(347): n is a, c, g, or t
  misc_feature (350)..(350): n is a, c, g, or t
  misc_feature (353)..(353): n is a, c, g, or t
  misc_feature (368)..(368): n is a, c, g, or t
  misc_feature (404)..(404): n is a, c, g, or t
  misc_feature (420)..(420): n is a, c, g, or t
  misc_feature (578)..(578): n is a, c, g, or t
  misc_feature (587)..(587): n is a, c, g, or t
  misc_feature (593)..(593): n is a, c, g, or t
  misc_feature (602)..(602): n is a, c, g, or t
  misc_feature (612)..(612): n is a, c, g, or t
  misc_feature (743)..(743): n is a, c, g, or t
  misc_feature (830)..(830): n is a, c, g, or t
  misc_feature (845)..(846): n is a, c, g, or t
  misc_feature (872)..(872): n is a, c, g, or t
  misc_feature (1757)..(1757): n is a, c, g, or t
  misc_feature (2509)..(2509): n is a, c, g, or t
  misc_feature (2533)..(2533): n is a, c, g, or t
  misc_feature (2605)..(2605): n is a, c, g, or t
  misc_feature (2614)..(2614): n is a, c, g, or t
  misc_feature (2617)..(2617): n is a, c, g, or t
  misc_feature (2621)..(2621): n is a, c, g, or t
  misc_feature (2632)..(2632): n is a, c, g, or t
  misc_feature (2638)..(2638): n is a, c, g, or t
  misc_feature (2863)..(2863): n is a, c, g, or t
  misc_feature (2872)..(2872): n is a, c, g, or t
  misc_feature (2923)..(2923): n is a, c, g, or t
  misc_feature (2956)..(2956): n is a, c, g, or t
  misc_feature (2965)..(2965): n is a, c, g, or t
  misc_feature (3082)..(3082): n is a, c, g, or t
  misc_feature (3115)..(3115): n is a, c, g, or t
  misc_feature (3160)..(3160): n is a, c, g, or t
  misc_feature (3171)..(3171): n is a, c, g, or t
cgcaagcccacctccacctcatcgatgcgatttgggaaggggccgtttcgctggacacggcccgtgcccgattcaccgagaaccagatcaacgacccgcttcgattgaccatcggtgaaggttccttcctgaagaacgtctccgttgccctcggttttgacggggaactgcccgacgaagacacgccgttcgaccccgaggcgttcttcgctgccggcaacgaagtcaacgaagcgcggatgcgcctnaccgaggggaagttgtcgaacctcaaggtgctcggcattgacatcggccgaatgttgcgccaaatcggcaancgagtcggtcaagaaatcgccttttcnctncgntctatagaaaatganatcgagtttttggacgagatgatggattggtgggancacgctggactgggcntgctccagtacgatgttgacccgcaattccacgtggtggtcggcttgaaccatcccccggtcgatgaccccgatgcgctgcccatgtggcagatggacgacggcatcatcgaaggagcgctttccacccgatttgcaaaggacgccaacgtggtcatncagcgcgtngacggnaccgggacnaaggacgatntgtggcactatctgattcaccgtcacgaattgaacaccatcgaattgagcgattgaggctgttgacccatgaaactcctcacgttcatccagtttttccgacaacttcgtggaaagaggccggttgacatngaacgcatccaatccatgggcttgcttgcggtcaaactcggacaaatcttcgcccttcgtcccgatttgattgaaccgcaaaggtgnattgaactccagcgnntgtacagccgggcagcgaccattccngaagaggattcgcaggcgcttctcgagaagttcgcccctcccggattcaacgagcatttccaacacattgagccccgtccgtttgctgctgcaagcatcggacagattcaccgggcggtgctaaaggacggcacgaaggtggttgtgaagatcatcaaagccgattttgaagcctcgttccgccgtgatgtccgccgaatgaagaggtggattcgcttgggcttgttcttcaacccgcgacttcgaaaagtcggcaaccccatcgggctgcttgcccacatcgaagactacacgttgcgggaactcaacctcacgaacgaaatcatcggacgaaacgatctcctggccaaggccgatgaagttgaagcgcacttctccatgccgaaattgaggttccccaagatgtgggaggacctctcgaaccagcgcgttctggtcatggaggaaatcacttcgcccacgcttgaagaccaccttgaaggaggaacgatggcgtgggaggacatgcttgaactgtttcgaattcacggtgcgttcatgtttggcctgggaacctttcacggagatttgcaccccggcaacgccatgatgaacgaggagggcgagttcttcttcatcgacacgggggccatttgtcacgccccggaacacgtacgaaacgccttgtttggcttcttttacttcctcgccaaaggggagctccgaaatgcgtttgacgccatgctgaccatggcggccgtccgcccaaccggcgttactctcgaaacgtattaccgctccatgggcgagttgtacgatggattcgtgggcacctcggtcagtgaggtttcgttgaccgagcagatgatgaagaccgtgaaggcggctgttcttgccggatgcgcntttggcgaagaggcctttcccatcattcgctcgttgatgtacatggacggcatggtcctgaagggtcatccgaacgttgacttgatcagttcgatgggtccgtatctggacgagttctcggtccttatcgacccgcacgccatcatcaaatcaaacgcttgaagtgttatttttgaggttttttttacgaacaaaaacccgcctttatatgtccaacccggggtcgtatgggtatgtccgccgccgctacgcccagcgtcgccatcataggagccggtcccggaggtcttgcgtccgcactgctcctcgcaaaatcaggcgtcaacgtgaccgtgttcgaacgctcgtccgccgtcggaggccgaaacaaagtcttcgaccgtgacgggttcaaattcgacctcggtccaacctttttccactatcctgaggtcattgaagacatcttcaaggccatcggaatggacgcccacgaggaactcaacctccacaagttggagttgaactaccgcctcatcttcggccaaggcggtgaacttgattgcaccagcgaccttgacgtgatgaccgaacgcatccgagaattgtccggcgaccaaaacgccaatgccttccgacgctacgtgaaggacaaccgaatgaaactcgagaaatccaaagcgtgtctgcaagaaccctggtacggaccctccgacctgctctctaagcgagcgatgcgtgtggctggggtgctccgtcctcaacgatcggtngcgaaagatttgatgaaactcttngacgacgaccggttgatgttggccatgtcgtttcaaacgaaatatctcggcatgtcaccgttcaattgcccnagcctgttnacnatgntggccttcctngagtangaatacggcatcttccacccgctcggtggattgggcagcgtcagcgagcgcatggctgccattgccaaagacctcggtgtcaccttccgaatgaacgaggccgtggaatccgtcatcatggacgggaagaccatcaccggcgttcgaaccgcaaagggtgacttcatggccgaccgagtggtcatgaacgctgactttgccaacggcatgacgcagcttttcccngacaaggtncgcaagaagtggtccaacaagaaattggacagcaagaaatactcgtgctcnaccttcatgctctaccttggcgttgaccggacntacgacganctccctcatcaccagatctacgcttccgccacctacgagaacaacctcgaagacatcgaaaagcaccaccgcctcacgtgggacgacccgtcggtgtacgttcaaaacgcatccgtnaccgacccgagcctcgctcctgaagggtgttcnaccgtttacgccctcgttccggtgtcgcacgttcacgaaaacatngactggtccanagaaaaagacgcgtaccgtgaccgcatcttggaacaaattgagtccaaactcggctttgagaacctcaaagaccacatcgtgacggagatggtcatcacccccgaggattggggcgaccactgctaccgtggagccgtgtttaacctcgctcacggcctcgatcagatgctttggcgtcgaccgaagaatcagtttgacgaaatcaacaacctctaccttgtcggcggcggcacccacccaggaagcgggctccccgtcatctacgaatccgctcgcatcagcagcaaattgttgctcgatagcctcggcatcatcccggattggaacggcgtagacacgtggttcgagagccgaaagcgatccaagcagggccgtgcggcggtcaacaaaacctcaaaagagccttcgagcggaacaccaacatctgcctgaggtgagaccgtgaaaacgctgcttctcaacaacgcctacgattattgcgaagccgtttgccgagaagcctcgaccaccttctactcgtcgttcagtgctcttcaactcgagaagcgcaaagctgtccatgccgtctatgcgttgtgccgttgggtggacgacatcgtcgacggtgacgaagaacccaacgtgacccactcgccgcaacttgaggttgcgacggacgctcgccaagccatcgttgaggagattcacgcaggaaaaacgccggtgcttccagcagacgaacaccgacaacggctgatggcgctcaccgaaattcggatgaaactcaatcaggtctacgacgagagcatcaccgccaacgaccaccccatcttcatcgcccttcaggac

SEQ ID NO: 1315 - DNA, 4000 bp, Escherichia coli
  misc_feature (497)..(497): n is a, c, g, or t
  misc_feature (629)..(629): n is a, c, g, or t
  misc_feature (800)..(800): n is a, c, g, or t
  misc_feature (1280)..(1280): n is a, c, g, or t
  misc_feature (1956)..(1956): n is a, c, g, or t
  misc_feature (2000)..(2000): n is a, c, g, or t
  misc_feature (2012)..(2012): n is a, c, g, or t
  misc_feature (2022)..(2022): n is a, c, g, or t
  misc_feature (2029)..(2029): n is a, c, g, or t
  misc_feature (2031)..(2033): n is a, c, g, or t
  misc_feature (2041)..(2041): n is a, c, g, or t
  misc_feature (2043)..(2043): n is a, c, g, or t
  misc_feature (2058)..(2070): n is a, c, g, or t
  misc_feature (3090)..(3090): n is a, c, g, or t
  misc_feature (3401)..(3401): n is a, c, g, or t
  misc_feature (3534)..(3534): n is a, c, g, or t
  misc_feature (3566)..(3566): n is a, c, g, or t
  misc_feature (3588)..(3588): n is a, c, g, or t
  misc_feature (3624)..(3624): n is a, c, g, or t
  misc_feature (3626)..(3626): n is a, c, g, or t
  misc_feature (3641)..(3641): n is a, c, g, or t
  misc_feature (3649)..(3649): n is a, c, g, or t
  misc_feature (3654)..(3654): n is a, c, g, or t
  misc_feature (3657)..(3657): n is a, c, g, or t
  misc_feature (3660)..(3660): n is a, c, g, or t
  misc_feature (3662)..(3662): n is a, c, g, or t
  misc_feature (3670)..(3672): n is a, c, g, or t
  misc_feature (3674)..(3674): n is a, c, g, or t
  misc_feature (3681)..(3681): n is a, c, g, or t
  misc_feature (3685)..(3685): n is a, c, g, or t
  misc_feature (3687)..(3687): n is a, c, g, or t
  misc_feature (3691)..(3691): n is a, c, g, or t
  misc_feature (3695)..(3695): n is a, c, g, or t
  misc_feature (3697)..(3701): n is a, c, g, or t
  misc_feature (3703)..(3704): n is a, c, g, or t
  misc_feature (3714)..(3718): n is a, c, g, or t
  misc_feature (3720)..(3722): n is a, c, g, or t
  misc_feature (3729)..(3729): n is a, c, g, or t
  misc_feature (3731)..(3735): n is a, c, g, or t
  misc_feature (3737)..(3737): n is a, c, g, or t
  misc_feature (3739)..(3739): n is a, c, g, or t
  misc_feature (3743)..(3743): n is a, c, g, or t
  misc_feature (3745)..(3746): n is a, c, g, or t
  misc_feature (3749)..(3749): n is a, c, g, or t
  misc_feature (3751)..(3751): n is a, c, g, or t
  misc_feature (3753)..(3753): n is a, c, g, or t
  misc_feature (3755)..(3761): n is a, c, g, or t
  misc_feature (3764)..(3764): n is a, c, g, or t
  misc_feature (3766)..(3768): n is a, c, g, or t
  misc_feature (3771)..(3771): n is a, c, g, or t
  misc_feature (3773)..(3773): n is a, c, g, or t
  misc_feature (3775)..(3775): n is a, c, g, or t
  misc_feature (3778)..(3778): n is a, c, g, or t
  misc_feature (3780)..(3781): n is a, c, g, or t
  misc_feature (3784)..(3784): n is a, c, g, or t
  misc_feature (3789)..(3790): n is a, c, g, or t
  misc_feature (3792)..(3793): n is a, c, g, or t
  misc_feature (3795)..(3795): n is a, c, g, or t
  misc_feature (3797)..(3797): n is a, c, g, or t
  misc_feature (3801)..(3803): n is a, c, g, or t
  misc_feature (3805)..(3808): n is a, c, g, or t
  misc_feature (3810)..(3810): n is a, c, g, or t
  misc_feature (3813)..(3813): n is a, c, g, or t
  misc_feature (3815)..(3817): n is a, c, g, or t
  misc_feature (3819)..(3819): n is a, c, g, or t
  misc_feature (3821)..(3822): n is a, c, g, or t
  misc_feature (3827)..(3828): n is a, c, g, or t
  misc_feature (3830)..(3830): n is a, c, g, or t
  misc_feature (3832)..(3834): n is a, c, g, or t
  misc_feature (3836)..(3838): n is a, c, g, or t
  misc_feature (3841)..(3842): n is a, c, g, or t
  misc_feature (3846)..(3846): n is a, c, g, or t
  misc_feature (3850)..(3850): n is a, c, g, or t
  misc_feature (3853)..(3854): n is a, c, g, or t
  misc_feature (3858)..(3862): n is a, c, g, or t
  misc_feature (3864)..(3866): n is a, c, g, or t
  misc_feature (3870)..(3872): n is a, c, g, or t
  misc_feature (3874)..(3874): n is a, c, g, or t
  misc_feature (3876)..(3877): n is a, c, g, or t
  misc_feature (3881)..(3881): n is a, c, g, or t
  misc_feature (3885)..(3885): n is a, c, g, or t
  misc_feature (3887)..(3887): n is a, c, g, or t
  misc_feature (3890)..(3891): n is a, c, g, or t
  misc_feature (3894)..(3894): n is a, c, g, or t
  misc_feature (3897)..(3900): n is a, c, g, or t
  misc_feature (3903)..(3906): n is a, c, g, or t
  misc_feature (3908)..(3911): n is a, c, g, or t
  misc_feature (3918)..(3919): n is a, c, g, or t
  misc_feature (3925)..(3925): n is a, c, g, or t
  misc_feature (3927)..(3928): n is a, c, g, or t
  misc_feature (3931)..(3931): n is a, c, g, or t
  misc_feature (3934)..(3935): n is a, c, g, or t
  misc_feature (3937)..(3939): n is a, c, g, or t
  misc_feature (3942)..(3943): n is a, c, g, or t
  misc_feature (3946)..(3947): n is a, c, g, or t
  misc_feature (3949)..(3951): n is a, c, g, or t
  misc_feature (3953)..(3953): n is a, c, g, or t
  misc_feature (3961)..(3963): n is a, c, g, or t
  misc_feature (3967)..(3967): n is a, c, g, or t
  misc_feature (3969)..(3969): n is a, c, g, or t
  misc_feature (3971)..(3972): n is a, c, g, or t
  misc_feature (3974)..(3975): n is a, c, g, or t
  misc_feature (3978)..(3979): n is a, c, g, or t
  misc_feature (3981)..(3983): n is a, c, g, or t
  misc_feature (3987)..(3987): n is a, c, g, or t
  misc_feature (3989)..(3990): n is a, c, g, or t
  misc_feature (3992)..(3994): n is a, c, g, or t
  misc_feature (3996)..(3997): n is a, c, g, or t
  misc_feature (4000)..(4000): n is a, c, g, or t
ttgcaggtttagtgcgtgttcctgctggcgaatcttatcaggaaatgatacgtttggtgtatcagcacaacgatattgttgacgtttctatccattcgctttacaaaattagtaagtatcgccgtgcagatagtggcgatgctgccccacgtctttcagttctcggctctggagcttgggatagacttaaggaaaaagcaaagaaacgcattaaggatattgcccgcgatttaataaaactatacgctaaacgtcgccatgaaaaaggctattctttctcgcccgactcgtatatgcagcatgaattggaggcttctttcctttatgaagatacacccgatcagctgaaagcaacgcaagacttgaagcaagatatggaaagttctcgtccaatggatagattagtttgtggagacgtaggttttggcaagacagaagttgcagtgcgcgcagcttttaaagctgcaaccgatggaaaacaagtggcagtgctcgtnccaactacggtactcgcattccaacattatcaaactttcaagaagagactaaaggatatgcctgttacggtagactatctttcgcgagcaagaacagctaaacaaaccaaacaagtattggcaaatttagcngaagggaagatagatattcttgtgggaacgcataagctgataagcaaaaatgtgaaatggaaagatattggcttacttattattgacgaagagcagaagtttggtgtatcaacaaaggaaaaactacgccaactgaaaagtaatatcgacacacttactatgtcggcaacncctattcctcgtactttacaattctctttaatgggagcaagagatatgagtattatgcgaactccaccgcccaaccgttatcctattcaaacagaaattgcaactttctcggcagacgtaattgcagatgcaataaactttgaaatgagtcgcaacggacaagtattttttgtgaacgaccgaatagcaaacttgcccgaattagcaagccttatcaagaaaaatgtgcccgattgtcgtgtagcaataggacatgggcagatgaaacccgaagagttggaagaaattattattggttttatgaaccacgattacgatgtgttgctttcaacaaccattgtcgaaaacggtatcgacatatcaaacgccaacaccatcataataaacgatgcacataagttcggactttcagaccttcaccaaatgagaggacgcgtgggacgttctaataaaaaagctttctgttatttgcttgcaccnccattggcagctttaaatccagatgcacgccgtcgtttggaggctttagaaacattttccgaccttggtagtggtttcagtttggcaatgcaagacctcgatattcgtggcgcaggcaatcttcttggagctgaacaaagtggatttatggaagatttaggctacgaaacatatcagaaaatattgaatcaggctgtaactgaacttaagaacgatgagtttcaagacctttatacggaggaaatggcagaaggaaaacagctctctggcgatgattttgtagacgattgtgccgtagaaagcgacctcgaaatgtatttccccgatacgtatgtacctggaagttcagaacgaatgttgctttatcgcgaactcgataacattgaaaacgatgtacaattagacgcctatcgcaaacgattggaagaccgtttcggaccaattccacgtcaaggaatagaattaatgcaagtagtttcgctccgccgattgggtaaacaccttggttgcgaaaagcttattttgaaacaaagcaccttgcaaatgcaatttgtgtccaatctaaacagtgcatactataagagtaacgccttcggaaaatgtatcgattatattgctgcaaaccctcgccgttgcaacattaaagaaaaaaacggcaaacgctcaatggtagttncaaacgtaaagacagttggcgacgccgttttcgtgctgcgtganatagacaaaggntaaatttatncaatagntnnnttctaaangnaaagccgcatatctnnnnnnnnnnnnnagatatgcggctttattctttttatttattcggctgttacactaacagttgatgcaactgtaccttgcacctcatagcctgctggcatcacagcttttgttcctggtataaaaatacaaggccaaaataaaagacctgtaacgacagctaaaggggttctattctttcctgaaatcctaacatctgtattagagaagaaaatctgttctccgtcagcaagtgttagtccactaatgttaatgcctaaacgcccttttgttcctgctaaagaacttttccttgcttcagtaaccttaccttttacgagtgttcctcgtggaattgcacaacaatcatttacataaacgtcctgtgaaacacggaagtcaactgtttgaccttcttctacttcccttgccaatactgtattaacagattgcagtgggacaatagtaccagctttaattgtaacttgttttccttgagcaaatgtgtgtccgatgctcaaaaggcagactgagattaacaaaaatacttttttcatattttaaattaatggattggcagtcccaaacaatctcatttatcatttctaatgtagaagcgtggaactgtatatccatattctttgtgataaggtggtaggaataccctgcaaacagaaatgagtataacagccccacgctatatgcgtggaggccattacgccgtttcttgtttgcttgtgattataagtttcctacgcttttatcacacaagaagaagacataacgcctcttttatttaataaaaaaatatggaaagagaatatttctcaatccatttgcaaaattaattaaaaactatttaaaaaccaaacgaatgaaataaaaatacgttcgacaccgttttactggtatattctttgtactatttttacgacaaatcaatacattatggaaataaaacgagaagacgtaccatacaattacacacattgcatagccacaaaacagcagtgtaaacgggctgaacaatgtttgcgggcactggcaatgaagntggaacgtagagaaaacgacaacgaaattatagaaattgtagacccgcgctatatgcaaactcgcacagaaacacaaccttgccagtggtttgtagaagcaaagccgaaacgttttgccaaaggaatgcgacacatttacgacgaagttccggcaaagaaattaaaactaatgcgcgaagaggtgcaatattgctttccatctcgatcgttttactttaaagccaggcgaggcgataagctgatttcggagaatcagcaagccgaaatagcagaagtattcaaagccatttgcccagatttagagccgaanttcgatgaattcattgatagtttcgagtggaacccctaatggtttcactcttttttatgcaacgtttactctcgaacacacggtacttttaacagaaaagtatatactttataaattgtctctccatagaaantcacagtttcgtaggtatgaaacttatagttnctgcgtataaactcacagtttngtaggtatgaaacttatagttcctgcgtataaactnanagtttcgtaggtatnaaacttanagttnctncgnanaaactgannntnatgtagnaaananattnccanannnnncnnagaaattgannnnnannnagcaaanannnnncnanatangnntananantnnnnnnnaangnnncanananatntnnatntatgnntnnantntctnnntnnnngnccnannnananntctanntntnnnannnatnncttntaantcnnccannnnnannntctnnnantnnaaanaatntngtnnaantcnnnnaannnnannnntaaaaannaacaancnnttngtnnannnccnntanntnnntngttaaaannngacntncnnanngtnnannnccgntnngnnnanngan

SEQ ID NO: 1316 - DNA, 4000 bp, Escherichia coli
  misc_feature (1)..(6): n is a, c, g, or t
  misc_feature (8)..(9): n is a, c, g, or t
  misc_feature (11)..(15): n is a, c, g, or t
  misc_feature (18)..(18): n is a, c, g, or t
  misc_feature (20)..(20): n is a, c, g, or t
  misc_feature (22)..(28): n is a, c, g, or t
  misc_feature (31)..(33): n is a, c, g, or t
  misc_feature (37)..(37): n is a, c, g, or t
  misc_feature (39)..(43): n is a, c, g, or t
  misc_feature (45)..(46): n is a, c, g, or t
  misc_feature (49)..(49): n is a, c, g, or t
  misc_feature (51)..(52): n is a, c, g, or t
  misc_feature (54)..(54): n is a, c, g, or t
  misc_feature (56)..(60): n is a, c, g, or t
  misc_feature (62)..(63): n is a, c, g, or t
  misc_feature (65)..(66): n is a, c, g, or t
  misc_feature (69)..(69): n is a, c, g, or t
  misc_feature (73)..(74): n is a, c, g, or t
  misc_feature (76)..(76): n is a, c, g, or t
  misc_feature (79)..(81): n is a, c, g, or t
  misc_feature (83)..(86): n is a, c, g, or t
  misc_feature (88)..(88): n is a, c, g, or t
  misc_feature (90)..(96): n is a, c, g, or t
  misc_feature (98)..(105): n is a, c, g, or t
  misc_feature (108)..(112): n is a, c, g, or t
  misc_feature (114)..(114): n is a, c, g, or t
  misc_feature (116)..(120): n is a, c, g, or t
  misc_feature (122)..(123): n is a, c, g, or t
  misc_feature (125)..(125): n is a, c, g, or t
  misc_feature (127)..(128): n is a, c, g, or t
  misc_feature (130)..(132): n is a, c, g, or t
  misc_feature (134)..(135): n is a, c, g, or t
  misc_feature (137)..(137): n is a, c, g, or t
  misc_feature (140)..(141): n is a, c, g, or t
  misc_feature (144)..(144): n is a, c, g, or t
  misc_feature (147)..(148): n is a, c, g, or t
  misc_feature (151)..(151): n is a, c, g, or t
  misc_feature (153)..(157): n is a, c, g, or t
  misc_feature (159)..(160): n is a, c, g, or t
  misc_feature (163)..(164): n is a, c, g, or t
  misc_feature (166)..(166): n is a, c, g, or t
  misc_feature (168)..(172): n is a, c, g, or t
  misc_feature (174)..(174): n is a, c, g, or t
  misc_feature (176)..(177): n is a, c, g, or t
  misc_feature (180)..(182): n is a, c, g, or t
  misc_feature (184)..(185): n is a, c, g, or t
  misc_feature (187)..(192): n is a, c, g, or t
  misc_feature (194)..(196): n is a, c, g, or t
  misc_feature (199)..(199): n is a, c, g, or t
  misc_feature (201)..(205): n is a, c, g, or t
  misc_feature (207)..(208): n is a, c, g, or t
  misc_feature (210)..(210): n is a, c, g, or t
  misc_feature (214)..(215): n is a, c, g, or t
  misc_feature (218)..(219): n is a, c, g, or t
  misc_feature (221)..(229): n is a, c, g, or t
  misc_feature (234)..(235): n is a, c, g, or t
  misc_feature (238)..(238): n is a, c, g, or t
  misc_feature (240)..(241): n is a, c, g, or t
  misc_feature (243)..(244): n is a, c, g, or t
  misc_feature (246)..(255): n is a, c, g, or t
  misc_feature (257)..(257): n is a, c, g, or t
  misc_feature (260)..(261): n is a, c, g, or t
  misc_feature (263)..(265): n is a, c, g, or t
  misc_feature (269)..(272): n is a, c, g, or t
  misc_feature (274)..(274): n is a, c, g, or t
  misc_feature (276)..(276): n is a, c, g, or t
  misc_feature (278)..(282): n is a, c, g, or t
  misc_feature (284)..(284): n is a, c, g, or t
  misc_feature (286)..(292): n is a, c, g, or t
  misc_feature (294)..(296): n is a, c, g, or t
  misc_feature (298)..(300): n is a, c, g, or t
  misc_feature (303)..(304): n is a, c, g, or t
  misc_feature (306)..(306): n is a, c, g, or t
  misc_feature (308)..(308): n is a, c, g, or t
  misc_feature (310)..(310): n is a, c, g, or t
  misc_feature (312)..(318): n is a, c, g, or t
  misc_feature (321)..(323): n is a, c, g, or t
  misc_feature (325)..(326): n is a, c, g, or t
  misc_feature (331)..(332): n is a, c, g, or t
  misc_feature (334)..(336): n is a, c, g, or t
  misc_feature (340)..(341): n is a, c, g, or t
  misc_feature (343)..(343): n is a, c, g, or t
  misc_feature (345)..(345): n is a, c, g, or t
  misc_feature (347)..(347): n is a, c, g, or t
  misc_feature (349)..(351): n is a, c, g, or t
  misc_feature (353)..(353): n is a, c, g, or t
  misc_feature (357)..(360): n is a, c, g, or t
  misc_feature (362)..(362): n is a, c, g, or t
  misc_feature (364)..(366): n is a, c, g, or t
  misc_feature (368)..(368): n is a, c, g, or t
  misc_feature (370)..(370): n is a, c, g, or t
  misc_feature (372)..(373): n is a, c, g, or t
  misc_feature (375)..(378): n is a, c, g, or t
  misc_feature (381)..(382): n is a, c, g, or t
  misc_feature (384)..(384): n is a, c, g, or t
  misc_feature (388)..(388): n is a, c, g, or t
  misc_feature (390)..(390): n is a, c, g, or t
  misc_feature (392)..(401): n is a, c, g, or t
  misc_feature (403)..(404): n is a, c, g, or t
  misc_feature (407)..(409): n is a, c, g, or t
  misc_feature (411)..(413): n is a, c, g, or t
  misc_feature (416)..(416): n is a, c, g, or t
  misc_feature (418)..(419): n is a, c, g, or t
  misc_feature (421)..(427): n is a, c, g, or t
  misc_feature (429)..(433): n is a, c, g, or t
  misc_feature (437)..(437): n is a, c, g, or t
  misc_feature (440)..(440): n is a, c, g, or t
  misc_feature (442)..(443): n is a, c, g, or t
  misc_feature (445)..(445): n is a, c, g, or t
  misc_feature (447)..(447): n is a, c, g, or t
  misc_feature (450)..(450): n is a, c, g, or t
  misc_feature (453)..(457): n is a, c, g, or t
  misc_feature (459)..(459): n is a, c, g, or t
  misc_feature (461)..(465): n is a, c, g, or t
  misc_feature (467)..(469): n is a, c, g, or t
  misc_feature (471)..(471): n is a, c, g, or t
  misc_feature (474)..(474): n is a, c, g, or t
  misc_feature (478)..(478): n is a, c, g, or t
  misc_feature (481)..(482): n is a, c, g, or t
  misc_feature (484)..(486): n is a, c, g, or t
  misc_feature (488)..(488): n is a, c, g, or t
  misc_feature (494)..(497): n is a, c, g, or t
  misc_feature (499)..(503): n is a, c, g, or t
  misc_feature (505)..(506): n is a, c, g, or t
  misc_feature (509)..(509): n is a, c, g, or t
  misc_feature (512)..(512): n is a, c, g, or t
  misc_feature (515)..(515): n is a, c, g, or t
  misc_feature (517)..(517): n is a, c, g, or t
  misc_feature (526)..(527): n is a, c, g, or t
  misc_feature (529)..(533): n is a, c, g, or t
  misc_feature (535)..(536): n is a, c, g, or t
  misc_feature (538)..(538): n is a, c, g, or t
  misc_feature (540)..(543): n is a, c, g, or t
  misc_feature (545)..(547): n is a, c, g, or t
  misc_feature (549)..(552): n is a, c, g, or t
  misc_feature (555)..(555): n is a, c, g, or t
  misc_feature (558)..(559): n is a, c, g, or t
  misc_feature (562)..(566): n is a, c, g, or t
  misc_feature (570)..(570): n is a, c, g, or t
  misc_feature (573)..(573): n is a, c, g, or t
  misc_feature (577)..(577): n is a, c, g, or t
  misc_feature (579)..(579): n is a, c, g, or t
  misc_feature (585)..(585): n is a, c, g, or t
  misc_feature (588)..(589): n is a, c, g, or t
  misc_feature (592)..(592): n is a, c, g, or t
  misc_feature (597)..(597): n is a, c, g, or t
  misc_feature (599)..(599): n is a, c, g, or t
  misc_feature (601)..(602): n is a, c, g, or t
  misc_feature (604)..(604): n is a, c, g, or t
  misc_feature (606)..(607): n is a, c, g, or t
  misc_feature (609)..(609): n is a, c, g, or t
  misc_feature (613)..(613): n is a, c, g, or t
  misc_feature (615)..(615): n is a, c, g, or t
  misc_feature (617)..(618): n is a, c, g, or t
  misc_feature (620)..(621): n is a, c, g, or t
  misc_feature (625)..(628): n is a, c, g, or t
  misc_feature (630)..(630): n is a, c, g, or t
  misc_feature (632)..(632): n is a, c, g, or t
  misc_feature (634)..(635): n is a, c, g, or t
  misc_feature (637)..(637): n is a, c, g, or t
  misc_feature (640)..(640): n is a, c, g, or t
  misc_feature (654)..(655): n is a, c, g, or t
  misc_feature (657)..(657): n is a, c, g, or t
  misc_feature (659)..(659): n is a, c, g, or t
  misc_feature (662)..(664): n is a, c, g, or t
  misc_feature (666)..(666): n is a, c, g, or t
  misc_feature (668)..(670): n is a, c, g, or t
  misc_feature (674)..(677): n is a, c, g, or t
  misc_feature (681)..(682): n is a, c, g, or t
  misc_feature (686)..(688): n is a, c, g, or t
  misc_feature (695)..(695): n is a, c, g, or t
  misc_feature (702)..(705): n is a, c, g, or t
  misc_feature (707)..(708): n is a, c, g, or t
  misc_feature (710)..(710): n is a, c, g, or t
  misc_feature (712)..(713): n is a, c, g, or t
  misc_feature (719)..(720): n is a, c, g, or t
  misc_feature (722)..(722): n is a, c, g, or t
  misc_feature (725)..(731): n is a, c, g, or t
  misc_feature (733)..(736): n is a, c, g, or t
  misc_feature (738)..(740): n is a, c, g, or t
  misc_feature (742)..(743): n is a, c, g, or t
  misc_feature (745)..(747): n is a, c, g, or t
  misc_feature (749)..(749): n is a, c, g, or t
  misc_feature (751)..(757): n is a, c, g, or t
  misc_feature (759)..(759): n is a, c, g, or t
  misc_feature (761)..(762): n is a, c, g, or t
  misc_feature (764)..(770): n is a, c, g, or t
  misc_feature (772)..(774): n is a, c, g, or t
  misc_feature (776)..(778): n is a, c, g, or t
  misc_feature (780)..(780): n is a, c, g, or t
  misc_feature (782)..(792): n is a, c, g, or t
  misc_feature (794)..(794): n is a, c, g, or t
  misc_feature (796)..(798): n is a, c, g, or t
  misc_feature (800)..(800): n is a, c, g, or t
  misc_feature (802)..(803): n is a, c, g, or t
  misc_feature (806)..(807): n is a, c, g, or t
  misc_feature (809)..(809): n is a, c, g, or t
  misc_feature (812)..(813): n is a, c, g, or t
  misc_feature (815)..(818): n is a, c, g, or t
  misc_feature (820)..(827): n is a, c, g, or t
  misc_feature (830)..(830): n is a, c, g, or t
  misc_feature (833)..(839): n is a, c, g, or t
  misc_feature (841)..(841): n is a, c, g, or t
  misc_feature (844)..(844): n is a, c, g, or t
  misc_feature (847)..(847): n is a, c, g, or t
  misc_feature (849)..(850): n is a, c, g, or t
  misc_feature (853)..(853): n is a, c, g, or t
  misc_feature (856)..(859): n is a, c, g, or t
  misc_feature (861)..(865): n is a, c, g, or t
  misc_feature (867)..(871): n is a, c, g, or t
  misc_feature (873)..(873): n is a, c, g, or t
  misc_feature (875)..(876): n is a, c, g, or t
  misc_feature (879)..(881): n is a, c, g, or t
  misc_feature (883)..(888): n is a, c, g, or t
  misc_feature (890)..(892): n is a, c, g, or t
  misc_feature (895)..(895): n is a, c, g, or t
  misc_feature (897)..(900): n is a, c, g, or t
  misc_feature (904)..(906): n is a, c, g, or t
  misc_feature (909)..(909): n is a, c, g, or t
  misc_feature (919)..(919): n is a, c, g, or t
  misc_feature (921)..(928): n is a, c, g, or t
  misc_feature (931)..(933): n is a, c, g, or t
  misc_feature (935)..(935): n is a, c, g, or t
  misc_feature (937)..(938): n is a, c, g, or t
  misc_feature (940)..(942): n is a, c, g, or t
  misc_feature (946)..(947): n is a, c, g, or t
  misc_feature (950)..(950): n is a, c, g, or t
  misc_feature (953)..(956): n is a, c, g, or t
  misc_feature (959)..(959): n is a, c, g, or t
  misc_feature (964)..(964): n is a, c, g, or t
  misc_feature (967)..(968): n is a, c, g, or t
  misc_feature (970)..(970): n is a, c, g, or t
  misc_feature (977)..(977): n is a, c, g, or t
  misc_feature (981)..(981): n is a, c, g, or t
  misc_feature (989)..(989): n is a, c, g, or t
  misc_feature (995)..(996): n is a, c, g, or t
  misc_feature (998)..(1000): n is a, c, g, or t
  misc_feature (1003)..(1003): n is a, c, g, or t
  misc_feature (1005)..(1007): n is a, c, g, or t
  misc_feature (1013)..(1013): n is a, c, g, or t
  misc_feature (1017)..(1020): n is a, c, g, or t
  misc_feature (1022)..(1022): n is a, c, g, or t
  misc_feature (1025)..(1026): n is a, c, g, or t
  misc_feature (1031)..(1032): n is a, c, g, or t
  misc_feature (1034)..(1035): n is a, c, g, or t
  misc_feature (1038)..(1039): n is a, c, g, or t
  misc_feature (1051)..(1051): n is a, c, g, or t
  misc_feature (1058)..(1058): n is a, c, g, or t
  misc_feature (1060)..(1060): n is a, c, g, or t
  misc_feature (1066)..(1066): n is a, c, g, or t
  misc_feature (1069)..(1069): n is a, c, g, or t
  misc_feature (1072)..(1073): n is a, c, g, or t
  misc_feature (1075)..(1075): n is a, c, g, or t
  misc_feature (1081)..(1081): n is a, c, g, or t
  misc_feature (1099)..(1099): n is a, c, g, or t
  misc_feature (1106)..(1106): n is a, c, g, or t
  misc_feature (1121)..(1121): n is a, c, g, or t
  misc_feature (1126)..(1126): n is a, c, g, or t
  misc_feature (1132)..(1132): n is a, c, g, or t
  misc_feature (1135)..(1135): n is a, c, g, or t
  misc_feature (1156)..(1156): n is a, c, g, or t
  misc_feature (1159)..(1159): n is a, c, g, or t
  misc_feature (1183)..(1183): n is a, c, g, or t
  misc_feature (1186)..(1186): n is a, c, g, or t
  misc_feature (1189)..(1189): n is a, c, g, or t
  misc_feature (1201)..(1201): n is a, c, g, or t
  misc_feature (1212)..(1212): n is a, c, g, or t
  misc_feature (1219)..(1219): n is a, c, g, or t
  misc_feature (1222)..(1222): n is a, c, g, or t
  misc_feature (1234)..(1234): n is a, c, g, or t
  misc_feature (1237)..(1237): n is a, c, g, or t
  misc_feature (1243)..(1243): n is a, c, g, or t
  misc_feature (1252)..(1252): n is a, c, g, or t
  misc_feature (1267)..(1267): n is a, c, g, or t
  misc_feature (1279)..(1279): n is a, c, g, or t
  misc_feature (1282)..(1282): n is a, c, g, or t
  misc_feature (1285)..(1285): n is a, c, g, or t
  misc_feature (1294)..(1294): n is a, c, g, or t
  misc_feature (1297)..(1297): n is a, c, g, or t
  misc_feature (1300)..(1300): n is a, c, g, or t
  misc_feature (1306)..(1306): n is a, c, g, or t
  misc_feature (1324)..(1324): n is a, c, g, or t
  misc_feature (1333)..(1333): n is a, c, g, or t
  misc_feature (1339)..(1341): n is a, c, g, or t
  misc_feature (1343)..(1343): n is a, c, g, or t
  misc_feature (1345)..(1345): n is a, c, g, or t
  misc_feature (1348)..(1349): n is a, c, g, or t
  misc_feature (1357)..(1357): n is a, c, g, or t
  misc_feature (1360)..(1360): n is a, c, g, or t
  misc_feature (1366)..(1366): n is a, c, g, or t
  misc_feature (1369)..(1369): n is a, c, g, or t
  misc_feature (1372)..(1372): n is a, c, g, or t
  misc_feature (1384)..(1384): n is a, c, g, or t
  misc_feature (1406)..(1406): n is a, c, g, or t
  misc_feature (1408)..(1409): n is a, c, g, or t
  misc_feature (1413)..(1413): n is a, c, g, or t
  misc_feature (1417)..(1417): n is a, c, g, or t
  misc_feature (1426)..(1426): n is a, c, g, or t
  misc_feature (1430)..(1430): n is a, c, g, or t
  misc_feature (1432)..(1432): n is a, c, g, or t
  misc_feature (1436)..(1436): n is a, c, g, or t
  misc_feature (1440)..(1441): n is a, c, g, or t
  misc_feature (1447)..(1447): n is a, c, g, or t
  misc_feature (1450)..(1450): n is a, c, g, or t
  misc_feature (1453)..(1453): n is a, c, g, or t
  misc_feature (1459)..(1459): n is a, c, g, or t
  misc_feature (1469)..(1469): n is a, c, g, or t
  misc_feature (1473)..(1474): n is a, c, g, or t
  misc_feature (1477)..(1477): n is a, c, g, or t
  misc_feature (1484)..(1484): n is a, c, g, or t
  misc_feature (1487)..(1487): n is a, c, g, or t
  misc_feature (1489)..(1489): n is a, c, g, or t
  misc_feature (1493)..(1493): n is a, c, g, or t
  misc_feature (1495)..(1495): n is a, c, g, or t
  misc_feature (1498)..(1498): n is a, c, g, or t
  misc_feature (1501)..(1501): n is a, c, g, or t
  misc_feature (1546)..(1546): n is a, c, g, or t
  misc_feature (1561)..(1561): n is a, c, g, or t
  misc_feature (1576)..(1576): n is a, c, g, or t
  misc_feature (1585)..(1585): n is a, c, g, or t
  misc_feature (1589)..(1589): n is a, c, g, or t
  misc_feature (1591)..(1591): n is a, c, g, or t
  misc_feature (1609)..(1610): n is a, c, g, or t
  misc_feature (1621)..(1621): n is a, c, g, or t
  misc_feature (1626)..(1626): n is a, c, g, or t
  misc_feature (1629)..(1629): n is a, c, g, or t
  misc_feature (1631)..(1636): n is a, c, g, or t
  misc_feature (1638)..(1638): n is a, c, g, or t
  misc_feature (1645)..(1646): n is a, c, g, or t
  misc_feature (1648)..(1649): n is a, c, g, or t
  misc_feature (1651)..(1653): n is a, c, g, or t
  misc_feature (1678)..(1678): n is a, c, g, or t
  misc_feature (1721)..(1721): n is a, c, g, or t
  misc_feature (1733)..(1733): n is a, c, g, or t
  misc_feature (1736)..(1736): n is a, c, g, or t
  misc_feature (1748)..(1748): n is a, c, g, or t
  misc_feature (1826)..(1826): n is a, c, g, or t
  misc_feature (1829)..(1829): n is a, c, g, or t
  misc_feature (1853)..(1853): n is a, c, g, or t
  misc_feature (1886)..(1886): n is a, c, g, or t
  misc_feature (1952)..(1952): n is a, c, g, or t
  misc_feature (1974)..(1974): n is a, c, g, or t
  misc_feature (1988)..(1988): n is a, c, g, or t
  misc_feature (1997)..(1997): n is a, c, g, or t
nnnnnnanncnnnnnggnancnnnnnnnccnnncagntnnnnnannagnanngnannnnncnnannaanctgnngnatnnngnnnngnannnnnnnannnnnnnngannnnnanannnnncnntngnnannntnngngannttncannatncnnnnngnngtnngncnnnnntntnnaannntnnannnnnncnnngtngnnnnnanngntccnncanncnnnnnnnnnactannagntnncnncnnnnnnnnnnanggnnannnagtnnnncncnannnnnangnnnnnnnannngnnngtnngnangncnnnnnnntgnnncnnttctnncnnngaanncngntntnnntnttcnnnntncnnntncngnntnnnnaannanaacngntnnnnnnnnnngnncannncnnncancnntnnnnnnnannnnngccngcncnntncngangcnnnnncnannnnngnnnanctngttntcnntnnngnaacgtnnnntnnnnngnnganaantcntntgggcatcnncnnnnnanncngnnnnannntnnnngcnggnnacnnnnnaaantangcananattcantcnnccnactgncngnnananntntccngntnngnncggnnnncnanannantgnaggaagaaatgagnnananacnnnanannntgcnnnnttcnntggnnnaggaaanggagcgnnnnannangnncaacanncncannnnnnncnnnnannngnngnnncngnnnnnnnangnngnnnnnnncnnngnnntngnnnnnnnnnnnangnnnangnnggnncngcnngnnnncnnnnnnnnccngtnnnnnnntnccnccncnnccncgnnnncnnnnncnnnnntngnngcnnngnnnnnnannnagnannnngatnnngangatgatgaanannnnnnnngcnnngntnntnnnggtnncantgnnnnctngcatngcnncncctgctnttgnctatggcngtgagnntnnngangnnntggaanagcnnnncntgnnttctnncnncgnngaagaagatgtngtcaccntnaccganganganncnggtgcnctgaccccggagggcaanctgacgntggtggacgattacnacacnagttantcngatggcagcgggcagcagttnatnacgctggtgtcgaagtctggcaanacnttntatctggtcatngaccgcaacgncaagggnganaacaccgttcanttnatgaancttgtggangaagccgaccttctntccctgatggangangangatgccgangcntanaccgcngaaaaagaagcggcggcncaggcagancaggannncnancannccgaggangangcgaanaangcngcggaagaagcngtggcatccggttctgaacagncnngtgncaanaaagttacnaagnangctnctannttcttnggngtnctggcnctggtcggtntggnngcnggcggtngcntntacncnttnatnaagcagaagcagaaaaagcaggcagaaaaagaagcccttgacccngatgcaaactacacngaggacaagggcgantttgaaatncctntngaggatgagccggaggannccggcgaggangatancgnannnnnntnattttanngnngnnntttgccgccttacatattgcaatcngaaacagattggagggattcttatcgcaaaattgatcgtggcngagaaaccgtcngtngccatgtcctangccaaagtcctcggtgccaccagccgtcaggacggctaccttgagggcaacggctatctggtaagctggtgcgtgggncanttggtggaactggcaccgcccaangtctacgatgccaaatacgtcaagtggagcatngcagacttgcccatcctgccgcaaaagtggcagtatctggtgtctgcgtccaccaaaaagcagttnggtatcctgcaaaagctgatgnaccgcccggacgtngacagcatngtgaacagttgcgatgcagggtagtgcggttaggtgactcaagagaaagaaaaaagagacctcatctcgtcaaaaatcaaatttcaaaatcattaaaggagctattcaaatgaaacgaaatcagaatttcgaccataatcactctcaaaaactgctttccttccgctacaacatagacaccaaccgagtggaagcccggttcacggatggctctgccgtcgccaacaggatgcccaactgcctcagaacatcctcaacccgctactttacagtggggttgacacggaggattgagtgtcatcgttttttcatggctaccgccgaaaatcattgtaacgtattttgtgttacaaattggtcaagcgaatgattatgattaaaattctcttactcgcacaataagtcatttgataaactggttaaaatgccaaataatttcaaatcatagtccaacacacaacaaatgtggtataataacaatatatttaatgctttaactgtgtttgcaaaaaggaaaagaagataagtatggagattacatggttgaaaaatgaagataatgccattcaatacgtctatgcctctgctgttccccaaaaaataccattagacatttttaaagaaattgttcagagcagtaaagaaaactgtctacctgaattttatgtgatatctgaacagggaaagtatatcggatatattttattattggccgataaaaaagaagacatccctaaaccttttacatttcttgcatgtcataatggcgatactctgccaaaagaaactcacaaaaaaatattggaatttatcggcaaacggtgtcgtgtaaacaactggaataaactcgcttggttggccgaacaagaaatccagcaattgtgatatcatcgttttttaagctatctctctataaaaactccttaaagacataaaggcaaacttgaataaataaatttatctaaaagccccacctacaatagatattccaaatcgaagaatctactgcaggtggggcttgttctatgtgataagctattttgtaaaaatcaaatacgtagattatatggcagaatcatttggtgacactgaaagctaatgttgcgccatcaacgacactatacatatcgccgttagccgcagtagcaattccagtaaactcaacctcccattttcctttagagagtccatattttacatcttccgtaccgattgtgccgtatgcagaaatggcatgatcaaaggttccaaagggtgtaccaagtttattgaaatgcaggttaccttcaaaggaaacaattactgcacccggaacggtaatcgtccattggatatacccttcagacagataatcaagtgtacatgaaccagcatcgccccagaaggtttcgcgagaaattgggacaagtttgaatgttgcagagtttacagttgttcctttatcaatttcgatactagattttttggaagaaagtgctacaacgcctggttcaactgcaacagcagcaggcatcaaaactgtgttgaaaacaaccaacgcagcactcgttccagccattttaaggaattcatttcgggtcatctttttcatgtcgatttgctccttatattttattgactgttacaagtcacccagctacaatttggattctttttcgcttaattctgcactggaatcacctcttacaaaattttagtatattggcatcatcgtgatcaaaagcaatatcactaacagccacctcatcacactataaagccgcaaattttcaactcaggtgtatgctcatcggcaaataaatgtgaaccatacgaatgccgctgttaaacaacctgccaaaaccactaaaatacaacttgccaactttggctcaatagcaactttttgattttcgcacagcgcaaatttctgaagttcctgaaatgttgtttgattgacattgccgtgtattgctttccatgcaacgaaatgatttgtaatcagaagataatctgaaacgatt

SEQ ID NO: 1317 - DNA, 4000 bp, Escherichia coli
  misc_feature (721)..(721): n is a, c, g, or t
  misc_feature (752)..(752): n is a, c, g, or t
  misc_feature (766)..(766): n is a, c, g, or t
  misc_feature (815)..(815): n is a, c, g, or t
  misc_feature (1669)..(1669): n is a, c, g, or t
  misc_feature (2418)..(2418): n is a, c, g, or t
  misc_feature (3829)..(3829): n is a, c, g, or t
  misc_feature (3983)..(3983): n is a, c, g, or t
  misc_feature (3986)..(3987): n is a, c, g, or t
  misc_feature (3989)..(3993): n is a, c, g, or t
  misc_feature (3995)..(3995): n is a, c, g, or t
  misc_feature (3998)..(3998): n is a, c, g, or t
tgaagatcgccccggacctgagcgacgaggacgtggccgcgatcgcggacctcaccctcgagctcggtctcgacggagtggtcgcggtgaacacgacgatcgcgcacgacctcgggcccggcgggctgtccgggccgccgctgctggcccgcggcctcgaggtggtcgcgcggctgcgcacgcggctcggcgacggcccggtgatcatcggtggcggcgggatcaccacggtcgaggacgcgcagcggtacctcgacgcgggcgcgaccctcgtccagggctacaccgggctgatctaccagggaccgttctggggttcgcggatcaatcgcggcctcgctcggctcgggacggcatgatgcgaccgccccagtggacctggcggttcaccgaggccgacggtgaggtgctcaaacccccgatcagcccgacgttctcgaaccggttcgacgccgaggcctggctgggcgagcactggagagccgtcgccgctgagggcgtgttcgcggcagtcgtgctgatggacgggaagcccatttcggctccgatcgagctctccgagccgcgggacctatagagcgaccggaaccgatatcagttcgtcggcaacgcccgtggcccctcaggattgcgcgggtgagccgtagcaccgggacgagcatcccgaccgcgaccttcctgccgggccgcgaagacggtgccgcccggcgccgcagcccgnttgagccgtcaggccacgcgacccttcgggntcatcgtgaccgtnagtgccgggtcgcgctcgaccgagtcacccaggatgtcgtcgatccggntcatgagctccgccgggatcatcacgccggaggccttgacgttctcggtgacctgctccgggcgcgaggcgccgatgatcgcaccggccacgttggagttctgcaagacccacgccacggcgagctgagccatcgagagaccgagctcgtccgcgaccggccgcagcagctggacgcgctcgagcagctccggctggtcgaggaagcgcttgaccatcatcgcgccgcccttctcgtccgtggcacgcgagccggcgggcggctgctgactgggcttgtacttgccggtcaggattccctgggcgaccggggaccagacgatctgggagagcccgagctcctcagaggtggggacgacctccgcctcgatcactcgccacagcatcgagtactgcggctgcgaggagatgagctggaagccgagctccttggacagcgcatggccggcccggatctgctcgacgctccactcgctcaccccgatgtacagcgacttgccggcgcggacgacgtcggcgaaggcctgcatcgtctcctcgagcggcgtctcgtagtcgaagcgatgtgcctggtagacgtcgacgtagtcggtctgcaagcgacggagcgagccgttgatggcctcgaggatgtgtttgcgcgagaggcccgtgtcatttgggccaccgggaccggtcggccagtacaccttggtgagcacctcgagcgattcgcgccgttggcccttgagcgcctcgccgaggaccgtctccgcgacggtgttggcatagacgtccgcagtgtcgaaggtggtgattccggcgtcgagtgccgcgtggacacaggcgtgcgcggcgtcgttctcgacctgtganccatgggtgagccagtttccgtacgcgatctcggagatcttgagaccgctcttgcccagatatcggtaagcaaccatgcggtcagcctaggcctggtcagcgcgggtgctgaccacgcttcaccagcgccttggggagccgcacccgacggatctgcatcgagcggagcacggcatacatgagcgagccacgttcgatcttgtccgccccgaacttcgcggccaggtggcccttgatgaccctcgtcatgacgatcgcgtcgacgatcgtcagcagcacgaggccgtagaggacgaccgtgatcatgaacgccgcggccggaatctgggcgaacaacatcgtcgcgaacacgatgccgagcgcgatcggcaagaagaactcgccgggagaccaacgcgcgtcgacgtaatcgcgaatccaccgacgctgcggccccttgtcgcgcgccgggaggtagcgttcgtcgcccgtgcgcagcgcctggtactcgcgctcgcgcgcgctccgggcctttccgcgctcggtctgcgcggcgagcttgcggtccgctgggacgagcgggcggcggttcgccgcctcggcctgcttgcgcttcggcgtcggtcgtcccttgccggccggctcggactcgatggcgtcgtgggccgtggacgccgcggcgtcgggcgctggttcctgcttgcgggtgaacacgggccaagcgtagtcgaggtgcgtactacggtggtcgggtgaccgaaacccctggnacctcgaccggggccggcgccccgttcgcccccgacacgctccgttcgcgggtcgcaaacgacttccccgcactgcggacagagctcgaggcgctggtgcgaatccccagtgtttccagcccggccttcgaccagacgcaggtgcgccggagcgccgaggcggtggctgcgctcctcggtggcgcgggcctgccggaggtgcgcatcctctccgtgacgggcgccgacggccgcgccggaacgcccgcagtggttgcgcgtcgtcccgggccggacggcgcccccagggtgctgctctacgcgcaccatgacgtccagccgccgggtgccgacgaggagtgggacacgcccgcgttcactccggtggaacgcgacggacggctctacggacgcggtgccgcggacgacaaggccggcctgatcgcgcacctcggggcgatccgcgctctcggtccggatctcccggtcgcattgacggtcttcgtcgagggtgaggaggagatcggctcgccgaccttcaaggaattcctgctcgaataccgcgagctgcttgcggcggacgtcatcgtcgtcgcggactcggtgaactggcgggtcggcgtcccggcgctgaccacgagcctgcgcgggctggccgactgcgtggtcgaggtcgccgtgctcgatcacgcgatccactcggggatgttcggcggaccggtgctcgacgctctgacggtgctcgcgagactgatcgcgaccctgcacgacgacgccggtgacgtcgcggtggccgggctcgggcgggcagcggaccccaccgtggactacaccgaggcggacctgcggtccgacgccggtctgctcgacggggtccggctcgccgggtcgggctcgatcgcggcggcgatctggaccagaccggcgatcgcggtgatcggcatcgacgggacgagtgtcgccgaggcctccaacacgctcgcaccccgcgcccgcgccaagctctcggtccgggtggcgccgggcggcgacgcggcggaggccctcgccgcgctgaccgagcacctcgagcggcacgcgccgttcggcgcacacgtcacggtgacggccggtgataccggcgaaccgttcctggcaccggccgactcgccggcgatgcgggcggcccgggcggcctttgaggcggcctggggcgtgccgccggtcgacgtcggcctcggcggctcgatcccgttcatcgcggacttgatccgcgagttcccggacgcggcgatcctggtgaccggggtcgaggaccccgattctcgcgcgcacggcgcgaacgagtcggtgcacctcggggagctgcagaaggtgatcgtcgccgaggccctgctgctacagggcttgcccggcgcgctcgctgccggggcctgagccaggcgcaccggcngcccggtcctggaccgggggagccgggtcgtactggatgccgcgccgcaccccgcgggcggcctccacgctctcgagccgatggaccaggtgcggggccatgtcgatgccggccgagacgccggcctagatgccggccgagacgccggcctagntgnngnnnnngncgncg

SEQ ID NO: 1318 - DNA, 4000 bp, Escherichia coli
  misc_feature (28)..(28): n is a, c, g, or t
  misc_feature (77)..(77): n is a, c, g, or t
  misc_feature (106)..(106): n is a, c, g, or t
  misc_feature (305)..(305): n is a, c, g, or t
  misc_feature (407)..(407): n is a, c, g, or t
  misc_feature (548)..(548): n is a, c, g, or t
  misc_feature (605)..(605): n is a, c, g, or t
  misc_feature (737)..(737): n is a, c, g, or t
  misc_feature (1193)..(1193): n is a, c, g, or t
  misc_feature (1241)..(1241): n is a, c, g, or t
  misc_feature (1318)..(1318): n is a, c, g, or t
  misc_feature (1398)..(1398): n is a, c, g, or t
  misc_feature (1400)..(1401): n is a, c, g, or t
  misc_feature (1403)..(1403): n is a, c, g, or t
  misc_feature (1410)..(1410): n is a, c, g, or t
  misc_feature (1424)..(1425): n is a, c, g, or t
  misc_feature (1431)..(1432): n is a, c, g, or t
  misc_feature (1435)..(1435): n is a, c, g, or t
  misc_feature (1464)..(1464): n is a, c, g, or t
  misc_feature (1471)..(1472): n is a, c, g, or t
  misc_feature (1474)..(1474): n is a, c, g, or t
  misc_feature (1476)..(1476): n is a, c, g, or t
  misc_feature (1480)..(1480): n is a, c, g, or t
  misc_feature (1489)..(1491): n is a, c, g, or t
  misc_feature (1494)..(1494): n is a, c, g, or t
  misc_feature (1506)..(1506): n is a, c, g, or t
  misc_feature (1522)..(1522): n is a, c, g, or t
  misc_feature (1531)..(1531): n is a, c, g, or t
  misc_feature (1547)..(1547): n is a, c, g, or t
  misc_feature (1555)..(1555): n is a, c, g, or t
  misc_feature (1592)..(1592): n is a, c, g, or t
  misc_feature (1601)..(1601): n is a, c, g, or t
  misc_feature (1634)..(1634): n is a, c, g, or t
  misc_feature (1645)..(1645): n is a, c, g, or t
  misc_feature (1651)..(1652): n is a, c, g, or t
  misc_feature (1663)..(1663): n is a, c, g, or t
  misc_feature (1990)..(1990): n is a, c, g, or t
  misc_feature (2398)..(2398): n is a, c, g, or t
  misc_feature (2599)..(2599): n is a, c, g, or t
  misc_feature (2926)..(2926): n is a, c, g, or t
  misc_feature (3346)..(3346): n is a, c, g, or t
  misc_feature (3597)..(3597): n is a, c, g, or t
  misc_feature (3786)..(3786): n is a, c, g, or t
  misc_feature (3975)..(3975): n is a, c, g, or t
cagtcgtccgataccggctgagcaggcnacactgctgctggcgtcggcggatgcagagggattcatccaggaagccnccgtctccgttattgagccagacccggangctcagctggcacagcgataaaaaaacgggcccggcagcgtgtgccgggccgcacgggcatcagaactgatagatcagacccacggccgtaatatcatccgtggccagattaagcgggttgttgtctttcaacaggttgatgcggtattcgccatagaccgacatattcttgttgaagtagtaggtcgcacccaccgcngtgtatttgacaatgtcggcgtcgccgatattctcaatctctttacctttcgatgagacgtaacccacagacggacggaaaccattcaggaactgatactgngcaacggcttcaaagttctgcgccttgtttgcgaaaccgttggtgatcggcgtggcgttcagggtttcaccatacatcgcggccagataaacctggttcgcatcatatttcactgaggtcgcccagtgctgcgctttttcnccttcaccgcgtggggcggcgttctgcgccgttgtgcgatccaggctggcaaaggcnccggcgaagctcaggccgaaatcgaagtcataagaggcagagagggcaaagccatcgccgttagaacgacgtacgccgtcggtgttagcgctgcgatcgtttttaccctgatactgcgcggcaacgtttaanccctgaaccaggccaaagaaatcgctgttacgccaggtcagcacgccggttgagcggccagagaggaaggcgtcggtgtagccggaatcgccgccaaagaagggcagcatatcggtgtaactcagcgcgtcatacaccaggccgtagttacgtccataatccagcgcaccggcttcgccaaacttcaggccagcgtaacccaggcgggtacggttgccgctctgcgcatcgctgccttctgagttgtgcaggctgtactgatactgccagaaaccgtagccggtcagctgatcggtaatctttgtttcgcctttaaaacccaggcgggaataagaggaggtatcaccgttgttcttatcgtcgtcagaaaagaggtgcgacacgttaatcttgccgaccagatccagcttatttccatccttgttataaatttctgcggcctgcactgaagagagnccgagcagtaacggcatgacagccgccagtaaagtgcgcttcatcatntattcattaccctgtattcattaattattatgccccggctgcggggtgaaaagaaaatgacacaaaaagttaaaatnacaaagcgcaataaaagtaacaaaatgtgatatgcatattcagtaaaggaaaatgcgtgtctgaaagacgattaaattcngnngnaataagnatttcttctgatgnnttttanngtntttaataaaaaagtgatgattatcagtgnttaattnntngntgtngcttttctnnnccnggcattttgtangtttttaaatcatcantcccgctgnttaaattatggataangcattaangcaaataagcgataagggttttattctaaccattagnctgcgtagnaatatctgttcatctttatttcaaaggttattncgctgccaatnatcacnncgggaataatncagaagaaatcgttttcattttatttttccgcataaaaaataatcaggccagacgtcgatctgcccgcttaaatgaaaagattctgttaaatcctggcatgtcgtcatcctctctcgctgaatattctgcgcctcatcctgcaccgtcgcgaggcaggctgcgctaaaacagggcactcttcgggccttttgcggagtgattgtttatcagcgatcacaaaagcgatatttcatcccgcgattgcataattccgctatttaaaacccggctctgccgctgcaatcagacaattattcactatatatgcaaaaaaagtgaatagcagnggcgtgtaacttattgatattgcgtcagggtgacgattttatgcagttaattctctggctggcacgttaactgcactctacagtagggctgcattacaacatcccttaacaattttaaaacaatagctttacccgaccgggaaagcaggagaatgggttatggcactgcacgtttcacgtcacgatttcgatcaatggatgatgccggtttatgcacccgcgacatttgtcccggttcgcgcggagggctcaaccgtctgggatcagaatggcaaagactacgtcgacttcgccggtggcatcgccgtgaatgcgttagggcatgcgcatccggcattacaacaggcgttgcaggagcaggccgcccgtttatggcacaccggcaatggctacaccaatgagccgatnctgcgactggcgaagcagttaattgatgccacctttgctgaccgggtctttttctgtaactccggtgcggaggccaacgaagcggcgctgaagctggcgcgcaaagtggcccacgatcgggtcggcccgcagaaaagtggcattgtggcatttaagaatgcgtttcatggccgcacgctgtttaccgttaccgccgggggncagcccgcttactctcaggattttgcgccgctgccacctgccatccagcacgccccgtttaatgacctggcggccgcggcggaactcattaatgaccagacctgcgcagtgattgtggaacccatccagggggagggcggcgtgctgcctgccgatccggcgttcctgcgcggactgcgtgaactttgcgacaggcatcaggccgtgctgatttttgatgaagtgcagagcggcgtgggccgcaccggttcgctttatgcctatatgcactacggcgtcacacccgatgtcctgaccagcgccaaagcgctcggcggtggcttcccnattggggcgatgctgacgcgcgacgatctggcgagcgtgatgggtgtcggcacacacggcaccacctatggcggtaatccgctggcgggcgcggtggccggtaaagtgatggaactggtcaatcagccggactttatgacgggagtgacagagcgtcaccagtggatcgtctcggctctggcggagatcaaccagcgtctgcagctgtttaaagaggtgcgcggcctgggcctgctgataggtgcggtgctgagcgatgcgtatgccggcaaagccaaagcgattaacctggctgccgctgagatgggcgtcatggtgctgattgcgggcgcgaacgtggtgcgttttgccccggccctgaacatcagcgagcaggaggtgaagctgggtatggcacgctttgccgaggcctgtgaaagnctggtacgagggtccgcatcatgatggtaatccgtccggttgaacgcgatgatttaagccagctgatgacgctggcaggcaaaaccggcggcgggctgacctcgctgccggtcgatagcgccacgcttcaggcgcgaatcgatcgatcgctgcaaacctggcaggatacgctgccgcgcgctgagcagggctacgtctttgtgctggccgacagtgaagataatcgcgcggtgggcatctgcgccattgangtggcggtgggcctgcaggacccctggtataacttccgcgtcggcacccaggtgcacgcgtcgaaagagctgaacgtctacgccgcgctgccgaccctgtcgctgagtaacgaccacaccggcagcagcgagctctgcaccctgtttctcgaccctgagtatcgtgacggcaaaaatggctatctgctntccaaatcacgcttcctgtttatggctaacttccgtgaccgttttatggagcgggtagtcgcggagatgcggggcgtcagcgatgagcagggccactcacccttctgggagagcgtcggcagccgcttcttctcaatggacttcagcaaagcggacttcctcagcggcaccggccagaaagcctttatngccgaactgatgccgaaacatccgc

SEQ ID NO: 1319 - DNA, 4000 bp, Escherichia coli
  misc_feature (1988)..(1988): n is a, c, g, or t
  misc_feature (1995)..(1995): n is a, c, g, or t
accaccattgaggtttctgcttcaccggagaaccacccacctctgcggcaatgaccatggcagaacgcgaaacccctcacaccagaacgtgaccaccatggcagtcacctccgtgacaaagatcgatgctacctatgttgtaaaaccaccgtgacgatcacgaagccatcgtgaggcactcccacctgcgacgccacaacctgaaatgccaaaataaaaaaaacgaaacggatttcatgaaagcaaattttttcatgaaacagattttgatattcgtttcatactctagttccggagccgtcgtcggcaacaacgtgaggcgttcaacctctcttgttcttcttcttccccataggtgcgcagtggaggttcttcaccacctccatcatatgacacactaccaccaccgtgaaccacggtgatcagaagctccgtcaccattgccaaactaccaccttatctccatgccaaacatgggagtcccacggttcggacatatgggaggattccgatttgtccctctgtttcttatttttctctttcattttgttgattgatcagtggaagtttgatagtggaggtgagataaggattggtgattttttggtatttctagaatgaggaagaaggtggtgatggtgaaggtgttgataatggttgtgattaatgtgtgggttaaggttatgtgatagaatttattaatgtgtatttgaagaatgaaaagatgatgaatgggttgaagattgaggtggaagatggatgatgtaacaacatattgacaatatttctagaatggagatgaagatggtggtctatggaggtgccgaggatggtggtttgttatttaagtggtggtttggaatggatgaaaggaggaatatctaagtgaagttggattctcttgtgatgaataacggtgtgttggtttggaggtagaagaatgggtctccatgatcccttggagatggtgcggagatcaaaaccccacctctcccctctggtttgtttttggtgttcaatatgaagatccatgagttgtcatgatcatgatgaatggataaaagaaaagtggatatgtgcctaatggaggggtatggagaaaagaatccagaggggacgtgttagggagtcttggaagaaataagatttctgatttcttataagaatgaagatagttaggttgaagcgtgagtgtgacagaagaagatagattaaagatggagatatgagttgaaggagaaaaaatattttcagtatttactgtgggtcaacttaatatttactgcaggacaacttaggaattataatatatgtttggaggtacaggagaatctattggaggtatagggagaagctcccatcaacgaattgaaggtggaaattcagttcttcgataacccaattcttaacaagcccattaaacagatccatttggagatttattttgccactgaatttagaaaaatatttcatttaacccttgaggcataacatttatgggcacaatggagttaggtctaacttgacatatttttttaagaattaggatcataataataaaatatataattttatcttaaaaattcatataaaataaataaattaataccttatttaataattcttgcaaatcttcacacatgagaggaccgaattgagtaattaataatgcatgtaaaaaaagaagaagttatattaaaaaccaaattttggtaagaacaacatagtttatcctaaaatgttgatatatctaatcattaaaaataaaaaagaaaaattgtaaattgtaaaatttgcattcattttactcttttttcattaattttgtgaaaactacataatttcttttatttacgttttcatttatttccattttatttttattaaaaacaaagaaaaaacaaaaaagaatattcaacttgtaatgcacacccttaataaaggaaaatctcttttatacacaattccatactatttttatatttttntaattanttatatatatatatatatatatatatatatatatacttttttattattgttctcttttaaattcaattaactttattttctcagttttaatgtctacaaaaaaatatttacaataaaattaattggtttatttttataacttttatatacatgttttttttttaattctagtaatatattttattttgataatgatgacaataatcgtttttttttttaattttagtagcacacgaggctggccaatcaatgcattttcggcgcaccatgaatcacacttgtacacaataaatactacatttttctcaaaatactaataaatattacctaacacaagtagaaaacgttcagatctcaaattagcaattgaaaatatatttatattttaaattattttcatgatattttgaaacaacatgtaaagtctgtgattgaaaaaacgtcaaaagtaagtggctgccgaattttatataaataaataaaatatatttaaaattaaaaaatagtttaatacaataaaaatactttttattcaaaaatgtaaagcaaaccataaactgttaactactatcttaaataataataataataatattattattattattattattattattaggttgcagtagtagtgtgtgacaaggataaggataagaactgaaatttcaggaacacagaaaataagaaataaaagctattaacagttcagacacgaggaagaagaagaagaaaagttttggaatatgaaaggaaactgtcaaagagtgtgattgctgccatatcactcttttcatttatttgactcgaattaggtaaccaaaatggttggtccacaaatgttaccaattttttgaggaggacaaaataataacgtagtatcataaattatgaagaaataaacaaatctaaaaagttaaatccgttatggaaggtgtgagacataacatcgtaatttgtttggtcaagtgtttatgtctcatcttttatggcgtgactgataacaacatttacattgaaacttggttaccgtttcacacaaacttcataatctgaaactataaatagagaagagaagagaggcaaaacaccaacgaaagttaaccatggcttcttcaaggaggatctcaaggctgctctctccttcttttctttctgctaccactaattctttgttttctagaggtactactacttctttatcatcacttccaagatcttggtctcatcttgttactttcatgtttggttcttgacagcatcaaaattaagtgatcttcaattttgtagtattttctgatccttatgaactgtagttaccaatttgttggagatggttgaattgatcaactgttatataatgtattttaaaaattgtatgatccattaccagaagtgtgtactccattctgtactcatttattggttggctttttgttcttttctagccacaacctgtttctttcaaagattcacttccattttttatgaataatccaaatgtgaaaatacttaccatattaagtaaaatcgagaaagttcaacaccatacttaaaaaagactatttcggttcatgttaatacctagaagaaggatcatgtctttcgatgagtgtttttaggccttgattttgatttggggttttcgttaatggacttgtttatttttaatcagactttttaaggccattgaccattttttctgatattcaggtggaagtggtactgttgttggaggactcagtaaattcagcactactgctgctgccactgaagaaccaattaaaccagcagttagagtagaacacactcagctcttaatcgatggaaaattcgttaattctgcttccggttagtcctctttttttcaccctttctacttttatcttcatctatttagtgtgtttgggtgagcacttgcaaactggttctgaatgaagggatgtgatttatcttaggaaatttttttatattttatcttaaagttagtaaagaatcttaataa

SEQ ID NO: 1320 - DNA, 4000 bp, Escherichia coli
  misc_feature (613)..(613): n is a, c, g, or t
  misc_feature (1674)..(1674): n is a, c, g, or t
  misc_feature (1703)..(1703): n is a, c, g, or t
  misc_feature (1878)..(1878): n is a, c, g, or t
  misc_feature (1983)..(1983): n is a, c, g, or t
  misc_feature (1985)..(1989): n is a, c, g, or t
cgagttaagaacatagcagagtagtacgtatcttttctcggtatatttattaccgatagcagcgaatagactattagggtcacaatgaaactgggagttatttcggacgttcacgggaactatgttgcactccgggcagttctggaggacatggaaggagaagtggataaactgatttgcgctggagacgttgttggatacggaccgcagcagacagaagtagttacggagatgatggagagagacgtccctacggtccaaggaaatcacgaccggagtttcgatagtccggagcgctatcaagcgaataacatggcgtatgagggcctgaaatacgctcgggcccgtatgactgatgaacagaagaactgggtctacgcgcttcctatgcgccgcagattcgcagaaggcaagattctgctcaagcatgaacacccggatgatgattacatcgggacgctaaagtcctatgtcaagcctgcgcagttcccagagatgaacccttacatgagagagctggatgttgatatgctcatcatgggacatactcacgtacagcacgtctacgagggaccagacggcaccgtgttgaatccgggcagtgtgggacaanccagagataaagacaaccgtgctgcatacgccatcgtagataccgacacgatggacgtagagcttcgcagagtagaatatgacattgaaaaagtcatccgtcttgtcaagcaagcgggtcttccagtgagaaccggaacacgtcttcgatgatgaaagataagaacagaggccagtacttctgtcacgattgcatggaggaaccggttttaacatataacaacggagacggaagggtttgtggaaagtgccagtcccataacatagtagatactgatgaagttagagatttcattaagtccagagaagtagcgaagctcggtctcgcgctttctttagtggagagcgtacgtcatgaagtattcgatgaggaaatacagcaacctattcgtagatgctttgggttgctcgattcttcttacgggcaagctactaacaaatacgaggatggtttccaggagggagaaatggacttagagtatcttcttcccgagcaatggctgtatgattcaatctgggattacaagtaaatttctaatatcccttccatcgtttcttctgctctctcgaacctcggaccttttgttattttatcgcctttcttcttgattatgttcgattcttcgagtttcggaatgtggttgtgaacaagagaaatttctaactcttcttcacttccactcaatttctcacagaggtcttctattgttatttttccctcggttgagactgcctgtagaatttctctacggcgtttagacttcaatgcgtcgagcgcgattttgattctctggtctgtttccatgctccattcgctatatgattgtgaattataataaaactacttaatgtctataaccgttgttatagttgagaatcagacggggtagtcttgatattggtcgtgtgatataccccttcgttcccgtattgatatatcttagatacttcttcctctgtgaaagcatagcctctgtagaatcggaaatcgtcaatctttccttcatacaactcagaatctccttgccccgtgttattccatgaggacccttctgtattttnccccataatcccgtatctcgtagacccgntacccagtccttcatttcttgcgtaatcatattggccttctaattctccatcgaagtatagctttgtagtatctccaacggcatatctatcatatgtaacaacgagatgatgccattttccatcatctgtgaatttcccagtgttgatttgggcattgcctccgctcgcactctnaatataaatcccgcagccatcttttccattggacccattggatgtatcatttacatacaatctcacatattcgcttgcgtcgtatgaccatatgtctgtatgggngnnnnnggcggcggggtcgccacgttgttgagtgtatacccagcaagacacagtcattgctgttatcgcaggactcgaattgaagaagtgattgattggaatgtaatttccattcccagcagatacgatttcaactgcttgccctattttcccttcggaaaatgtaacgttgggtctgcagacagacgagtggaaattatttccactataatctctcgtatctccatcaaaggggaaccagtattccagatgctgttggttataatctgcgagttctggttccgctttaagaaggtccttgaatttctgattgcggccatatccttcttcgtcctgggcagaatcccaatctacaccagagtgccatcctacaacgtttgaaggagtaggaactgctgtttcatatggagaggtcgctacggttccattactatctactcccataatcagaacgtagtactcatcccacgtggacaatccagttatcgtgtatgatgtggcgctgccggtgagtgtttgtgagagggtatagtcagataagtctctcgactgagtgtcggagtaatagatgcgggtctcgtcgtagctctggggattgctccagctaacatcgacctctgtttctctctcttcgtctattgttacgcccgtcggcggagctatcggatttagaccgatgctggatatagacgtattggattttaaaacgtgtactcctatctggaatttcttgtggctggaactccaagtgatttccttcgttgaatcttctaccacgtctataagatgaatttcttctccgggtagatttggagaaccgattactgaaatcttaaccatgtctccattagaatctatatccatatcattaaggttcggctgaatcggagacgttgaatatttgtaaccggataggtgatatgactctttcatttctatcttgctgaacccgaaaacgctatcactatcgcttctatcggacttacctccgatgcttaaccaatcataccatgtattgtgctcgtggaaatagaaaccgagtacgtctccattatctgtatttccaggcgtgaagtcgctgttattgttatagttgctcgggtaagtttctcctatgtagtattctacaccttgctctatttcaagttcttcgagtgtaagagtagattctccattctttttcacgacctctcggaggtcccatttgctcgtagaaccgctatcaatagggtggccgaattcgatggcccccgatgaattgaacgaacctccatccattggagtgactctaatatctccccagaatgtacgttgagctgtccagaagtggtggtagaagtcactgttattacttcctgcaccatctgtattaatactgtattctgtcctaaatgctggcgttgcattcaatacatctgcagcatgggacatgttgaattccttttggcctgcatcccagtctccagcagtctcccaactaacagaggttacggaagtcgcggttccaagacttagagaagtaatctccggggcatctccattatccccggcgaaggttaattctaatctgaaatccgtatgagagctggaccacgtcagttcttcggctgggttgcctacaagagtcgtcgtgacaatctcttcggacggagtctccggagaccctactacggaaatatccacctccatatctccgggggaataatccaggttgactaaatctggttgggtttgagacgggaaggacttggtctccgttttgattgtagtagaattgtcaatatctaaggttgtaactgtcccatctgtaggctcatagtagttatccgatgatggagcaacgtttgcccagtcataagtttcccatgtaaccgtccccgaagcagagtaaactctcgtatcaacttgagtagattctgttatccccgatgtgtttcctgtgaggtctgccctgataaacgcatctccaggagaatccccgtcaaccgtccatgtgagggtttcagattgcccctcg

SEQ ID NO: 1321 - DNA, 4000 bp, Escherichia coli
  misc_feature (1)..(2): n is a, c, g, or t
  misc_feature (7)..(12): n is a, c, g, or t
  misc_feature (14)..(19): n is a, c, g, or t
  misc_feature (22)..(26): n is a, c, g, or t
  misc_feature (28)..(30): n is a, c, g, or t
  misc_feature (33)..(34): n is a, c, g, or t
  misc_feature (37)..(38): n is a, c, g, or t
  misc_feature (40)..(42): n is a, c, g, or t
  misc_feature (46)..(53): n is a, c, g, or t
  misc_feature (55)..(55): n is a, c, g, or t
  misc_feature (57)..(60): n is a, c, g, or t
  misc_feature (62)..(64): n is a, c, g, or t
  misc_feature (69)..(72): n is a, c, g, or t
  misc_feature (74)..(74): n is a, c, g, or t
  misc_feature (76)..(76): n is a, c, g, or t
  misc_feature (78)..(79): n is a, c, g, or t
  misc_feature (82)..(84): n is a, c, g, or t
  misc_feature (87)..(89): n is a, c, g, or t
  misc_feature (92)..(92): n is a, c, g, or t
  misc_feature (96)..(96): n is a, c, g, or t
  misc_feature (98)..(104): n is a, c, g, or t
  misc_feature (106)..(107): n is a, c, g, or t
  misc_feature (109)..(109): n is a, c, g, or t
  misc_feature (112)..(113): n is a, c, g, or t
  misc_feature (115)..(115): n is a, c, g, or t
  misc_feature (122)..(123): n is a, c, g, or t
  misc_feature (127)..(127): n is a, c, g, or t
  misc_feature (132)..(132): n is a, c, g, or t
  misc_feature (136)..(138): n is a, c, g, or t
  misc_feature (140)..(144): n is a, c, g, or t
  misc_feature (146)..(146): n is a, c, g, or t
  misc_feature (153)..(153): n is a, c, g, or t
  misc_feature (155)..(155): n is a, c, g, or t
  misc_feature (157)..(157): n is a, c, g, or t
  misc_feature (164)..(165): n is a, c, g, or t
  misc_feature (167)..(167): n is a, c, g, or t
  misc_feature (169)..(171): n is a, c, g, or t
  misc_feature (174)..(174): n is a, c, g, or t
  misc_feature (176)..(176): n is a, c, g, or t
  misc_feature (178)..(179): n is a, c, g, or t
  misc_feature (182)..(183): n is a, c, g, or t
  misc_feature (187)..(188): n is a, c, g, or t
  misc_feature (191)..(192): n is a, c, g, or t
  misc_feature (194)..(196): n is a, c, g, or t
  misc_feature (199)..(199): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (209)..(209): n is a, c, g, or t
  misc_feature (214)..(214): n is a, c, g, or t
  misc_feature (217)..(218): n is a, c, g, or t
  misc_feature (220)..(222): n is a, c, g, or t
  misc_feature (224)..(225): n is a, c, g, or t
  misc_feature (227)..(227): n is a, c, g, or t
  misc_feature (229)..(229): n is a, c, g, or t
  misc_feature (233)..(234): n is a, c, g, or t
  misc_feature (236)..(239): n is a, c, g, or t
  misc_feature (243)..(243): n is a, c, g, or t
  misc_feature (245)..(248): n is a, c, g, or t
  misc_feature (250)..(252): n is a, c, g, or t
  misc_feature (254)..(263): n is a, c, g, or t
  misc_feature (266)..(266): n is a, c, g, or t
  misc_feature (268)..(273): n is a, c, g, or t
  misc_feature (276)..(276): n is a, c, g, or t
  misc_feature (280)..(281): n is a, c, g, or t
  misc_feature (283)..(283): n is a, c, g, or t
  misc_feature (285)..(286): n is a, c, g, or t
  misc_feature (288)..(291): n is a, c, g, or t
  misc_feature (293)..(294): n is a, c, g, or t
  misc_feature (296)..(296): n is a, c, g, or t
  misc_feature (298)..(300): n is a, c, g, or t
  misc_feature (302)..(302): n is a, c, g, or t
  misc_feature (304)..(308): n is a, c, g, or t
  misc_feature (310)..(310): n is a, c, g, or t
  misc_feature (312)..(312): n is a, c, g, or t
  misc_feature (314)..(314): n is a, c, g, or t
  misc_feature (316)..(316): n is a, c, g, or t
  misc_feature (319)..(327): n is a, c, g, or t
  misc_feature (329)..(333): n is a, c, g, or t
  misc_feature (335)..(339): n is a, c, g, or t
  misc_feature (342)..(344): n is a, c, g, or t
  misc_feature (346)..(348): n is a, c, g, or t
  misc_feature (350)..(350): n is a, c, g, or t
  misc_feature (352)..(354): n is a, c, g, or t
  misc_feature (356)..(356): n is a, c, g, or t
  misc_feature (358)..(358): n is a, c, g, or t
  misc_feature (361)..(362): n is a, c, g, or t
  misc_feature (365)..(365): n is a, c, g, or t
  misc_feature (367)..(367): n is a, c, g, or t
  misc_feature (369)..(370): n is a, c, g, or t
  misc_feature (373)..(374): n is a, c, g, or t
  misc_feature (376)..(376): n is a, c, g, or t
  misc_feature (378)..(378): n is a, c, g, or t
  misc_feature (382)..(382): n is a, c, g, or t
  misc_feature (384)..(384): n is a, c, g, or t
  misc_feature (386)..(386): n is a, c, g, or t
  misc_feature (388)..(390): n is a, c, g, or t
  misc_feature (392)..(395): n is a, c, g, or t
  misc_feature (398)..(398): n is a, c, g, or t
  misc_feature (400)..(400): n is a, c, g, or t
  misc_feature (403)..(411): n is a, c, g, or t
  misc_feature (414)..(416): n is a, c, g, or t
  misc_feature (418)..(418): n is a, c, g, or t
  misc_feature (422)..(423): n is a, c, g, or t
  misc_feature (433)..(433): n is a, c, g, or t
  misc_feature (435)..(435): n is a, c, g, or t
  misc_feature (437)..(437): n is a, c, g, or t
  misc_feature (440)..(442): n is a, c, g, or t
  misc_feature (444)..(445): n is a, c, g, or t
  misc_feature (447)..(449): n is a, c, g, or t
  misc_feature (451)..(452): n is a, c, g, or t
  misc_feature (454)..(454): n is a, c, g, or t
  misc_feature (457)..(457): n is a, c, g, or t
  misc_feature (460)..(461): n is a, c, g, or t
  misc_feature (463)..(464): n is a, c, g, or t
  misc_feature (466)..(466): n is a, c, g, or t
  misc_feature (471)..(473): n is a, c, g, or t
  misc_feature (475)..(476): n is a, c, g, or t
  misc_feature (480)..(480): n is a, c, g, or t
  misc_feature (483)..(484): n is a, c, g, or t
  misc_feature (486)..(494): n is a, c, g, or t
  misc_feature (496)..(498): n is a, c, g, or t
  misc_feature (500)..(503): n is a, c, g, or t
  misc_feature (505)..(507): n is a, c, g, or t
  misc_feature (509)..(509): n is a, c, g, or t
  misc_feature (511)..(515): n is a, c, g, or t
  misc_feature (517)..(517): n is a, c, g, or t
  misc_feature (520)..(521): n is a, c, g, or t
  misc_feature (523)..(523): n is a, c, g, or t
  misc_feature (525)..(525): n is a, c, g, or t
  misc_feature (528)..(529): n is a, c, g, or t
  misc_feature (533)..(534): n is a, c, g, or t
  misc_feature (536)..(543): n is a, c, g, or t
  misc_feature (547)..(547): n is a, c, g, or t
  misc_feature (549)..(555): n is a, c, g, or t
  misc_feature (560)..(563): n is a, c, g, or t
  misc_feature (565)..(565): n is a, c, g, or t
  misc_feature (567)..(568): n is a, c, g, or t
  misc_feature (570)..(572): n is a, c, g, or t
  misc_feature (574)..(575): n is a, c, g, or t
  misc_feature (577)..(577): n is a, c, g, or t
  misc_feature (579)..(579): n is a, c, g, or t
  misc_feature (582)..(583): n is a, c, g, or t
  misc_feature (589)..(592): n is a, c, g, or t
  misc_feature (596)..(596): n is a, c, g, or t
  misc_feature (599)..(600): n is a, c, g, or t
  misc_feature (602)..(602): n is a, c, g, or t
  misc_feature (604)..(604): n is a, c, g, or t
  misc_feature (606)..(606): n is a, c, g, or t
  misc_feature (611)..(618): n is a, c, g, or t
  misc_feature (621)..(623): n is a, c, g, or t
  misc_feature (625)..(629): n is a, c, g, or t
  misc_feature (631)..(632): n is a, c, g, or t
  misc_feature (634)..(635): n is a, c, g, or t
  misc_feature (637)..(638): n is a, c, g, or t
  misc_feature (641)..(641): n is a, c, g, or t
  misc_feature (644)..(645): n is a, c, g, or t
  misc_feature (647)..(647): n is a, c, g, or t
  misc_feature (650)..(650): n is a, c, g, or t
  misc_feature (652)..(655): n is a, c, g, or t
  misc_feature (658)..(659): n is a, c, g, or t
  misc_feature (662)..(662): n is a, c, g, or t
  misc_feature (665)..(665): n is a, c, g, or t
  misc_feature (667)..(667): n is a, c, g, or t
  misc_feature (669)..(669): n is a, c, g, or t
  misc_feature (672)..(674): n is a, c, g, or t
  misc_feature (676)..(678): n is a, c, g, or t
  misc_feature (681)..(681): n is a, c, g, or t
  misc_feature (683)..(689): n is a, c, g, or t
  misc_feature (691)..(692): n is a, c, g, or t
  misc_feature (694)..(698): n is a, c, g, or t
  misc_feature (703)..(704): n is a, c, g, or t
  misc_feature (706)..(706): n is a, c, g, or t
  misc_feature (709)..(713): n is a, c, g, or t
  misc_feature (715)..(716): n is a, c, g, or t
  misc_feature (718)..(720): n is a, c, g, or t
  misc_feature (722)..(722): n is a, c, g, or t
  misc_feature (724)..(725): n is a, c, g, or t
  misc_feature (727)..(728): n is a, c, g, or t
  misc_feature (732)..(737): n is a, c, g, or t
  misc_feature (739)..(740): n is a, c, g, or t
  misc_feature (742)..(746): n is a, c, g, or t
  misc_feature (749)..(750): n is a, c, g, or t
  misc_feature (752)..(754): n is a, c, g, or t
  misc_feature (756)..(756): n is a, c, g, or t
  misc_feature (759)..(761): n is a, c, g, or t
  misc_feature (764)..(765): n is a, c, g, or t
  misc_feature (768)..(768): n is a, c, g, or t
  misc_feature (770)..(770): n is a, c, g, or t
  misc_feature (772)..(772): n is a, c, g, or t
  misc_feature (774)..(774): n is a, c, g, or t
  misc_feature (776)..(777): n is a, c, g, or t
  misc_feature (779)..(782): n is a, c, g, or t
  misc_feature (784)..(784): n is a, c, g, or t
  misc_feature (787)..(788): n is a, c, g, or t
  misc_feature (790)..(793): n is a, c, g, or t
  misc_feature (795)..(796): n is a, c, g, or t
  misc_feature (798)..(798): n is a, c, g, or t
  misc_feature (801)..(802): n is a, c, g, or t
  misc_feature (807)..(809): n is a, c, g, or t
  misc_feature (814)..(818): n is a, c, g, or t
  misc_feature (821)..(824): n is a, c, g, or t
  misc_feature (827)..(827): n is a, c, g, or t
  misc_feature (830)..(830): n is a, c, g, or t
  misc_feature (833)..(836): n is a, c, g, or t
  misc_feature (839)..(841): n is a, c, g, or t
  misc_feature (844)..(846): n is a, c, g, or t
  misc_feature (849)..(850): n is a, c, g, or t
  misc_feature (852)..(853): n is a, c, g, or t
  misc_feature (855)..(855): n is a, c, g, or t
  misc_feature (857)..(857): n is a, c, g, or t
  misc_feature (859)..(859): n is a, c, g, or t
  misc_feature (862)..(862): n is a, c, g, or t
  misc_feature (866)..(866): n is a, c, g, or t
  misc_feature (873)..(873): n is a, c, g, or t
  misc_feature (876)..(878): n is a, c, g, or t
  misc_feature (881)..(881): n is a, c, g, or t
  misc_feature (883)..(883): n is a, c, g, or t
  misc_feature (886)..(888): n is a, c, g, or t
  misc_feature (893)..(894): n is a, c, g, or t
  misc_feature (898)..(899): n is a, c, g, or t
  misc_feature (902)..(905): n is a, c, g, or t
  misc_feature (908)..(908): n is a, c, g, or t
  misc_feature (910)..(910): n is a, c, g, or t
  misc_feature (912)..(912): n is a, c, g, or t
  misc_feature (914)..(917): n is a, c, g, or t
  misc_feature (919)..(921): n is a, c, g, or t
  misc_feature (925)..(925): n is a, c, g, or t
  misc_feature (927)..(928): n is a, c, g, or t
  misc_feature (930)..(930): n is a, c, g, or t
  misc_feature (933)..(934): n is a, c, g, or t
  misc_feature (936)..(938): n is a, c, g, or t
  misc_feature (940)..(942): n is a, c, g, or t
  misc_feature (947)..(948): n is a, c, g, or t
  misc_feature (951)..(951): n is a, c, g, or t
  misc_feature (954)..(955): n is a, c, g, or t
  misc_feature (959)..(960): n is a, c, g, or t
  misc_feature (963)..(963): n is a, c, g, or t
  misc_feature (965)..(966): n is a, c, g, or t
  misc_feature (970)..(970): n is a, c, g, or t
  misc_feature (972)..(976): n is a, c, g, or t
  misc_feature (978)..(979): n is a, c, g, or t
  misc_feature (981)..(982): n is a, c, g, or t
  misc_feature (984)..(987): n is a, c, g, or t
  misc_feature (989)..(989): n is a, c, g, or t
  misc_feature (992)..(993): n is a, c, g, or t
  misc_feature (995)..(997): n is a, c, g, or t
  misc_feature (999)..(1000): n is a, c, g, or t
  misc_feature (1003)..(1004): n is a, c, g, or t
  misc_feature (1006)..(1006): n is a, c, g, or t
  misc_feature (1010)..(1010): n is a, c, g, or t
  misc_feature (1013)..(1013): n is a, c, g, or t
  misc_feature (1015)..(1019): n is a, c, g, or t
  misc_feature (1027)..(1028): n is a, c, g, or t
  misc_feature (1032)..(1032): n is a, c, g, or t
  misc_feature (1296)..(1298): n is a, c, g, or t
  misc_feature (1977)..(1977): n is a, c, g, or t
  misc_feature (1986)..(1986): n is a, c, g, or t
  misc_feature (2204)..(2204): n is a, c, g, or t
  misc_feature (3027)..(3027): n is a, c, g, or t
  misc_feature (3071)..(3071): n is a, c, g, or t
  misc_feature (3074)..(3075): n is a, c, g, or t
  misc_feature (3079)..(3081): n is a, c, g, or t
  misc_feature (3083)..(3085): n is a, c, g, or t
  misc_feature (3087)..(3087): n is a, c, g, or t
  misc_feature (3346)..(3347): n is a, c, g, or t
  misc_feature (3349)..(3354): n is a, c, g, or t
  misc_feature (3357)..(3357): n is a, c, g, or t
  misc_feature (3359)..(3359): n is a, c, g, or t
  misc_feature (3361)..(3363): n is a, c, g, or t
  misc_feature (3365)..(3365): n is a, c, g, or t
  misc_feature (3369)..(3369): n is a, c, g, or t
  misc_feature (3371)..(3374): n is a, c, g, or t
  misc_feature (3376)..(3377): n is a, c, g, or t
  misc_feature (3379)..(3382): n is a, c, g, or t
  misc_feature (3384)..(3385): n is a, c, g, or t
  misc_feature (3387)..(3389): n is a, c, g, or t
  misc_feature (3392)..(3392): n is a, c, g, or t
  misc_feature (3395)..(3397): n is a, c, g, or t
  misc_feature (3473)..(4000): n is a, c, g, or t
nnaggannnnnngnnnnnnccnnnnnannnccnnggnntnnncgcnnnnnnnnangnnnncnnnggggnnnncntngnncannncgnnnacnccgncnnnnnnncnncnccnntnccgcggnngttnggcgngcgnnngnnnnncnacggctngntngggcccnncntnnncgncnannagnngccnnggnncnnncancnggncancnacctnccnngnnncnngnangccnngnnnnaccncnnnnannncnnnnnnnnnnccncnnnnnnccnccgnntngnngnnnncnncntnnngnannnnntntngnanggnnnnnnnnngnnnnngnnnnncgnnngnnngnannncntnggnnacnancnngcnncntncttncngnannncnnnngcnanccnnnnnnnnnccnnngngagnncggcttgggngnanctnnngnngnnnanntnccngcnnanntncggcnnncnntcgnggnncnnnnnnnnntnnngnnnncnnncngnnnnncnccnntngngcnncgcnngnnnnnnnngcgngnnnnnnncgtcnnnnangnngnnncnncngnggnngggctnnnngggngcnngntngncgccnnnnnnnngcnnncnnnnngnnanntnnttngcnncnacntnnnnccnnccnccngncnccnnncnnnggncnnnnnnngnncnnnnnccgcnnangannnnntnntnnngntnnanntgcnnnnnntnnannnnngcnngnnngnggnnnccnngcncntncncnngnnnntnganntnnnntnngncgnntcggnnncgaannnnnaannnnggnggnggnnnngcnnnggnnnggnntnngncngnggngggnggggggnggnnnggngnggnnnggganngaannggnnnnggntngntnnnngnnngagnanntnccnncnnngnnncggcnncgnggnnccgnngcngnncggnannnnnanngnntnnnngncgnntnnncnnggnngncgcncgngnnnnnggcgcttnntctncggagtcggcgccggcggcggcggttccgaggaaacggcgcgggcgcatccaggcgggggcgcggttcggcgacgaagggaggggacacgcacccaggcggtgttttcctttggctttcttgcccatctcgctcggtgaacgcgcggagaccccggcgcgacagccgcgtgcgcggacggacagtggcggcaccaaagccgccgccgcgcctgaagcggcgagcgctccagcgccgaaaaaaaatagcagactgtttgcgcgcnnngatgaaatgcctccgtcgtccgtacgagacgggaaaatcgatgcttccgagagcggcggttcgcttcgtgaagcgagtctcggacgacgcgcctcctcggcggtaccgagagagaggatagcgtcgagcgtcgagaagtcgtcgcggccacacccgaccacgcgcgaaccctcttttcgccccctccactcttcacctccgcctccgcggcgccctccacgcgcgcgtcaccatgccctgtctcccccgcgcgccccttcgcctcgcgctcctgcctctctcctgcctgctctcgctgttcctcgccaggagcgtctccgcggtcccgagcgccaccgggcacctcatcgcggatgcgctcgccgagctccccgacgggctcgggcgcgagatccaggccgtgatgacatccatgaacatgaccgagcgagacacgcacttctcccgcctcgtcgcgtacgacgtcgcggaggtgaaccagagcctggcgttggtcacgttcccgacccccgagaacgggttcgagatgagctacgtgggcatgacgcacgacttggaccccgacgggacgtacgtcgcggtcgtgtgcggccacacccggccgagcgcgtgcgcgggtgaaaacccgcacgtcgccgcgcccggcgaccacccgtgcggcgtcgacgacgccgcgaanccggccacngggccgttttgcgagccgctcgctttatcccacccgagcaccgagcacggcgagctgctcgtgcacgcgtccgaggtgctggactcggtgaaagccgcgtgggaggcggacaaacggaactacgaaaaccccacgctgcacctggagatcgtggacgcggagacgttcgcggacctcatggacgtcgacgacgccggcgacgtcgacgcgctggaganggcgctggagggagacgcgtcgtctcccgctgcctctcccgatggcacgtcacaacgttacagggacgagcccggaaaccgtaagcggctccgcgcgctgctccgcctcggcggcggcatcggcggcgtgcgcggcgcgggcatgcgcgccggcgtcggcggcgtcggccggttcggcggcgcgggcggcatcggccgcggcgccggcttcagacgcggacgcaacatggcggtgaaccaggtgatggccgccaacttctacgggaaccgggggcgcgcgatcggcgccgggcaggcggcgtacttcaacgacccggggatcccgggggggaagtaggcagaacgcgcgaagggcgccggagagaggcgcgccgccagagagacgcgtcgaacgctttatcgatacagaagagactccgacttagacttttgtgggaaaaagacccaacttctgccagtctgccagttcgtgattcgtgaaatcgcgcgcgagattttctcaggcgagctcgcgcggattcggatagcgcttcgtactccacgcggcgcggcgcggggcgcccacggcgaagcccccgcgcccgagccgagcagtcgcgaaggggtgccatgtcgagtgcggcggcgagcgcgcgcggccacgcgacgtgtccatgctgccaggtctgtctccgcgcccccccgacttcgtggtggttcaaacattttcccgggaaaaacgagacggcggacgtgtccgtttccctcgggacgctcccccggtcccccgccactggccgacgagccccgacgagcctcggagtgcctcccgtgcctccccgancgcgcacgcgtggacgcgcccggaacccccgagaccgccgtcgncgnncgcnnncnnncngcgcacccctcgatccgcgacgcgcgcttttctcggcgtaccggaaatcgctgaccaaactgacgttccaaacgcgttccaaacgcgcctcgctccccgtaccccgtgccgatacgccgatacgccgcgcagagccccgaccgcccgctggtgtgcgcgccatgcaccgcgaccgcgctccgcgcgcgccggtggacgctcgagcggctccgcggcgcgcacgagcgcgcgcgcgccgacgtggcgagcgcgctgagcnngnnnnnngangngnnnanaaanannnntnntnnnncnncnnncgncgnnncgcagtccgcagtccgcgcgacgccgtccgcagtccgcagtccgcagtccgactgcgttgacgcgcgacggtcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1322 - DNA, 4000 bp, Escherichia coli
  misc_feature (1548)..(1548): n is a, c, g, or t
  misc_feature (3093)..(3093): n is a, c, g, or t
  misc_feature (3108)..(3108): n is a, c, g, or t
  misc_feature (3134)..(3134): n is a, c, g, or t
  misc_feature (3255)..(3255): n is a, c, g, or t
  misc_feature (3274)..(3274): n is a, c, g, or t
  misc_feature (3280)..(3280): n is a, c, g, or t
  misc_feature (3285)..(3285): n is a, c, g, or t
tgcacttcagtattcatgaaaaatatgcgccatacctgaatagcgacaaagacggtaagcatggtgtcttccaagccgtattaacaagcttaggtaaatttacccagcaacaatacctgcctagatggagaagtacagatcaagaaggtttacatcaacttgctaatggcgaagtagatttcatcatcgacccacccgctatcgatgatcaagcattgaaatttggatcactctctgaggccattttttggggtcacgatgccgtgatcgccaaagccgcaaatggcactaccattgaccaggaaaaaattgcttactttgatcgagggtttgagagctcgccgagtagcgccaatcatctggcgagcatttcaagttacccagaacaactcatcttagacctactgaagaatgatattgaagccctagtgatgccgctgcgcttggcgcaacaactcatcaagcaatttggtaatgagggccttcaaatagatgggctatacgggcgagaaccctttgcatatcgctggctgatttcccatgaagacgcgcccttacattcggtcttagatcgttttatgactgggctagatccgattgagtcacgccaactctttgctttagatacaagcccggtcaccctaacttcacattactggaaaacagcactcccttggagcctgagtatggctctcttgattggcgggggattgttcatttggcagttacaaataaaacgttacaaacaagaacaagaaactgccgacctcatcagctcaaaagaagttgctgaaaaagccaatgcggccaagtctgcctttcttgccaccatgagtcatgaaattcgtacgcccatgaatgccattctgggtgtgcaagagttactgctcaatagtcataagctaccgcctagcgaaaaaccgcttctgaagagcgcccatgcatctgcagagtcactcttgggcatgctaaatcaagtcttagacctctccaagatagaggctggaaaactcacgctgaatctagagccctactgcctcaaagatttagtggatgatattcactcaaccttctctacggttgcgaccaaacaaaaattactactgcacacctcaatcgatccacgggttgctagagtactcatgattgaccctttgagactcaggcagatcctacaaaacctcttaagcaacgcgattaaattcactgatcatggtgcgatctatttttccatcaccgttctagcagatgatcatgctgggcaattgattgagtttagggtgattgatacgggcattggcatgggtaaagaagaaattactcgcgcacttgaagcctttgagcaagttcccaaacggatggatatgggtgaacagcaagccggtactgggcttggtctcaccattactaaacacctcattgactccatgaacagttacctctactttgatagcgatcctggatttggaagcaatgtgcatttttgcgttgcctttccccgtactagcatggccgcattgcgcacgaacttatctgacaacaattcanccaagaagcatcttgctaaaaaacaatccggcaataaagaaaatccaaaaggaacactaaaggctctcgtggtggaggatcaccccgcaagccgtcaaatcctttctttgcaactcgaggcactcggcatccaagtatgggtttgcgagagtgcagatgatgcattggcgttggtgcgagaacatcgttttgatctcatgctgacagaccaatcgatgccaggtatgcaaggatccgatttagcaaaagcagtgcgcgccatgggtcatcgagagctcattattattggcgtgactgcagatatttatgccctagattctcgccatcaatttttatctgccggtatgaacggggtactgataaaaccgcttagcctcagcgcccttgagaatgagctcacccgttactttgctgtggttgatgctgatgcacaaaggaccgtaagagaagattttgaatattcgttcgaggcattctccaatcttttaaaagataatcctgaacatatttcgtttatcttggatgagattcgaaaagtccatgatgacatcttgattgaacttgcagagattactgaaaacaatgggcttacagagagtcaattcagggccatggtgcataaggttaagggtggcgcccaactactcagcgccaaggctttcaccgagcaatgtcagaagctcgaactcgatgggccgctccaagaaagagcgcgcctctttactaaactactggagcaagaaaaccaagtcattaaacgctatcaaggcaaatacggtggataggaattggtagagggtttatcctttgagggtgagagcccaataccgccaccgtctattcctactattttgtgcaagcacaatattgctagtcgttggcttggctcatgccgcagatttagtctctcaagaaactgcctttcaatacatccccaaagcggttgcaagcagtctagaaaaaagccaaatcccccaagatgccattagcatctccgtcacggaaattgggcaagctcaccaaggcaaagaaatacagtatttctctaggactgctctggactggcgctccaccgaagccatgaaccctgcttcaactatgaagctagtgacaactcttgctggcttggatgttttaggtccacagtatcgctggcgcaccaagctctttactgatggggctattcgtcaaggcgttttaaaaggcaatttgtatcttcagggcagtggtgatccaaagcttatccctgaagagctcgcgcggatgatgaaagatctgcaaggtttaggaatccagaagattgatggcaacctcatcttcgatcgaagcgcctatgctcctagcgtcatggagcaaaacaccattgatggcgaagcacttcgcgcctacaacgttactccagatcccctcctctatgcctttcggaccatatcgtttcagatgggcaaatcccgtaccgctgactttatagatattaattacacccctgcgcttgctaatttcaagattaataatgagatgcagctcgttgatcgctcttgtgantcatggaagaaaganatacgctttgagatcaatcctgaaantggtagcgcatcccccaatcaaagtattagcgcttcattttctggggcatttccaaatggatgcaaaggggtcgcttataacgtcgttgccttagatgccaacacattcttaacccggggntttattgccgcctgggagntagctngtggnacttgggcgcaaactccaacaggcagcaatggcatcgtgccaatcaccgctagaccactcctgcaatttgaaggcattagcttagctgatgacgtacaagatattaataagtattcaaacaatgtcatggctaggcaattgatgctgaccttagccctggaaaaaatgggtaagcctgcgaccacagaaaatggtgaactagtgattcaggggtggctcaaaaaaatgggcttgcagtttccagaactcgtgattgagaacggctccgggctatcgcgtaatgaagctatctcggcgcagcatatgaatgagctcctggtcaccgctcgtaagctcgccgttgctgaggcgttttataacagcttacccttagcaggatcggacggaactatgcgtaatcgccttatgactcagctacgaaagtttttacaccttaagaaaaaacctgaagccagaattaaaacaggctcactctccgatgtgcgagcgatctcaggttatgtgattagcaaatctggaaaaatgtacgccgtcacttcattcatcaaccaccccaatgcctggagaggcttagaagcgcacgatcaattactagcgtggttgctggaagatggtcctgagccaaaacaggcccgctgaagtcgatctctcaccccatcccactcttcaccagcaggtggctctgggaacaaaagcaaatcccagccctgttgat

SEQ ID NO: 1323 - DNA, 4000 bp, Escherichia coli
  misc_feature (98)..(98): n is a, c, g, or t
  misc_feature (278)..(278): n is a, c, g, or t
  misc_feature (1549)..(1549): n is a, c, g, or t
  misc_feature (1555)..(1555): n is a, c, g, or t
  misc_feature (1657)..(1657): n is a, c, g, or t
  misc_feature (1985)..(1985): n is a, c, g, or t
  misc_feature (1991)..(1991): n is a, c, g, or t
  misc_feature (2631)..(2631): n is a, c, g, or t
  misc_feature (2681)..(2681): n is a, c, g, or t
  misc_feature (2981)..(2982): n is a, c, g, or t
  misc_feature (3260)..(3260): n is a, c, g, or t
  misc_feature (3326)..(3326): n is a, c, g, or t
  misc_feature (3438)..(3438): n is a, c, g, or t
  misc_feature (3545)..(3545): n is a, c, g, or t
  misc_feature (3564)..(3564): n is a, c, g, or t
  misc_feature (3683)..(3683): n is a, c, g, or t
  misc_feature (3828)..(3828): n is a, c, g, or t
  misc_feature (3832)..(3832): n is a, c, g, or t
  misc_feature (3835)..(3836): n is a, c, g, or t
  misc_feature (3838)..(3839): n is a, c, g, or t
  misc_feature (3846)..(3846): n is a, c, g, or t
  misc_feature (3860)..(3860): n is a, c, g, or t
  misc_feature (3903)..(3903): n is a, c, g, or t
  misc_feature (3917)..(3917): n is a, c, g, or t
  misc_feature (3968)..(3968): n is a, c, g, or t
aaaatgtggcagaatatgatgagtctttattagagaaattctttgaagatccagattctatcacagaagaagaaatcaatgaagctttaagaaaagcnactattgatttgtctattatcccaatgacttgtggttcttcatttaagaacaaaggagttcagtttatgttggatgctgtatgtaaataccttccatctccactagataaagatgatatcaaaggaactgaccctaaaactgatgctgaaatcacaagaaaaccagatgtaaatgagccntttgctgcattagcatttaagattgctactgacccttatgtaggtagattggcattctttagagcttattctggtaaattggatgcaggttcttatgtattgaacacaagatctgattctaaagaaagaatctcaagaatctatcagatgcacgcgaataagcaaaaccctgtagagtacattgaagcaggagatatcggtgcagctgtaggatttaaagatatcaaaactggggatacactttgtgatgaaaagaaccctatcgttcttgaatctatgattttcccagatccagtaatcggtatcgctgttgaacctaaaactaaagctgaccaagataaaatgggtaacgctttagcgaagttagcagaagaggatcctactttccaagtgaaaacagatgaagcatctggacaaactatcatctcaggaatgggagagcttcacttggatatcatcgtagaccgtctaagaagagagttcaaggtagaagtaaaccaaggacagccgcaagtagagtacaaagaatctcttacagctacagctaaccacagagaagtttacaaaaaacaaactgggggtagaggtaaattcgcggatatcatcttcgaaattggtcctgctgatgaaggaaaaacaggtcttgaattcatcaacgaaattaaaggtggtaacattccaaaagaatttatcccttctgttgaaaaaggattcaaagaagctatgaaaaatggtcctttggctggattcgagattgaaggaattaaagttacactaaaagatggttctttccacccagtggactctgaccaactttcattcgaattggctgctaaacttggatttagagaagctggtaaagctgctaaaccagtaatcatggagcctatcatgaaattggaagttgttactccagaagaatacatgggggatatcgtaggtgaccttaacagaagaagaggtactgtaaacggtatggatgatagaaataatgctaaagttatcaaagcatttgttccattagcagaaatgtttggatatgtaacagctcttagaacattatcttctggtagagcaacatcttctatggagtttgaaaaatatgaaccagctccacagaatgtggctgaagaagtaatagctaaagcaagaggttaattaaaatttagattaaaatgtcacaaagaatcagaataaaattaaaatcttacgattacaatttagtagataaatctgctgagaaaatcgtaaaaacagtaaaatctacaggngctgtngtaaatggaccaatcccattacctactcacaagagaatctttactgtgcttagatctccgcatgttaataaaaaagcaagagaacagttccagctttctgcncacaagagattgatggatatctactcttcttcttctaagactgtagatgctcttatgaagttagaattaccaagcggtgtagatgtagaaatcaaagtttgataaaacaatgtatttatacattttgctatgataaaaatcctttcctaagaaattgggaaaggattttcgttatttgaaatacttttgatattattgcagaataaattttagtatgggaaatcaaattagtaacaacaaaatcagacagataatcctgctggggatgattttcggatttttgtttttgataggatttaatttaagtaattttttgccatcatttctnggtgcngttacactttatgttattttccgcgattattattttaagcttacggaggagagaaaatggaaaccttggctggcgattggtttcttgatgttgctttctctattggtcattattgttccgttttattacatcgcagaaacattggtggtaaagctggcaaattcccgagaatatatagagatagccatagagaatgccaatcaaatccatcaatatataaaggataagacaggctatgacatcataaattccattgatataaaaaaagtaggtgagtgggcgacggtttacacctcatctttgctgaatactacggtggaggtggttactacgattgtgacggcttttttcattttgtattttatgctgatcaattcgcgagcgatggaaagagctttggagaaggctgttccgctgaaaaaatctaatatcaataagataggcgagcgtttccgaaaacttatcattgccaatgtggtgggaattcctgtggtagccattgggcaggggcttacggttttgataggctatcttatttttggggtttctagtccgtttttcttatttattttgacggctatggcatcgcttatccctattgtaggaggggcgattgtctatgttccagtgtcacttgtgntgctggtgaaccaagacccagtgggagcggcgggcgttctgttctttggnttcctttctgcgggagtggataatatcctgagattcacatttttaaagagaatagaaaacatccatccgctgaactctgtatttgggattattttaggattgaaggtttttggctttattgggctgatttttgggccgatattgatttccattacagtgctgctgattcaggtttatcatgatgaattttctgaaaatgacaaaaaagaggaaaatgacacggatgagaccgaagaaatttctgaaaatatacccttgtaaaggggctaaaataggcgtgtttagaaaattaacattttnngaagtaaaattttaatgaattgttaattttagttaaaaaaataaccgtaaatttgcgatatttaaaatttagaaaaccaaaaaatttttatgaagacaaactttttaaggagatctgcgatagcagcattgactttaacaacagcaagtttttattttgcacaagaggaaaaacaagactcagaaaagagcattgatgaagtagttcttgtgggggtagcggacatcgctaaagacagaaaaactccagtagcggtttctactgtaaaatctgctcanatcatcgagagattaggaaaccaagaaatgacggaagttcttaacactacaccatctgtgtacgcnactaagtctggtggtggtttcggagatggaggtatcacaatgcgtggtttcgaatctagaaacatcgctgtgatggtaaatggtatgccagtgaacgatatggaaggagggnctgtgtacttttctaactggacaggtctttctgatgttacaagtactatccaagttcagagaggtttaggttcttctaaattagcaattgcgtctgtagggggaacnatgaacttcattactcgtncagcagacatgaaaaaaggaggtgttgtaagaataggagtagcgaataacgactatcacaaagcatctttctcatacaatacaggtaaatctaaaagcggttggtctacatctatcttnatgagtagaacagctggttcttattatgtacaaaatactgatttcgaagcttatgcatactatttcgctttaggatttgagccaaataaaaaacataacttccagtttactataacaacttctcctcagtggcacgaccaaagangttntannannaaaatanaagattatataaantataatccagatcatgatggaaatccatacagacagtataacncagattatggatantatacagatgcagcaggaagaagaatagcattgtctaacaaatctaacttntactcaaaaccagtaatgatgttcaactggga

SEQ ID NO: 1324 - DNA, 4000 bp, Escherichia coli
  misc_feature (1)..(7): n is a, c, g, or t
  misc_feature (10)..(12): n is a, c, g, or t
  misc_feature (14)..(14): n is a, c, g, or t
  misc_feature (19)..(22): n is a, c, g, or t
  misc_feature (26)..(27): n is a, c, g, or t
  misc_feature (31)..(37): n is a, c, g, or t
  misc_feature (41)..(42): n is a, c, g, or t
  misc_feature (44)..(45): n is a, c, g, or t
  misc_feature (52)..(54): n is a, c, g, or t
  misc_feature (56)..(57): n is a, c, g, or t
  misc_feature (59)..(64): n is a, c, g, or t
  misc_feature (66)..(75): n is a, c, g, or t
  misc_feature (77)..(79): n is a, c, g, or t
  misc_feature (84)..(85): n is a, c, g, or t
  misc_feature (89)..(93): n is a, c, g, or t
  misc_feature (97)..(102): n is a, c, g, or t
  misc_feature (104)..(105): n is a, c, g, or t
  misc_feature (108)..(112): n is a, c, g, or t
  misc_feature (114)..(116): n is a, c, g, or t
  misc_feature (118)..(120): n is a, c, g, or t
  misc_feature (123)..(124): n is a, c, g, or t
  misc_feature (126)..(126): n is a, c, g, or t
  misc_feature (131)..(131): n is a, c, g, or t
  misc_feature (134)..(135): n is a, c, g, or t
  misc_feature (138)..(138): n is a, c, g, or t
  misc_feature (140)..(142): n is a, c, g, or t
  misc_feature (144)..(144): n is a, c, g, or t
  misc_feature (146)..(147): n is a, c, g, or t
  misc_feature (149)..(151): n is a, c, g, or t
  misc_feature (153)..(153): n is a, c, g, or t
  misc_feature (155)..(155): n is a, c, g, or t
  misc_feature (157)..(157): n is a, c, g, or t
  misc_feature (159)..(159): n is a, c, g, or t
  misc_feature (161)..(161): n is a, c, g, or t
  misc_feature (163)..(163): n is a, c, g, or t
  misc_feature (165)..(168): n is a, c, g, or t
  misc_feature (170)..(171): n is a, c, g, or t
  misc_feature (173)..(173): n is a, c, g, or t
  misc_feature (177)..(178): n is a, c, g, or t
  misc_feature (181)..(184): n is a, c, g, or t
  misc_feature (186)..(186): n is a, c, g, or t
  misc_feature (188)..(188): n is a, c, g, or t
  misc_feature (190)..(193): n is a, c, g, or t
  misc_feature (195)..(196): n is a, c, g, or t
  misc_feature (198)..(198): n is a, c, g, or t
  misc_feature (200)..(201): n is a, c, g, or t
  misc_feature (203)..(206): n is a, c, g, or t
  misc_feature (208)..(208): n is a, c, g, or t
  misc_feature (212)..(215): n is a, c, g, or t
  misc_feature (218)..(221): n is a, c, g, or t
  misc_feature (223)..(223): n is a, c, g, or t
  misc_feature (227)..(229): n is a, c, g, or t
  misc_feature (231)..(231): n is a, c, g, or t
  misc_feature (233)..(233): n is a, c, g, or t
  misc_feature (235)..(236): n is a, c, g, or t
  misc_feature (239)..(242): n is a, c, g, or t
  misc_feature (248)..(250): n is a, c, g, or t
  misc_feature (253)..(255): n is a, c, g, or t
  misc_feature (257)..(266): n is a, c, g, or t
  misc_feature (269)..(270): n is a, c, g, or t
  misc_feature (273)..(273): n is a, c, g, or t
  misc_feature (275)..(277): n is a, c, g, or t
  misc_feature (280)..(280): n is a, c, g, or t
  misc_feature (282)..(290): n is a, c, g, or t
  misc_feature (294)..(297): n is a, c, g, or t
  misc_feature (299)..(303): n is a, c, g, or t
  misc_feature (305)..(308): n is a, c, g, or t
  misc_feature (311)..(312): n is a, c, g, or t
  misc_feature (314)..(318): n is a, c, g, or t
  misc_feature (320)..(321): n is a, c, g, or t
  misc_feature (323)..(334): n is a, c, g, or t
  misc_feature (336)..(338): n is a, c, g, or t
  misc_feature (340)..(343): n is a, c, g, or t
  misc_feature (348)..(351): n is a, c, g, or t
  misc_feature (353)..(355): n is a, c, g, or t
  misc_feature (361)..(361): n is a, c, g, or t
  misc_feature (364)..(365): n is a, c, g, or t
  misc_feature (367)..(368): n is a, c, g, or t
  misc_feature (370)..(384): n is a, c, g, or t
  misc_feature (387)..(388): n is a, c, g, or t
  misc_feature (392)..(398): n is a, c, g, or t
  misc_feature (402)..(406): n is a, c, g, or t
  misc_feature (408)..(408): n is a, c, g, or t
  misc_feature (410)..(414): n is a, c, g, or t
  misc_feature (416)..(417): n is a, c, g, or t
  misc_feature (419)..(420): n is a, c, g, or t
  misc_feature (425)..(428): n is a, c, g, or t
  misc_feature (431)..(433): n is a, c, g, or t
  misc_feature (436)..(437): n is a, c, g, or t
  misc_feature (440)..(445): n is a, c, g, or t
  misc_feature (447)..(448): n is a, c, g, or t
  misc_feature (450)..(453): n is a, c, g, or t
  misc_feature (456)..(460): n is a, c, g, or t
  misc_feature (466)..(473): n is a, c, g, or t
  misc_feature (475)..(477): n is a, c, g, or t
  misc_feature (479)..(479): n is a, c, g, or t
  misc_feature (481)..(486): n is a, c, g, or t
  misc_feature (488)..(489): n is a, c, g, or t
  misc_feature (491)..(491): n is a, c, g, or t
  misc_feature (494)..(494): n is a, c, g, or t
  misc_feature (496)..(498): n is a, c, g, or t
  misc_feature (500)..(501): n is a, c, g, or t
  misc_feature (504)..(504): n is a, c, g, or t
  misc_feature (506)..(514): n is a, c, g, or t
  misc_feature (516)..(519): n is a, c, g, or t
  misc_feature (522)..(523): n is a, c, g, or t
  misc_feature (527)..(532): n is a, c, g, or t
  misc_feature (536)..(539): n is a, c, g, or t
  misc_feature (541)..(541): n is a, c, g, or t
  misc_feature (544)..(550): n is a, c, g, or t
  misc_feature (552)..(553): n is a, c, g, or t
  misc_feature (555)..(560): n is a, c, g, or t
  misc_feature (562)..(563): n is a, c, g, or t
  misc_feature (565)..(571): n is a, c, g, or t
  misc_feature (573)..(574): n is a, c, g, or t
  misc_feature (576)..(576): n is a, c, g, or t
  misc_feature (581)..(583): n is a, c, g, or t
  misc_feature (585)..(585): n is a, c, g, or t
  misc_feature (591)..(595): n is a, c, g, or t
  misc_feature (600)..(605): n is a, c, g, or t
  misc_feature (614)..(619): n is a, c, g, or t
  misc_feature (621)..(623): n is a, c, g, or t
  misc_feature (628)..(634): n is a, c, g, or t
  misc_feature (640)..(640): n is a, c, g, or t
  misc_feature (647)..(647): n is a, c, g, or t
  misc_feature (650)..(651): n is a, c, g, or t
  misc_feature (660)..(663): n is a, c, g, or t
  misc_feature (681)..(681): n is a, c, g, or t
  misc_feature (707)..(707): n is a, c, g, or t
  misc_feature (724)..(724): n is a, c, g, or t
  misc_feature (766)..(766): n is a, c, g, or t
  misc_feature (797)..(797): n is a, c, g, or t
  misc_feature (1084)..(1084): n is a, c, g, or t
  misc_feature (1108)..(1108): n is a, c, g, or t
  misc_feature (1114)..(1114): n is a, c, g, or t
  misc_feature (1140)..(1140): n is a, c, g, or t
  misc_feature (1147)..(1147): n is a, c, g, or t
  misc_feature (1150)..(1150): n is a, c, g, or t
  misc_feature (1231)..(1231): n is a, c, g, or t
  misc_feature (3723)..(3723): n is a, c, g, or t
  misc_feature (3779)..(3779): n is a, c, g, or t
  misc_feature (3846)..(3846): n is a, c, g, or t
  misc_feature (3869)..(3869): n is a, c, g, or t
  misc_feature (3877)..(3877): n is a, c, g, or t
  misc_feature (3881)..(3881): n is a, c, g, or t
  misc_feature (3896)..(3896): n is a, c, g, or t
  misc_feature (3899)..(3899): n is a, c, g, or t
  misc_feature (3902)..(3902): n is a, c, g, or t
  misc_feature (3905)..(3905): n is a, c, g, or t
  misc_feature (3910)..(3911): n is a, c, g, or t
  misc_feature (3914)..(3914): n is a, c, g, or t
  misc_feature (3920)..(3920): n is a, c, g, or t
  misc_feature (3937)..(3937): n is a, c, g, or t
  misc_feature (3941)..(3941): n is a, c, g, or t
  misc_feature (3962)..(3962): n is a, c, g, or t
nnnnnnnaannnanttttnnnngggnntttnnnnnnngggnntnnttttttnnngnngnnnnnntnnnnnnnnnngnnnccccnnaaannnnntttnnnnnncnnaannnnngnnnannnaannanttttnaannaantnnntnannannntnantnantngnannnntnnantttnnttnnnntngntnnnnannancnntnnnntnaaannnnttnnnntngggnnntncnannaannnntttttnnnaannncnnnnnnnnnnccnnttncnnnaangnnnnnnnnnaaannnnannnnnannnnccnntnnnnnannannnnnnnnnnnntnnngnnnnttttnnnntnnntttttnaanntnntnnnnnnnnnnnnnnnttnnaaannnnnnnaaannnnnancnnnnntnntnnttttnnnnttnnnttnnttnnnnnnannannnnaannnnntttttnnnnnnnncnnncntnnnnnntnnanttnannntnnttngnnnnnnnnngnnnnaanncccnnnnnntttnnnnanttnnnnnnngnnannnnnntnntnnnnnnnannanttttnnnantttttnnnnnaaaannnnnnaaatttttnnnnnncnnnaattnnnnnnnaatttntttaaanaannttaaatttnnnntaaattatgcaaaaaatntcttattaaaataattctaatctttntgttaatgttaaacttnatttcccaattaataaaaaaggagaaagtagtgaaaaaaatnattacgttatttacctgtttttttcttgtantaggtttcacgcagacttcatctgcagaatctgatacattaaaaaaacttaagaaacaaggttacgcaacagttgctgttgccaatgaacctccctatagtgatatcaaatctgatggatatgttactggagcggcgccagatgttgcacgcgctgtgcttgcagtcctgggtgttccagaacttaaagctgaagttattatgtacggtgctatgattccagcgcttcaagcaagaagagttgatatggcaacttctggtctttatattaagcctggtagatgtgantctattatttattctgagcctganctttgnggtgcagaggcgtttgcggttccagntggcaanccnaacaacctactaacttatgaagacattgcagctaatcctgcattaaaaatgactacttgtgctggttgtgctgaagagaantatgctttagagcgcggtgtaagtgctgatcaaattatttattttgatgcacctccaagtggtataaaaatgcttcaacaaggtagagttgatgtatttgctctatctggtttaggtacagcagatcttcttaacaagactaatgatccaaaccttgaattaatcatgccagttactggtgttccaatgggttgtgctggtgcagcatttaacaaggatgatttagagtttagatctgaatacaatatggctttggctatgttgaaagctactggtgaatttgcagctataattgagccttatggtttctctgcagaagcaactgctagtaaatcctacttgacacaatgtcctgatggaatgtaaattgtttttataatttaatcttccctgtaagatactcggggtaggtctaattagaatttactttacaacctaatctgccctgtaatatttacagggcaggttttttttaaaatttttttatgaatgaagtcttagagttctacccaattcttattaaaggaacgattacaacagtccagttaactgtattaggagctatattagctctaattgtttcttttattgttggacttgcaaggatttcttcatttgctgcagttagagtaattgcaatcatttatttagaatttttccgaggcagttctgctctcgttcaaatgttttttatatatttcgtattaccaatgtggggcatatattttgatgccttgactgctggtgtagtagcctgcggccttaacgtcggcgcatatggttcagaggttgttcgaggagcaatacttgcagttagtaaggagcaacatgaagcatgcaaagccttaaactattcaagcttaaaaaaatatagatacgttattattcctcaagcaatcccaatcatgattcctacatttggaaatttacttattgagcttttaaaattaacagcggttgcctcactgattactatttcagatcttacatttatggctcaaataatcagggttcagactgcattaacattagagccatttttactcatacttgttatttattttattattgctacggttttggttcagatagtagatctgattgctaaaaagttttctaaaggtagaaatattatgaccgcaggagacaaataattatggagtggaattgggatcatgcattcgctgttctgccgcaactagcagatggtttattagtaactattcaagctactattgttgcttcacttcttgcttatgtattgggactagggatagctattgtcaaaatgtcaaaaagtaagcttacacgtatttcaatctactggattactgagtttgttagaagaacgccaatcttagttcagctttatgtagtattttatgttctaccagactttggaatattcttagaagccttcacatgtggtgtcattgtattaggcattcattttagtacatatacttcagaagtctttagagctggtattgacaatgttcctaaaggccagtgggaggcagcaaagtcacttaactataacccacttcaaacctggaaaaatgttatcctgcctcaggccataccaccaatgattccacctcttgcaaactatctcattaccatgtttaaggaaacaccattattagcagcaattacagtagttgaattatttagagctgccgatcagtatagtaatagtcattacacctatctagaaccaatgaccttagttggagtgttctttttgattgtttcaataccatcagcaatgttagcaatgaaactagaaaagaagtttaagcaagcaaagacggcgtaagtcaatttttgaccaaacaagtctgatctcaacccctctagagaactctaaacattttgatatggtcaatacctgcttcttcgtatatctctccctcacatacaaagccaagatctagataaaaactatgcgcatgccattgagatgataaccaaagcttttcaagattgtttttttgagcccatttaataagctcttgcatgacggacttaccaattccaagtccgcgatacttttttagaacagcaacccttccaatgtgtccatcaattaatatccttccagttccaattggctcatcatcagaataagccagtacatgctttgcttcatcatctaatccatcaatttcaagctcttctggcacattctgctcatcaacaaagacctcaaaccttattttgcagatatctttttcattgcccttatagtcacaaattttggattcaatattcatattaatttcataattattaagatacaaaaaataagttaattgctaaagcaaaataaacgaatgcggctagcttatttatgttgtttccaactgattttgattttttaagaaatctctcaagaaaacttccaagaaatgcaatcgatgagaaaacacatagcgcactcaaaataaataaaagaccaagtgttaggatttgaatagtaacactgcccncactaacattaacaaattgcggcaaaaaaaccagaaagaaaagagcaacctttggnttggtcagattcatgattatgcctgtaatataataggattgattggtacttttttctttgctttcancaaggactagctcctcatttttnagagacanccancctaaataaacaagntancangcncccannatntttaanccattaaacgcaatagnactngtttggaaaataacgcttacnccaacagctaccaagagagtatgccccactagcccagt

SEQ ID NO: 1325 - DNA, 4000 bp, Escherichia coli
  misc_feature (1)..(8): n is a, c, g, or t
  misc_feature (10)..(21): n is a, c, g, or t
  misc_feature (23)..(26): n is a, c, g, or t
  misc_feature (28)..(36): n is a, c, g, or t
  misc_feature (38)..(47): n is a, c, g, or t
  misc_feature (49)..(50): n is a, c, g, or t
  misc_feature (52)..(54): n is a, c, g, or t
  misc_feature (57)..(62): n is a, c, g, or t
  misc_feature (64)..(68): n is a, c, g, or t
  misc_feature (70)..(70): n is a, c, g, or t
  misc_feature (72)..(76): n is a, c, g, or t
  misc_feature (78)..(80): n is a, c, g, or t
  misc_feature (82)..(82): n is a, c, g, or t
  misc_feature (84)..(84): n is a, c, g, or t
  misc_feature (86)..(87): n is a, c, g, or t
  misc_feature (89)..(93): n is a, c, g, or t
  misc_feature (95)..(95): n is a, c, g, or t
  misc_feature (97)..(98): n is a, c, g, or t
  misc_feature (101)..(101): n is a, c, g, or t
  misc_feature (103)..(106): n is a, c, g, or t
  misc_feature (108)..(119): n is a, c, g, or t
  misc_feature (123)..(126): n is a, c, g, or t
  misc_feature (128)..(129): n is a, c, g, or t
  misc_feature (131)..(137): n is a, c, g, or t
  misc_feature (139)..(139): n is a, c, g, or t
  misc_feature (141)..(142): n is a, c, g, or t
  misc_feature (144)..(149): n is a, c, g, or t
  misc_feature (151)..(195): n is a, c, g, or t
  misc_feature (199)..(222): n is a, c, g, or t
  misc_feature (224)..(229): n is a, c, g, or t
  misc_feature (231)..(249): n is a, c, g, or t
  misc_feature (251)..(253): n is a, c, g, or t
  misc_feature (255)..(256): n is a, c, g, or t
  misc_feature (258)..(268): n is a, c, g, or t
  misc_feature (270)..(270): n is a, c, g, or t
  misc_feature (274)..(274): n is a, c, g, or t
  misc_feature (277)..(277): n is a, c, g, or t
  misc_feature (282)..(282): n is a, c, g, or t
  misc_feature (287)..(287): n is a, c, g, or t
  misc_feature (292)..(292): n is a, c, g, or t
  misc_feature (295)..(295): n is a, c, g, or t
  misc_feature (299)..(299): n is a, c, g, or t
  misc_feature (301)..(301): n is a, c, g, or t
  misc_feature (303)..(303): n is a, c, g, or t
  misc_feature (310)..(312): n is a, c, g, or t
  misc_feature (314)..(314): n is a, c, g, or t
  misc_feature (318)..(319): n is a, c, g, or t
  misc_feature (321)..(321): n is a, c, g, or t
  misc_feature (323)..(323): n is a, c, g, or t
  misc_feature (331)..(332): n is a, c, g, or t
  misc_feature (334)..(334): n is a, c, g, or t
  misc_feature (336)..(336): n is a, c, g, or t
  misc_feature (338)..(338): n is a, c, g, or t
  misc_feature (341)..(341): n is a, c, g, or t
  misc_feature (349)..(349): n is a, c, g, or t
  misc_feature (352)..(352): n is a, c, g, or t
  misc_feature (354)..(354): n is a, c, g, or t
  misc_feature (361)..(363): n is a, c, g, or t
  misc_feature (366)..(366): n is a, c, g, or t
  misc_feature (369)..(370): n is a, c, g, or t
  misc_feature (374)..(374): n is a, c, g, or t
  misc_feature (377)..(378): n is a, c, g, or t
  misc_feature (382)..(382): n is a, c, g, or t
  misc_feature (386)..(386): n is a, c, g, or t
  misc_feature (388)..(389): n is a, c, g, or t
  misc_feature (393)..(393): n is a, c, g, or t
  misc_feature (397)..(398): n is a, c, g, or t
  misc_feature (400)..(400): n is a, c, g, or t
  misc_feature (405)..(405): n is a, c, g, or t
  misc_feature (410)..(410): n is a, c, g, or t
  misc_feature (412)..(413): n is a, c, g, or t
  misc_feature (418)..(418): n is a, c, g, or t
  misc_feature (421)..(422): n is a, c, g, or t
  misc_feature (424)..(424): n is a, c, g, or t
  misc_feature (427)..(428): n is a, c, g, or t
  misc_feature (433)..(433): n is a, c, g, or t
  misc_feature (438)..(438): n is a, c, g, or t
  misc_feature (446)..(447): n is a, c, g, or t
  misc_feature (450)..(450): n is a, c, g, or t
  misc_feature (453)..(454): n is a, c, g, or t
  misc_feature (456)..(456): n is a, c, g, or t
  misc_feature (461)..(462): n is a, c, g, or t
  misc_feature (464)..(464): n is a, c, g, or t
  misc_feature (469)..(469): n is a, c, g, or t
  misc_feature (472)..(472): n is a, c, g, or t
  misc_feature (477)..(477): n is a, c, g, or t
  misc_feature (482)..(483): n is a, c, g, or t
  misc_feature (490)..(490): n is a, c, g, or t
  misc_feature (493)..(493): n is a, c, g, or t
  misc_feature (497)..(498): n is a, c, g, or t
  misc_feature (503)..(503): n is a, c, g, or t
  misc_feature (506)..(506): n is a, c, g, or t
  misc_feature (511)..(511): n is a, c, g, or t
  misc_feature (515)..(516): n is a, c, g, or t
  misc_feature (520)..(520): n is a, c, g, or t
  misc_feature (523)..(523): n is a, c, g, or t
  misc_feature (525)..(526): n is a, c, g, or t
  misc_feature (532)..(532): n is a, c, g, or t
  misc_feature (534)..(534): n is a, c, g, or t
  misc_feature (538)..(538): n is a, c, g, or t
  misc_feature (544)..(544): n is a, c, g, or t
  misc_feature (550)..(552): n is a, c, g, or t
  misc_feature (554)..(556): n is a, c, g, or t
  misc_feature (564)..(564): n is a, c, g, or t
  misc_feature (566)..(566): n is a, c, g, or t
  misc_feature (570)..(570): n is a, c, g, or t
  misc_feature (573)..(573): n is a, c, g, or t
  misc_feature (576)..(579): n is a, c, g, or t
  misc_feature (583)..(584): n is a, c, g, or t
  misc_feature (586)..(586): n is a, c, g, or t
  misc_feature (591)..(591): n is a, c, g, or t
  misc_feature (604)..(604): n is a, c, g, or t
  misc_feature (606)..(607): n is a, c, g, or t
  misc_feature (610)..(611): n is a, c, g, or t
  misc_feature (613)..(616): n is a, c, g, or t
  misc_feature (618)..(618): n is a, c, g, or t
  misc_feature (622)..(622): n is a, c, g, or t
  misc_feature (624)..(624): n is a, c, g, or t
  misc_feature (626)..(629): n is a, c, g, or t
  misc_feature (631)..(631): n is a, c, g, or t
  misc_feature (633)..(634): n is a, c, g, or t
  misc_feature (636)..(637): n is a, c, g, or t
  misc_feature (639)..(639): n is a, c, g, or t
  misc_feature (642)..(642): n is a, c, g, or t
  misc_feature (644)..(644): n is a, c, g, or t
  misc_feature (646)..(649): n is a, c, g, or t
  misc_feature (652)..(653): n is a, c, g, or t
  misc_feature (655)..(655): n is a, c, g, or t
  misc_feature (658)..(658): n is a, c, g, or t
  misc_feature (665)..(665): n is a, c, g, or t
  misc_feature (667)..(667): n is a, c, g, or t
  misc_feature (669)..(669): n is a, c, g, or t
  misc_feature (673)..(674): n is a, c, g, or t
  misc_feature (679)..(679): n is a, c, g, or t
  misc_feature (682)..(683): n is a, c, g, or t
  misc_feature (685)..(685): n is a, c, g, or t
  misc_feature (688)..(689): n is a, c, g, or t
  misc_feature (692)..(692): n is a, c, g, or t
  misc_feature (694)..(695): n is a, c, g, or t
  misc_feature (698)..(698): n is a, c, g, or t
  misc_feature (703)..(703): n is a, c, g, or t
  misc_feature (705)..(705): n is a, c, g, or t
  misc_feature (708)..(708): n is a, c, g, or t
  misc_feature (711)..(712): n is a, c, g, or t
  misc_feature (717)..(717): n is a, c, g, or t
  misc_feature (720)..(720): n is a, c, g, or t
  misc_feature (725)..(733): n is a, c, g, or t
  misc_feature (735)..(737): n is a, c, g, or t
  misc_feature (739)..(740): n is a, c, g, or t
  misc_feature (742)..(743): n is a, c, g, or t
  misc_feature (746)..(752): n is a, c, g, or t
  misc_feature (754)..(757): n is a, c, g, or t
  misc_feature (760)..(767): n is a, c, g, or t
  misc_feature (769)..(769): n is a, c, g, or t
  misc_feature (775)..(775): n is a, c, g, or t
  misc_feature (777)..(779): n is a, c, g, or t
  misc_feature (781)..(788): n is a, c, g, or t
  misc_feature (791)..(797): n is a, c, g, or t
  misc_feature (799)..(799): n is a, c, g, or t
  misc_feature (803)..(803): n is a, c, g, or t
  misc_feature (805)..(808): n is a, c, g, or t
  misc_feature (810)..(812): n is a, c, g, or t
  misc_feature (814)..(817): n is a, c, g, or t
  misc_feature (819)..(819): n is a, c, g, or t
  misc_feature (821)..(824): n is a, c, g, or t
  misc_feature (828)..(834): n is a, c, g, or t
  misc_feature (836)..(844): n is a, c, g, or t
  misc_feature (846)..(855): n is a, c, g, or t
  misc_feature (857)..(857): n is a, c, g, or t
  misc_feature (862)..(862): n is a, c, g, or t
  misc_feature (866)..(868): n is a, c, g, or t
  misc_feature (872)..(875): n is a, c, g, or t
  misc_feature (877)..(877): n is a, c, g, or t
  misc_feature (879)..(879): n is a, c, g, or t
  misc_feature (887)..(896): n is a, c, g, or t
  misc_feature (898)..(898): n is a, c, g, or t
  misc_feature (900)..(902): n is a, c, g, or t
  misc_feature (904)..(908): n is a, c, g, or t
  misc_feature (910)..(911): n is a, c, g, or t
  misc_feature (913)..(931): n is a, c, g, or t
  misc_feature (935)..(935): n is a, c, g, or t
  misc_feature (937)..(939): n is a, c, g, or t
  misc_feature (941)..(941): n is a, c, g, or t
  misc_feature (946)..(948): n is a, c, g, or t
  misc_feature (950)..(950): n is a, c, g, or t
  misc_feature (954)..(954): n is a, c, g, or t
  misc_feature (956)..(959): n is a, c, g, or t
  misc_feature (962)..(963): n is a, c, g, or t
  misc_feature (965)..(965): n is a, c, g, or t
  misc_feature (967)..(967): n is a, c, g, or t
  misc_feature (969)..(969): n is a, c, g, or t
  misc_feature (971)..(978): n is a, c, g, or t
  misc_feature (980)..(980): n is a, c, g, or t
  misc_feature (982)..(982): n is a, c, g, or t
  misc_feature (984)..(987): n is a, c, g, or t
  misc_feature (989)..(1005): n is a, c, g, or t
  misc_feature (1007)..(1022): n is a, c, g, or t
  misc_feature (1024)..(1027): n is a, c, g, or t
  misc_feature (1030)..(1030): n is a, c, g, or t
  misc_feature (1032)..(1032): n is a, c, g, or t
  misc_feature (1034)..(1036): n is a, c, g, or t
  misc_feature (1038)..(1038): n is a, c, g, or t
  misc_feature (1040)..(1040): n is a, c, g, or t
  misc_feature (1044)..(1058): n is a, c, g, or t
  misc_feature (1060)..(1061): n is a, c, g, or t
  misc_feature (1063)..(1063): n is a, c, g, or t
  misc_feature (1066)..(1067): n is a, c, g, or t
  misc_feature (1069)..(1069): n is a, c, g, or t
  misc_feature (1072)..(1080): n is a, c, g, or t
  misc_feature (1082)..(1082): n is a, c, g, or t
  misc_feature (1084)..(1084): n is a, c, g, or t
  misc_feature (1088)..(1090): n is a, c, g, or t
  misc_feature (1094)..(1103): n is a, c, g, or t
  misc_feature (1105)..(1105): n is a, c, g, or t
  misc_feature (1107)..(1109): n is a, c, g, or t
  misc_feature (1111)..(1112): n is a, c, g, or t
  misc_feature (1114)..(1121): n is a, c, g, or t
  misc_feature (1123)..(1123): n is a, c, g, or t
  misc_feature (1126)..(1127): n is a, c, g, or t
  misc_feature (1129)..(1131): n is a, c, g, or t
  misc_feature (1135)..(1147): n is a, c, g, or t
  misc_feature (1149)..(1153): n is a, c, g, or t
  misc_feature (1155)..(1158): n is a, c, g, or t
  misc_feature (1160)..(1161): n is a, c, g, or t
  misc_feature (1163)..(1164): n is a, c, g, or t
  misc_feature (1166)..(1169): n is a, c, g, or t
  misc_feature (1171)..(1172): n is a, c, g, or t
  misc_feature (1175)..(1177): n is a, c, g, or t
  misc_feature (1179)..(1180): n is a, c, g, or t
  misc_feature (1182)..(1183): n is a, c, g, or t
  misc_feature (1185)..(1185): n is a, c, g, or t
  misc_feature (1189)..(1198): n is a, c, g, or t
  misc_feature (1201)..(1204): n is a, c, g, or t
  misc_feature (1206)..(1206): n is a, c, g, or t
  misc_feature (1209)..(1209): n is a, c, g, or t
  misc_feature (1211)..(1211): n is a, c, g, or t
  misc_feature (1213)..(1214): n is a, c, g, or t
  misc_feature (1216)..(1220): n is a, c, g, or t
  misc_feature (1222)..(1222): n is a, c, g, or t
  misc_feature (1225)..(1234): n is a, c, g, or t
  misc_feature (1236)..(1238): n is a, c, g, or t
  misc_feature (1241)..(1252): n is a, c, g, or t
  misc_feature (1255)..(1255): n is a, c, g, or t
  misc_feature (1257)..(1257): n is a, c, g, or t
  misc_feature (1261)..(1261): n is a, c, g, or t
  misc_feature (1263)..(1265): n is a, c, g, or t
  misc_feature (1267)..(1268): n is a, c, g, or t
  misc_feature (1270)..(1271): n is a, c, g, or t
  misc_feature (1273)..(1274): n is a, c, g, or t
  misc_feature (1276)..(1281): n is a, c, g, or t
  misc_feature (1283)..(1294): n is a, c, g, or t
  misc_feature (1296)..(1296): n is a, c, g, or t
  misc_feature (1298)..(1298): n is a, c, g, or t
  misc_feature (1300)..(1302): n is a, c, g, or t
  misc_feature (1304)..(1304): n is a, c, g, or t
  misc_feature (1308)..(1308): n is a, c, g, or t
  misc_feature (1310)..(1310): n is a, c, g, or t
  misc_feature (1312)..(1331): n is a, c, g, or t
  misc_feature (1333)..(1339): n is a, c, g, or t
  misc_feature (1342)..(1355): n is a, c, g, or t
  misc_feature (1358)..(1360): n is a, c, g, or t
  misc_feature (1363)..(1363): n is a, c, g, or t
  misc_feature (1367)..(1367): n is a, c, g, or t
  misc_feature (1369)..(1377): n is a, c, g, or t
  misc_feature (1379)..(1380): n is a, c, g, or t
  misc_feature (1382)..(1382): n is a, c, g, or t
  misc_feature (1384)..(1388): n is a, c, g, or t
  misc_feature (1391)..(1391): n is a, c, g, or t
  misc_feature (1393)..(1394): n is a, c, g, or t
  misc_feature (1396)..(1397): n is a, c, g, or t
  misc_feature (1399)..(1400): n is a, c, g, or t
  misc_feature (1402)..(1403): n is a, c, g, or t
  misc_feature (1406)..(1408): n is a, c, g, or t
  misc_feature (1410)..(1414): n is a, c, g, or t
  misc_feature (1416)..(1423): n is a, c, g, or t
  misc_feature (1425)..(1425): n is a, c, g, or t
  misc_feature (1427)..(1427): n is a, c, g, or t
  misc_feature (1429)..(1435): n is a, c, g, or t
  misc_feature (1437)..(1437): n is a, c, g, or t
  misc_feature (1441)..(1443): n is a, c, g, or t
  misc_feature (1445)..(1445): n is a, c, g, or t
  misc_feature (1447)..(1452): n is a, c, g, or t
  misc_feature (1456)..(1456): n is a, c, g, or t
  misc_feature (1458)..(1460): n is a, c, g, or t
  misc_feature (1462)..(1463): n is a, c, g, or t
  misc_feature (1465)..(1469): n is a, c, g, or t
  misc_feature (1471)..(1471): n is a, c, g, or t
  misc_feature (1474)..(1474): n is a, c, g, or t
  misc_feature (1477)..(1481): n is a, c, g, or t
  misc_feature (1489)..(1489): n is a, c, g, or t
  misc_feature (1492)..(1492): n is a, c, g, or t
  misc_feature (1494)..(1494): n is a, c, g, or t
  misc_feature (1499)..(1499): n is a, c, g, or t
  misc_feature (1501)..(1501): n is a, c, g, or t
  misc_feature (1504)..(1505): n is a, c, g, or t
  misc_feature (1510)..(1510): n is a, c, g, or t
  misc_feature (1513)..(1513): n is a, c, g, or t
  misc_feature (1520)..(1520): n is a, c, g, or t
  misc_feature (1524)..(1525): n is a, c, g, or t
  misc_feature (1527)..(1527): n is a, c, g, or t
  misc_feature (1530)..(1530): n is a, c, g, or t
  misc_feature (1532)..(1532): n is a, c, g, or t
  misc_feature (1542)..(1543): n is a, c, g, or t
  misc_feature (1545)..(1545): n is a, c, g, or t
  misc_feature (1548)..(1548): n is a, c, g, or t
  misc_feature (1550)..(1551): n is a, c, g, or t
  misc_feature (1566)..(1566): n is a, c, g, or t
  misc_feature (1569)..(1569): n is a, c, g, or t
  misc_feature (1571)..(1576): n is a, c, g, or t
  misc_feature (1578)..(1578): n is a, c, g, or t
  misc_feature (1580)..(1585): n is a, c, g, or t
  misc_feature (1587)..(1590): n is a, c, g, or t
  misc_feature (1595)..(1598): n is a, c, g, or t
  misc_feature (1600)..(1600): n is a, c, g, or t
  misc_feature (1602)..(1603): n is a, c, g, or t
  misc_feature (1607)..(1608): n is a, c, g, or t
  misc_feature (1611)..(1615): n is a, c, g, or t
  misc_feature (1618)..(1618): n is a, c, g, or t
  misc_feature (1621)..(1622): n is a, c, g, or t
  misc_feature (1721)..(1721): n is a, c, g, or t
  misc_feature (1787)..(1787): n is a, c, g, or t
  misc_feature (1982)..(1985): n is a, c, g, or t
  misc_feature (1989)..(1989): n is a, c, g, or t
  misc_feature (2057)..(2057): n is a, c, g, or t
nnnnnnnncnnnnnnnnnnnngnnnncnnnnnnnnncnnnnnnnnnncnnannngcnnnnnncnnnnncngnnnnncnnngngngnncnnnnngngnncgngnnnncnnnnnnnnnnnngcgnnnngnngnnnnnnnancnncnnnnnncnnnnnnnnnnnnnnnnnnnnnnnnnnnnnnnnnnnnnnnnnnnnngcannnnnnnnnnnnnnnnnnnnnnnncnnnnnntnnnnnnnnnnnnnnnnnnncnnncnncnnnnnnnnnnnantgcncgnacgtncgcgntgtgncancaantnanacgcacnnncncganngnancgatcggnncncncnccncgcgcccnccncncccgcgnnnganganngcgnccnngacngccncnngcgncccnngngtcgngaaananngcgtngcnncncgnncgcgnctccntcccgcgnngcnctnncncccgnncntctcncgnctccncgcgnncgcggcncgncccnncgcgngcntctcngcgnntcanatntnngcccgncngacngcccgnccgcgnnncnnncgcgcgtntncccnccncgnnnngcgnncnccccngccgaccccgcgngnncgnngnnnncncgcncnannnngnanngnntngcncncnnnnganngngcnggagacngngnacanncctcncanncnctnntangnnccncccgncncgngcnngaccnccngcgcnnnnnnnnncnnncnncnnctnnnnnnncnnnngcnnnnnnnncngcgcgngnnngnnnnnnnngcnnnnnnngngcgngnnnncnnngnnnngngnnnnaaannnnnnngnnnnnnnnncnnnnnnnnnngngcgcncgcnnncggnnnncncncccccccnnnnnnnnnncncnnncnnnnngnngnnnnnnnnnnnnnnnnnnncgcncnnngngcgcnnngncgcncnnnnganncncncncnnnnnnnncncncnnnntnnnnnnnnnnnnnnnnntnnnnnnnnnnnnnnnncnnnncgngngnnngngngcgnnnnnnnnnnnnnnncnncncgnncnggnnnnnnnnngngngcgnnngcgnnnnnnnnnngngnnngnngnnnnnnnncncgnngnnngcgnnnnnnnnnnnnncnnnnncnnnngnngnngnnnncnncgnnngnngnncnctcnnnnnnnnnncgnnnngngtntntnngnnnnngncgnnnnnnnnnngnnngannnnnnnnnnnncgngngcgngnnngnngnngnngnnnnnngnnnnnnnnnnnntntntnnnanaaananannnnnnnnnnnnnnnnnnnngnnnnnnncgnnnnnnnnnnnnnnggnnnccncgcncnnnnnnnnntnncncnnnnngcngnngnngnngnngcnnncnnnnncnnnnnnnncncncnnnnnnnanacannncncnnnnnngcgngnnngnngnnnnngngcncgnnnnnggcgcggncgngnctctncngcnngcggnggnggtctcngtgnngngcntngcgctggggnngnggngnnggacgcggcgcgcgnggngnnnnnngntnnnnnntnnnnaaaannnnananngagnntannnnnttntannagtcatcaatccaggtacagcccgaaccctaggttgatgggcttggactcgagcatccacgccgcctggttgatgacgaagttgtcgcacccctggctngccgccgcgagcagcgccgcgcggtctgccaccgcctcgggctcctccgggtaccacactcccggncgcgtttccccgcgcagcatcgccgacgcgaacgccgccgtggcgttccccaccgcgtcccgcagccgcgggtggttgaagatgccgccggcgagcttgccattcttcagcttgacgtccacgcgcatcgccgtgcgctcgcccacgagcgcgtccacggcgcgcaccagcggagcggtgagccgcgccagcgtnnnngcgntttcgcggttggcgagaaaatccttgggcgcgacggcgctcattaagttcatcgccagattccacacncccggcgacgtcccgaaccgcgtcttgaccgtctccgcgccgaacacctcgcgcgcggatctcgtctcgggaagattgtacatgaacacctcgcgctttccgcacttcttcccgaagtccaccaccttcctttgcgcggccgggcgcgaagtcacgggcgcgccgttttcccagctctccacgtcctcgccgcagagcatgtaggaggtggcgaggatggtgtccccgacgccgccgcttcccgcgcagaagtacgagtacagcacgtactccacctcggcgtccatgtccccgcccgcctcgcggttcgcggcgatcatgtccgcggccatgacgttggacacgccggggtacacgccggcggtggtgatgcacggcacgccggcggcgcgcgcggcggcgtgtctcgacttggccgcctgcgcgtagttcgcatcgtcgcagacgtccaggtacgggacgcccgcggcgatggcggcgtccatgaccgcgttacggtcgccgccgctctggaacgggcccgcgctgtgcacgacgaggtccgcgcccgcgatcgcggcggcgacggagccggcgtccgccagatcgagtttcgcgaagtccgcgacgccgcgcaggcaggggtgcctctccatcgcctccgcggccgccgcgtccgagcggccggcgagcaccaccttcgcgacggacgggtcgttggccaccagcgccgccgcggaggcggcgccgacgcgaccagtgccgcccacgaacaccaccttcttggtcgcctcggtctcggaggcctcggcctcggacgcgcgcgcgcgcgtcgatcgacggcggttcgagggtcgcgcgaccttcgcgaacgataggcgctcggcggtcgagggcgaggcgcgcgcgctcggcgcggcggtcgctcggcacatcgcggacgcggacatggtggtctgtgtcgggcgaacggacgcgcgcgggggcgaagtgatggtcgcggtgccgaacgcgcgatgacgtcggcacttctgttctttgttttatccggtgcgagcggtgggaaagctgtcggtcgttttcgaggtctattcttgagtcacagatatatacgatttcgaagactgcatggactgtcatgacggttgaaaatgttggatcgagagaaaatcagaaaaagcgaagacagtggggatttcaaacgaaaagaaccgtttgtggagcttttcaacgtccgaggcatcgacgccgcgcgcatacccgcgcgctcttcgcagcgacgggaccgtgaccgtacggcggcgcgccttcgaccttcgaagcgtcgcaccgcgcgcgtacgcgcgaaaacccattcgccggggcgtggaggatacacatccgcgctccataaggttgcatttttaagcgctcctcgtcgccgggtcgaccctctcgcgtttcccacgcgtgcatcgggtagacgccggcgcgtgccaacgaggccaccgcgcgccgccttcgttccaagatggcgaccgcgatggccgaggagacgcccccctactcgttcgtggccaagaacgggcaggtggcgtgggacgcggtgatgggcttcgacctcgcgccgtttctcagcgggcagaacgtcgcgccgaacgccctcggcgcgctcgatgacctgtccaggcagctggaggaggcgcgcatcgagccggacccgggggtgaaccccgagacgaacaccgaccgcctcgcgcgcctcgccgtggtcctgcagctcagcagcgagtaccaggcgatgcgcgcggaggacctgcaggtggcggtcgagaagaaggatcgcgagctggacgtcatggacgagcagatggagcagctcgagcgcggcggcgcgcgcacggacacctcgctggaggcggaggcggacgccgcgcgcagccgcgcggaggaggcggaccgacgcatgtcgctgcagacgcagg

SEQ ID NO: 1326 - DNA, 4000 bp, Escherichia coli
  misc_feature (803)..(803): n is a, c, g, or t
  misc_feature (808)..(808): n is a, c, g, or t
  misc_feature (1556)..(1556): n is a, c, g, or t
  misc_feature (1595)..(1595): n is a, c, g, or t
  misc_feature (1784)..(1784): n is a, c, g, or t
  misc_feature (1971)..(1972): n is a, c, g, or t
  misc_feature (1996)..(1996): n is a, c, g, or t
  misc_feature (2007)..(2007): n is a, c, g, or t
  misc_feature (2015)..(2015): n is a, c, g, or t
  misc_feature (2330)..(2330): n is a, c, g, or t
  misc_feature (3073)..(3073): n is a, c, g, or t
  misc_feature (3640)..(3640): n is a, c, g, or t
  misc_feature (3676)..(3676): n is a, c, g, or t
  misc_feature (3682)..(3682): n is a, c, g, or t
  misc_feature (3692)..(3693): n is a, c, g, or t
  misc_feature (3721)..(3721): n is a, c, g, or t
accaactttgcaggcatctgcaaaaagagggagaaacaatgatgtttctttgatgtttttaaaaggtagggtaaggaagagactgttgtaaatttggaatctagaaagtattttttcgttaaatcgttcgattttaggttttcgggccattaaagtttgtgttttatagttcggtaaaaatatggtgcatcaatcgttttttgtcgtttatactctcttccattgagatcatcgtctccgttctagagactccagggacatcgtcaatactaaaaataatatcctttgcatggtgcgtatctcgcgccctaaccttacagaaaacattgaatttccccgtggtaatatgcgcaactgtgataaaaggaatatcatttagtgcacttagaacttcattgatggtatttgttttttcaagaaaaacacctacataggcaataaaagaataccctagtttgacatagtcaagatttaaggaagatcctttaatgatccctgattcttccatctttctaacccgaacatgaacggttcctgcagagattaataaacgttttgaaatgtctgtgaatggaattcttgtattatcaattaaaatatctaggatttgatggtcaatttcatctaaagctactttgctcatggctaatatatttttgcaaatttaactaaattttactgataaatcatcaatgaattcgcttgattttgaagaaaaacgcactgaaatgaattaaatctatgctttaattgaacataatgagacaaaatccaaattttcaagaagattatcttttttaaantgtantgaaatgttttttagttcttcagggaggattatttttttatgggccttcaaagggagtttaacaccaaaaaatttcatttcagggaggaaaacaatcgcgtcatccctaagttcttccttatagtgaattgccaattcctgctcagcatagctatttccatcctctgttacagtgacgccggtaatgattaggtcaacaaagtctttagcgttctctgggattgcgtaataggcttctgtagggtggtcaaaattatcttccaaaagtgtttctagaagcagtccaaagcttttaaacaagtgccttcgtgtggtttctctttggtaatcattcgggacgtgtcccgcttcaaaaaggacggtgggtgttccgagttgagtgaatttatctcccacacaatttgggttaaacgcatcatcataacgtccaatttgatttgggagggcatcctgaagcccgttttttaattcaacaatgagttgcatcgctttctttcttggagcagttacagtgcgcgcttcgtctgcggaaggagctaaaaaagaaatgcttgccgtttcccccattttacctgcagcaaacaaagtgcgttggccatgtagatttaagcaatagtcgggtttttctaacgtatataaatcatgtaataccttactttctggttgtgtaagatccactgcatcacgatttaggtctattccatttgcatttaaacgtgtataggcttgagctccgtctgggttaagntgtagtataacacacagtgtgaaggcttcctgaaggtgnttttgaggcgtatcaacaaaccagggaataaagtctagcagtgctcgggtggtcgtactctcgtttccatgcatctgtgaccacattaggatctttacctttccttttccaagtgttaaaagagatatgggtaaatcatttacagaacgaccgataacttttctagaaacagtttccggtaagccttcnaaaaatgaatataaagcacttggcggtaaatatcgcttggtagtcatatagattataaaacacaaatgtaaacatctgtttgtttacatttgtaacgaaatagtatttcatatcaaaccactgaacccgcattattgtatttgttttgatacaaatgtaacacatcaataaatgaatgaataaaaannctttaaatcaagtacttacgtttnaaaattaaagnaatacatncatttttaaagggcttgttttattcagtttacaattgtatatttgtaatagaaccaataatagtttacaatgttaaacattgaccacttcctaaagcgacttgaatcattaatggaaaataaccatctaaatgcaactgcctttgccgaaaaaatcgatgttcaacgttcttccgtttctcatattttatcgaaacgaaataaaccgagtttggaatttatattgaaaatcaatgaacattttgaggaagctgatttagaatggttactattgggtgaaaaacaagatcaagaaaaacaccctaccctactaaangagaaagtagaagtttcagaaatcgatgcaatcgaacacaaaacaaaatatgaaatcacacaagggatgccccaaaagaatgaaaattcaaacacggacgaaatatctcaaataattcaattatataaggacggtagttttcgcacttattttcccaaatcttagtatttttgctcttgatgaagcattatctaaaattactactgcctttactgtttatttcctgctattctgtcgaacgaaattgtgaggattttcatgaaggtacctttgaattttctcaaatcattaatggtgagatgacccgttcccgttttgaacgtgacgcaaactttgaaatagaattctttgagggcgtcacagacaccgccagtatccgatgggtaaatgattgcgaatgtattttaaccaagctcaatcctacttcaaatcaggacaaacgtcctattcaaatcaaaatcttaagtaccaccaacaattcatacacctttgaatactccctagtaggagatagtggaaacacccagcgaggaacgattcagaaaataaaataacgcatgatcaccccagatatagtagtcgcttttataacccttacctttttggagattgttttaggaatagataacattattttcatttcaattttatcagatcgatttcccatagagaaacgtaagaaattaatgcagttggggcttttcttggcaatgatcatgcggattctattactgatgggagtnaattggctgactaggatgcaaaccacattaatacagtttgacacaaaatacttctcctctaacatatccattcaagctttgattctattagcaggaggattatttttaatttataagagtactcgtgaaatttttgataaggtggagtatgatttagatgagaaaaaagcagaaaaaaacttttcattctctttttctaaagctttggtccaaatcattttaatcgatattgttttttcttttgactcgatccttacagctattggaatgacaagtggaattccgtatgccttgtggatcatgatcactgcagttgtgatcgctttgactatcatgattggatttgcttcccctgtaagtaaatttgtaaatgcccatccgtccatacagatattgggcttgtcttttttattgcttattggttttatgttaattacagaagcagcaagccattctcaaactgtaattttcggatcctcaatcacaacagtacctaaggggtatctatattttgctattgctttttcgttaggagtagaaatgcttaatatgagaattagaaaaacnagatcaaattagaagtctaaggttatttgagggtcntcgccnttttttgatnntgaaataacttcttcatcaacatccacntcaatatcattaatatcttcctctggaggcatttcatatggcaacgcttccttgagctcaacagacttaattttcttttgtgtgagttgatttcctagggctttaaaacccttgactgagatgaattcatccgcattaatctctaagctatcaggttgttcttttcctcttggcttttcaaaatggacttcaagaattgggagccaatcaaatccaacatatagaagggtaccgtcgtctttaatatagctatcctcccgatcaacactttcaattaaa

SEQ ID NO: 1327 - DNA, 4000 bp, Escherichia coli
  misc_feature (113)..(113): n is a, c, g, or t
  misc_feature (122)..(122): n is a, c, g, or t
  misc_feature (205)..(205): n is a, c, g, or t
  misc_feature (212)..(212): n is a, c, g, or t
  misc_feature (1095)..(1095): n is a, c, g, or t
  misc_feature (1100)..(1100): n is a, c, g, or t
  misc_feature (1114)..(1114): n is a, c, g, or t
  misc_feature (1148)..(1148): n is a, c, g, or t
  misc_feature (1167)..(1167): n is a, c, g, or t
  misc_feature (1420)..(1420): n is a, c, g, or t
  misc_feature (1992)..(1992): n is a, c, g, or t
  misc_feature (2585)..(2585): n is a, c, g, or t
  misc_feature (3882)..(3882): n is a, c, g, or t
gccataatggaatcgcgccacgcgtgacaagatgcaaatttgccggtgtcatgccaagcacatcatcggccgtgcgccgtgccacaatcgccgcgcgatgtgcgttaacacgntgggcaaanttaccaatttgcacgctccagcttgggttttcatcagtggcagggttggcggcacttgcaatatcaagctggataaattcggnctttttnggtgctgcagctggccgtgtcttggttttgctgactggcaggcttttgctgactggcaggcttttgggcaatttgtcgccgcgttcgggtggtgccactggcaaggttgttggcatggcaagcgcggcacgccgaaccgtgatggttttgacgcgtttaaactgattatccagaatttgcatcatatggcggtcgcggctgcgcgacgttttcccgccaaacacaacaccaatcagccgaacaccattgcgttcgaccgtggcaacaagattgaatcccgatgcattaatatagcctgttttgatgccatctgtgccgctatattttgccaacagcttgttatgattgccgtatttccggcctttccagttaaagctttgggtgctgaaatatttataaaattgcggaaaatcgcgccgcatggcaacggccagaacggccatatcacgcgctgtcgatttctgccggcgatttggcaggcctgacgcgttcttgaaaaccgtacgccgcatgcccagagccttggccttgcgggtcatgcgtttggcaaattttcgttccgtgcccgacagtttttcggcaattgctgttgccacatcattggccgattttgtcactagcgcgtagatggcttgttcggcgctgattgattgacctggtttcaaatataatttggatggcgaacggccagcggctgttttggaaaccggaatcctgcttttcagtgtcatgcgtcccgcttcgatatcttcaaacaaaagataaagcgtcatgattttggtcaaggatgccgggtagcgcagattatcggcattgcgcgaaaacagaactttgccagtggcttcttcaatgacgattgacgcatatttgctggctttagccngtgtngccggcaacccaancccaaccataaaaatgatcatcattgtcaaaaangatttaccggggcggaaanccccaagctgtgacaaagccaaaaggccggattttatcgaaaatagacatttttcaccacggcgattgagtgaccgaaagggtgcatgttgcttgttcagtagcgtcttggctacatttgatcgtgccattaaggcctgccccattccgaaattatgactatcttgtaacactgcgcggcaaagcataacgcaattaggattctattcaagaatcttgccaaaatttggacaataaactgcaatatggtcgcntcatgtatttgcgaaagtttttttgccgcaccccttttccttgatgtatgcgataccaatatcaaaaggatgcggcgggcgttttgtttctgtgctatattcaacgccctgtacggatgattgaattacgaaggtttaaaagagaatttatggcaaatgaagacgataaaaacggcaatggtcagttaatcctcgacagccgtaccaaaacgaaaaagccatcaatgtataaagtcattatgcttaatgacgactatacaccgatggagtttgtcgtgcatgtcttgcagaaatttttcggtcgttcggcagatgaagccacccagatcatgttgaatgtgcatcagcgcggggttggtgtttgcggtgtctatagttttgaaatcgccgaaagcaaagcgcaaaaaaccattgattatgcgcggaagaatgatcatccgctgcaattacaactggaaaaggaataggcaaaatgctgtcacgcgaactcgaagaaacattgcgccgcgccatgtcgaatgcggcatcatgttcgcatgaatttgccactttagaacatttgctattggcgntaaccgaagatagtgacgcgcttgaagtcctgcatgcctgcaatgttgatattgatgagctggtcaaaaagctgggtgaatttatcgaaattgaactggcatcgattgttgaccccgaaggcaatgttgatgtgcagccaacggcaagtttccagcgcgtgatccagcgcgccatcatccatacacaatcatcagggcgggaagtggccaccggtgccaatgttctggtgtcgattttctccgagcgcgaaagccatgctgtctggtttttgaaatcattgaatatgacacggcttgatgcggtgtcctttatcagccatggcgccgacagcagtatcgccaaaagccagagcgaagatcaggctggcgaaaccattggcgaggatggcaaagacccgcttagccagtttgctgtcaatttgatcgccaaggccgcagctggtaggattgatccattgattggccgcagccgtgaattagaccgcacgattcaggttttatgccgccgcacgaaaaacaatccgctttatgttggtgatccgggtgttggcaaaaccgccatcgccgaagggcttgccttgcgaatttatganggcaatgttcccgatgttctggcaacagcggtgatttattcgcttgatatgggacaattgctggctggaacccgctatcgtggtgattttgaagaacggttgaaagccgtgatgaaagcggtggcagacgacgaaaatgccattctgttcattgatgaaatccatacggtgattggcgcaggggcgacctctggcggagcgatggatgcgtcaaatctgctaaagcctgcgttgcaggaaggcacgcttcgctgtatcgggtcgacaacctataaagaatatcgcggtcattttgaaaaggatcgcgcattggtgcgccggttccagaagattgatgttgccgagccgaccatccccgatacgatcaaaattctgaatggtttgaaaagccgctatgaagatcatcacaaagtgcgctttaccggtgctgccttgaaaaccgcggttgatctgtctgctcgctatatcaatgatcgcaaattgcccgataaagcgattgatgtgattgacgaagctgcggcggcacaaaatctgctgccaccatcacgccgccgccaaacaattggccagaaagaaatcgaagccacggtggcgacaatggcgcggattccgtcaaagcatgttagccgtgatgacaaggctgtgttggcatcgcttgaaactgatttgaaacgtatggtgtttggccaagatccggccattaccgccttggcatcagcgattaagctatcgcgtgctggccttcgtgatgcagaaaagccggttggcaattatctgttttccggcccaacaggcgttggtaaaaccgaggttgcgcgccagcttgccgaaacgcttggcatcaagctgatgcggtttgatatgtccgaatatatggaacgccatacggtatcgcgcctgattggtgcgcctccaggctatgtcgggtttgaccaaggcgggctgttgaccgatgcggttgatcagacgccgcatgccgttctgcttcttgacgagatcgaaaaagcgcatcctgatttgttcaatattctgctgcaggtcatggatcatggcaaattgaccgacaataatggcaagattgttgatttcagaaatgtcattttgattatgacaacaaatgccggagcgcaggaattgtcaaaatcggcaatcggctttaaccgtacgcataatgaaggcgccgatattgaagctatcgaaaaaatgtttacgcctgaattccgtaaccggcttgatgcgattattccgtttgcgccgcttggcaaagatgtcatccggttggttgttgataaatttntcatgcagcttgatgcccagcttgccgatcgtaatgtcgaaatcgaattgagcgaagcggcgatggattggcttgccgaacgtggctatgacgccaaatatggcgcgcggccactggc

SEQ ID NO: 1328 - DNA, 4000 bp, Escherichia coli
  misc_feature (1986)..(1986): n is a, c, g, or t
  misc_feature (1989)..(1989): n is a, c, g, or t
  misc_feature (1992)..(1992): n is a, c, g, or t
  misc_feature (2184)..(2184): n is a, c, g, or t
  misc_feature (2186)..(2186): n is a, c, g, or t
  misc_feature (2188)..(2190): n is a, c, g, or t
  misc_feature (2192)..(2193): n is a, c, g, or t
  misc_feature (2198)..(2200): n is a, c, g, or t
  misc_feature (2203)..(2204): n is a, c, g, or t
  misc_feature (2206)..(2206): n is a, c, g, or t
  misc_feature (2208)..(2208): n is a, c, g, or t
  misc_feature (2212)..(2217): n is a, c, g, or t
  misc_feature (2219)..(2231): n is a, c, g, or t
  misc_feature (2237)..(2238): n is a, c, g, or t
  misc_feature (2241)..(2241): n is a, c, g, or t
  misc_feature (2243)..(2245): n is a, c, g, or t
  misc_feature (2247)..(2247): n is a, c, g, or t
  misc_feature (2249)..(2251): n is a, c, g, or t
  misc_feature (2254)..(2257): n is a, c, g, or t
  misc_feature (2259)..(2260): n is a, c, g, or t
  misc_feature (2262)..(2264): n is a, c, g, or t
  misc_feature (2266)..(2279): n is a, c, g, or t
  misc_feature (2281)..(2282): n is a, c, g, or t
  misc_feature (2285)..(2290): n is a, c, g, or t
  misc_feature (2292)..(2293): n is a, c, g, or t
  misc_feature (2295)..(2295): n is a, c, g, or t
  misc_feature (2297)..(2297): n is a, c, g, or t
  misc_feature (2300)..(2300): n is a, c, g, or t
  misc_feature (2302)..(2303): n is a, c, g, or t
  misc_feature (2305)..(2305): n is a, c, g, or t
  misc_feature (2308)..(2311): n is a, c, g, or t
  misc_feature (2313)..(2315): n is a, c, g, or t
  misc_feature (2317)..(2318): n is a, c, g, or t
  misc_feature (2321)..(2321): n is a, c, g, or t
  misc_feature (2324)..(2324): n is a, c, g, or t
  misc_feature (2326)..(2326): n is a, c, g, or t
  misc_feature (2328)..(2328): n is a, c, g, or t
  misc_feature (2330)..(2338): n is a, c, g, or t
  misc_feature (2340)..(2343): n is a, c, g, or t
  misc_feature (2345)..(2345): n is a, c, g, or t
  misc_feature (2347)..(2356): n is a, c, g, or t
  misc_feature (2358)..(2360): n is a, c, g, or t
  misc_feature (2363)..(2363): n is a, c, g, or t
  misc_feature (2367)..(2373): n is a, c, g, or t
  misc_feature (2375)..(2384): n is a, c, g, or t
  misc_feature (2386)..(2386): n is a, c, g, or t
  misc_feature (2389)..(2391): n is a, c, g, or t
  misc_feature (2395)..(2395): n is a, c, g, or t
  misc_feature (2398)..(2407): n is a, c, g, or t
  misc_feature (2409)..(2409): n is a, c, g, or t
  misc_feature (2411)..(2415): n is a, c, g, or t
  misc_feature (2417)..(2417): n is a, c, g, or t
  misc_feature (2420)..(2427): n is a, c, g, or t
  misc_feature (2429)..(2430): n is a, c, g, or t
  misc_feature (2432)..(2432): n is a, c, g, or t
  misc_feature (2434)..(2436): n is a, c, g, or t
  misc_feature (2439)..(2440): n is a, c, g, or t
  misc_feature (2442)..(2442): n is a, c, g, or t
  misc_feature (2445)..(2447): n is a, c, g, or t
  misc_feature (2449)..(2449): n is a, c, g, or t
  misc_feature (2451)..(2452): n is a, c, g, or t
  misc_feature (2456)..(2464): n is a, c, g, or t
  misc_feature (2466)..(2468): n is a, c, g, or t
  misc_feature (2470)..(2477): n is a, c, g, or t
  misc_feature (2479)..(2481): n is a, c, g, or t
  misc_feature (2484)..(2486): n is a, c, g, or t
  misc_feature (2488)..(2493): n is a, c, g, or t
  misc_feature (2496)..(2496): n is a, c, g, or t
  misc_feature (2498)..(2500): n is a, c, g, or t
  misc_feature (2504)..(2505): n is a, c, g, or t
  misc_feature (2507)..(2513): n is a, c, g, or t
  misc_feature (2515)..(2518): n is a, c, g, or t
  misc_feature (2520)..(2522): n is a, c, g, or t
  misc_feature (2525)..(2527): n is a, c, g, or t
  misc_feature (2529)..(2529): n is a, c, g, or t
  misc_feature (2531)..(2535): n is a, c, g, or t
  misc_feature (2537)..(2542): n is a, c, g, or t
  misc_feature (2545)..(2545): n is a, c, g, or t
  misc_feature (2547)..(2550): n is a, c, g, or t
  misc_feature (2552)..(2559): n is a, c, g, or t
  misc_feature (2561)..(2563): n is a, c, g, or t
  misc_feature (2565)..(2580): n is a, c, g, or t
  misc_feature (2585)..(2585): n is a, c, g, or t
  misc_feature (2588)..(2597): n is a, c, g, or t
  misc_feature (2599)..(2600): n is a, c, g, or t
  misc_feature (2602)..(2607): n is a, c, g, or t
  misc_feature (2612)..(2617): n is a, c, g, or t
  misc_feature (2620)..(2620): n is a, c, g, or t
  misc_feature (2623)..(2623): n is a, c, g, or t
  misc_feature (2625)..(2625): n is a, c, g, or t
  misc_feature (2627)..(2627): n is a, c, g, or t
  misc_feature (2629)..(2629): n is a, c, g, or t
  misc_feature (2631)..(2637): n is a, c, g, or t
  misc_feature (2639)..(2647): n is a, c, g, or t
  misc_feature (2649)..(2650): n is a, c, g, or t
  misc_feature (2654)..(2661): n is a, c, g, or t
  misc_feature (2663)..(2669): n is a, c, g, or t
  misc_feature (2671)..(2671): n is a, c, g, or t
  misc_feature (2673)..(2675): n is a, c, g, or t
  misc_feature (2677)..(2684): n is a, c, g, or t
  misc_feature (2688)..(2694): n is a, c, g, or t
  misc_feature (2696)..(2696): n is a, c, g, or t
  misc_feature (2698)..(2698): n is a, c, g, or t
  misc_feature (2701)..(2710): n is a, c, g, or t
  misc_feature (2712)..(2713): n is a, c, g, or t
  misc_feature (2720)..(2722): n is a, c, g, or t
  misc_feature (2724)..(2727): n is a, c, g, or t
  misc_feature (2731)..(2731): n is a, c, g, or t
  misc_feature (2735)..(2735): n is a, c, g, or t
  misc_feature (2737)..(2737): n is a, c, g, or t
  misc_feature (2739)..(2741): n is a, c, g, or t
  misc_feature (2743)..(2745): n is a, c, g, or t
  misc_feature (2747)..(2749): n is a, c, g, or t
  misc_feature (2751)..(2751): n is a, c, g, or t
  misc_feature (2753)..(2754): n is a, c, g, or t
  misc_feature (2756)..(2756): n is a, c, g, or t
  misc_feature (2758)..(2758): n is a, c, g, or t
  misc_feature (2760)..(2760): n is a, c, g, or t
  misc_feature (2764)..(2765): n is a, c, g, or t
  misc_feature (2767)..(2768): n is a, c, g, or t
  misc_feature (2770)..(2770): n is a, c, g, or t
  misc_feature (2773)..(2780): n is a, c, g, or t
  misc_feature (2783)..(2783): n is a, c, g, or t
  misc_feature (2785)..(2785): n is a, c, g, or t
  misc_feature (2787)..(2787): n is a, c, g, or t
  misc_feature (2789)..(2789): n is a, c, g, or t
  misc_feature (2791)..(2794): n is a, c, g, or t
  misc_feature (2796)..(2798): n is a, c, g, or t
  misc_feature (2800)..(2801): n is a, c, g, or t
  misc_feature (2804)..(2807): n is a, c, g, or t
  misc_feature (2810)..(2811): n is a, c, g, or t
  misc_feature (2813)..(2814): n is a, c, g, or t
  misc_feature (2816)..(2820): n is a, c, g, or t
  misc_feature (2822)..(2822): n is a, c, g, or t
  misc_feature (2824)..(2824): n is a, c, g, or t
  misc_feature (2827)..(2829): n is a, c, g, or t
  misc_feature (2831)..(2835): n is a, c, g, or t
  misc_feature (2843)..(2846): n is a, c, g, or t
  misc_feature (2856)..(2858): n is a, c, g, or t
  misc_feature (2860)..(2860): n is a, c, g, or t
  misc_feature (2869)..(2869): n is a, c, g, or t
  misc_feature (2871)..(2871): n is a, c, g, or t
  misc_feature (2873)..(2873): n is a, c, g, or t
  misc_feature (2876)..(2877): n is a, c, g, or t
  misc_feature (2884)..(2884): n is a, c, g, or t
  misc_feature (2886)..(2887): n is a, c, g, or t
  misc_feature (2889)..(2889): n is a, c, g, or t
  misc_feature (2892)..(2892): n is a, c, g, or t
  misc_feature (2899)..(2899): n is a, c, g, or t
  misc_feature (2902)..(2902): n is a, c, g, or t
  misc_feature (2907)..(2907): n is a, c, g, or t
  misc_feature (2912)..(2912): n is a, c, g, or t
  misc_feature (2914)..(2914): n is a, c, g, or t
  misc_feature (2916)..(2916): n is a, c, g, or t
  misc_feature (2918)..(2918): n is a, c, g, or t
  misc_feature (2921)..(2924): n is a, c, g, or t
  misc_feature (2926)..(2926): n is a, c, g, or t
  misc_feature (2929)..(2932): n is a, c, g, or t
  misc_feature (2937)..(2937): n is a, c, g, or t
  misc_feature (2940)..(2940): n is a, c, g, or t
  misc_feature (2942)..(2944): n is a, c, g, or t
  misc_feature (2946)..(2946): n is a, c, g, or t
  misc_feature (2948)..(2949): n is a, c, g, or t
  misc_feature (2954)..(2958): n is a, c, g, or t
  misc_feature (2961)..(2966): n is a, c, g, or t
  misc_feature (2969)..(2973): n is a, c, g, or t
  misc_feature (2980)..(2980): n is a, c, g, or t
  misc_feature (2992)..(2992): n is a, c, g, or t
  misc_feature (2994)..(2997): n is a, c, g, or t
  misc_feature (2999)..(3004): n is a, c, g, or t
  misc_feature (3006)..(3007): n is a, c, g, or t
  misc_feature (3011)..(3011): n is a, c, g, or t
  misc_feature (3015)..(3015): n is a, c, g, or t
  misc_feature (3019)..(3021): n is a, c, g, or t
  misc_feature (3027)..(3028): n is a, c, g, or t
  misc_feature (3030)..(3030): n is a, c, g, or t
  misc_feature (3034)..(3035): n is a, c, g, or t
  misc_feature (3037)..(3040): n is a, c, g, or t
  misc_feature (3042)..(3047): n is a, c, g, or t
  misc_feature (3051)..(3051): n is a, c, g, or t
  misc_feature (3058)..(3058): n is a, c, g, or t
  misc_feature (3060)..(3068): n is a, c, g, or t
  misc_feature (3070)..(3072): n is a, c, g, or t
  misc_feature (3076)..(3077): n is a, c, g, or t
  misc_feature (3082)..(3083): n is a, c, g, or t
  misc_feature (3088)..(3088): n is a, c, g, or t
  misc_feature (3094)..(3094): n is a, c, g, or t
  misc_feature (3099)..(3100): n is a, c, g, or t
  misc_feature (3102)..(3104): n is a, c, g, or t
  misc_feature (3106)..(3108): n is a, c, g, or t
  misc_feature (3114)..(3114): n is a, c, g, or t
  misc_feature (3119)..(3120): n is a, c, g, or t
  misc_feature (3123)..(3123): n is a, c, g, or t
  misc_feature (3129)..(3131): n is a, c, g, or t
  misc_feature (3134)..(3135): n is a, c, g, or t
  misc_feature (3141)..(3145): n is a, c, g, or t
  misc_feature (3147)..(3147): n is a, c, g, or t
  misc_feature (3154)..(3154): n is a, c, g, or t
  misc_feature (3162)..(3162): n is a, c, g, or t
  misc_feature (3165)..(3166): n is a, c, g, or t
  misc_feature (3170)..(3171): n is a, c, g, or t
  misc_feature (3174)..(3174): n is a, c, g, or t
  misc_feature (3180)..(3180): n is a, c, g, or t
  misc_feature (3185)..(3185): n is a, c, g, or t
  misc_feature (3187)..(3188): n is a, c, g, or t
  misc_feature (3194)..(3194): n is a, c, g, or t
  misc_feature (3197)..(3197): n is a, c, g, or t
  misc_feature (3199)..(3199): n is a, c, g, or t
  misc_feature (3202)..(3205): n is a, c, g, or t
  misc_feature (3207)..(3208): n is a, c, g, or t
  misc_feature (3210)..(3215): n is a, c, g, or t
  misc_feature (3218)..(3218): n is a, c, g, or t
  misc_feature (3223)..(3223): n is a, c, g, or t
  misc_feature (3226)..(3227): n is a, c, g, or t
  misc_feature (3231)..(3231): n is a, c, g, or t
  misc_feature (3233)..(3234): n is a, c, g, or t
  misc_feature (3240)..(3240): n is a, c, g, or t
  misc_feature (3243)..(3243): n is a, c, g, or t
  misc_feature (3247)..(3248): n is a, c, g, or t
  misc_feature (3251)..(3252): n is a, c, g, or t
  misc_feature (3254)..(3254): n is a, c, g, or t
  misc_feature (3258)..(3262): n is a, c, g, or t
  misc_feature (3272)..(3272): n is a, c, g, or t
  misc_feature (3278)..(3278): n is a, c, g, or t
  misc_feature (3283)..(3285): n is a, c, g, or t
  misc_feature (3287)..(3287): n is a, c, g, or t
  misc_feature (3289)..(3289): n is a, c, g, or t
  misc_feature (3291)..(3291): n is a, c, g, or t
  misc_feature (3293)..(3293): n is a, c, g, or t
  misc_feature (3295)..(3296): n is a, c, g, or t
  misc_feature (3301)..(3304): n is a, c, g, or t
  misc_feature (3306)..(3306): n is a, c, g, or t
  misc_feature (3308)..(3308): n is a, c, g, or t
  misc_feature (3316)..(3316): n is a, c, g, or t
  misc_feature (3318)..(3318): n is a, c, g, or t
  misc_feature (3320)..(3321): n is a, c, g, or t
  misc_feature (3324)..(3326): n is a, c, g, or t
  misc_feature (3335)..(3335): n is a, c, g, or t
  misc_feature (3337)..(3337): n is a, c, g, or t
  misc_feature (3339)..(3341): n is a, c, g, or t
  misc_feature (3348)..(3349): n is a, c, g, or t
  misc_feature (3352)..(3354): n is a, c, g, or t
  misc_feature (3358)..(3361): n is a, c, g, or t
  misc_feature (3365)..(3365): n is a, c, g, or t
  misc_feature (3367)..(3371): n is a, c, g, or t
  misc_feature (3373)..(3374): n is a, c, g, or t
  misc_feature (3377)..(3379): n is a, c, g, or t
  misc_feature (3381)..(3381): n is a, c, g, or t
  misc_feature (3383)..(3383): n is a, c, g, or t
  misc_feature (3386)..(3386): n is a, c, g, or t
  misc_feature (3388)..(3388): n is a, c, g, or t
  misc_feature (3391)..(3391): n is a, c, g, or t
  misc_feature (3394)..(3394): n is a, c, g, or t
  misc_feature (3397)..(3397): n is a, c, g, or t
  misc_feature (3407)..(3411): n is a, c, g, or t
  misc_feature (3417)..(3417): n is a, c, g, or t
  misc_feature (3419)..(3420): n is a, c, g, or t
  misc_feature (3422)..(3425): n is a, c, g, or t
  misc_feature (3427)..(3428): n is a, c, g, or t
  misc_feature (3434)..(3434): n is a, c, g, or t
  misc_feature (3443)..(3443): n is a, c, g, or t
  misc_feature (3451)..(3451): n is a, c, g, or t
  misc_feature (3457)..(3457): n is a, c, g, or t
  misc_feature (3460)..(3460): n is a, c, g, or t
  misc_feature (3462)..(3463): n is a, c, g, or t
  misc_feature (3467)..(3467): n is a, c, g, or t
  misc_feature (3469)..(3469): n is a, c, g, or t
  misc_feature (3472)..(3472): n is a, c, g, or t
  misc_feature (3474)..(3474): n is a, c, g, or t
  misc_feature (3479)..(3480): n is a, c, g, or t
  misc_feature (3482)..(3482): n is a, c, g, or t
  misc_feature (3487)..(3487): n is a, c, g, or t
  misc_feature (3493)..(3494): n is a, c, g, or t
  misc_feature (3506)..(3506): n is a, c, g, or t
  misc_feature (3508)..(3508): n is a, c, g, or t
  misc_feature (3510)..(3510): n is a, c, g, or t
  misc_feature (3513)..(3513): n is a, c, g, or t
  misc_feature (3523)..(3523): n is a, c, g, or t
  misc_feature (3525)..(3525): n is a, c, g, or t
  misc_feature (3527)..(3529): n is a, c, g, or t
  misc_feature (3534)..(3534): n is a, c, g, or t
  misc_feature (3537)..(3539): n is a, c, g, or t
  misc_feature (3541)..(3541): n is a, c, g, or t
  misc_feature (3546)..(3546): n is a, c, g, or t
  misc_feature (3549)..(3549): n is a, c, g, or t
  misc_feature (3553)..(3553): n is a, c, g, or t
  misc_feature (3556)..(3556): n is a, c, g, or t
  misc_feature (3562)..(3562): n is a, c, g, or t
  misc_feature (3564)..(3565): n is a, c, g, or t
  misc_feature (3567)..(3567): n is a, c, g, or t
  misc_feature (3569)..(3571): n is a, c, g, or t
  misc_feature (3580)..(3580): n is a, c, g, or t
  misc_feature (3587)..(3587): n is a, c, g, or t
  misc_feature (3589)..(3589): n is a, c, g, or t
  misc_feature (3594)..(3594): n is a, c, g, or t
  misc_feature (3598)..(3598): n is a, c, g, or t
  misc_feature (3600)..(3600): n is a, c, g, or t
  misc_feature (3604)..(3604): n is a, c, g, or t
  misc_feature (3606)..(3606): n is a, c, g, or t
  misc_feature (3608)..(3608): n is a, c, g, or t
  misc_feature (3610)..(3610): n is a, c, g, or t
  misc_feature (3612)..(3612): n is a, c, g, or t
  misc_feature (3618)..(3618): n is a, c, g, or t
  misc_feature (3620)..(3620): n is a, c, g, or t
  misc_feature (3622)..(3622): n is a, c, g, or t
  misc_feature (3625)..(3626): n is a, c, g, or t
  misc_feature (3628)..(3628): n is a, c, g, or t
  misc_feature (3636)..(3639): n is a, c, g, or t
  misc_feature (3649)..(3649): n is a, c, g, or t
  misc_feature (3651)..(3651): n is a, c, g, or t
  misc_feature (3655)..(3655): n is a, c, g, or t
  misc_feature (3661)..(3661): n is a, c, g, or t
  misc_feature (3663)..(3664): n is a, c, g, or t
  misc_feature (3675)..(3675): n is a, c, g, or t
  misc_feature (3679)..(3681): n is a, c, g, or t
  misc_feature (3685)..(3685): n is a, c, g, or t
  misc_feature (3687)..(3688): n is a, c, g, or t
  misc_feature (3693)..(3694): n is a, c, g, or t
  misc_feature (3697)..(3697): n is a, c, g, or t
  misc_feature (3699)..(3699): n is a, c, g, or t
  misc_feature (3710)..(3710): n is a, c, g, or t
  misc_feature (3712)..(3712): n is a, c, g, or t
  misc_feature (3716)..(3716): n is a, c, g, or t
  misc_feature (3720)..(3721): n is a, c, g, or t
  misc_feature (3730)..(3730): n is a, c, g, or t
  misc_feature (3734)..(3734): n is a, c, g, or t
  misc_feature (3739)..(3739): n is a, c, g, or t
  misc_feature (3742)..(3742): n is a, c, g, or t
  misc_feature (3751)..(3751): n is a, c, g, or t
  misc_feature (3754)..(3754): n is a, c, g, or t
  misc_feature (3774)..(3774): n is a, c, g, or t
  misc_feature (3779)..(3780): n is a, c, g, or t
  misc_feature (3787)..(3788): n is a, c, g, or t
  misc_feature (3790)..(3790): n is a, c, g, or t
  misc_feature (3798)..(3798): n is a, c, g, or t
  misc_feature (3802)..(3802): n is a, c, g, or t
  misc_feature (3805)..(3805): n is a, c, g, or t
  misc_feature (3808)..(3808): n is a, c, g, or t
  misc_feature (3816)..(3817): n is a, c, g, or t
  misc_feature (3820)..(3820): n is a, c, g, or t
  misc_feature (3825)..(3826): n is a, c, g, or t
  misc_feature (3828)..(3828): n is a, c, g, or t
  misc_feature (3830)..(3831): n is a, c, g, or t
  misc_feature (3833)..(3833): n is a, c, g, or t
  misc_feature (3839)..(3839): n is a, c, g, or t
  misc_feature (3849)..(3850): n is a, c, g, or t
  misc_feature (3854)..(3854): n is a, c, g, or t
  misc_feature (3864)..(3865): n is a, c, g, or t
  misc_feature (3868)..(3868): n is a, c, g, or t
  misc_feature (3874)..(3874): n is a, c, g, or t
  misc_feature (3877)..(3877): n is a, c, g, or t
  misc_feature (3882)..(3882): n is a, c, g, or t
  misc_feature (3886)..(3886): n is a, c, g, or t
  misc_feature (3890)..(3890): n is a, c, g, or t
  misc_feature (3898)..(3898): n is a, c, g, or t
  misc_feature (3900)..(3900): n is a, c, g, or t
  misc_feature (3904)..(3904): n is a, c, g, or t
  misc_feature (3916)..(3916): n is a, c, g, or t
  misc_feature (3925)..(3925): n is a, c, g, or t
  misc_feature (3985)..(3986): n is a, c, g, or t
aaggagatgctcattattccttggtctacccaagagcctctttttatggctgcaattatccccgcaggaacaccaataatgagggcaaataagattgcacagactccaagctcagcagtagcaggaaatagctcaaaaaactcctcaacgacaggcctattcgtgattaaagaggtgcccaaatctccatgaagtatgtcagtcaaatagtttagatactgttgccatatcggcttatcaaagccaagttgtgcgagaagttcagcgtgtctttctgtactcagtcctctttcaccagcaagaacctcaactgggtctccaggaagaaccctgataaagccaaaggcaaccagcgtgacgccaaagaatactggcaccagcaacattagacggttaattaaaaagcgaagcatagttactttgtgtgtggcttaaattggtaggctaaatagctactaaaaaaacacgtagctattaggtctaacaacttaaatataaattgacgcggatattagatatccgcgtcaaaatgttatttattttaggtcgacaccatcataaaagatgtggcttccaagtgggtgaactttaaatcctgtcacttcagcgcgaacaggtttaaatgcaactgagtgcgcaatagttacccatggtgcttcctctttgaagatctcctgtgctgcttcatataaaacagttctttcagcttgatcagttaactgtcttgcttcatttaggagagaatcaaattcctcatggcaccagcgtgcacggttaccaccagatttggcagcggcacaacctaataaaacacccatgaagttgtctggatcaccattgtctccagtccaacccaataacactgtgtcgtgttcgccagcatttgagcgcttgaggtactcaccccactcaaatgtaacaatttcagcgtcaacacctacagcagcccagtcagcctgaattagttcagccatacgacgggcgttagggttataaggacgctgaactggcatcgcccagatatttgtcttgagtccacttacaccagcggcgtctagcattgattttgcaccagctggatcataagcgtaatctctaaccgcatggttataagaccacatggttggtggaattgggttttttgcaacagagcccgcaccctcaaaaacgatatccaagattgcttgcttgttgatagccatgcttagagcttgacgaaccatcttttggtcaaatggcgccttctcagtgttaaatgctaagtaaccaacatttaagccttcttgttctaggacattgatttctggatctgcctgcatctctgcaacatcagcagggttaggataaggcatcacgtgacattctcctgccttaagtttttgataacgaacactagagtcagtagtgatagcaaaaactagcttatcaatgttagatctaccgtcccaatagtcatcaaaggcttcataacgaatcattgaatccttcttgtaagacttaaagacaaatgggcccgtaccaactggtttgaagtcaatatcagcttgattcccagaggcagtcaaattgtctgcatactcagctgataatattgaagcaaagtccatagctaaatttgaaacaaaaggtgattcaggcttagtcaaagtgaacttaactgtatggtcatcaattttatcaatggacccaattaatccatccatacccatccatccaaaatacaagtgctctccacctacagcataataaggatgatctttatcccactgtctgttgaagctaaacatgatgtcatctgcgttaaagtcacgagttggagtaaagtaaggtgttgaatggaacttgacacctttacgtaagttaaacgtgtactctagtccatcatcagatgcagaccaagattcagctaaaccagggattacttttgttgtgcctgtctcaaactggacaaggcgattgaaaatagtttgtgaagaagcgtcaaangtngtnccggctgagtaaagcgaaggtgtaaagccttcaggacttccttcagaacaaaaaaccattgttttggcttgtgctactccacttaatgccatactgagaccaagcccagcggcaagtagtgattttttcatatatttctccttaatttaatacctagtctggctaggttatagaattgctaaacaaaaaaancnannnannaaaannnttnntngntttnnnnnnannnnnnnnnnnnnaaaaannttngnnnangnnnttnnnntnntnnnannnnnnnnnnnnnnannaannnnnngnnantnaancnncnaannnnannnannttnaantnantnnnnnnnnnannnntnannnnnnnnnncnnnaantttnnnnnnnannnnnnnnnnanggnnntttnaannnnnnnnnngnannnnncnaannnnnnnnanncntnnnaanngnaannntnannaaannnnnnnnncnnncnnnnnnnngnnnttnnnannnnnnccnannntttnnannnnnnnannnntnnnccnnnangnnnnnannnnnnttnannnntnnnnnnnnannnannnnnnnnnnnnnnnnttttnggnnnnnnnnnngnnannnnnnaaaannnnnnttnaancnangncnnnnnnnannnnnnnnnannaaannnnnnnngnnnnnnntnannngnnnnnnnncttnnnnnnntnanttnnnnnnnnnntnnaaaaaannnannnncctncaantngnnncnnnannncnannantncnccannanntnttnnnnnnnnttngngntngnnnncnnntnnaannnnttnncnncnnnnntnangtnnnannnnncccaaggnnnnaccaaaaaannnancaataattncnanatnnaaaatantnntnccnatttttnacnttttnttttntngnanttnnnntnaannnnttttncangnnnantnntcccnnnnnaannnnnnccnnnnncctaatnaaaaaatggttncnnnnannnnnngnnaaancccnaatnnnaaattnngnaatnntnnnntnnnnnnaggntcctttnannnnnnnnngnnntacnngcccnnttttnaagaanttttnntnnntnnncaaatngactnnttnctttannnaanntttttnnnnngntttttanaatcttanttnnatcnnccnaaaaanccccngnntcatgntcntnaannnntnntnnnnnntcnaatangannggtnannagtcangtntttnnccnngnttcnnnnnaaaaccctcntttttnaagtnnncntntnantnnataannnntngncctctttncntnncannnccaaaaatntnannngttaaannaannntatnnnncggngnnnnntnnaannncntnacntnttnctnttnaatttcaatnnnnntttgancnntnnnncnnttaatnaacgttaanaaggattntttttntgnannattnanttngnagganntntcaangatttnnattaactcatcnanantcncaataatctntngnnnagganaannnantaganttnatanaantttatntnntntnnnaatggcctnatttgcncntattntttnanattntntntncnggaatnancnaanntnttcggggnnnngggaaaaggntnaaancttttncnncctttgagccntaannncttnannttccnnctntnaacccgtttanancttnaaanncataagggncttngtttntgntttcttcangcnatgtaggaataacaaagcgntcctnntaatttnntnttccaagntagnggnacntttcttcnnccncctcnnancnnancccagnatcacttagnncggncaaaaccttnntgncgtgcnctnttttntttntttnatgggctngnatanccagaagtttanttattgaantcaggatgggcttttcatctccagctgtaaacatattggcaaggtattgagctggcaggnncaaggaatttgctg

SEQ ID NO: 1329 - DNA, 4000 bp, Escherichia coli
  misc_feature (532)..(532): n is a, c, g, or t
  misc_feature (741)..(741): n is a, c, g, or t
  misc_feature (786)..(786): n is a, c, g, or t
  misc_feature (1041)..(1041): n is a, c, g, or t
  misc_feature (1175)..(1176): n is a, c, g, or t
  misc_feature (1332)..(1332): n is a, c, g, or t
  misc_feature (1989)..(1989): n is a, c, g, or t
  misc_feature (2890)..(2890): n is a, c, g, or t
  misc_feature (3184)..(3184): n is a, c, g, or t
  misc_feature (3603)..(3603): n is a, c, g, or t
  misc_feature (3621)..(3621): n is a, c, g, or t
agcagcattcgttagttcgattgcttctgcgcaaatatcgtacgataactcaaaaacagacgcctttggtgccggttacgtgcaagatggtaatgccaaggttgctccaggtggttccgctgtcagagctaatgacatcatcattaagcagacaggaactagtactaagctgattcctcaagacgccaaaatcatcattcgtttgcctaaaggcttgaattttgatggcagcccaagcttcctggtcacaccagcgacgcctactttaggcctcacgctgaaggacacaagtgaatttggtgatcctacattggatgatccaaaagttgagctgttcgacgccaataatgacggcggcatggaccgtgctgtagtcactgccgctgcagcagcaggtcatggcgattcgttgactatcagcataaatctgactgctgatgcgactgccaccaaaggtgctaaaaaagcatctgtaattgttaatggcggattggccgcaacccagtacgttgttgaagttgttgaaggtttnacagagccggttttctcggcttcaggtaaaagcctgacgtcgattgaccagagtcaacagacagcctctgttacttctgctttgttcacagtaacagtgcctaagggaacagctaataaagctaaacttacgtttactccacagtcaaaggtcaaattctcccctcagggaacgaccattacttatactgtaaacactcctcttacgangtacccatttaccgctgtttctagcactggtaccttcgcggctgntactggcacgccgtcattgtcattgactgtgtcaggtaccactactgctgatgtacaagtaacgttcaaagtttctcaggtacaatctgaggctggtggcagtactggtactcgtggcttggtgctttctggtgcagtatcaggtacagctgctctggttgatgtcaaagcaaatggctcttctgcagcgcttaccaaaggtacaaaagcagctcctaacaaaattaaggaaattgtagctggtagctctgttangcaaaccctgccaacgattgatatcactgaaaactttgatggtgatgcagttggatatgttgctgctggaaaaactggaacaattactcttactccaggaactggtttgaaatttaaaggtacaaatacaattnnagtaacaggcactggttggaccctcgaagcaccgagcgcatctattagcagcacaacaggtaaattaacactgtatttaggtaatgctactaatacagctggtgttggttctttgactgttactatttctggtataggagctacagctgacaaaancgcaactggtgacttgtcactgactgttggttcacccggtaacccagacaagtctacagcgcctagtaataagcttgtagtagcgaaggccactccacttggaactgtagatgttgctggtcctaagactaaagacctcaagacaactggccctggtggtgcagctgttacatcaactattacctttaaggaaactacttatggtgctctgacaacatcaaataagactgatgttcaggatgcttactttaggttgactcctacgaaggaaggttctatcaaggctgttactatcagcttcagtggctatcctagtggagctgctacacctactattagtgcatgttctgcagaaaataatgtaaccactggtgcatggatctgtaaaattacagctgagtcctccggtgttactgctggtacaagtactattagtgtgaaggtaaattactctgctggatccaagttcccagtaggtactacattggctatgaccattgatggtaattcaggtgtcagtggtactgttgatgtagctaatgttggtatagcaacttctgcaaaagcaggtgcaatcactgatgttaagccaggtgccacagaagcgaaggatttcgccaaagtgactatcactcctaaatatactaatgctattangcaaagtagggagttcaggttgcttgcgcctcagggtgtagctttccagaatgcttctgctacggctacagctagccctggtattgctacagcaaccattaccgcgacattcaatccgaatgacacgttggttatgactacgaagacaactgctacagtagtatttacaccgaaaggtattcttactagcggtaacaccggcttccagtcatttaccttggtagacggtaatattgatggttcacgtaaatctggtattactggtgaatctatcatcctagcttatggtgacggtactctgaaagctctggatgccggtgctaatggcagtgtaaatgtaggattccctgttaagaacactgttactggtggtcttaatattacggactacgtttacacagttaaatcaagtgatgccactattggctcaccaacaatcagcggtgatgtagttacagtacttggcaagaaaacaggtaatgcaactattaccgtaacagatggactgggtgctactgacacttacgtagttactgtaagcgatgctattgctcagcccgatgctgaaaaagcggcgaaaactgctgatggttctacaaccactgcaaccttcaaagctggtgcatctagcgatggtggtgccacatacgccactgaatttaccactgctgacgatgtcacactggtaggtacggtgaatgtagatgctgctgaccagggtaaagatggtgaagtctacatcgctattctgtctaaactggataacggaagctccatcctcgcctatatggatgagactggttctccgcagacttgggacggcacagttgctggccttggtgccaacgttgtagcaactccgcttgctgatacctataacctcacaatcttcagcggcacnctgggtgccggtactcacagggtggctctggcatactctactgaagacggtgatatcgtttatagtggtaaagcaatggtaattactgttaccgagtaatatcagtaagtagtattaaaaacggcaccttcgggtgccgtttttttttgtatggaatgcataaatacgatattgcgcaggtctaaaatgataatattccaactcttaaatattattgaaatgttagctaaagcatgaaaattaaagtctttgaacttatagcgtttgttatttcattcttctttaaccaggtgnttgcccaggatcttgatctatttcaggcggttgattcgccggaggagggtgaaaataacagccgtagggcacaaagaaatgaacgtgtgcgctcctcgccagcttttacattggtaggaactagccgttttggtgataactatgtagcgtcattaaaatccagagatggaaattctgtaattgttgaatgggagaaggacttaattaaagaaatccagggttttagtggatacggtttggttaatgttcaaagtcgtaaggtggcaatacgcttaccagaagatgatccatgcataccagctaaagacaaaggagttcaatgcaatggtgaacttgcaatactcactttaagtaacgcacaacctactgaaccgactatggaatctgaaacatcagttgtagagccaacagataatgangtttccggctcagatganaatgaggtaattgacaatgatcagaacgaaacaattacttttaccaatccatttaccggggaagaagaggaaaggcctgcattaacacctgaagagcaagctgaaagggaagctcgtcgacaaaggcgtgcagaacaattcaggaattttgaaatagtacgcataccagacaatgaaattcctgaaggaatgcaaagaatcagaacaccttttggcgatcgtctagaacctgtagaagagtaatatagagtttgttaagtatttctattgttacttataaaacagaaatagaaacaattgcacgcttaatagattccctgaaagtagcaattggaatattacctaccaattataaagtcgataagatttcatttgttga

SEQ ID NO: 1330 - DNA, 4000 bp, Escherichia coli
  misc_feature (1985)..(1985): n is a, c, g, or t
gttttctatgaacgtattgattattaattgctgatttaaatattactgttatttaatattattttcaaaaaaaagcataaaagaaaataattgaaaataatttttagttatataatctcattcacaaattaactttaagaaggaaatttaatttttgaatattaattttttttattccatcattaagaggatgtaaacttgctaataattgcgaacaattatttcaacaagcttttaatgatgctgttgatatagctaatgataaaactttaaatttagatagttataatatttttttacctttatttgataattcaaatttacctaatcaaaataataacacaaaataataacaatcaaccaaatgcaaataataatcaattgaaactgataatcttgatattattaatgatataagaaattatgattttgaatttcatcctgatcttaatggtcttgatactattataaccaagattatatatgttgaataacaattaagaaattttgactataatacacttcaaaaaatttgaagaagtaaatagctataaatcttattgaaaaactgttattttttaaagaaatttaataaaattaaaaaaaaataatcataaaaatatttatttttttattttattttattttattttttggattttctttattcctttattttattaaaatttaatacttgtaattatattaagcaataacgatatatatattaatgaagttcaaaaaaatatatatgtataattttattaataaaatataatagttgataaattaacaattacttattattatttattataattaaccataataacaaaaaaatataataataataataatggttgttgtaataacaataaataatttatttataatataaattattttaatttttaatttatattccattttatgaatacatttgttagataacgtatttaatatttaatgtagattgtttgttgtgaatcattaaaaatatattatattaatgtattgtataatattaattggttgattttattaaaaaggaatgattgaaaatacatacagaaaatgaattaatcaaatagtttaattataaatacattaattttattggttgatcaatattacaaataataatattataataattataaatataaataataattaaataattaaataattaaataatggaataattaaataatggaataataaataattgaataataaataaatagataaataaataaatagataaatatataattaaataataaataataaataataaatagtaaataataaataataatgaataataaataataaataattaaataataataaataattaattcaaccttttaaataattaatttttataatattttaaaataaaataatataataaaaaaaaaaaactgacagacgaaatagataattttatatttataatatttaataaaataaaaaaaatataaaaaaataaaatcgaaagaaaatagttatattttttattatattttacaaaaaagacaatggaaagaaataactacttgtttatttttataatattttaaaacataaaagaatacgaaagaaaaacataattttatttttttaattttaaaaaaaaaaaaaatatatatatatatatatatatatatatttatataattacaatattttaaataaaacttttttttggtaagataataagagcatgtaaaaaaaaaagaatatatatatggttacaataatttagctttgtttactaggaagagaatattcaataaatatatatatatttataataattttaagtctatggtatatttatttatatatatatagaatataattatattaaataaagttgattagtgaacaattaaggaaaaaatttatatttaaaatattatgaatataaaatattttgtttctttagtcattttttatttttttttttttttttntataacttaaataaaaaataaaaaataaaaaataataatatatatatatttattatttttaaatacattgataataagaataaactttgttatatcttgtataaatctcaaaaatttataaagtaacgaaaagaaaaatataagagcaaaaaatacgaataaaaggaaaagaaatagaaacaaataacacagaataaccaaaatttaaagtaataataaaaataaaaaattaaattgtaaacaaaagtttttttttttacacatatttaaaatgtaaaataaaattgaaataaacacatgtatagaataaaatattttgataataaagttcgactataaatattacaaagttgaaattaaatcgaaatcttttgaaggaagaataaaaatattttacatgtactaaaatatgatattaaacatgaaaatatggtatcaaaaatgaaagtagtaaacttaacaaaaaaaataattaatttataaacatatcaaacttatactacataaaaaattaaattaataatattataaataatataaaaaaataaaatcaaaataagaatttcaattgaaataaataaatataaataaacttattattttaataatttatatgtagaattgttgaaaaatattaatataattattatatttaattttaaagaattacttgtgttgtattctaatatataattttaattgtataattattttaggttaataataatagagattgaaaattaattaaaacaaaatgaaatacgattatgatgaaacaggagctaactttagctactttatattatcacttttaattcttttccttgttccatacacaatatattgtattaagaatcttggaggtattttattgttaaataataaaataatacaactaaaaattaaaaaagaaaaaaaagaaaaaagttttttaagaaaaaaatattcaataaaaatttaaaaaaaaaagtttctaaaagaaaattaataattaattatatattttaataggtaagaaaggacaatcaggtcatacagaggtattattaaatgaaaagaaaaaagcaagattaaacgcaaaaaaaagtgataaatcttcaggtttaaggtatataatgaaatttaaaaaattttattttttggctgtaattatttacaattttttttttttaatttatagatatgtattattaattggtggttggattttacttggattactagtttataaagtaatgaatactgaagttgattatgtcgaatgggatccttatcaaattatggaattaaagaaggtatattacaactattatttaatgcttgtttacataagatattaatatatatattttttatttttccttttttttttttaaaaaaaaaataataaataaattttatagtcagcaactccagctcaaattaaaaagcaatataagttacttggtctcaaatagtaaatattattttataataaaatttttaaaaaaaaagttctgttgaaaaaaatcataacgataatttaatattaatattaatataatatagtcacccagataaggttgaagaaaaagatagagctactgctgaagatcgttggatcgaaatcactaaagcttataaagtgtaaataatatttttaaaagtggaatattaataaatatttatataatcaataaaaattaattaattagatgcttataccgatttaatgatatttaataatatagtcttaccgatgatgaagctagaagaaactttgaagaatacggtcatccagatggcaaacaatgtaaataatatattatttatattaatatttatggtttgcttattaattaataatttaataaattaaaattaaaatagcattcagcttaggtattgctttaccagcttggcttgctgaatcaagtaattcatttattgtatgtaggctttaaataatatattgaaagaaatttaattatatcaaaatatttaaagtcattaattttttttttttttttttattt

SEQ ID NO: 1331 - DNA, 4000 bp, Escherichia coli
  misc_feature (1361)..(1361): n is a, c, g, or t
  misc_feature (1367)..(1367): n is a, c, g, or t
  misc_feature (1979)..(1980): n is a, c, g, or t
  misc_feature (1983)..(1983): n is a, c, g, or t
  misc_feature (1985)..(1985): n is a, c, g, or t
  misc_feature (1988)..(1988): n is a, c, g, or t
  misc_feature (1990)..(1990): n is a, c, g, or t
  misc_feature (1993)..(1993): n is a, c, g, or t
  misc_feature (1995)..(1995): n is a, c, g, or t
  misc_feature (1997)..(1997): n is a, c, g, or t
ccccatgtagtagtgtatttaatgtagtgagggatgaggttattgaaattggattaacacctaatcgggcagacgccatgagtcattttggtgtagctagagatttaaaagctggtttaaaacaacaaggtatatctaaagaacttatcactccttcagtgatgcagttttctgttgacaataggctttctactattcaagttaaggtagacacaccagaattagctccacgatattctggtattactattagtaatttaacagtaaaggaaagtcctgattggataaaaaacaggcttaaggctattgggcttaatcctattaacaatgttgtggatgcaacaaattatgtaatgcatgaattgggtcaaccactacacgcttttgatttagataaaattgaaggaaaaaaaataatcgttaaaacacttaaggaagggactaattttactacactagacgggattgaaagacagttatcttctgaagatttaatgatttgtgacgcaaaaaaacccatgtgtttagcgggtgtttttggagggcaagactcaggagttagtgaaaaaacatcagctattttcctagaatctgcctatttcaatccagtttctattagaaaatcagccaagaggcatgggctgagcacagatgcctcttttaggtttgaacgaggtattgatattaaccttgtagaagaaactttaaaaagagcagcgctactcattaaagaattaacagggggacaaatcagttcggatattgtagatctatacccgaaaaaagaggaaaattatcaggtgtttttgacctttaagagaatatattcactcataggagaagaaatccctacagacactattaagagtattttaagttcattagagattcgtgtaaacaatgtgacagaatctggactagggttaaccatccctttttatagagtagatgttcaaagagaagtagacgttattgaagaaattttgagggtttatggctacaacaatattcatttctcaaaaaaaataaatgcttctatcgcttttacagatccaaaatcagatcatattattcaaaataaaattggtgattcattagcagctcaaggatttcatgagattttaaccaactccctcacttctcctaagccactacaatatactcaagatattgacctacaacagtcagtaaatatattgaatccattgagtaatgacttaagtatattaaaaacttcaatgttatttacgggcttagaaactgtttcctataatattaatagaaaaacaaatcgtttaaaactatttgaatttggtaagacttaccaccaaatcgaagaaaatagaatagaacataagcanttaagnatcttaatgacgggaaaaaaagctcctgagaattggttaagttcaggtgaaaagtttagcttctttgaccttaaatctattgtagaaaacatattggaaaggttaggtattcaaaaatggaaaatctcaaaagcctcttctgaccttttttcagaaggtataagttacaatggcagaaaggaaactcttgttacctttggggtactctccaataagcttcttaaaaaattagacataaaacaggaagttctttatgctgattttaattgggattcaattcttaaatctcttacaaaagaagcaatgaaatttaaagaaattcctaagtttcctgaagtatctagagatttcgccctattgatcaaaaacaatgtaacttttgaacaggtagctaaaactgctaaaaatactgaaaaaaaatatttaaaagaggtagggttattcgatgtgtatacaggaaataatttacccgaaggcactaagtcttatggtgttaattttatactccaagacccaaatgctacactagaagaaaagcaaatagacaaaataatgcaaaagctccaatctgcttttgaaaaagacttggaagctacgcttagataaaaaaannccntnttnanaangngnttttttttatctaagactatagctgatacattttctctcgttgcaccttaatgtctttatctgacatataatcgtcaaaactcaggtacctatctatgacccctttaggggttatttcaactaccctattggctactgtttgtgcaaattcatgatcatgagtggtcattaataaagttcctttaaaagcttttaaagagttgttaaatgcggtaatactctctaaatctaaatgatttgttggctcgtctaacataagtacatttgcgcgaagcatcatcattctactaagcatacaccttactttttctcctccagacaaaacagtggctttttttaatgcctcttctccactgaatagcattttccctagaaacccccttatgtgtacttcttctctttcctcttcggttttagcccactgtctcaaccaatctaccaaattactttctgttttaaaaaactcagaattatctgctggtaaataggattgattggttgtaacaccccattggtagtggccactttctgcttttttatttccgtttataatttcataaaaagcagaggtagctctggcatctttagaaaaaacaaccaccttatctccctttgcgaggttaagatctactcctttaaacaacaaatcgccatcttcagaaaatgcactcaaattttccacatttaagatttggtctcctgcctctctttctctctcaaaaattattgcagggtaccttctcgaagagggtttaatgtcgtctacttttaattttgaaagcattttttttctagaggtagcttgcttacttttagcaacgttagcgctaaacctcataataaactcttgaagctctttggccttttcttctgcttttttgttttgttgtgccctttgtcttaaagccaactggctactctcataccaaaaagtgtaattacctgaataaaggtttaattttccgaaatcaatatctgcaatatgggtgcagactgcatctaaaaagtgtctgtcgtgagatacaactataaccgtgttttcataatctgccagaaaattttctaaccatgagatggtttcataatctaaatcgttagtaggctcatccatgatcaatacatctggatttccaaataaggcttgtgccaacaatacccttacttttaatttggggtctaaatctgacattaaagtataatgaaaagactcattaataccaagattagagagcattgcagcagcgtcactgtctgcattccaaccattcatctcttcaaattgaacttgcaactcccctattctatctgcgtttttgtcatcataatcagcatataggctgtcaatttcattcttaatatcgaataaaggcttatttccttttaccacagtttcaagaacggtattactgtcataagcgttatgattctgctctaagatagacatgcgtttccctggctctaagtgaacgtgacccgagcttggctctaactgtttggataagaacttcaaaaaagtagattttccggcaccatttgcgccaataatcccgtagcaattgccctgaagaaaggctacgttcacctcgtcaaataatacgcgtttcccaaattgaatggataaattagatactgataacatagaagtatttaaagtttttgcaaaagtattaatttatattttgctgggctttgtttatggctactaataaataagaatagtcataaagcggggtcatattaagaagctagcattaggttttttaacttgaccttaacaatattggctatggtccatttgtacctttgtgtcataggattatttatgaaaaaaggattcttaatattagtctgcgtgttagcatacagttgtggtgtcattgacaagcgcccctctcccgtatattttgggggagaaattgtcaatcctactaatccttatgtggtgttgtttaaagacgaccaagtcattgattctgccaaattagacagaagcaatcgcttta

SEQ ID NO: 1332 - DNA, 4000 bp, Escherichia coli
  misc_feature (752)..(752): n is a, c, g, or t
  misc_feature (788)..(788): n is a, c, g, or t
  misc_feature (1007)..(1007): n is a, c, g, or t
  misc_feature (1031)..(1031): n is a, c, g, or t
  misc_feature (1034)..(1034): n is a, c, g, or t
  misc_feature (3344)..(3344): n is a, c, g, or t
  misc_feature (3428)..(3428): n is a, c, g, or t
  misc_feature (3440)..(3440): n is a, c, g, or t
  misc_feature (3449)..(3449): n is a, c, g, or t
  misc_feature (3602)..(3602): n is a, c, g, or t
  misc_feature (3608)..(3608): n is a, c, g, or t
  misc_feature (3917)..(3917): n is a, c, g, or t
cagtgccgttagcgaaggtgtaggtgtagacggtcttgccgttttcacccttagcgctttcctgacgcataatgcgcgagttctgcaggaacttaaccggcaggttgttagcccaaatgttgcggtagaaggcgctctggtcttggtggccagtccagccctcaaactcaacaatctgggggtagcccaaaactacgttggggttccagttgtccttgttggagttgtccacaaagcggatcacgtcagagttcaaacccttgttggtggcgccgccatagttttcatcattggaccagtgcgaccaggtggagtagcgctcaaagcggtcagcccactctgaacccatttcccaacccatcttgtttagctcgcggcccaggcgctcagcttgccagcccgaaccgtagtaaacgtcaatgtagatccagcggaagttggggtaggtagccagcgggaactggttacgcaggtcttggaaacgcttaattaccgcgccgctacctagatcagcgcgctgatcaacgtagtaggactggtttagccagttccagccgcgcccgccagtgaagggtagggaaccgaaagagttggcttcggggtaggcctcagtggtgttgacgtggacgccgtaaatcgcgttggagttggcggtggtgttaaacagggtggcaaagtccttgtcaccaccggcgcgggtgttgatgttgcccgcgtagtccatgtgtccagagtcgtggccttcagaagcntaacccttgagcatcacgcgctgacctaggccgtcngtagccaggttgacgcgctttacgtcgtcggctacctgcaagaaggggtgcgtggcggccgagccgaagtcaaagggaatatgggttactacccacttgtggttgtcagctgcaccggccacccagggggtgatgtccgcataggcgacggcggcatcctgccagttcaccgtgcccgaggagttggcgtcaccggtgaacaccaaagtggtgtagggncgctcttcatcgccgacggcgtcngtngctgcagctgagcggtaggtccactggccgttggaggccagcagggtcttagaaccatcctggtcaactacccggcgcttccagcgcgaaccgtcgtcagcttcccagccggtggggcggtcataggtggcgttggtttccatacccacggccaccttagaggtgttaaccatcaggtaggtactgggggcgtcagcgtcgctgaccggggtggactcgcttaggctctcaatagtgtcagccacgccagcgtatttgttcttagcgctagcgccacgcgaaaccagggtgataccggcagcgtaggcgccgccgtctttagcgctaaccgataccaggccatggccgggaatctcgacggtgtgggcgccaccggtgagctcagtgatacggaaggttagggtgggacgcttggcaccagttgtgccctgggcctttgaagtaatctcctttacttcaatttcggccttcatggtgacgtcagtgtcattgaagtcaaccgtgtaggccaccttggtgttggattctttaactgcctgcaccgacttgacggtgtaagcctgattgtcaatcagtactgaatcgaggacctgggtgcggccgccaactttattgcccgcgaaggtgtagccaagtacctgggggaaggcgttggatacggtcgcggtcaagttaccggcgctaatggtctccggagcactaatgacaccagaagtttccggggtcactgcgccagcagctgcccctggaagggatagggcgacaacccctagcaatgctagggaccgtcggtggaggtgtcttaccttcatcgtgtagggctcctttgcctagacgtggttgacccaattttgtccttttgcaacaaaaagcgtcaagtctaagcagaaccgaacagcataagttgcaaccaaacagttacaaatctggtttgagctaataatttaactagcgcctactgcgcgcatttgttcgtttattgtaaagactgttttgcacacaaaccgaaaagcttggggtagtccatgtaccacagcttcattgccgcctgtacatgggaacaccgccgccagtgagcaacacgcactatagccagggtgatgagctagctataacggaacactcgcagtagcggcggtgcggcgatagattaccttggtttttactagtaattccagtacctaaacctcattttttgcactttcttttaggccaaaagtgtttctgcaggccagcaagttacaagtagtcgcaaatcactttatatgtgggctaattaactaaaaacggtgctgagcgggtctaaacccacccagcaccgtcgaattagttaaaagcgcaggtcactccgcactggcggcgctagcagccgaaccggccacagccgcaccgggaattagcgtcagaccgtcgtcggcaacgtcaaccgtaacctgctggccgtcagcaacctggccggccaagatcaggcgggccaagcggtcaccaatctcacgctgcaccaggcgacgcagcgggcgagccccgtaagccgggtcgtagccctcgtcagccagccaagtgcgggcggcgtcggtaacatccaggctgatgcggcggtcagacagacgcttgctcatcttgcttagctgcaagcccacaatctggcccaactcatccttgctcagcgcattaaagatcagcacatcgtcaaggcggttgaggaactcaggcttgaaggcggcgcgcaccgtagccataacgttctcgcgcttttcctcctggctcagcgccgggtctaccaggaactggctacccaggttggaggtcaggatcaagatgacgttacggaagtccaccgtgcgtccctggccgtcagttaggcgaccgtcgtcgagcacctgcagcaagatgtcaaagacctcagggtgggccttttccacctcatctagcagcaccacagagtaggggcgacgacgcaccgcctcggtcagctgaccgccctcttcgtagcctacgtacccgggaggggcacccactaggcgcgaaaccgagtgcttctcggagtattcgctcatgtcgatacgcacaatggcgtgctcgtcatcgaagaggaactcagccagggccttggccagctcggtcttacctacaccggtggggcctaggaacatgaaggaaccggtggggcggtcagggtcagaaaccccggcgcgcgagcggcgcacagcgtcggccacagccgcaaccgcgtccttctggccgattaggcgcgagcctacctgctcttccatgtgcagcagcttttcgctttcgccctgcatcagcttncctaccggaatgccggtccaagaagagataacctcagcgatctcctcagggccaaccttctcagcgatcatcggctcgccagcntcaggctggttntgctcactngcttcagcctcagcgatttgacgctgcaagctgggcatttcgccgtagcggatacgtccggcggcctcaaagtcaccttcacgctcagccagttcggcgcgggtacgcagctcatctagctgggcgcgcagctcaccgatgcggttgtgaccngccttntgggcttcccagcgggcgtttagggcgctgagttcttcgtttaggtcagccaggcgggcacgcaaggcagccaggcgctctgccgcgccggcgtcggcctcatcttccttggcgctggaatcagccaggtaggcttcttccatctttaggcggtctacgcgacggcgcagctcgtcaatttccaccggggaggagtccagctccatgcgcaggcgggaagcagcctcatcaaccaggtcaatggccttgtcgggcagttggcggccggtgatgtagcggtctgacaggctggcggcagccaccagggcnccgtcggagatggtcacgtggtggtgtgcctcgtacttgggggcgataccacgcaagatggccacggtgtcagccacggaggg

SEQ ID NO: 1333 - DNA, 4000 bp, Escherichia coli
  misc_feature (29)..(29): n is a, c, g, or t
  misc_feature (40)..(40): n is a, c, g, or t
  misc_feature (88)..(89): n is a, c, g, or t
  misc_feature (91)..(91): n is a, c, g, or t
  misc_feature (94)..(94): n is a, c, g, or t
  misc_feature (96)..(96): n is a, c, g, or t
  misc_feature (101)..(101): n is a, c, g, or t
  misc_feature (103)..(105): n is a, c, g, or t
  misc_feature (107)..(109): n is a, c, g, or t
  misc_feature (111)..(111): n is a, c, g, or t
  misc_feature (117)..(117): n is a, c, g, or t
  misc_feature (119)..(119): n is a, c, g, or t
  misc_feature (123)..(123): n is a, c, g, or t
  misc_feature (125)..(125): n is a, c, g, or t
  misc_feature (128)..(128): n is a, c, g, or t
  misc_feature (131)..(131): n is a, c, g, or t
  misc_feature (133)..(133): n is a, c, g, or t
  misc_feature (135)..(138): n is a, c, g, or t
  misc_feature (141)..(141): n is a, c, g, or t
  misc_feature (143)..(145): n is a, c, g, or t
  misc_feature (147)..(147): n is a, c, g, or t
  misc_feature (149)..(149): n is a, c, g, or t
  misc_feature (158)..(158): n is a, c, g, or t
  misc_feature (160)..(160): n is a, c, g, or t
  misc_feature (162)..(165): n is a, c, g, or t
  misc_feature (171)..(174): n is a, c, g, or t
  misc_feature (178)..(178): n is a, c, g, or t
  misc_feature (180)..(181): n is a, c, g, or t
  misc_feature (185)..(186): n is a, c, g, or t
  misc_feature (188)..(188): n is a, c, g, or t
  misc_feature (190)..(190): n is a, c, g, or t
  misc_feature (195)..(196): n is a, c, g, or t
  misc_feature (198)..(198): n is a, c, g, or t
  misc_feature (201)..(201): n is a, c, g, or t
  misc_feature (208)..(210): n is a, c, g, or t
  misc_feature (214)..(214): n is a, c, g, or t
  misc_feature (216)..(216): n is a, c, g, or t
  misc_feature (218)..(218): n is a, c, g, or t
  misc_feature (220)..(221): n is a, c, g, or t
  misc_feature (224)..(225): n is a, c, g, or t
  misc_feature (230)..(231): n is a, c, g, or t
  misc_feature (234)..(239): n is a, c, g, or t
  misc_feature (242)..(243): n is a, c, g, or t
  misc_feature (245)..(248): n is a, c, g, or t
  misc_feature (251)..(256): n is a, c, g, or t
  misc_feature (260)..(260): n is a, c, g, or t
  misc_feature (262)..(262): n is a, c, g, or t
  misc_feature (266)..(267): n is a, c, g, or t
  misc_feature (269)..(270): n is a, c, g, or t
  misc_feature (272)..(272): n is a, c, g, or t
  misc_feature (274)..(274): n is a, c, g, or t
  misc_feature (276)..(276): n is a, c, g, or t
  misc_feature (280)..(280): n is a, c, g, or t
  misc_feature (282)..(284): n is a, c, g, or t
  misc_feature (286)..(288): n is a, c, g, or t
  misc_feature (290)..(292): n is a, c, g, or t
  misc_feature (294)..(295): n is a, c, g, or t
  misc_feature (299)..(300): n is a, c, g, or t
  misc_feature (303)..(305): n is a, c, g, or t
  misc_feature (307)..(307): n is a, c, g, or t
  misc_feature (310)..(311): n is a, c, g, or t
  misc_feature (313)..(314): n is a, c, g, or t
  misc_feature (317)..(317): n is a, c, g, or t
  misc_feature (319)..(319): n is a, c, g, or t
  misc_feature (321)..(321): n is a, c, g, or t
  misc_feature (328)..(330): n is a, c, g, or t
  misc_feature (333)..(334): n is a, c, g, or t
  misc_feature (336)..(338): n is a, c, g, or t
  misc_feature (342)..(346): n is a, c, g, or t
  misc_feature (348)..(348): n is a, c, g, or t
  misc_feature (352)..(352): n is a, c, g, or t
  misc_feature (354)..(354): n is a, c, g, or t
  misc_feature (356)..(359): n is a, c, g, or t
  misc_feature (361)..(361): n is a, c, g, or t
  misc_feature (363)..(367): n is a, c, g, or t
  misc_feature (369)..(369): n is a, c, g, or t
  misc_feature (375)..(376): n is a, c, g, or t
  misc_feature (378)..(379): n is a, c, g, or t
  misc_feature (383)..(384): n is a, c, g, or t
  misc_feature (387)..(388): n is a, c, g, or t
  misc_feature (390)..(390): n is a, c, g, or t
  misc_feature (393)..(393): n is a, c, g, or t
  misc_feature (395)..(396): n is a, c, g, or t
  misc_feature (398)..(398): n is a, c, g, or t
  misc_feature (403)..(403): n is a, c, g, or t
  misc_feature (407)..(407): n is a, c, g, or t
  misc_feature (409)..(409): n is a, c, g, or t
  misc_feature (412)..(415): n is a, c, g, or t
  misc_feature (420)..(420): n is a, c, g, or t
  misc_feature (422)..(422): n is a, c, g, or t
  misc_feature (426)..(427): n is a, c, g, or t
  misc_feature (431)..(431): n is a, c, g, or t
  misc_feature (435)..(435): n is a, c, g, or t
  misc_feature (437)..(437): n is a, c, g, or t
  misc_feature (439)..(440): n is a, c, g, or t
  misc_feature (443)..(444): n is a, c, g, or t
  misc_feature (447)..(449): n is a, c, g, or t
  misc_feature (451)..(451): n is a, c, g, or t
  misc_feature (453)..(455): n is a, c, g, or t
  misc_feature (457)..(458): n is a, c, g, or t
  misc_feature (460)..(461): n is a, c, g, or t
  misc_feature (463)..(463): n is a, c, g, or t
  misc_feature (467)..(467): n is a, c, g, or t
  misc_feature (471)..(475): n is a, c, g, or t
  misc_feature (477)..(480): n is a, c, g, or t
  misc_feature (483)..(484): n is a, c, g, or t
  misc_feature (487)..(490): n is a, c, g, or t
  misc_feature (493)..(501): n is a, c, g, or t
  misc_feature (507)..(507): n is a, c, g, or t
  misc_feature (509)..(510): n is a, c, g, or t
  misc_feature (512)..(512): n is a, c, g, or t
  misc_feature (514)..(515): n is a, c, g, or t
  misc_feature (517)..(518): n is a, c, g, or t
  misc_feature (522)..(523): n is a, c, g, or t
  misc_feature (527)..(528): n is a, c, g, or t
  misc_feature (533)..(541): n is a, c, g, or t
  misc_feature (544)..(544): n is a, c, g, or t
  misc_feature (548)..(548): n is a, c, g, or t
  misc_feature (550)..(551): n is a, c, g, or t
  misc_feature (553)..(553): n is a, c, g, or t
  misc_feature (556)..(558): n is a, c, g, or t
  misc_feature (561)..(569): n is a, c, g, or t
  misc_feature (571)..(576): n is a, c, g, or t
  misc_feature (579)..(588): n is a, c, g, or t
  misc_feature (590)..(599): n is a, c, g, or t
  misc_feature (601)..(601): n is a, c, g, or t
  misc_feature (603)..(604): n is a, c, g, or t
  misc_feature (606)..(607): n is a, c, g, or t
  misc_feature (609)..(610): n is a, c, g, or t
  misc_feature (613)..(615): n is a, c, g, or t
  misc_feature (618)..(620): n is a, c, g, or t
  misc_feature (622)..(623): n is a, c, g, or t
  misc_feature (625)..(626): n is a, c, g, or t
  misc_feature (628)..(628): n is a, c, g, or t
  misc_feature (630)..(630): n is a, c, g, or t
  misc_feature (632)..(639): n is a, c, g, or t
  misc_feature (641)..(645): n is a, c, g, or t
  misc_feature (647)..(648): n is a, c, g, or t
  misc_feature (650)..(654): n is a, c, g, or t
  misc_feature (656)..(657): n is a, c, g, or t
  misc_feature (660)..(671): n is a, c, g, or t
  misc_feature (673)..(675): n is a, c, g, or t
  misc_feature (677)..(679): n is a, c, g, or t
  misc_feature (681)..(682): n is a, c, g, or t
  misc_feature (684)..(687): n is a, c, g, or t
  misc_feature (689)..(690): n is a, c, g, or t
  misc_feature (692)..(693): n is a, c, g, or t
  misc_feature (695)..(695): n is a, c, g, or t
  misc_feature (699)..(707): n is a, c, g, or t
  misc_feature (711)..(716): n is a, c, g, or t
  misc_feature (718)..(720): n is a, c, g, or t
  misc_feature (723)..(727): n is a, c, g, or t
  misc_feature (729)..(729): n is a, c, g, or t
  misc_feature (731)..(731): n is a, c, g, or t
  misc_feature (733)..(734): n is a, c, g, or t
  misc_feature (738)..(741): n is a, c, g, or t
  misc_feature (743)..(747): n is a, c, g, or t
  misc_feature (749)..(749): n is a, c, g, or t
  misc_feature (752)..(757): n is a, c, g, or t
  misc_feature (759)..(762): n is a, c, g, or t
  misc_feature (764)..(767): n is a, c, g, or t
  misc_feature (770)..(772): n is a, c, g, or t
  misc_feature (774)..(774): n is a, c, g, or t
  misc_feature (776)..(776): n is a, c, g, or t
  misc_feature (778)..(778): n is a, c, g, or t
  misc_feature (780)..(780): n is a, c, g, or t
  misc_feature (784)..(784): n is a, c, g, or t
  misc_feature (788)..(790): n is a, c, g, or t
  misc_feature (792)..(797): n is a, c, g, or t
  misc_feature (799)..(808): n is a, c, g, or t
  misc_feature (810)..(812): n is a, c, g, or t
  misc_feature (814)..(815): n is a, c, g, or t
  misc_feature (817)..(819): n is a, c, g, or t
  misc_feature (823)..(827): n is a, c, g, or t
  misc_feature (831)..(840): n is a, c, g, or t
  misc_feature (843)..(844): n is a, c, g, or t
  misc_feature (846)..(847): n is a, c, g, or t
  misc_feature (850)..(851): n is a, c, g, or t
  misc_feature (853)..(854): n is a, c, g, or t
  misc_feature (857)..(857): n is a, c, g, or t
  misc_feature (859)..(860): n is a, c, g, or t
  misc_feature (863)..(867): n is a, c, g, or t
  misc_feature (869)..(869): n is a, c, g, or t
  misc_feature (871)..(871): n is a, c, g, or t
  misc_feature (873)..(873): n is a, c, g, or t
  misc_feature (875)..(877): n is a, c, g, or t
  misc_feature (880)..(880): n is a, c, g, or t
  misc_feature (883)..(883): n is a, c, g, or t
  misc_feature (885)..(886): n is a, c, g, or t
  misc_feature (890)..(893): n is a, c, g, or t
  misc_feature (895)..(897): n is a, c, g, or t
  misc_feature (899)..(904): n is a, c, g, or t
  misc_feature (907)..(908): n is a, c, g, or t
  misc_feature (910)..(912): n is a, c, g, or t
  misc_feature (914)..(914): n is a, c, g, or t
  misc_feature (917)..(920): n is a, c, g, or t
  misc_feature (922)..(923): n is a, c, g, or t
  misc_feature (925)..(925): n is a, c, g, or t
  misc_feature (927)..(927): n is a, c, g, or t
  misc_feature (929)..(929): n is a, c, g, or t
  misc_feature (935)..(940): n is a, c, g, or t
  misc_feature (942)..(942): n is a, c, g, or t
  misc_feature (946)..(948): n is a, c, g, or t
  misc_feature (950)..(951): n is a, c, g, or t
  misc_feature (955)..(956): n is a, c, g, or t
  misc_feature (958)..(958): n is a, c, g, or t
  misc_feature (960)..(961): n is a, c, g, or t
  misc_feature (963)..(966): n is a, c, g, or t
  misc_feature (969)..(972): n is a, c, g, or t
  misc_feature (974)..(974): n is a, c, g, or t
  misc_feature (976)..(976): n is a, c, g, or t
  misc_feature (978)..(979): n is a, c, g, or t
  misc_feature (982)..(982): n is a, c, g, or t
  misc_feature (986)..(986): n is a, c, g, or t
  misc_feature (997)..(997): n is a, c, g, or t
  misc_feature (1022)..(1022): n is a, c, g, or t
  misc_feature (1025)..(1025): n is a, c, g, or t
  misc_feature (1028)..(1028): n is a, c, g, or t
  misc_feature (1037)..(1037): n is a, c, g, or t
  misc_feature (1039)..(1041): n is a, c, g, or t
  misc_feature (1045)..(1046): n is a, c, g, or t
  misc_feature (1051)..(1051): n is a, c, g, or t
  misc_feature (1058)..(1059): n is a, c, g, or t
  misc_feature (1062)..(1062): n is a, c, g, or t
  misc_feature (1064)..(1064): n is a, c, g, or t
  misc_feature (1081)..(1082): n is a, c, g, or t
  misc_feature (1085)..(1085): n is a, c, g, or t
  misc_feature (1091)..(1091): n is a, c, g, or t
  misc_feature (1093)..(1095): n is a, c, g, or t
  misc_feature (1097)..(1097): n is a, c, g, or t
  misc_feature (1100)..(1100): n is a, c, g, or t
  misc_feature (1121)..(1121): n is a, c, g, or t
  misc_feature (1127)..(1127): n is a, c, g, or t
  misc_feature (1133)..(1133): n is a, c, g, or t
  misc_feature (1139)..(1139): n is a, c, g, or t
  misc_feature (1143)..(1144): n is a, c, g, or t
  misc_feature (1155)..(1155): n is a, c, g, or t
  misc_feature (1157)..(1158): n is a, c, g, or t
  misc_feature (1160)..(1160): n is a, c, g, or t
  misc_feature (1173)..(1173): n is a, c, g, or t
  misc_feature (1175)..(1175): n is a, c, g, or t
  misc_feature (1178)..(1178): n is a, c, g, or t
  misc_feature (1181)..(1181): n is a, c, g, or t
  misc_feature (1187)..(1187): n is a, c, g, or t
  misc_feature (1194)..(1194): n is a, c, g, or t
  misc_feature (1197)..(1197): n is a, c, g, or t
  misc_feature (1201)..(1201): n is a, c, g, or t
  misc_feature (1212)..(1212): n is a, c, g, or t
  misc_feature (1219)..(1219): n is a, c, g, or t
  misc_feature (1225)..(1226): n is a, c, g, or t
  misc_feature (1241)..(1241): n is a, c, g, or t
  misc_feature (1246)..(1246): n is a, c, g, or t
  misc_feature (1250)..(1251): n is a, c, g, or t
  misc_feature (1256)..(1256): n is a, c, g, or t
  misc_feature (1265)..(1265): n is a, c, g, or t
  misc_feature (1276)..(1277): n is a, c, g, or t
  misc_feature (1287)..(1288): n is a, c, g, or t
  misc_feature (1292)..(1292): n is a, c, g, or t
  misc_feature (1295)..(1296): n is a, c, g, or t
  misc_feature (1302)..(1305): n is a, c, g, or t
  misc_feature (1311)..(1311): n is a, c, g, or t
  misc_feature (1313)..(1313): n is a, c, g, or t
  misc_feature (1322)..(1322): n is a, c, g, or t
  misc_feature (1328)..(1328): n is a, c, g, or t
  misc_feature (1332)..(1332): n is a, c, g, or t
  misc_feature (1340)..(1340): n is a, c, g, or t
  misc_feature (1347)..(1347): n is a, c, g, or t
  misc_feature (1355)..(1355): n is a, c, g, or t
  misc_feature (1364)..(1365): n is a, c, g, or t
  misc_feature (1367)..(1367): n is a, c, g, or t
  misc_feature (1379)..(1379): n is a, c, g, or t
  misc_feature (1418)..(1418): n is a, c, g, or t
  misc_feature (1431)..(1433): n is a, c, g, or t
  misc_feature (1449)..(1449): n is a, c, g, or t
  misc_feature (1455)..(1455): n is a, c, g, or t
  misc_feature (1467)..(1467): n is a, c, g, or t
  misc_feature (1474)..(1474): n is a, c, g, or t
  misc_feature (1485)..(1485): n is a, c, g, or t
  misc_feature (1512)..(1512): n is a, c, g, or t
  misc_feature (1528)..(1528): n is a, c, g, or t
  misc_feature (1539)..(1539): n is a, c, g, or t
  misc_feature (1542)..(1542): n is a, c, g, or t
  misc_feature (1550)..(1550): n is a, c, g, or t
  misc_feature (1556)..(1556): n is a, c, g, or t
  misc_feature (1564)..(1564): n is a, c, g, or t
  misc_feature (1606)..(1606): n is a, c, g, or t
  misc_feature (1632)..(1632): n is a, c, g, or t
  misc_feature (1784)..(1784): n is a, c, g, or t
  misc_feature (1791)..(1791): n is a, c, g, or t
  misc_feature (1793)..(1793): n is a, c, g, or t
  misc_feature (1798)..(1798): n is a, c, g, or t
  misc_feature (1800)..(1800): n is a, c, g, or t
  misc_feature (1827)..(1827): n is a, c, g, or t
  misc_feature (1992)..(1992): n is a, c, g, or t
  misc_feature (2017)..(2017): n is a, c, g, or t
  misc_feature (2022)..(2022): n is a, c, g, or t
aagcacttggcgtagatactgacgaaaanaaacttttaanattaagtttatctatggtagacgatgttgcaagaacagtttcagattnnanganangttanannnannnanatgaanangacnanganaangnannnnaantnnnantngtaattganantnnnngtatgnnnntaanannaacnnananagatnngnttnaaaaagnnnaaangnangnnganntaggnngannnnnnaanncnnnnacnnnnnnagtncntaanngnntnantntgtntnnntnnngnnncnntggnnttnnngnaannanncanananacgcatnnnaanntnnntttnnnnntnatgntnannnntnannnnnanaagganntnnatanncanntncantnntnattgnaatnanaannnnaaaantnaaannagangaanangnnaannaannnanannnannanngntatnagannnnntnnnnaannaannnnaannnnnnnnncaaaancnntngnntnngtannagtnnaaatnnnnnnnnnaanaggnanngntcnnnatnnnnnnnnngnnnnnntannnnnnnnnnannnnnnnnnnanannannannaannngannnanntnnananannnnnnnngnnnnnannannnnnannttnnnnnnnnnnnngnnngnnncnnannnnanntnntnatgnnnnnnnnngatnnnnnnannntannnnnancnanngaannnnannnnnanaannnnnncnnnnannnntcnnnanantntngaangcannngnnnnnnannnnnnnnnnannnannannnagannnnnatannnnnnnnnnaanntnnttnnannatntnnagnnnnnanangngnnnatnaanannatannnnannntnnnnnnaanntnnnanaannnnannananantattannnnnntntatnnngnncaannanannannnntannnnantnannaanaatnaattggtatancgaagtaagtagaaatttagataanatnccngattgtatnannnattnngatanagaattnntanangcaaaaaaagaaattannatntttggnannntnganaaagcaagtgcttctttaccnggtatngttgancaaagntttnnacaattacaananntngaagcaatattanantanctnaatatngaattangangtanaagatcaaaancatttanaaaatnntttgaacattacaanagagnattnnatagnagagaagcngaaaaatatgnngacggtgaannagangtnnttgatnnnnaaaaantnataaacgantttgcnttantaagaaancaatggntaggcatnaccaaaggnntngatcaaaaacantggcaaataacaaacattgttaaactacgagtagcaggnatggaagatgccnnnatcaaatagaataatncttacngacgtagacggngtattantagaatgggancaccattttactaaatggatgttacancgaacactctttgatnaaaaaggaagnagntatcaccnatatanattgttanaagataaagaaaacacttacgaaatggcagaacgttttggtnttactataccagaaattagaaaaganattagagagtttaacagaagtgcttggatgggaacacaacggcctatgccagattcacaaacttgggttaaactactacacgcagaaggttggacttttataccaattacatcacaaacatctgacaaaccagcacaagaattacgtaaaanacgactngnagaantntttggcaaacaagttttttcaaactancacatattaggtacaggagcagataaagattcagcattagcagagtttcacaacacagggttatattgggtcgaggacaagcctaagaacgctttagccgggctcaattacggtttaaaggttatattatacaatcgtccttacaaccaaaacttcggccatccngaaattactagagtaaataattggnaaganatacaccaaattttatcaggaagaaaatgacaacagacataccaacaatatacgtaggatacgatccaagagaagacgaaccttatgaagtactaaaatatacagcacaaaaacacgcatcgggtccaataaacgtatacccgatcaagcaagatttattaagacgaataggattatatagacgagcatggcaattaggcagttcagcactaccaagtcctgtagatcctaaaaatgatatacaacacagagatcaatcagatggcagaccatttgctactgacttttcattttcaagatttttaacaccatttttacatagattagaaggttgggcagtgtttatggactgtgatatgtattttagaagtgatcctttagagttatttgaaaaatacaatgatccgggatatgcgatgtattgtattaaacataatcatacccaagcatcaaacgaaacccataaaatgtatggtaatgaacaatacaattataatcgtaaaaactggtcttcagtaataatgtataattgtagtcatccagcacacaaatatcttactgtggatgatgtaagtacaaaatcaggaagatggttgcatagatttgaatggattgaagactatgctcgtgcaaacaatcttaagtttgatgaccttataggtaatctaccagaagaatggaactggttagatggacatagttcagcagatattgatgctaaaaatgttcacttcacaagaggtggcccgtggttcagaggacaaatatgggaaccacttgatgaacaatcagaaaaatatgcagtggaatgggaatctataagagacgaatatagagaatctaaaaattccaatgcataatgaactgggaaaaattaagaaaacctcattatcacaaagaaccggttgaatacatttacgcaactggcatttttaatcttaaagaatacgataaactttacgaaaaccaaaacaacctttctcaccaaatttggcaagactttgataccaaatataaaattggttttgaattttttaaagatttacgtgagtttaataaaaataaagaagtaatttgtttatggttttttaaagagagatctgacagaaaaactggtaacgatatagatctagaaggaaaaattataaaatatcaacctaatacatttttaataacaagatctaaaaacataaaaataattaaaaggaaatcggttttacctaacagaccggttttacaattagatttaagcataaacaaatacaataaaattataaaaatggaaacctaataatacatttgttttttgtggacaagaaggacatacttggcactcatatgaaagtaataaaaatactaaccgtattacatttaatacttttattatgaagtatagaaaaagggtaactttttataccaattaatttttccagtacaatttatctatttgattaacttttccatgatcccctataatggcactactgttaaatcctaaactttgcataaataggtccatctcatctacatcaggtataagaggttgtttagggtctttatataaatttacctcgtttaaaacataagttgctcttttaaaaatctccggcgagcctttcattactaaaagttctgcgccttgtacatcttgtttaataaaatcataaattgcatcgttgccaacaatagatttaagtgtttgcatttttcttttttctactgcttgtgaaggaaatgtgtcaattccaaatatgtttgatcctttagtataagttattttatgccctttaatctgtcttaagtgcatatctacttctttattttcgtttcctaatacagcaataaaaacttcatttgcacattttaataatcttccttcgtgtttttttcctgcttcaatgcaagtataatgtgcatcaggccaaaattccttcacttctctggtccatattccgttccatgcacccaaatctaaaac

SEQ ID NO: 1334 - DNA, 4000 bp, Escherichia coli
  misc_feature (50)..(50): n is a, c, g, or t
  misc_feature (54)..(55): n is a, c, g, or t
  misc_feature (63)..(63): n is a, c, g, or t
  misc_feature (66)..(67): n is a, c, g, or t
  misc_feature (69)..(69): n is a, c, g, or t
  misc_feature (75)..(75): n is a, c, g, or t
  misc_feature (77)..(78): n is a, c, g, or t
  misc_feature (81)..(81): n is a, c, g, or t
  misc_feature (84)..(84): n is a, c, g, or t
  misc_feature (86)..(86): n is a, c, g, or t
  misc_feature (88)..(89): n is a, c, g, or t
  misc_feature (92)..(93): n is a, c, g, or t
  misc_feature (98)..(98): n is a, c, g, or t
  misc_feature (104)..(104): n is a, c, g, or t
  misc_feature (107)..(108): n is a, c, g, or t
  misc_feature (111)..(111): n is a, c, g, or t
  misc_feature (115)..(118): n is a, c, g, or t
  misc_feature (120)..(121): n is a, c, g, or t
  misc_feature (123)..(123): n is a, c, g, or t
  misc_feature (125)..(126): n is a, c, g, or t
  misc_feature (128)..(128): n is a, c, g, or t
  misc_feature (130)..(131): n is a, c, g, or t
  misc_feature (133)..(133): n is a, c, g, or t
  misc_feature (135)..(138): n is a, c, g, or t
  misc_feature (140)..(141): n is a, c, g, or t
  misc_feature (143)..(143): n is a, c, g, or t
  misc_feature (145)..(146): n is a, c, g, or t
  misc_feature (148)..(148): n is a, c, g, or t
  misc_feature (150)..(151): n is a, c, g, or t
  misc_feature (153)..(153): n is a, c, g, or t
  misc_feature (155)..(156): n is a, c, g, or t
  misc_feature (158)..(158): n is a, c, g, or t
  misc_feature (160)..(161): n is a, c, g, or t
  misc_feature (163)..(163): n is a, c, g, or t
  misc_feature (165)..(166): n is a, c, g, or t
  misc_feature (168)..(168): n is a, c, g, or t
  misc_feature (170)..(171): n is a, c, g, or t
  misc_feature (173)..(173): n is a, c, g, or t
  misc_feature (175)..(176): n is a, c, g, or t
  misc_feature (178)..(180): n is a, c, g, or t
  misc_feature (182)..(191): n is a, c, g, or t
  misc_feature (193)..(193): n is a, c, g, or t
  misc_feature (196)..(197): n is a, c, g, or t
  misc_feature (199)..(202): n is a, c, g, or t
  misc_feature (204)..(204): n is a, c, g, or t
  misc_feature (206)..(207): n is a, c, g, or t
  misc_feature (209)..(210): n is a, c, g, or t
  misc_feature (215)..(215): n is a, c, g, or t
  misc_feature (222)..(224): n is a, c, g, or t
  misc_feature (226)..(226): n is a, c, g, or t
  misc_feature (229)..(255): n is a, c, g, or t
  misc_feature (257)..(257): n is a, c, g, or t
  misc_feature (259)..(274): n is a, c, g, or t
  misc_feature (276)..(278): n is a, c, g, or t
  misc_feature (280)..(288): n is a, c, g, or t
  misc_feature (290)..(314): n is a, c, g, or t
  misc_feature (316)..(334): n is a, c, g, or t
  misc_feature (337)..(341): n is a, c, g, or t
  misc_feature (344)..(344): n is a, c, g, or t
  misc_feature (347)..(347): n is a, c, g, or t
  misc_feature (349)..(349): n is a, c, g, or t
  misc_feature (351)..(351): n is a, c, g, or t
  misc_feature (353)..(358): n is a, c, g, or t
  misc_feature (362)..(367): n is a, c, g, or t
  misc_feature (370)..(373): n is a, c, g, or t
  misc_feature (375)..(375): n is a, c, g, or t
  misc_feature (378)..(379): n is a, c, g, or t
  misc_feature (381)..(390): n is a, c, g, or t
  misc_feature (392)..(402): n is a, c, g, or t
  misc_feature (404)..(409): n is a, c, g, or t
  misc_feature (412)..(412): n is a, c, g, or t
  misc_feature (414)..(418): n is a, c, g, or t
  misc_feature (422)..(427): n is a, c, g, or t
  misc_feature (429)..(430): n is a, c, g, or t
  misc_feature (432)..(434): n is a, c, g, or t
  misc_feature (437)..(439): n is a, c, g, or t
  misc_feature (442)..(445): n is a, c, g, or t
  misc_feature (447)..(449): n is a, c, g, or t
  misc_feature (456)..(457): n is a, c, g, or t
  misc_feature (472)..(477): n is a, c, g, or t
  misc_feature (480)..(481): n is a, c, g, or t
  misc_feature (483)..(484): n is a, c, g, or t
  misc_feature (486)..(486): n is a, c, g, or t
  misc_feature (491)..(495): n is a, c, g, or t
  misc_feature (497)..(497): n is a, c, g, or t
  misc_feature (499)..(513): n is a, c, g, or t
  misc_feature (515)..(519): n is a, c, g, or t
  misc_feature (521)..(521): n is a, c, g, or t
  misc_feature (523)..(526): n is a, c, g, or t
  misc_feature (528)..(538): n is a, c, g, or t
  misc_feature (540)..(550): n is a, c, g, or t
  misc_feature (552)..(555): n is a, c, g, or t
  misc_feature (558)..(558): n is a, c, g, or t
  misc_feature (563)..(567): n is a, c, g, or t
  misc_feature (571)..(580): n is a, c, g, or t
  misc_feature (582)..(587): n is a, c, g, or t
  misc_feature (589)..(589): n is a, c, g, or t
  misc_feature (591)..(594): n is a, c, g, or t
  misc_feature (599)..(600): n is a, c, g, or t
  misc_feature (602)..(605): n is a, c, g, or t
  misc_feature (608)..(613): n is a, c, g, or t
  misc_feature (616)..(619): n is a, c, g, or t
  misc_feature (622)..(622): n is a, c, g, or t
  misc_feature (627)..(628): n is a, c, g, or t
  misc_feature (631)..(631): n is a, c, g, or t
  misc_feature (633)..(633): n is a, c, g, or t
  misc_feature (636)..(636): n is a, c, g, or t
  misc_feature (638)..(640): n is a, c, g, or t
  misc_feature (642)..(643): n is a, c, g, or t
  misc_feature (645)..(645): n is a, c, g, or t
  misc_feature (647)..(649): n is a, c, g, or t
  misc_feature (651)..(652): n is a, c, g, or t
  misc_feature (654)..(655): n is a, c, g, or t
  misc_feature (658)..(659): n is a, c, g, or t
  misc_feature (661)..(664): n is a, c, g, or t
  misc_feature (666)..(671): n is a, c, g, or t
  misc_feature (673)..(675): n is a, c, g, or t
  misc_feature (680)..(680): n is a, c, g, or t
  misc_feature (688)..(689): n is a, c, g, or t
  misc_feature (693)..(693): n is a, c, g, or t
  misc_feature (695)..(695): n is a, c, g, or t
  misc_feature (697)..(701): n is a, c, g, or t
  misc_feature (705)..(706): n is a, c, g, or t
  misc_feature (716)..(718): n is a, c, g, or t
  misc_feature (2784)..(2784): n is a, c, g, or t
  misc_feature (2822)..(2823): n is a, c, g, or t
  misc_feature (2825)..(2825): n is a, c, g, or t
  misc_feature (2827)..(2830): n is a, c, g, or t
  misc_feature (2833)..(2834): n is a, c, g, or t
  misc_feature (2837)..(2838): n is a, c, g, or t
  misc_feature (2840)..(2841): n is a, c, g, or t
  misc_feature (2844)..(2848): n is a, c, g, or t
  misc_feature (2850)..(2851): n is a, c, g, or t
  misc_feature (2853)..(2853): n is a, c, g, or t
  misc_feature (2855)..(2857): n is a, c, g, or t
  misc_feature (2859)..(2859): n is a, c, g, or t
  misc_feature (2862)..(2866): n is a, c, g, or t
  misc_feature (2868)..(2873): n is a, c, g, or t
  misc_feature (2875)..(2878): n is a, c, g, or t
  misc_feature (2880)..(2883): n is a, c, g, or t
  misc_feature (2890)..(2891): n is a, c, g, or t
  misc_feature (2893)..(2893): n is a, c, g, or t
  misc_feature (2897)..(2897): n is a, c, g, or t
  misc_feature (2901)..(2901): n is a, c, g, or t
  misc_feature (2903)..(2904): n is a, c, g, or t
  misc_feature (2907)..(2908): n is a, c, g, or t
  misc_feature (2912)..(2913): n is a, c, g, or t
  misc_feature (2916)..(2916): n is a, c, g, or t
  misc_feature (2918)..(2918): n is a, c, g, or t
  misc_feature (2922)..(2923): n is a, c, g, or t
  misc_feature (2925)..(2925): n is a, c, g, or t
  misc_feature (2927)..(2929): n is a, c, g, or t
  misc_feature (2931)..(2933): n is a, c, g, or t
  misc_feature (2937)..(2937): n is a, c, g, or t
  misc_feature (2940)..(2941): n is a, c, g, or t
  misc_feature (2945)..(2947): n is a, c, g, or t
  misc_feature (2951)..(2952): n is a, c, g, or t
  misc_feature (2954)..(2955): n is a, c, g, or t
  misc_feature (2957)..(2957): n is a, c, g, or t
  misc_feature (2959)..(2961): n is a, c, g, or t
  misc_feature (2963)..(2964): n is a, c, g, or t
  misc_feature (2968)..(2968): n is a, c, g, or t
  misc_feature (2973)..(2973): n is a, c, g, or t
  misc_feature (2976)..(2977): n is a, c, g, or t
  misc_feature (2980)..(2981): n is a, c, g, or t
  misc_feature (2995)..(2995): n is a, c, g, or t
  misc_feature (3000)..(3000): n is a, c, g, or t
  misc_feature (3002)..(3003): n is a, c, g, or t
  misc_feature (3005)..(3005): n is a, c, g, or t
  misc_feature (3008)..(3011): n is a, c, g, or t
  misc_feature (3020)..(3020): n is a, c, g, or t
  misc_feature (3023)..(3024): n is a, c, g, or t
  misc_feature (3026)..(3026): n is a, c, g, or t
  misc_feature (3030)..(3030): n is a, c, g, or t
  misc_feature (3035)..(3036): n is a, c, g, or t
  misc_feature (3040)..(3040): n is a, c, g, or t
  misc_feature (3045)..(3045): n is a, c, g, or t
  misc_feature (3052)..(3053): n is a, c, g, or t
  misc_feature (3056)..(3056): n is a, c, g, or t
  misc_feature (3060)..(3062): n is a, c, g, or t
  misc_feature (3065)..(3068): n is a, c, g, or t
  misc_feature (3076)..(3080): n is a, c, g, or t
  misc_feature (3082)..(3082): n is a, c, g, or t
  misc_feature (3084)..(3084): n is a, c, g, or t
  misc_feature (3086)..(3086): n is a, c, g, or t
  misc_feature (3093)..(3093): n is a, c, g, or t
  misc_feature (3099)..(3100): n is a, c, g, or t
  misc_feature (3104)..(3105): n is a, c, g, or t
  misc_feature (3108)..(3110): n is a, c, g, or t
  misc_feature (3112)..(3113): n is a, c, g, or t
  misc_feature (3117)..(3117): n is a, c, g, or t
  misc_feature (3120)..(3120): n is a, c, g, or t
  misc_feature (3122)..(3122): n is a, c, g, or t
  misc_feature (3126)..(3126): n is a, c, g, or t
  misc_feature (3130)..(3131): n is a, c, g, or t
  misc_feature (3138)..(3138): n is a, c, g, or t
  misc_feature (3143)..(3143): n is a, c, g, or t
  misc_feature (3147)..(3148): n is a, c, g, or t
  misc_feature (3150)..(3151): n is a, c, g, or t
  misc_feature (3154)..(3154): n is a, c, g, or t
  misc_feature (3162)..(3162): n is a, c, g, or t
  misc_feature (3166)..(3168): n is a, c, g, or t
  misc_feature (3171)..(3171): n is a, c, g, or t
  misc_feature (3173)..(3173): n is a, c, g, or t
  misc_feature (3175)..(3175): n is a, c, g, or t
  misc_feature (3178)..(3178): n is a, c, g, or t
  misc_feature (3182)..(3183): n is a, c, g, or t
  misc_feature (3186)..(3186): n is a, c, g, or t
  misc_feature (3188)..(3188): n is a, c, g, or t
  misc_feature (3193)..(3193): n is a, c, g, or t
  misc_feature (3197)..(3197): n is a, c, g, or t
  misc_feature (3199)..(3199): n is a, c, g, or t
  misc_feature (3205)..(3205): n is a, c, g, or t
  misc_feature (3207)..(3207): n is a, c, g, or t
  misc_feature (3209)..(3209): n is a, c, g, or t
  misc_feature (3213)..(3213): n is a, c, g, or t
  misc_feature (3215)..(3215): n is a, c, g, or t
  misc_feature (3218)..(3218): n is a, c, g, or t
  misc_feature (3220)..(3221): n is a, c, g, or t
  misc_feature (3223)..(3223): n is a, c, g, or t
  misc_feature (3227)..(3227): n is a, c, g, or t
  misc_feature (3229)..(3230): n is a, c, g, or t
  misc_feature (3232)..(3236): n is a, c, g, or t
  misc_feature (3238)..(3240): n is a, c, g, or t
  misc_feature (3252)..(3253): n is a, c, g, or t
  misc_feature (3256)..(3256): n is a, c, g, or t
  misc_feature (3261)..(3261): n is a, c, g, or t
  misc_feature (3264)..(3264): n is a, c, g, or t
  misc_feature (3270)..(3270): n is a, c, g, or t
  misc_feature (3272)..(3273): n is a, c, g, or t
  misc_feature (3276)..(3276): n is a, c, g, or t
  misc_feature (3280)..(3281): n is a, c, g, or t
  misc_feature (3285)..(3285): n is a, c, g, or t
  misc_feature (3292)..(3292): n is a, c, g, or t
  misc_feature (3297)..(3297): n is a, c, g, or t
  misc_feature (3300)..(3302): n is a, c, g, or t
  misc_feature (3305)..(3305): n is a, c, g, or t
  misc_feature (3307)..(3307): n is a, c, g, or t
  misc_feature (3309)..(3309): n is a, c, g, or t
  misc_feature (3311)..(3311): n is a, c, g, or t
  misc_feature (3313)..(3315): n is a, c, g, or t
  misc_feature (3319)..(3319): n is a, c, g, or t
  misc_feature (3321)..(3321): n is a, c, g, or t
  misc_feature (3325)..(3325): n is a, c, g, or t
  misc_feature (3327)..(3327): n is a, c, g, or t
  misc_feature (3329)..(3329): n is a, c, g, or t
  misc_feature (3332)..(3332): n is a, c, g, or t
  misc_feature (3340)..(3345): n is a, c, g, or t
  misc_feature (3349)..(3349): n is a, c, g, or t
  misc_feature (3353)..(3353): n is a, c, g, or t
  misc_feature (3355)..(3356): n is a, c, g, or t
  misc_feature (3359)..(3360): n is a, c, g, or t
  misc_feature (3362)..(3362): n is a, c, g, or t
  misc_feature (3367)..(3367): n is a, c, g, or t
  misc_feature (3373)..(3373): n is a, c, g, or t
  misc_feature (3378)..(3380): n is a, c, g, or t
  misc_feature (3385)..(3385): n is a, c, g, or t
  misc_feature (3390)..(3391): n is a, c, g, or t
  misc_feature (3393)..(3393): n is a, c, g, or t
  misc_feature (3399)..(3400): n is a, c, g, or t
  misc_feature (3409)..(3412): n is a, c, g, or t
  misc_feature (3417)..(3417): n is a, c, g, or t
  misc_feature (3419)..(3420): n is a, c, g, or t
  misc_feature (3423)..(3426): n is a, c, g, or t
  misc_feature (3428)..(3428): n is a, c, g, or t
  misc_feature (3433)..(3433): n is a, c, g, or t
  misc_feature (3435)..(3435): n is a, c, g, or t
  misc_feature (3438)..(3438): n is a, c, g, or t
  misc_feature (3442)..(3442): n is a, c, g, or t
  misc_feature (3446)..(3446): n is a, c, g, or t
  misc_feature (3452)..(3453): n is a, c, g, or t
  misc_feature (3455)..(3458): n is a, c, g, or t
  misc_feature (3463)..(3464): n is a, c, g, or t
  misc_feature (3466)..(3466): n is a, c, g, or t
  misc_feature (3469)..(3469): n is a, c, g, or t
  misc_feature (3471)..(3479): n is a, c, g, or t
  misc_feature (3483)..(3483): n is a, c, g, or t
  misc_feature (3488)..(3489): n is a, c, g, or t
  misc_feature (3491)..(3491): n is a, c, g, or t
  misc_feature (3496)..(3497): n is a, c, g, or t
  misc_feature (3500)..(3500): n is a, c, g, or t
  misc_feature (3503)..(3503): n is a, c, g, or t
  misc_feature (3506)..(3506): n is a, c, g, or t
  misc_feature (3509)..(3509): n is a, c, g, or t
  misc_feature (3513)..(3513): n is a, c, g, or t
  misc_feature (3517)..(3518): n is a, c, g, or t
  misc_feature (3526)..(3527): n is a, c, g, or t
  misc_feature (3531)..(3533): n is a, c, g, or t
  misc_feature (3538)..(3538): n is a, c, g, or t
  misc_feature (3548)..(3548): n is a, c, g, or t
  misc_feature (3550)..(3551): n is a, c, g, or t
  misc_feature (3553)..(3555): n is a, c, g, or t
  misc_feature (3557)..(3558): n is a, c, g, or t
  misc_feature (3562)..(3562): n is a, c, g, or t
  misc_feature (3566)..(3568): n is a, c, g, or t
  misc_feature (3570)..(3571): n is a, c, g, or t
  misc_feature (3576)..(3576): n is a, c, g, or t
  misc_feature (3578)..(3580): n is a, c, g, or t
  misc_feature (3582)..(3582): n is a, c, g, or t
  misc_feature (3587)..(3587): n is a, c, g, or t
  misc_feature (3590)..(3590): n is a, c, g, or t
  misc_feature (3597)..(3597): n is a, c, g, or t
  misc_feature (3599)..(3600): n is a, c, g, or t
  misc_feature (3602)..(3603): n is a, c, g, or t
  misc_feature (3605)..(3605): n is a, c, g, or t
  misc_feature (3608)..(3608): n is a, c, g, or t
  misc_feature (3615)..(3615): n is a, c, g, or t
  misc_feature (3617)..(3618): n is a, c, g, or t
  misc_feature (3620)..(3621): n is a, c, g, or t
  misc_feature (3627)..(3627): n is a, c, g, or t
  misc_feature (3629)..(3629): n is a, c, g, or t
  misc_feature (3636)..(3638): n is a, c, g, or t
  misc_feature (3643)..(3643): n is a, c, g, or t
  misc_feature (3647)..(3647): n is a, c, g, or t
  misc_feature (3650)..(3650): n is a, c, g, or t
  misc_feature (3652)..(3652): n is a, c, g, or t
  misc_feature (3656)..(3660): n is a, c, g, or t
  misc_feature (3666)..(3668): n is a, c, g, or t
  misc_feature (3671)..(3671): n is a, c, g, or t
  misc_feature (3676)..(3676): n is a, c, g, or t
  misc_feature (3679)..(3679): n is a, c, g, or t
  misc_feature (3681)..(3684): n is a, c, g, or t
  misc_feature (3686)..(3686): n is a, c, g, or t
  misc_feature (3693)..(3698): n is a, c, g, or t
  misc_feature (3700)..(3700): n is a, c, g, or t
  misc_feature (3705)..(3705): n is a, c, g, or t
  misc_feature (3707)..(3707): n is a, c, g, or t
  misc_feature (3709)..(3709): n is a, c, g, or t
  misc_feature (3712)..(3712): n is a, c, g, or t
  misc_feature (3715)..(3715): n is a, c, g, or t
  misc_feature (3717)..(3717): n is a, c, g, or t
  misc_feature (3719)..(3719): n is a, c, g, or t
  misc_feature (3722)..(3723): n is a, c, g, or t
  misc_feature (3729)..(3733): n is a, c, g, or t
  misc_feature (3735)..(3735): n is a, c, g, or t
  misc_feature (3737)..(3737): n is a, c, g, or t
  misc_feature (3741)..(3741): n is a, c, g, or t
  misc_feature (3745)..(3746): n is a, c, g, or t
  misc_feature (3749)..(3750): n is a, c, g, or t
  misc_feature (3754)..(3754): n is a, c, g, or t
  misc_feature (3757)..(3759): n is a, c, g, or t
  misc_feature (3761)..(3761): n is a, c, g, or t
  misc_feature (3763)..(3763): n is a, c, g, or t
  misc_feature (3765)..(3766): n is a, c, g, or t
  misc_feature (3769)..(3770): n is a, c, g, or t
  misc_feature (3775)..(3775): n is a, c, g, or t
  misc_feature (3781)..(3782): n is a, c, g, or t
  misc_feature (3784)..(3784): n is a, c, g, or t
  misc_feature (3788)..(3788): n is a, c, g, or t
  misc_feature (3791)..(3791): n is a, c, g, or t
  misc_feature (3793)..(3793): n is a, c, g, or t
  misc_feature (3801)..(3801): n is a, c, g, or t
  misc_feature (3804)..(3804): n is a, c, g, or t
  misc_feature (3807)..(3808): n is a, c, g, or t
  misc_feature (3811)..(3814): n is a, c, g, or t
  misc_feature (3816)..(3818): n is a, c, g, or t
  misc_feature (3829)..(3829): n is a, c, g, or t
  misc_feature (3832)..(3832): n is a, c, g, or t
  misc_feature (3836)..(3836): n is a, c, g, or t
  misc_feature (3850)..(3850): n is a, c, g, or t
  misc_feature (3854)..(3855): n is a, c, g, or t
  misc_feature (3858)..(3858): n is a, c, g, or t
  misc_feature (3866)..(3866): n is a, c, g, or t
  misc_feature (3868)..(3869): n is a, c, g, or t
  misc_feature (3871)..(3871): n is a, c, g, or t
  misc_feature (3874)..(3874): n is a, c, g, or t
  misc_feature (3876)..(3879): n is a, c, g, or t
  misc_feature (3884)..(3884): n is a, c, g, or t
  misc_feature (3886)..(3887): n is a, c, g, or t
  misc_feature (3891)..(3892): n is a, c, g, or t
  misc_feature (3895)..(3895): n is a, c, g, or t
  misc_feature (3906)..(3906): n is a, c, g, or t
  misc_feature (3909)..(3909): n is a, c, g, or t
  misc_feature (3914)..(3914): n is a, c, g, or t
  misc_feature (3916)..(3918): n is a, c, g, or t
  misc_feature (3921)..(3924): n is a, c, g, or t
  misc_feature (3929)..(3929): n is a, c, g, or t
  misc_feature (3933)..(3933): n is a, c, g, or t
  misc_feature (3939)..(3939): n is a, c, g, or t
  misc_feature (3941)..(3941): n is a, c, g, or t
  misc_feature (3943)..(3943): n is a, c, g, or t
  misc_feature (3946)..(3946): n is a, c, g, or t
  misc_feature (3948)..(3949): n is a, c, g, or t
  misc_feature (3955)..(3955): n is a, c, g, or t
  misc_feature (3959)..(3959): n is a, c, g, or t
  misc_feature (3961)..(3961): n is a, c, g, or t
  misc_feature (3970)..(3970): n is a, c, g, or t
  misc_feature (3972)..(3973): n is a, c, g, or t
  misc_feature (3988)..(3988): n is a, c, g, or t
  misc_feature (3992)..(3998): n is a, c, g, or t
aattttcattattattatttgaacaaatattaattttcctttgtaattantatnnataaaaanaannanaataanannaanaananannaanntattnatattnatnntantatnnnntnntntnntntnntntnnnntnntntnntntnntntnntntnntntnntntnntntnntnnnannnnnnnnnnanttnntnnnntntnntnnttttnttttttnnnanttnnnnnnnnnnnnnnnnnnnnnnnnnnnanannnnnnnnnnnnnnnntnnnannnnnnnnntnnnnnnnnnnnnnnnnnnnnnnnnntnnnnnnnnnnnnnnnnnnnttnnnnnttnttntntntnnnnnntttnnnnnnttnnnnanttnntnnnnnnnnnnannnnnnnnnnntnnnnnnttntnnnnntttnnnnnnannannnaannnttnnnnannnttttttnnttttttttttttttnnnnnnttnnannantttannnnntnannnnnnnnnnnnnnntnnnnnantnnnnannnnnnnnnnnannnnnnnnnnntnnnnttnttttnnnnntttnnnnnnnnnntnnnnnntntnnnnttttnnannnnttnnnnnnttnnnnaanttttnnaantnatnannntnntnannntnntnnaannannnnannnnnnannnaaaanaaaaaaannaaanantnnnnntttnntttttttttnnnaaaaaaaaaaaaaaaaaaaagaaaaaaaaaagataagattaaagaaagttaatataaatatatagtatcaaatataaatttattataatttttttttacctccttttgaataaaagcatgaataatcttgataattacgaataactaatatacattttgctttaagatgaataaattcatcattttcaatatctttatttttcaaagtaaatgaaagatattcattattttttatcatatttgatgttaaattgatattcctaaaattttttaatatataaacattaaatatttaaattatattttaaatttgattagtttattctattttattgattataaattattttatttatcaatttttttttaaagaattttataaactattcttaaactttttaattatttatttataccatttgtgatcacatagaataaattcattattatattcttcatttttattatttttccaactttcaataggccattcgtaataaccatctctgatatttttacatccatcatcatttatatattgttttaattcttcatcaaattgttctattattgaatatagaatttttattttttatttttttattaatttttttttaaaaaaaatatatatataaatattatataatattataaatattttatatattataaaataataacctttatcatatttatattcacagatgcaggttccaatttttaatttatcattttctactaatgatttatccaattcttcattttttctatataaatcttcttttttaataaaacttttccaactatgtaaattattatatttattatagtaatttaatgtagtttctataaatttataccaatatatataaatataattaatttattcgtatggagttatatataaaaaattaatcgtaatttaaaaaaaaaaaataataataataataattatttaatatatatcataatatattttatgattattgaattaattataacaaatgaaaaatacaacttttaattaatttttattttaaaaattattattacctccattggtataatagtaagaattatcatcgctattacaaataacaataacggattttgcattaatatgatagtttggatcattatcaatagtaagactttttaaattaacagttacataattggtgtctcttgcatctaaatgaatttccctaatttttttattaaataatattgataatattagatttaaaaaaatttttcctttaataacaatatgtttttttttttaattaaaaaaaaaaaaaatatggtaattatggtattaccatgaatgattcttgttcttgtttgtaaattgatgaataatgtatttatttgaattttctttccaattttcaatttcatattcataataatctttagatatcactaaatgattatcgtcatgtattaaactctttattccatttatatattgttctattataaacaaaaaaaattagaattagtatattatatatattattaattatttaatatttaataattaatttataaatattatttattattaaccttgatcatatttatatatttgaatatatgcgccaacatttgctttattattttccactaaacatctatttgatgcactattttttgaaaataatttatttttttcaatgaaaaaacttgatttgtaagaatcattataattgctaaaactgcagttgtgtactaatattatatatatttaataaaataatttattcatattttttttaaaaattatggtcatttttttaaaatatattaaaattataaaatataattatttaaaatatatgtcatacctccatcagaataaaaagtagagtaatccatataattacgaataaataaggtaaattttatataaatatgttttaatatatttcttttaacatctatactttttaaatagacggaagtatatccattaatattatcaccatttggatataattgaattttcctaatatttttaataatatttttgagagacaataattcaaattttaaattatatnttaattataatatattatttagttaatttaaaaaaaannantnnnnttnnttnncnnttnnnnncnncnannntnaannnnngnnnnnnannnncnnnnaataaannanttcnaatnannaannttcnnttnanaatnncnannntnnntaanttnnttgnnnttanntnnantnnnanntttnaaatnttnnttnnaatgttctaaatanaatantnntnatnnnnatatatatnttnntnaatntatanngatnttttnttatttnnaanaaannntannnntaatatannnnntntntnatatttntaggtnnaaanntannnannaatnatngntttnttannataaatnaattnattnntnnaantaagaaangaannnttntntntanattnnttncntcccnaacnantagaantntnattnanatngnntntatntnntnnnnntnnntatatatttatnnatnttaanttnatttantnnttntttnnttantaatatnaaatnatnnnaanananantnnntaananattnanantantaataatnnnnnnaatnattntnnttnntnatatnaaaaanaaaannncctanaatannantagtannattattttnnnnatctncnnttnnnnanaaaananaantatnattnttattnntnnnntcatnncnatntnnnnnnnnnttanttttnntnaattnnttnttntanatnatantatnntaatattnnttannnattantaaaaaaatntnntnnntnnatantatnnntnnatatntnnnanaaaanttntaattantnnannantanaaaaaanannannaataananaaatatnnnttatntatnttnanattnnnnntatttnnnatnttttnttntnnnntntaaattnnnnnntntattntntnctnttntntntannaaattnnnnntntnaaantttnnatnnatanaannntncntnnatnntattntatttnnanaatnttnantttatttnttnttnnaannnngnnntatatatattnttntatntatatattataaanattnnatnaaataaananntnttntnnnnattananntttnntanatatatatatnatnttttntnnnttnnnnttttntatntatttntntntananntaaaanatantnttttttatnannatatatatatatatntaannnnnnnta

SEQ ID NO: 1335 - DNA, 4000 bp, Escherichia coli
  misc_feature (278)..(278): n is a, c, g, or t
  misc_feature (530)..(530): n is a, c, g, or t
  misc_feature (622)..(622): n is a, c, g, or t
  misc_feature (874)..(874): n is a, c, g, or t
  misc_feature (916)..(916): n is a, c, g, or t
  misc_feature (924)..(924): n is a, c, g, or t
  misc_feature (958)..(958): n is a, c, g, or t
  misc_feature (970)..(970): n is a, c, g, or t
  misc_feature (1162)..(1162): n is a, c, g, or t
  misc_feature (1194)..(1194): n is a, c, g, or t
  misc_feature (1261)..(1261): n is a, c, g, or t
  misc_feature (1989)..(1989): n is a, c, g, or t
cacgcactatcccgatcatctgttccacaacacccgccggcgcgacggaaccgcgcggttcgaggacgtgcttccgccgctggtaaacgagcacgacggcagccacggcgtgcagtgggtggatttcgacggcgacggcgcgctggatctggcgctgtcgaacaacgatcccgccggcggccatttcttgttccgcaatctcctcgagcccgaccgcgcccgcgcgtcgctcgccgtcgacgtcgtcgatgccggcggccggcacaccaaggccggcncggaagtgcgcgtctacgctgcagggacgcggaagctgatcgcaacaggcctggtcgataccggcggcggctactgctcgcagaacgtgatgcccgtgcatctcggaaccggcggcgccaagcgagtcgacgtggaagtcacagcgatgggaaagggtggccgccgcgtgacgcgagtagccggggtcgacgcgcgcacagcgacgcgtccgctgcgcgtgcgcgtcgctcgctgacgcgcgagacggggcnaggggcggagcaagctccgcccctacggatgtaagcgtcgaagttgatcgcccgtaggggccgaccttggtcggcccctctagcccctgtanccgaggcgtcgcttcatggccctcacagttccacctgggtctctcgctgcgcctcgtcccaccgcgccgagcagcctcgccgcctgcgtcgcgttgccgccgctctcctcgagcgccgcgctcaacgccgtctcctcgagcgcgcgaatctcgtcgcgcaggttcagcgctccggcctgcagccgctggcgcagcgtgccgccgtccaccagtgcgccgcggcgcgatgatgtccgcagcacgcgcgagggnagatccgacagcagcagctcccggccggcgcgcttgtagacnagcgcctngtagatcacgttgcgcagctcgcggatgttgccnggccacggatangccgccatcgccgccagggcgtcgggccggatcgcctcgatccgcggctgccggttctcgcgcgcgaagcgatcgaggaagtgccgcgccagcaccggcaggtcgtcgatccgctcgcgcagcggcgacagccggatctggacgatggccagccgctcgtagagatccgcgccgaaccgcccggccgcgacnagcggcaccagatcgcggttggtcgcggcgangatccggaaatcgacctcgtgccagtcgttctcgcccagccggctgacgacgtgatcctcgagcacncgcagcagcttgatctgcgtctcgagcggcgtgtcgtcgatctcgtcgaggaacacggtgccgccggccgccgccatcagctggccgtcgtacgactgcaccgcgccggagaaggcgccgcgggcgtagccgaagagctccgcctccatcagctcgttcgggatggccgcgcagttgatcggcaccaaccgccgctcgtgccgcggcgaccacgcgtgaatcagccgcgcggtcacctccttgccggtgccggtttcgccggtgagcagcacggccatcgaggttcgcgccacccgcgccacctgccgcaataccgcctgcgaggcgaggctgttctgcacgatgtgttcggccggcggcggtgccggttccggcgtcaacagctcctcgagccgcgcgacgagcgcgtcgaatgcccccgttgcgctcaatccgatgacgtcgtacgcgccgcgcagcacggcgtccgtgacccgcgccgcgggcaccgccgccgttgacacccagacccagcgcccgcgtgcagcgcgcggcgccggcacgcgcgtcgatgtagcggtcgcggcgacgagcggcaggccggtccgttcctctcgatcgatcccgatgtcggcgcccttcagccgctcgacgagcgcgcgcgaggggggcggtccggtccagccgacaagtcgcatacttcgtcattagagcacggatcattcgcgattcaattactgatactcctnaacatcgtaaggaattggccggaaaaggcccggaccagctcatgcaccgtgaggctttcacgcgaacgtaagcgtgttcgcgctgggggccacatagccatgctgaatgttcttctcgaccacctggtcgccgttttcgtcgtcgcggcgatcgtgagcgtcgccgcggagctcgttctcctcagcacctgggtgattgccgccgatgaatcgggcctcgtcgtcaagcgcttcggccagccgctcgcatcgggccgaatcatcgcgatgcagggcgaggccggctatcaggcgcgcatgctgtcgccaggctggcacttcggcctgtggcgctggcgctatcgcgtgatcaaggtgccgacggttgtcgtgcggccgggcgacatcgcgctggtggtggccgccgacggcgccgcgatccccagcgagcgcgtgctcgcgaagagcgtgccgtgcaataactttcaagacgccgaagcgttcctcaccggcggcggcgagcgcggccgccagatcgcgttcctcaccgccggcacctaccgcatcaacccggcgctcttcgacgtcgtcaccgccgcgaacgcgtcgaaggtcggcgtcaccgccgcggagctgcgcgtgcatcaggttcagcccgatcgcgtcggcatcgtgacgatgctcgacggccgcccgattccggccggcgacatggcggggccgagcgtgccgggccacgagagcttccagcgcggccaggcgttcatcgatgccggcgggtgccgcggcctgcaggaggatgtgctgctgtccggttcgtggaacctgaacccgtggctggtgcaggttgagcaggtgccgctcgtcgaggtgccgatcggctacgtcggcgtcgtcgtcagctacgtcggccgcgagcacatcgacgtgtctggtgaggagttcacgcacggcgatctcgtcgagcgcggccgcaagggcgtgtggatggagccgctgctgccgggcaagcatccgctcaacaccaaggtgatgaaggtggagctggtgccgaccaccaacatcgtcctgaactgggcgcagcagaccgaggcgcatcactacgacgcgcggctgtcgtcgatcatcgtccgctcgaaggacggcttctcgttcagcctcgacgtctcgcagatcattcacatcggcatgcgcaacgcgccgcgggtgatctcgcgggtcgggtcgatgcagaacctggtcgatcacgtgctgcagccgacggtcggcaactacttccgcaactcggcgcaggaagtgtcggtgctcgagttcctgtcggcgcggtcggatcggcagcggcacgcgttcctcgacatcaagaaggcgatcgaggcctatgacgtcgagtgcatcgacacgctgatcggcgacatcgcgccgccggcagagctgatgaagacgcagaccgaccgcaaaatcgccgaggagctcgagcgcacctacgaggtccagcgagaggcccaggtgacgcgccaggcgctggagcgcgagaccgccgtggccaacctgcagggcgaggtcgtccgctcggagcagatggtgaaggtggcgcagcagaacgcgctcgctgccgcggagcaggcgcgcggcgagggcagcgcgatcgagttgcgcgcccagggtcaggcggcgtcgatccggctgtcgggcgaggcggaagcgtcggcgctgcgggcggtcggcgcggcgaaggcagatgcctacaagcagggcgtcgccgccgtcggcgagagcgggtttacggcgatgcagatcgctacgatcctcggcgagaacaaggtcaaggtggtgcccgagatcgccgtgtcgggtgacggttcgtcggggatggcgaacgtgatgctcgccaagctggtcgcggccgctaacgctgacgcgaccagaaatcggggctagtggctaggggcttggggctggccgttcttcggccagctccaagcttcattttgccgggagagcctcagccagcccccagcccctattgcgccgc

SEQ ID NO: 1336 - DNA, 4000 bp, Escherichia coli
  misc_feature (611)..(611): n is a, c, g, or t
  misc_feature (656)..(656): n is a, c, g, or t
  misc_feature (665)..(665): n is a, c, g, or t
  misc_feature (689)..(689): n is a, c, g, or t
  misc_feature (752)..(752): n is a, c, g, or t
  misc_feature (1960)..(1960): n is a, c, g, or t
  misc_feature (1985)..(1985): n is a, c, g, or t
  misc_feature (1990)..(1990): n is a, c, g, or t
  misc_feature (2031)..(2031): n is a, c, g, or t
  misc_feature (2080)..(2080): n is a, c, g, or t
  misc_feature (2195)..(2195): n is a, c, g, or t
  misc_feature (2642)..(2642): n is a, c, g, or t
  misc_feature (2834)..(2834): n is a, c, g, or t
  misc_feature (2857)..(2858): n is a, c, g, or t
  misc_feature (2886)..(2886): n is a, c, g, or t
  misc_feature (2936)..(2936): n is a, c, g, or t
  misc_feature (2948)..(2948): n is a, c, g, or t
  misc_feature (2951)..(2951): n is a, c, g, or t
  misc_feature (2993)..(2993): n is a, c, g, or t
  misc_feature (3008)..(3008): n is a, c, g, or t
  misc_feature (3011)..(3011): n is a, c, g, or t
  misc_feature (3020)..(3020): n is a, c, g, or t
  misc_feature (3026)..(3027): n is a, c, g, or t
  misc_feature (3035)..(3035): n is a, c, g, or t
  misc_feature (3037)..(3038): n is a, c, g, or t
  misc_feature (3056)..(3056): n is a, c, g, or t
  misc_feature (3062)..(3062): n is a, c, g, or t
  misc_feature (3074)..(3074): n is a, c, g, or t
  misc_feature (3083)..(3083): n is a, c, g, or t
  misc_feature (3092)..(3092): n is a, c, g, or t
  misc_feature (3109)..(3109): n is a, c, g, or t
  misc_feature (3119)..(3119): n is a, c, g, or t
  misc_feature (3121)..(3121): n is a, c, g, or t
  misc_feature (3143)..(3143): n is a, c, g, or t
  misc_feature (3155)..(3155): n is a, c, g, or t
  misc_feature (3161)..(3161): n is a, c, g, or t
  misc_feature (3182)..(3182): n is a, c, g, or t
  misc_feature (3191)..(3191): n is a, c, g, or t
  misc_feature (3196)..(3196): n is a, c, g, or t
  misc_feature (3203)..(3203): n is a, c, g, or t
  misc_feature (3209)..(3209): n is a, c, g, or t
  misc_feature (3211)..(3211): n is a, c, g, or t
  misc_feature (3213)..(3213): n is a, c, g, or t
  misc_feature (3226)..(3226): n is a, c, g, or t
  misc_feature (3236)..(3236): n is a, c, g, or t
  misc_feature (3242)..(3242): n is a, c, g, or t
  misc_feature (3248)..(3248): n is a, c, g, or t
  misc_feature (3254)..(3254): n is a, c, g, or t
  misc_feature (3257)..(3257): n is a, c, g, or t
  misc_feature (3260)..(3260): n is a, c, g, or t
  misc_feature (3266)..(3266): n is a, c, g, or t
  misc_feature (3274)..(3274): n is a, c, g, or t
  misc_feature (3281)..(3281): n is a, c, g, or t
  misc_feature (3295)..(3295): n is a, c, g, or t
  misc_feature (3302)..(3302): n is a, c, g, or t
  misc_feature (3308)..(3308): n is a, c, g, or t
  misc_feature (3314)..(3314): n is a, c, g, or t
  misc_feature (3317)..(3317): n is a, c, g, or t
  misc_feature (3332)..(3332): n is a, c, g, or t
  misc_feature (3338)..(3338): n is a, c, g, or t
  misc_feature (3344)..(3344): n is a, c, g, or t
  misc_feature (3366)..(3366): n is a, c, g, or t
  misc_feature (3373)..(3373): n is a, c, g, or t
  misc_feature (3386)..(3386): n is a, c, g, or t
  misc_feature (3401)..(3401): n is a, c, g, or t
  misc_feature (3409)..(3409): n is a, c, g, or t
  misc_feature (3556)..(3556): n is a, c, g, or t
  misc_feature (3577)..(3577): n is a, c, g, or t
  misc_feature (3673)..(3673): n is a, c, g, or t
  misc_feature (3940)..(3940): n is a, c, g, or t
  misc_feature (3953)..(3953): n is a, c, g, or t
  misc_feature (3973)..(3973): n is a, c, g, or t
  misc_feature (3985)..(3985): n is a, c, g, or t
caaacagacggtcgattgccttttcaaggcttgtgtttttatagtaaatgatcgggatcacttctactttaaatcccggcaccttcatggctttgatcttcatcaggtctgtgtttgtcagaatcgggttatttacttttagtacctggcagttctctgccttctcctctaagaggttaccgtcttcaccgatatagactgtcgtggatgttacaactttctcacggatcgagtcgatcggcgggtttgttacctgtgcaaacagctgtttgaaatagttgaataatggctgatggtcacttgcaagtgcagcaagcggtgtatcaatacccatggcagaggtgccctcgccgccgttctttgccatcggaaggattgcttcacgcagggactcgaatgtataaccgaaagctttctgcattctctggcgctcttccttggtgtattccggcacacgctcgttcgggatttttagatcttccagttttaagaggttgcggtcaagccattcaccgtatggctgtttgtttgcataagtttctttcaactcatcatcgtcgatcacgcggcctgcaacggtatcaaccagaagcattttaccaggacgcagncgctcttttacgagaatctttgtcggatcgatatcaagtacaccnacctcggangagaggatcagataatcatcatcngtaatgtaataacgggaaggacgcagaccgttgcggtcaagcactgctcccatcatatcaccntcggagaacagaatagatgcaggtccgtcccacggctccatcatcgtcgcataatactgatagaaatcttttttcttctgtgacatgatgcggttgtttgcccatggctccgggatcatgatcataactgcaagtggaagttccatgccgctcataaccagaaattccaaggtattatcaagcattgcggagtcggaaccctcggaattgataaccggaagtaccttctgcagttctccttttaagtgctcagactccatcgtctcctcgcgggcaagcatcttgtccgcattacccttgatggtgttgatctcaccgttatgtacgataaaacggttcggatgcgctctctcccagcttggattcgtgttcgtggagaaacgggagtgcacggttgcgatcgctgattcgtaatctttatcctgtaagtcagcaaagaataagcgaagctgctctactaagaacatacctttgtatacgatggttctgctggataaagaaaccacataagtatcatcgttggactgttcaaaaacacgtcttgccacatacagtttgcggtcaaaatcaagtccctttgccacttctgccggacgtttgacaaagccctgcataatatacggcatacagtcaactgctttctgtccgagtttggtcggatcggttggaacttctctccatcctaagaactccattccttccttgttcacgatgacctcaaacattttcttcgcctggttgcgttttaattcatcctgcgggaagaaaaacatgccgacaccgtagtctctctcctctccaagctcgattccaagtggttttgtcactttggagaaaaacttgtgtgatacctgaagcagaataccaacaccgtcacctgtcttgccctctgcatctttacctgctctgtgtttcaagttttctacgatctttaatgcattctctaccgttgcatgtgtcttgatacctttgatattgacaacagcaccgataccgcagttatcatgttcaaatctcggatcatacattccggtttctgtcttacagctgcccgctacagaaaaacggtctaatttctgctctttcatcttcaacttcctttctccatccactcatctgtctttgcctgaaaaacagttgtcttttgtcggatttgttatgtattaatatacaactttcatattcgtttgtctaccagttttttcttnatattatctgataatatgataattntatgnaatgtatgtatattatctgtcttttttatttattttctctnaaaataatatctatacaaacaattcaatagaaaaaagatgcaaaaaaanttcattaatttttctgcatcttcgcatttttattatttctattaaattgtgtttaaattgtatctgtgtctttccgctcttttacctgcagatctatgcttccatgcctgccagntcatccatttttttcttaaacccatggttaaaaattgcgattacacgtccgactccgatcactgccaccaccgttccaagcccgattccgatcagatgtccctgacagaccagtccgactgtgatcgtgatacagatgttgaagaggtcaaaacagtttttggtaaatcccacactcttatgtaccgtgtctgcgatcgcctgcatagcttccggcaagttgatttgggtatgcctccccaaataccagaatcactgccgaaaacagattcagaaaccttgtgaaaataagacttaacggcaactgcagcagatccataagcagtgtcagacggatgtccattttctgtgcgtgcatcaaagtttctccctctgccttctgataccggaaatgccggatcagatgcaggatcatctccacaagcacaaacagtgtgtagatcaccantgtcatattcattgttctttccctgatttctttcgctcatctgttacaatgtgtttcaattccattgtcatggactaatagtttctttcccatatttggtcaaagaagtcatttccctccagtgttttcccatcacaactatacaaagcaccattatcaatgtcaagtgacagaagaagcgtggaatcatcnaggtatggcgtcattttttcctnnaaaagcgggacgacatcttccctgtgtntacattcgttccagtcctggtgttcatccttgtcaactgcaaattcaacnccataggtgtcntcnatcacaattcccttttcatcatccacataaaaggctgcaaantcatattgggcagtnccntgcatttcntaggtnntgcttatnannagatagtccagaccatcntttttngaaagacatatngttccattncctgcatgngacaggtgaaagtttcngctgataaancncggataactttcatattctccntcttttgttccncgatanactttcacataacatccatangaactgttncttanaacatcntctacngntncatccggctcacngccatatccnactacngaaacnagatcngcnatnccatcntgtgtganatctgcngttgtttcaaatanaggcacntcatangcatcnttncccggataatctganttatantagttnccctcttcccctaactgaccgntatcgcngtaggtggaatanacatattcctgattntccacganatatttttgtgtctgtgcatcagaagtattttctgtagtttcagagatttctgtacctgattctttttctgtgtcttctgatatgttttctaacatttcttccgtatttcctgttttcagtttttccggcatctcttctgcattttntgttttcttcgcgttttctgnttctttctcattttcttccaatactgacgcgtttgaagcagcagaattttctattgtttttttactgcatccagcaaaacactcacttgcaagtanaacagtaatcatcgccatgactaatttatttttcattttccccacctcataacatactctttttcgtttgtatcttcatctgtttcttccgcctgaatcaagaaattctccctctgataaaagtaaattgcatgcacattcttttcgtatacacataaacacaattcggtttttctgctttttacataatccagcagacattttccaattcccatcgattgtgcagattctttcacaaacaatccctcgatatagcaatcatttatnccgataaaaccanctatctgaccatttttttcntcttcatatacntatacttctgcttcc

SEQ ID NO: 1337 - DNA, 4000 bp, Escherichia coli
  misc_feature (2)..(5): n is a, c, g, or t
  misc_feature (7)..(7): n is a, c, g, or t
  misc_feature (9)..(14): n is a, c, g, or t
  misc_feature (16)..(18): n is a, c, g, or t
  misc_feature (20)..(20): n is a, c, g, or t
  misc_feature (22)..(30): n is a, c, g, or t
  misc_feature (32)..(42): n is a, c, g, or t
  misc_feature (44)..(48): n is a, c, g, or t
  misc_feature (51)..(51): n is a, c, g, or t
  misc_feature (53)..(54): n is a, c, g, or t
  misc_feature (56)..(65): n is a, c, g, or t
  misc_feature (67)..(67): n is a, c, g, or t
  misc_feature (69)..(71): n is a, c, g, or t
  misc_feature (73)..(73): n is a, c, g, or t
  misc_feature (75)..(78): n is a, c, g, or t
  misc_feature (80)..(85): n is a, c, g, or t
  misc_feature (87)..(91): n is a, c, g, or t
  misc_feature (94)..(99): n is a, c, g, or t
  misc_feature (103)..(105): n is a, c, g, or t
  misc_feature (107)..(142): n is a, c, g, or t
  misc_feature (144)..(148): n is a, c, g, or t
  misc_feature (150)..(151): n is a, c, g, or t
  misc_feature (153)..(158): n is a, c, g, or t
  misc_feature (163)..(163): n is a, c, g, or t
  misc_feature (166)..(167): n is a, c, g, or t
  misc_feature (169)..(178): n is a, c, g, or t
  misc_feature (182)..(185): n is a, c, g, or t
  misc_feature (187)..(189): n is a, c, g, or t
  misc_feature (192)..(196): n is a, c, g, or t
  misc_feature (198)..(202): n is a, c, g, or t
  misc_feature (205)..(205): n is a, c, g, or t
  misc_feature (207)..(214): n is a, c, g, or t
  misc_feature (216)..(217): n is a, c, g, or t
  misc_feature (219)..(229): n is a, c, g, or t
  misc_feature (232)..(234): n is a, c, g, or t
  misc_feature (237)..(253): n is a, c, g, or t
  misc_feature (255)..(257): n is a, c, g, or t
  misc_feature (259)..(260): n is a, c, g, or t
  misc_feature (262)..(262): n is a, c, g, or t
  misc_feature (265)..(268): n is a, c, g, or t
  misc_feature (272)..(273): n is a, c, g, or t
  misc_feature (277)..(278): n is a, c, g, or t
  misc_feature (280)..(280): n is a, c, g, or t
  misc_feature (283)..(283): n is a, c, g, or t
  misc_feature (285)..(287): n is a, c, g, or t
  misc_feature (289)..(290): n is a, c, g, or t
  misc_feature (294)..(301): n is a, c, g, or t
  misc_feature (303)..(313): n is a, c, g, or t
  misc_feature (315)..(316): n is a, c, g, or t
  misc_feature (318)..(319): n is a, c, g, or t
  misc_feature (321)..(322): n is a, c, g, or t
  misc_feature (324)..(328): n is a, c, g, or t
  misc_feature (331)..(343): n is a, c, g, or t
  misc_feature (345)..(351): n is a, c, g, or t
  misc_feature (353)..(360): n is a, c, g, or t
  misc_feature (362)..(376): n is a, c, g, or t
  misc_feature (379)..(379): n is a, c, g, or t
  misc_feature (383)..(383): n is a, c, g, or t
  misc_feature (386)..(386): n is a, c, g, or t
  misc_feature (388)..(389): n is a, c, g, or t
  misc_feature (392)..(392): n is a, c, g, or t
  misc_feature (394)..(397): n is a, c, g, or t
  misc_feature (400)..(409): n is a, c, g, or t
  misc_feature (411)..(415): n is a, c, g, or t
  misc_feature (417)..(418): n is a, c, g, or t
  misc_feature (420)..(423): n is a, c, g, or t
  misc_feature (425)..(427): n is a, c, g, or t
  misc_feature (429)..(430): n is a, c, g, or t
  misc_feature (432)..(437): n is a, c, g, or t
  misc_feature (439)..(444): n is a, c, g, or t
  misc_feature (446)..(446): n is a, c, g, or t
  misc_feature (449)..(456): n is a, c, g, or t
  misc_feature (458)..(460): n is a, c, g, or t
  misc_feature (463)..(464): n is a, c, g, or t
  misc_feature (466)..(467): n is a, c, g, or t
  misc_feature (469)..(474): n is a, c, g, or t
  misc_feature (476)..(478): n is a, c, g, or t
  misc_feature (480)..(483): n is a, c, g, or t
  misc_feature (486)..(486): n is a, c, g, or t
  misc_feature (488)..(490): n is a, c, g, or t
  misc_feature (492)..(495): n is a, c, g, or t
  misc_feature (497)..(498): n is a, c, g, or t
  misc_feature (500)..(500): n is a, c, g, or t
  misc_feature (502)..(505): n is a, c, g, or t
  misc_feature (510)..(510): n is a, c, g, or t
  misc_feature (513)..(514): n is a, c, g, or t
  misc_feature (516)..(517): n is a, c, g, or t
  misc_feature (520)..(521): n is a, c, g, or t
  misc_feature (525)..(535): n is a, c, g, or t
  misc_feature (538)..(539): n is a, c, g, or t
  misc_feature (541)..(544): n is a, c, g, or t
  misc_feature (546)..(559): n is a, c, g, or t
  misc_feature (561)..(563): n is a, c, g, or t
  misc_feature (565)..(567): n is a, c, g, or t
  misc_feature (569)..(569): n is a, c, g, or t
  misc_feature (572)..(573): n is a, c, g, or t
  misc_feature (578)..(590): n is a, c, g, or t
  misc_feature (592)..(593): n is a, c, g, or t
  misc_feature (596)..(596): n is a, c, g, or t
  misc_feature (598)..(603): n is a, c, g, or t
  misc_feature (605)..(611): n is a, c, g, or t
  misc_feature (613)..(622): n is a, c, g, or t
  misc_feature (624)..(624): n is a, c, g, or t
  misc_feature (626)..(626): n is a, c, g, or t
  misc_feature (630)..(631): n is a, c, g, or t
  misc_feature (633)..(634): n is a, c, g, or t
  misc_feature (636)..(638): n is a, c, g, or t
  misc_feature (641)..(647): n is a, c, g, or t
  misc_feature (650)..(651): n is a, c, g, or t
  misc_feature (653)..(656): n is a, c, g, or t
  misc_feature (659)..(665): n is a, c, g, or t
  misc_feature (667)..(671): n is a, c, g, or t
  misc_feature (673)..(681): n is a, c, g, or t
  misc_feature (683)..(684): n is a, c, g, or t
  misc_feature (686)..(688): n is a, c, g, or t
  misc_feature (694)..(695): n is a, c, g, or t
  misc_feature (697)..(697): n is a, c, g, or t
  misc_feature (699)..(699): n is a, c, g, or t
  misc_feature (703)..(704): n is a, c, g, or t
  misc_feature (706)..(706): n is a, c, g, or t
  misc_feature (708)..(709): n is a, c, g, or t
  misc_feature (712)..(713): n is a, c, g, or t
  misc_feature (715)..(715): n is a, c, g, or t
  misc_feature (717)..(717): n is a, c, g, or t
  misc_feature (719)..(722): n is a, c, g, or t
  misc_feature (724)..(727): n is a, c, g, or t
  misc_feature (729)..(740): n is a, c, g, or t
  misc_feature (742)..(744): n is a, c, g, or t
  misc_feature (746)..(746): n is a, c, g, or t
  misc_feature (749)..(755): n is a, c, g, or t
  misc_feature (757)..(765): n is a, c, g, or t
  misc_feature (768)..(774): n is a, c, g, or t
  misc_feature (776)..(776): n is a, c, g, or t
  misc_feature (778)..(778): n is a, c, g, or t
  misc_feature (780)..(787): n is a, c, g, or t
  misc_feature (789)..(793): n is a, c, g, or t
  misc_feature (795)..(800): n is a, c, g, or t
  misc_feature (803)..(803): n is a, c, g, or t
  misc_feature (805)..(810): n is a, c, g, or t
  misc_feature (813)..(815): n is a, c, g, or t
  misc_feature (817)..(818): n is a, c, g, or t
  misc_feature (821)..(828): n is a, c, g, or t
  misc_feature (830)..(831): n is a, c, g, or t
  misc_feature (833)..(834): n is a, c, g, or t
  misc_feature (837)..(837): n is a, c, g, or t
  misc_feature (839)..(839): n is a, c, g, or t
  misc_feature (841)..(846): n is a, c, g, or t
  misc_feature (849)..(859): n is a, c, g, or t
  misc_feature (861)..(876): n is a, c, g, or t
  misc_feature (878)..(881): n is a, c, g, or t
  misc_feature (884)..(884): n is a, c, g, or t
  misc_feature (886)..(886): n is a, c, g, or t
  misc_feature (888)..(890): n is a, c, g, or t
  misc_feature (892)..(896): n is a, c, g, or t
  misc_feature (898)..(899): n is a, c, g, or t
  misc_feature (901)..(901): n is a, c, g, or t
  misc_feature (903)..(913): n is a, c, g, or t
  misc_feature (915)..(923): n is a, c, g, or t
  misc_feature (925)..(928): n is a, c, g, or t
  misc_feature (933)..(933): n is a, c, g, or t
  misc_feature (936)..(937): n is a, c, g, or t
  misc_feature (939)..(940): n is a, c, g, or t
  misc_feature (942)..(945): n is a, c, g, or t
  misc_feature (947)..(947): n is a, c, g, or t
  misc_feature (949)..(952): n is a, c, g, or t
  misc_feature (954)..(960): n is a, c, g, or t
  misc_feature (962)..(964): n is a, c, g, or t
  misc_feature (967)..(970): n is a, c, g, or t
  misc_feature (972)..(972): n is a, c, g, or t
  misc_feature (974)..(976): n is a, c, g, or t
  misc_feature (978)..(978): n is a, c, g, or t
  misc_feature (980)..(988): n is a, c, g, or t
  misc_feature (990)..(991): n is a, c, g, or t
  misc_feature (993)..(995): n is a, c, g, or t
  misc_feature (998)..(999): n is a, c, g, or t
  misc_feature (1001)..(1007): n is a, c, g, or t
  misc_feature (1010)..(1019): n is a, c, g, or t
  misc_feature (1022)..(1032): n is a, c, g, or t
  misc_feature (1034)..(1035): n is a, c, g, or t
  misc_feature (1037)..(1042): n is a, c, g, or t
  misc_feature (1044)..(1049): n is a, c, g, or t
  misc_feature (1051)..(1056): n is a, c, g, or t
  misc_feature (1061)..(1065): n is a, c, g, or t
  misc_feature (1067)..(1073): n is a, c, g, or t
  misc_feature (1076)..(1079): n is a, c, g, or t
  misc_feature (1081)..(1081): n is a, c, g, or t
  misc_feature (1083)..(1086): n is a, c, g, or t
  misc_feature (1088)..(1089): n is a, c, g, or t
  misc_feature (1091)..(1097): n is a, c, g, or t
  misc_feature (1099)..(1106): n is a, c, g, or t
  misc_feature (1108)..(1109): n is a, c, g, or t
  misc_feature (1111)..(1116): n is a, c, g, or t
  misc_feature (1118)..(1118): n is a, c, g, or t
  misc_feature (1121)..(1121): n is a, c, g, or t
  misc_feature (1123)..(1123): n is a, c, g, or t
  misc_feature (1125)..(1125): n is a, c, g, or t
  misc_feature (1127)..(1129): n is a, c, g, or t
  misc_feature (1132)..(1138): n is a, c, g, or t
  misc_feature (1140)..(1143): n is a, c, g, or t
  misc_feature (1145)..(1145): n is a, c, g, or t
  misc_feature (1149)..(1151): n is a, c, g, or t
  misc_feature (1153)..(1154): n is a, c, g, or t
  misc_feature (1156)..(1163): n is a, c, g, or t
  misc_feature (1165)..(1169): n is a, c, g, or t
  misc_feature (1171)..(1180): n is a, c, g, or t
  misc_feature (1184)..(1185): n is a, c, g, or t
  misc_feature (1187)..(1188): n is a, c, g, or t
  misc_feature (1190)..(1193): n is a, c, g, or t
  misc_feature (1195)..(1196): n is a, c, g, or t
  misc_feature (1198)..(1204): n is a, c, g, or t
  misc_feature (1206)..(1217): n is a, c, g, or t
  misc_feature (1219)..(1222): n is a, c, g, or t
  misc_feature (1226)..(1228): n is a, c, g, or t
  misc_feature (1230)..(1232): n is a, c, g, or t
  misc_feature (1234)..(1236): n is a, c, g, or t
  misc_feature (1238)..(1240): n is a, c, g, or t
  misc_feature (1242)..(1245): n is a, c, g, or t
  misc_feature (1248)..(1248): n is a, c, g, or t
  misc_feature (1250)..(1251): n is a, c, g, or t
  misc_feature (1255)..(1275): n is a, c, g, or t
  misc_feature (1277)..(1278): n is a, c, g, or t
  misc_feature (1281)..(1282): n is a, c, g, or t
  misc_feature (1284)..(1286): n is a, c, g, or t
  misc_feature (1288)..(1293): n is a, c, g, or t
  misc_feature (1295)..(1297): n is a, c, g, or t
  misc_feature (1300)..(1300): n is a, c, g, or t
  misc_feature (1302)..(1303): n is a, c, g, or t
  misc_feature (1305)..(1307): n is a, c, g, or t
  misc_feature (1309)..(1310): n is a, c, g, or t
  misc_feature (1312)..(1312): n is a, c, g, or t
  misc_feature (1315)..(1315): n is a, c, g, or t
  misc_feature (1317)..(1327): n is a, c, g, or t
  misc_feature (1329)..(1341): n is a, c, g, or t
  misc_feature (1343)..(1343): n is a, c, g, or t
  misc_feature (1345)..(1352): n is a, c, g, or t
  misc_feature (1354)..(1354): n is a, c, g, or t
  misc_feature (1356)..(1356): n is a, c, g, or t
  misc_feature (1359)..(1365): n is a, c, g, or t
  misc_feature (1367)..(1367): n is a, c, g, or t
  misc_feature (1369)..(1369): n is a, c, g, or t
  misc_feature (1371)..(1378): n is a, c, g, or t
  misc_feature (1380)..(1381): n is a, c, g, or t
  misc_feature (1383)..(1388): n is a, c, g, or t
  misc_feature (1390)..(1391): n is a, c, g, or t
  misc_feature (1393)..(1394): n is a, c, g, or t
  misc_feature (1396)..(1396): n is a, c, g, or t
  misc_feature (1399)..(1401): n is a, c, g, or t
  misc_feature (1404)..(1405): n is a, c, g, or t
  misc_feature (1407)..(1410): n is a, c, g, or t
  misc_feature (1414)..(1414): n is a, c, g, or t
  misc_feature (1416)..(1423): n is a, c, g, or t
  misc_feature (1425)..(1438): n is a, c, g, or t
  misc_feature (1440)..(1441): n is a, c, g, or t
  misc_feature (1445)..(1445): n is a, c, g, or t
  misc_feature (1449)..(1450): n is a, c, g, or t
  misc_feature (1452)..(1454): n is a, c, g, or t
  misc_feature (1456)..(1465): n is a, c, g, or t
  misc_feature (1468)..(1469): n is a, c, g, or t
  misc_feature (1471)..(1478): n is a, c, g, or t
  misc_feature (1480)..(1492): n is a, c, g, or t
  misc_feature (1494)..(1496): n is a, c, g, or t
  misc_feature (1499)..(1504): n is a, c, g, or t
  misc_feature (1507)..(1512): n is a, c, g, or t
  misc_feature (1514)..(1514): n is a, c, g, or t
  misc_feature (1516)..(1520): n is a, c, g, or t
  misc_feature (1522)..(1526): n is a, c, g, or t
  misc_feature (1529)..(1530): n is a, c, g, or t
  misc_feature (1533)..(1533): n is a, c, g, or t
  misc_feature (1535)..(1535): n is a, c, g, or t
  misc_feature (1538)..(1538): n is a, c, g, or t
  misc_feature (1540)..(1541): n is a, c, g, or t
  misc_feature (1543)..(1546): n is a, c, g, or t
  misc_feature (1549)..(1553): n is a, c, g, or t
  misc_feature (1555)..(1556): n is a, c, g, or t
  misc_feature (1558)..(1558): n is a, c, g, or t
  misc_feature (1560)..(1561): n is a, c, g, or t
  misc_feature (1564)..(1571): n is a, c, g, or t
  misc_feature (1573)..(1574): n is a, c, g, or t
  misc_feature (1576)..(1589): n is a, c, g, or t
  misc_feature (1592)..(1598): n is a, c, g, or t
  misc_feature (1600)..(1603): n is a, c, g, or t
  misc_feature (1605)..(1607): n is a, c, g, or t
  misc_feature (1609)..(1610): n is a, c, g, or t
  misc_feature (1612)..(1613): n is a, c, g, or t
  misc_feature (1615)..(1617): n is a, c, g, or t
  misc_feature (1619)..(1619): n is a, c, g, or t
  misc_feature (1621)..(1622): n is a, c, g, or t
  misc_feature (1624)..(1630): n is a, c, g, or t
  misc_feature (1632)..(1633): n is a, c, g, or t
  misc_feature (1635)..(1641): n is a, c, g, or t
  misc_feature (1643)..(1644): n is a, c, g, or t
  misc_feature (1646)..(1647): n is a, c, g, or t
  misc_feature (1652)..(1654): n is a, c, g, or t
  misc_feature (1657)..(1657): n is a, c, g, or t
  misc_feature (1659)..(1659): n is a, c, g, or t
  misc_feature (1665)..(1667): n is a, c, g, or t
  misc_feature (1669)..(1670): n is a, c, g, or t
  misc_feature (1673)..(1674): n is a, c, g, or t
  misc_feature (1678)..(1679): n is a, c, g, or t
  misc_feature (1682)..(1684): n is a, c, g, or t
  misc_feature (1687)..(1688): n is a, c, g, or t
  misc_feature (1690)..(1693): n is a, c, g, or t
  misc_feature (1696)..(1696): n is a, c, g, or t
  misc_feature (1700)..(1700): n is a, c, g, or t
  misc_feature (1703)..(1704): n is a, c, g, or t
  misc_feature (1706)..(1707): n is a, c, g, or t
  misc_feature (1709)..(1709): n is a, c, g, or t
  misc_feature (1719)..(1721): n is a, c, g, or t
  misc_feature (1723)..(1724): n is a, c, g, or t
  misc_feature (1726)..(1729): n is a, c, g, or t
  misc_feature (1731)..(1732): n is a, c, g, or t
  misc_feature (1738)..(1740): n is a, c, g, or t
  misc_feature (1744)..(1745): n is a, c, g, or t
  misc_feature (1747)..(1748): n is a, c, g, or t
  misc_feature (1750)..(1751): n is a, c, g, or t
  misc_feature (1755)..(1757): n is a, c, g, or t
  misc_feature (1759)..(1766): n is a, c, g, or t
  misc_feature (1782)..(1783): n is a, c, g, or t
  misc_feature (1790)..(1791): n is a, c, g, or t
  misc_feature (1794)..(1796): n is a, c, g, or t
  misc_feature (1799)..(1799): n is a, c, g, or t
  misc_feature (1979)..(1981): n is a, c, g, or t
  misc_feature (1984)..(1984): n is a, c, g, or t
  misc_feature (1987)..(1987): n is a, c, g, or t
  misc_feature (1989)..(1990): n is a, c, g, or t
  misc_feature (1995)..(1995): n is a, c, g, or t
  misc_feature (1998)..(1998): n is a, c, g, or t
  misc_feature (2000)..(2000): n is a, c, g, or t
  misc_feature (2002)..(2003): n is a, c, g, or t
  misc_feature (2005)..(2006): n is a, c, g, or t
  misc_feature (2008)..(2011): n is a, c, g, or t
  misc_feature (2013)..(2017): n is a, c, g, or t
  misc_feature (2023)..(2025): n is a, c, g, or t
  misc_feature (2028)..(2032): n is a, c, g, or t
  misc_feature (2035)..(2043): n is a, c, g, or t
  misc_feature (2052)..(2052): n is a, c, g, or t
  misc_feature (3199)..(3199): n is a, c, g, or t
  misc_feature (3203)..(3208): n is a, c, g, or t
  misc_feature (3210)..(3223): n is a, c, g, or t
  misc_feature (3226)..(3229): n is a, c, g, or t
  misc_feature (3231)..(3234): n is a, c, g, or t
  misc_feature (3236)..(3239): n is a, c, g, or t
  misc_feature (3242)..(3242): n is a, c, g, or t
  misc_feature (3244)..(3251): n is a, c, g, or t
  misc_feature (3253)..(3260): n is a, c, g, or t
  misc_feature (3264)..(3264): n is a, c, g, or t
  misc_feature (3266)..(3268): n is a, c, g, or t
  misc_feature (3270)..(3274): n is a, c, g, or t
  misc_feature (3276)..(3281): n is a, c, g, or t
  misc_feature (3283)..(3286): n is a, c, g, or t
  misc_feature (3288)..(3295): n is a, c, g, or t
  misc_feature (3297)..(3302): n is a, c, g, or t
  misc_feature (3304)..(3308): n is a, c, g, or t
  misc_feature (3310)..(3311): n is a, c, g, or t
  misc_feature (3314)..(3314): n is a, c, g, or t
  misc_feature (3316)..(3317): n is a, c, g, or t
  misc_feature (3320)..(3320): n is a, c, g, or t
  misc_feature (3323)..(3323): n is a, c, g, or t
  misc_feature (3326)..(3326): n is a, c, g, or t
  misc_feature (3328)..(3329): n is a, c, g, or t
  misc_feature (3332)..(3332): n is a, c, g, or t
  misc_feature (3334)..(3336): n is a, c, g, or t
  misc_feature (3338)..(3339): n is a, c, g, or t
  misc_feature (3342)..(3351): n is a, c, g, or t
  misc_feature (3355)..(3356): n is a, c, g, or t
  misc_feature (3359)..(3363): n is a, c, g, or t
  misc_feature (3368)..(3373): n is a, c, g, or t
  misc_feature (3375)..(3381): n is a, c, g, or t
  misc_feature (3383)..(3390): n is a, c, g, or t
  misc_feature (3392)..(3395): n is a, c, g, or t
  misc_feature (3397)..(3397): n is a, c, g, or t
  misc_feature (3399)..(3400): n is a, c, g, or t
  misc_feature (3403)..(3408): n is a, c, g, or t
  misc_feature (3411)..(3416): n is a, c, g, or t
  misc_feature (3418)..(3418): n is a, c, g, or t
  misc_feature (3420)..(3423): n is a, c, g, or t
  misc_feature (3425)..(3425): n is a, c, g, or t
  misc_feature (3427)..(3431): n is a, c, g, or t
  misc_feature (3433)..(3434): n is a, c, g, or t
  misc_feature (3436)..(3436): n is a, c, g, or t
  misc_feature (3438)..(3439): n is a, c, g, or t
  misc_feature (3441)..(3450): n is a, c, g, or t
  misc_feature (3452)..(3453): n is a, c, g, or t
  misc_feature (3455)..(3457): n is a, c, g, or t
  misc_feature (3459)..(3460): n is a, c, g, or t
  misc_feature (3464)..(3467): n is a, c, g, or t
  misc_feature (3469)..(3469): n is a, c, g, or t
  misc_feature (3472)..(3476): n is a, c, g, or t
  misc_feature (3478)..(3478): n is a, c, g, or t
  misc_feature (3480)..(3480): n is a, c, g, or t
  misc_feature (3482)..(3483): n is a, c, g, or t
  misc_feature (3485)..(3487): n is a, c, g, or t
  misc_feature (3491)..(3492): n is a, c, g, or t
  misc_feature (3494)..(3495): n is a, c, g, or t
  misc_feature (3497)..(3497): n is a, c, g, or t
  misc_feature (3500)..(3500): n is a, c, g, or t
  misc_feature (3506)..(3506): n is a, c, g, or t
  misc_feature (3509)..(3509): n is a, c, g, or t
  misc_feature (3511)..(3533): n is a, c, g, or t
  misc_feature (3536)..(3537): n is a, c, g, or t
  misc_feature (3540)..(3542): n is a, c, g, or t
  misc_feature (3545)..(3551): n is a, c, g, or t
  misc_feature (3553)..(3555): n is a, c, g, or t
  misc_feature (3557)..(3557): n is a, c, g, or t
  misc_feature (3560)..(3576): n is a, c, g, or t
  misc_feature (3578)..(3581): n is a, c, g, or t
  misc_feature (3585)..(3585): n is a, c, g, or t
  misc_feature (3587)..(3587): n is a, c, g, or t
  misc_feature (3589)..(3590): n is a, c, g, or t
  misc_feature (3594)..(3596): n is a, c, g, or t
  misc_feature (3598)..(3598): n is a, c, g, or t
  misc_feature (3601)..(3602): n is a, c, g, or t
  misc_feature (3606)..(3607): n is a, c, g, or t
  misc_feature (3609)..(3610): n is a, c, g, or t
  misc_feature (3613)..(3614): n is a, c, g, or t
  misc_feature (3616)..(3616): n is a, c, g, or t
  misc_feature (3618)..(3619): n is a, c, g, or t
  misc_feature (3622)..(3631): n is a, c, g, or t
  misc_feature (3633)..(3645): n is a, c, g, or t
  misc_feature (3648)..(3653): n is a, c, g, or t
  misc_feature (3655)..(3657): n is a, c, g, or t
  misc_feature (3659)..(3660): n is a, c, g, or t
  misc_feature (3662)..(3662): n is a, c, g, or t
  misc_feature (3664)..(3664): n is a, c, g, or t
  misc_feature (3666)..(3670): n is a, c, g, or t
  misc_feature (3673)..(3673): n is a, c, g, or t
  misc_feature (3675)..(3675): n is a, c, g, or t
  misc_feature (3677)..(3681): n is a, c, g, or t
  misc_feature (3684)..(3684): n is a, c, g, or t
  misc_feature (3686)..(3687): n is a, c, g, or t
  misc_feature (3694)..(3695): n is a, c, g, or t
  misc_feature (3697)..(3698): n is a, c, g, or t
  misc_feature (3701)..(3705): n is a, c, g, or t
  misc_feature (3707)..(3707): n is a, c, g, or t
  misc_feature (3710)..(3710): n is a, c, g, or t
  misc_feature (3712)..(3712): n is a, c, g, or t
  misc_feature (3714)..(3719): n is a, c, g, or t
  misc_feature (3721)..(3721): n is a, c, g, or t
  misc_feature (3723)..(3730): n is a, c, g, or t
  misc_feature (3732)..(3742): n is a, c, g, or t
  misc_feature (3744)..(3744): n is a, c, g, or t
  misc_feature (3747)..(3751): n is a, c, g, or t
  misc_feature (3767)..(3767): n is a, c, g, or t
  misc_feature (3770)..(3770): n is a, c, g, or t
  misc_feature (3773)..(3774): n is a, c, g, or t
  misc_feature (3776)..(3782): n is a, c, g, or t
  misc_feature (3784)..(3785): n is a, c, g, or t
  misc_feature (3787)..(3789): n is a, c, g, or t
  misc_feature (3791)..(3791): n is a, c, g, or t
  misc_feature (3793)..(3796): n is a, c, g, or t
  misc_feature (3801)..(3802): n is a, c, g, or t
  misc_feature (3804)..(3804): n is a, c, g, or t
  misc_feature (3806)..(3809): n is a, c, g, or t
  misc_feature (3811)..(3813): n is a, c, g, or t
  misc_feature (3815)..(3817): n is a, c, g, or t
  misc_feature (3819)..(3822): n is a, c, g, or t
  misc_feature (3824)..(3828): n is a, c, g, or t
  misc_feature (3830)..(3836): n is a, c, g, or t
  misc_feature (3839)..(3841): n is a, c, g, or t
  misc_feature (3843)..(3844): n is a, c, g, or t
  misc_feature (3846)..(3846): n is a, c, g, or t
  misc_feature (3848)..(3854): n is a, c, g, or t
  misc_feature (3857)..(3857): n is a, c, g, or t
  misc_feature (3859)..(3862): n is a, c, g, or t
  misc_feature (3864)..(3869): n is a, c, g, or t
  misc_feature (3873)..(3873): n is a, c, g, or t
  misc_feature (3875)..(3881): n is a, c, g, or t
  misc_feature (3884)..(3886): n is a, c, g, or t
  misc_feature (3888)..(3889): n is a, c, g, or t
  misc_feature (3891)..(3892): n is a, c, g, or t
  misc_feature (3894)..(3895): n is a, c, g, or t
  misc_feature (3897)..(3898): n is a, c, g, or t
  misc_feature (3900)..(3901): n is a, c, g, or t
  misc_feature (3903)..(3904): n is a, c, g, or t
  misc_feature (3906)..(3907): n is a, c, g, or t
  misc_feature (3909)..(3912): n is a, c, g, or t
  misc_feature (3914)..(3918): n is a, c, g, or t
  misc_feature (3920)..(3922): n is a, c, g, or t
  misc_feature (3925)..(3925): n is a, c, g, or t
  misc_feature (3941)..(3941): n is a, c, g, or t
  misc_feature (3944)..(3945): n is a, c, g, or t
  misc_feature (3948)..(3948): n is a, c, g, or t
  misc_feature (3951)..(3952): n is a, c, g, or t
  misc_feature (3954)..(3955): n is a, c, g, or t
  misc_feature (3957)..(3957): n is a, c, g, or t
  misc_feature (3959)..(3961): n is a, c, g, or t
  misc_feature (3964)..(3966): n is a, c, g, or t
  misc_feature (3968)..(3970): n is a, c, g, or t
  misc_feature (3973)..(3978): n is a, c, g, or t
  misc_feature (3981)..(3985): n is a, c, g, or t
  misc_feature (3987)..(3988): n is a, c, g, or t
  misc_feature (3990)..(3991): n is a, c, g, or t
  misc_feature (3993)..(3994): n is a, c, g, or t
  misc_feature (3996)..(3997): n is a, c, g, or t
  misc_feature (3999)..(3999): n is a, c, g, or t
cnnnncncnnnnnncnnncncnnnnnnnnncnnnnnnnnnnnannnnngcncnngnnnnnnnnnncncnnncncnnnntnnnnnngnnnnncgnnnnnntcgnnncnnnnnnnnnnnnnnnnnnnnnnnnnnnnnnnnnnnncnnnnncnncnnnnnnaaacncanncnnnnnnnnnnaaannnncnnncgnnnnncnnnnnaancnnnnnnnngnncnnnnnnnnnnnatnnngtnnnnnnnnnnnnnnnnngnnngnncncgnnnncgcnngcgnngncgngnnngnncgcnnnnnnnngnnnnnnnnnnncnncnncnncnnnnnccnnnnnnnnnnnnntnnnnnnngnnnnnnnngnnnnnnnnnnnnnnncgncgcncgncnncgncnnnnttnnnnnnnnnncnnnnncnntnnnntnnntnncnnnnnngnnnnnntnttnnnnnnnntnnnggnngnntnnnnnngnnngnnnncgngnnngnnnngnngngnnnngtcgngtnncnngannacgnnnnnnnnnnnatnnannnnannnnnnnnnnnnnnannntnnntntgnntgtgnnnnnnnnnnnnnannatnannnnnnannnnnnncnnnnnnnnnngngngacnngnncnnnaannnnnnnctnntnnnnttnnnnnnngnnnnngnnnnnnnnnanncnnncgattnncncncggnncncnnccnncncncnnnncnnnngnnnnnnnnnnnntnnntngtnnnnnnncnnnnnnnnnaannnnnnntncntnnnnnnnncnnnnnannnnnngcncnnnnnntgnnngnngcnnnnnnnngnngnnggntngnnnnnnatnnnnnnnnnnntnnnnnnnnnnnnnnnnannnnacncncnnncnnnnngnngncnnnnnnnnnnnannnnnnnnngnnnntgttnttnntnntnnnntncnnnnannnnnnncnnntcnnnntngnnngntnnnnnnnnncnnannnaanncnnnnnnnggnnnnnnnnnngannnnnnnnnnngnngnnnnnntnnnnnngnnnnnngcgcnnnnngnnnnnnntgnnnntntnnnntnntnnnnnnntnnnnnnnncnncnnnnnnancanantnannnaannnnnnncnnnncncgcnnncnncnnnnnnnncnnnnncnnnnnnnnnnccgnncnntnnnncnncnnnnnnntnnnnnnnnnnnngnnnngcgnnngnnngnnncnnnannnnatngnntcgnnnnnnnnnnnnnnnnnnnnnanntannannnannnnnnannnacncnngnnncnncngcncnnnnnnnnnnntnnnnnnnnnnnnnancnnnnnnnntngntcnnnnnnngngngnnnnnnnngnncnnnnnnanncnncnccnnncgnncnnnncacncnnnnnnnntnnnnnnnnnnnnnntnntctntttnntnnntnnnnnnnnnnacnnannnnnnnngnnnnnnnnnnnnncnnnatnnnnnntcnnnnnnancnnnnngnnnnncgnncgntncgngnngnnnntgnnnnncnncngnngcnnnnnnnncnngnnnnnnnnnnnnnnggnnnnnnncnnnngnnntnncnncnnncncnncnnnnnnncnncnnnnnnncnncnnttttnnntcncnttcgtnnntnnatnngatnnggnnncgnncnnnncancgancgnncnncncgcgtttcgnnngnntnnnncnnctcgcnnncccnngnntnngggnnngnnnnnnnncgtcgtcgcgcggggnncgggggnnggnnntgngctcggcttcggcttcggcgcgtcgtgaagtgaagtgacgtcgccgagtgagagggcaacccgcacacgtcgacgccgcatccgtcgtcggtcggatccgcgcgcggtgacgacggcgatgatgcgcgcggtgaggacgtcgacgacgacgtgggcgcgtcgcctcgctagggaggccgnnncgncgngnngtcgncgncngnngnngnnnntnnnnncgacgnnncgnnnnncgnnnnnnnnngatgatganggagtggcggcggctgagtgtatgggtaaacagttagaagagacaagaacaacgaccacagaagcgctgtcgttcacgctgcgcgtcgatgaaaccgccccgacgccgtcgcggttggacgcctacgtctcctctcgcgtcgacgacccggggttttctcgcggacgcgtcgcggcggcgatcaaggcgagtaaagtgagactcaacggacgcgtggaacgcaagccgtcgcgcgcgttgaaaccgggggacgtcgtggagggggcgctggagcccgaaccgacgagtgaggcgacgccggaaccgtggatagagttggatgtggtgtatgaggacgcgagcgtgttggtggtgaataaaccggcggggatggtgacgcatccgagcgcggggcacgcgagcggtacgttggtcaacgccgtgttggggcactgcgagcttccggaactcgtcgttccaacgggtaggaagtcgacgacgcaccgaggtggtgaagatgaggatgaggatgaggatgaggaacccatcgggggggattctcaaggggtgacgacgaggccggggattgtacacaggttggataaaggaacgagcggcgtcatggttgtggccaaggacgcggcggcgcacaactcactctgcgatcaattcgccgcgcgagaggttcggagacggtacgtcgccattcttagcggtgttccgacgccgaaaaaggggcggatcgaggcgccaatcggacgcgatccgcgagataggcttcgcatggcggtgacgcccggcggcgggaggttcgcggcgagcaattacgaagtcatcgcgacgctcgccaatggcaatgcctctctcgtcgaatggcggctggagactggacgaacccaccaaattcgcgtgcacgccaaacacatcggtcacccgatcctcggcgacgacgtgtacggcggtggtgggggttccgcggtgagcgcgttgacgcgttacggcgtcctcgcgccgaaagaggcgaaagccatcctgtccaaaatcgacagaccgatgcttcacgcgcgaaccttggggttttcccacccacgcaccgcggaaagtcttcactttacgcgagatccaccggacgatttcgcccagtttgccgccgcgttgtctctatcgncgtnnnnnncnnnnnnnnnnnnnncgnnnngnnnnannnnttncnnnnnnnncnnnnnnnnccgngnnnannnnntnnnnnncnnnncnnnnnnnncnnnnnntnnnnntnnttntnnttnttnttntnnttntnnncnntgnnnnnnnnnnttcnntgnnnnncgtgnnnnnngnnnnnnngnnnnnnnngnnnncngnncgnnnnnnccnnnnnncncnnnncncnnnnntnncnannannnnnnnnnncnngnnngnngcgnnnnangcnnnnnangncnncnnngacnncnncnacnacgacnacnannnnnnnnnnnnnnnnnnnnnnncgnnttnnncgnnnnnnncnnngncgnnnnnnnnnnnnnnnnncnnnngcgncngnngcgnnngntgnncganntnntcnncntnntcnnnnnnnnnnannnnnnnnnnnnnccnnnnnngnnncnncngngnnnnncgngngnnnnncgngnngatcganngnntcnnnnncntcngngnnnnnngngnnnnnnnngnnnnnnnnnnngncgnnnnngtcgtcgtcgtcgtcntcntcnncnnnnnnnannannnanannnncggcnncncnnnntnnncnnntnnnngnnnnngnnnnnnncgnnncnnangnnnnnnnggnannnnannnnnntcancnnnnnnnaannngnngnngnngnngnngnngnngnnnntnnnnnannncgncgacgacgacgacgangannagnagnngnngngnnngannngnnngannnnnntgnnnnngnngnngnngnngnt

SEQ ID NO: 1338 - DNA, 4000 bp, Escherichia coli
  misc_feature (49)..(49): n is a, c, g, or t
  misc_feature (394)..(394): n is a, c, g, or t
  misc_feature (1544)..(1544): n is a, c, g, or t
  misc_feature (2608)..(2608): n is a, c, g, or t
caaagacaataggaatgacaatgggaatcatcggtctatttgtcagtangttttcgacaagtaccctcgccgccgcagaacctggtgccccccctgcagcccaatacaacaaacacctcacctgcgccgtgtactaccgaatggtggccggcagtttcaaacgccaaggcaatggcatcttggccgcgccagccctggatcaaatgaatctaatgatcacgcgcacaaaggcactcggcgcggcgttaggccataccgaggctgattatttgagtgattggtcggacaccctaggtgtcatgacggatcaaatgaatcgcaactatgacaatattcgccaactgaaaacgcgctaccaaaatcgctgcaaagcgcttaatgactgacaacccgntctgccaacccgcgtatcacaccgcgcatcgatcggtttaaaagtcaggcgctgcctcgagcatcaggacgcggttcgttgcgggatgcgcaaaggtcagcctctgagcatgcagcattaaccgcgcccccgacgcacgcaccgacgccggcgcatacaaatcgcatcccacaatgggcagcccaatcaaggcaaggtgcagtcgcagttgatggcgaacgcccgttacgggcatcaaggcgagtctcgtctgcgagccggctgcgctcagaacccgatatcgcgtcaatgcctgcttccctgtccgccaattgacccgctggcaggggcgtcgtaaccggtcgggcccaagtggaaaggtgatttcgccagcatcaactgcggccgttccggcaacctgcgcaacatactgcttgtcaatccggcgctcacgaaacaattgattgagtccggagattccccgtttagaacacccaaaaaccaccaaccctgaggtgtcgaggtccaagcgatgcaccgcttgggcctcagctcgcagggcttgagcctcgttcagcaaacaccgcttttcgaaccgaccgggcgtcgtaaacagccctgctggcttattcatcaccagtaggtgctcatcttcataaatgatccaatctttcacattacgccgtctcaatcgtttcttgccttctgcttgggtatcataccggttcagcgaagcagaatcggtcttatgactcagaatatcgaacaccttggcgaggtcattaccgctgccgttccagcgctcctcacagcgcttgaggtaatggaaacggtgcaacagggccaccatccggctcggccacaggcgaccatcaactttatcgaaccgtttatcgaatcgctcaatgaggcgcacgcatcgcttgcgccgctgacttttcccacgcaaatcgaaaagtttggcgagcatctcaagaccagctttctgtatgcaagccggaccggtgagaatcttaccgccacagccgaagactcaatggcattcttccgagcaaacagaaccttcagtaaagcgttggatcacctattcccgttggcgaccctattgaatccaatccatcagtttttcctagaggcgccgctgcggcacagcccgaacgtagccgagcantttttgtctgagccgagccattatcccatcacccacatcgaaaatgcctatgatcaacggggcggcgcgtcgatctacattccgcactgggtcgacccgaatgctttgacgcccgtggtcatcgcacttcacggtggagccggccatggccgggacatgctctggcattggttacgagaagcgcgcagccgagggtttgttttgatcgcgcccacgtcaagcgaggatacttggcggctcaaccgtcccgagctggaacaaccggcacttttggccttattgcacttcgtcaaagatcagatccaaatcgatgagacgaaaatcctactctctggcttatcggacggcgccacgctttcgttacagttgggcttacaacctgacgcgccatttacgcatttggcccctttctcaggcaccctcgatcctgccctcgtcagtcaggaggtggatcttttacagcaagacaagcccatctacttagtacacggcgataacgattggatgtttccagtggagattggccaaatggcagcggaattactgggcgctcgcaatccgaatctcatttataatgagatcaaaggattgggccacacctttgcccgatcagagttgaagcaattattgccctggttttcagcggcactctcactggagcaataacctatgacgaatcgactgatattgtgtgtcttgctggtcattatcagcccttggctactcgccaaagaattgatcctgctccacaccaacgattttcacgggcacattcaacaagagggcaagtacgcaggcgcggctaaaattgcagcgtttgtaaaggaaatcaaagctcagcaccctgcggtattgctgctagatgctggcgacgccatctctggaacacctgtgtccagcatgtttgaaggcgaacccatattcgatgttatgaatgcgatgggctacgacgtcggcctgattggcaaccacgaatttgatcatggctataaaaagatcgagcgctttcgcgccatcgccaaccaccctttattaaccgccaatgctcttggcccggacggcgngctattgggcgatgccccttatttactgcgcaacctcgatggcatccgagttgggatcatcggcttgatcaccgagacagcccccaccttgttttcaccgaccggcaacgaagggttaacctttttaaatcccgccgatcgactttccgaactcgtgcccatgctcaggcccaaaaccgatgttttgattctactctcccacattggacatgaagcagaattggtattggcagaacagttccaggatcttgatctcatcattggcggacattcgcacaccttggtgcagcatccagtgcgggttggtaaaaccctcgtcgcccaagccaaccactacggcagtcatttagggctgatcaagatcaaggtgcccgacgcggggcaggggtccctcgatattcaaggcgatttgattgccgcgaacgagctgcccgatggggatcccgcaacgcaagcgctggtttcatcctatgaagcaaaggttgaagatcaagtcgatatcaagatcgctgtcattcgcaaaaactatagcaaaatagcgcttcaaccgattcttgaagacatcttggccgaggctatcggggccgacctgggctattacaatcggaccggtattcgcgatgtcctctcagagggtgatgtcacagcgagaatgatttggaaccttgagccctttggtaataccctggttaagctcaccctaagcggcgctgacttgttgatactgctcagccaagagcccaccctgcatcacgcagccaacgcaattgatccagaacgacgttatcagctcgcaaccaattcgtttatcgcatcccacgcgaccctggcctttggcgatgccatcaccgccgtcgataccggtattttagtccgcgatattttgatccaacagatcaaagccaagggtctgcagtaacgggccgcctcgtcttaggcgcctttaaagaatccgcgaacctcccccacaaagcggtcgagctgatcatgctgcacccaatgacccgcgtgatcaaaccgaacagaacgcgcattgttaaagtgttccgccgggtcacccggttgatgacgaccaaactcgctttcgctgccgctgattaataacaaaggtgcattgattctcgaccagagttgctgcgtctgcgcaagggtcaaatcaaagggcgccatgacatgggtttggttatcaaacttccaggaataggtgccgtcttcgttttggttactaccatgcactgttaagtggcgcgcttgggcttcgctcaaatgcttattttccgtgcgcatccgctcaaaggcttcttctaaggtggcataccgccgcggcgttcggcccgcgctgccccgcgtactgtcaacgaaggactgaatgcgctcgtgcaccgggacttc

SEQ ID NO: 1339 - DNA, 4000 bp, Escherichia coli
  misc_feature (1969)..(1969): n is a, c, g, or t
  misc_feature (1973)..(1973): n is a, c, g, or t
  misc_feature (1976)..(1976): n is a, c, g, or t
  misc_feature (1978)..(1978): n is a, c, g, or t
  misc_feature (1982)..(1982): n is a, c, g, or t
  misc_feature (1987)..(1988): n is a, c, g, or t
  misc_feature (1992)..(1994): n is a, c, g, or t
  misc_feature (1998)..(1998): n is a, c, g, or t
  misc_feature (3987)..(3987): n is a, c, g, or t
gccggtaccatcgggttgtgcccaacctcctgtctccctcgacccgcggcgccatcgatctccccggtgctgacctcgattggctccaccagctcatcgccgattggcaggtgatcgcagacctatcggtgtccgacctggtgctgtggatccgcaccagcaccggacgtttcgtcgccgccgcccactcccgtcccgccacgggcgccaccgtccacctcgaggaggtcatcggccgacgtatgcccgccgcccgcgaggcgatggcgctggaggcgctcaccagcgtgcaggtcgtcgtcgccgccgatccggaatggaccggcacgaccgccgtgcgcgaggaatacgtcccggtggtgcgtgacagtgaacccatcgccatcatcacacgggagacctcggtgggcgtcatgcgcggcgggcggatcgtccaccagccccaggaggatctggccgacgcgttgtgcctcatgatctcccagggcgccttcccgatccggggcgccgccaccgcggtgcgacacggcactccgcgcgtgggcgacggtgtcgtcaggctcgacgacgacggagtcgtggtctacacctcccccaatgcgcgatcctgcttccaccggctggggctggtcgacgagatcgacggacaggtactcgccgaggccgtcactcggatcattcccgagcgcacgcccgtggatgagacgctggcggtcgtgctcatggggcgccaggcctggctgaccgagatcgaggtcggcgggatcttcctgtcggtgcgctccatcccactgcgtcgcgacgggcatcgcgccggtgctctgctgctggtgcgcgacgtctcggagatccgacgacgcgagcaggtgctgctcaacaaggacgccaccatccgcgagatccaccaccgggtcaagaacaacctgcagacggtctcggccctcctgcgactccagggccgacgcgccaccaatgacgagacccgcgaggcgctggccgaggccgagcgccgcgtcgccaccattgcgacggtgcacgcggccctgagccagaacgtcgacgagaccgtcgatttcgacgaggtcttcgcgtccgtgctacgcggcgctgcggcggtggcctccgctggcggacgcgtgaccacccgcctcgaaggcgccttcggggtggtggaggccgatgcggcccaggcgctggcgacggtcctggccgagctggtcaccaacgccgtcgagcacgggcttcaggatcacgacggcaccgtggtcgtcaccgctcagcgcgatgacgacgagctgaccgtccacgtcatcgacgacggcgtcggccttgagcccggagcggcgatgacgggactgggaacgcggatcgtatccaccctggtgcacggggagctgcgcggcaccatcgattggcgacccgtgagcgatccggtgcgtgaggcgaggggcaccgacgtcgtcgtgcgcgcccggctcgctccgtcggcctgatcgtctcggcatcgcgggtcgacgcccgacgcgtttcgatgacggaaccggcgaggcccgccgatgggcgggatcgcctcgcacatgggtttcggcttgaagcttgaaggaggtgcgcggcgtctacaacgaggtgtgcggcacagcccgtgaccgggtcggcgctgcgaccagatctctccccagtgcgacggtgccgaccggtgcaagactcagccagcgacactggaacgaggcggtggcgtatcgggtcgtctacgacgccgaggtcttcggatgacgcctgcgctggacaccatgcggcaggataacaagacgagcgtttccgatctcatgccggcgcgatccctcgtgcgcgacaatgaaataatgaggaataccttgtcttccaccgggggaggaggcatgcgccgcgcacggtcgtgcgccgtgagtactcgacctgctgaagcggaattttgaagccgtctgacgcnccgngcncnccgnccgcnngggnnngggncgggggggggggggggggggggggagccgctcgccgtttgagggaacgacgctcgtcctcgctcatccccccccacacgccagcatcctgaccgttctccagagcccacttcaagcaggtgtcgatgacctcgcagcgggcgcacacctctttcgcctcggcgatctgcgcgatggccggaccggtgttgccgacggggaagaagagctccgggtcaacggtgagacatgctgcctgacttcgccagtccatgagggctcccttcggggtacgtcttgcggcccgcctatacccgccataccgagcggtgctcggagatgagcaacaggttgtcgcgttctgagccaactttcacacgcgtgcgcaggtgtggcaagagttcagcggtgagaggtgcgccggcgaccttgtcgttatggtcacaggaacgaatccttgattctgagcgattcggaggcataagggaagccacgtcaggttgctgcagcagttgcgtcggcggcgatctgtatggggacggtatccccccgggacaccaggaccccgcggcccggatgcgtgggcgctcgcgggtcggtcaccgctcgcagcgagcgtcccgccacctgcgaggccggtcccagggcgggccacagtacgactagatcgccgcgctcgcgcagggtcgccaacggcccccggtacgtgcccacaacgcgttcggtggtcgccgaggccaggacgatccgtccgctgtgcagagctctctccactcgagagagcaccaccgcctcggccagatcgagatcgtcgatcgccaggaccggctcgtccggattttcatgaaggcagcgcttgagcgcggccagtgccgtcgtgcgcccggatcccgggggtccgaccacgagcacgcagccgcgggggaccggcaggggccgggcgtcatcaccgcccacggcccacgttccggccaggggcgccaccgtccgggggatcgcgaccaggcggtgggccgacctcgccgtcgcctctcggggcgcgcacggggtgaccacctggacggacaatgcccgctccgcctcgacggctccgtcgatgacgacgccgcggcccggagccgatcccgtcaccacgccgcgcgggaggcccgccaccgacgcctgggcgggctgcggcgcccccagtacgagccgcaaccctattctggaggcccatctggcccccgccatggacagcggcgcggtcagcaccagtcccgtgcccgtcgccggggccgtgcgcaccagcagctcgagcaggttctggccctcgcccggacccagcacctcgtcgacggcggccgccatggcatccacgtcgtcgacgaccagcagttccccggccagccgcccggcggcggccaacgaccacaggcgcaccaggcgccgtggatcctccgggccgacgacggtgcccagtccccggtcgagggccgtcagccaggggggcgcggtgcccgccaggcacagggacaccgcccgttgagcatccatggccgcgcacgccgccgcgagggccgccgtcgtgcgccccgagccgggcgagccgatcaccgccaacggtcggtccaccggccaccgccagtgccccaggcgctgctcatccggatggtccgtgcccgccagcaccagaccctcggccggtcccgtggcggggcccagttcggcggcctcccgcgcactcagcgatgcgggcagcggcgcggcccatggccgccacggcgatgaggtcgagcgggcggccgcccgcacctcggtgatcagcgcctccaggcgatccgccggcccgcaccacggcgcctgagcggcgccgtggtcgccgtccgtcccggcgaccaggacgcgtccgggacggggaccgagagcggccgcgccctcatgccccaggacgtcgcgggaatccccggcgtcgagtacacgcaggcacacccgcagtgttgtgttggcgcgaatggccggggagatgacgccngtcggccgctgtg

SEQ ID NO: 1340 - DNA, 4000 bp, Escherichia coli
  misc_feature (1)..(1): n is a, c, g, or t
  misc_feature (4)..(4): n is a, c, g, or t
  misc_feature (7)..(7): n is a, c, g, or t
  misc_feature (11)..(12): n is a, c, g, or t
  misc_feature (14)..(16): n is a, c, g, or t
  misc_feature (19)..(20): n is a, c, g, or t
  misc_feature (22)..(24): n is a, c, g, or t
  misc_feature (26)..(26): n is a, c, g, or t
  misc_feature (28)..(30): n is a, c, g, or t
  misc_feature (32)..(33): n is a, c, g, or t
  misc_feature (35)..(38): n is a, c, g, or t
  misc_feature (40)..(54): n is a, c, g, or t
  misc_feature (57)..(62): n is a, c, g, or t
  misc_feature (64)..(66): n is a, c, g, or t
  misc_feature (68)..(79): n is a, c, g, or t
  misc_feature (81)..(83): n is a, c, g, or t
  misc_feature (86)..(88): n is a, c, g, or t
  misc_feature (90)..(95): n is a, c, g, or t
  misc_feature (97)..(98): n is a, c, g, or t
  misc_feature (101)..(106): n is a, c, g, or t
  misc_feature (110)..(111): n is a, c, g, or t
  misc_feature (113)..(117): n is a, c, g, or t
  misc_feature (120)..(120): n is a, c, g, or t
  misc_feature (122)..(122): n is a, c, g, or t
  misc_feature (124)..(124): n is a, c, g, or t
  misc_feature (126)..(128): n is a, c, g, or t
  misc_feature (130)..(131): n is a, c, g, or t
  misc_feature (133)..(135): n is a, c, g, or t
  misc_feature (137)..(140): n is a, c, g, or t
  misc_feature (142)..(144): n is a, c, g, or t
  misc_feature (228)..(228): n is a, c, g, or t
  misc_feature (414)..(414): n is a, c, g, or t
  misc_feature (1990)..(1991): n is a, c, g, or t
  misc_feature (2007)..(2007): n is a, c, g, or t
  misc_feature (2016)..(2017): n is a, c, g, or t
  misc_feature (2021)..(2021): n is a, c, g, or t
  misc_feature (2317)..(2317): n is a, c, g, or t
  misc_feature (2444)..(2445): n is a, c, g, or t
  misc_feature (2453)..(2453): n is a, c, g, or t
  misc_feature (2456)..(2459): n is a, c, g, or t
  misc_feature (2466)..(2467): n is a, c, g, or t
  misc_feature (2469)..(2469): n is a, c, g, or t
  misc_feature (2792)..(2792): n is a, c, g, or t
  misc_feature (2807)..(2807): n is a, c, g, or t
  misc_feature (2838)..(2838): n is a, c, g, or t
  misc_feature (2846)..(2846): n is a, c, g, or t
  misc_feature (2855)..(2855): n is a, c, g, or t
  misc_feature (2858)..(2858): n is a, c, g, or t
  misc_feature (2861)..(2861): n is a, c, g, or t
  misc_feature (2864)..(2864): n is a, c, g, or t
  misc_feature (2910)..(2910): n is a, c, g, or t
  misc_feature (2912)..(2912): n is a, c, g, or t
  misc_feature (3059)..(3059): n is a, c, g, or t
  misc_feature (3065)..(3065): n is a, c, g, or t
  misc_feature (3080)..(3081): n is a, c, g, or t
  misc_feature (3089)..(3089): n is a, c, g, or t
  misc_feature (3091)..(3091): n is a, c, g, or t
  misc_feature (3104)..(3104): n is a, c, g, or t
  misc_feature (3152)..(3152): n is a, c, g, or t
  misc_feature (3161)..(3161): n is a, c, g, or t
  misc_feature (3164)..(3164): n is a, c, g, or t
  misc_feature (3179)..(3179): n is a, c, g, or t
  misc_feature (3184)..(3185): n is a, c, g, or t
  misc_feature (3194)..(3194): n is a, c, g, or t
  misc_feature (3197)..(3197): n is a, c, g, or t
  misc_feature (3220)..(3221): n is a, c, g, or t
  misc_feature (3223)..(3223): n is a, c, g, or t
  misc_feature (3225)..(3225): n is a, c, g, or t
  misc_feature (3228)..(3229): n is a, c, g, or t
  misc_feature (3236)..(3236): n is a, c, g, or t
  misc_feature (3248)..(3248): n is a, c, g, or t
  misc_feature (3254)..(3254): n is a, c, g, or t
  misc_feature (3257)..(3257): n is a, c, g, or t
  misc_feature (3557)..(3557): n is a, c, g, or t
  misc_feature (3564)..(3564): n is a, c, g, or t
  misc_feature (3622)..(3622): n is a, c, g, or t
  misc_feature (3624)..(3624): n is a, c, g, or t
  misc_feature (3649)..(3649): n is a, c, g, or t
  misc_feature (3658)..(3658): n is a, c, g, or t
  misc_feature (3728)..(3728): n is a, c, g, or t
  misc_feature (3734)..(3734): n is a, c, g, or t
  misc_feature (3743)..(3744): n is a, c, g, or t
  misc_feature (3749)..(3749): n is a, c, g, or t
  misc_feature (3780)..(3780): n is a, c, g, or t
  misc_feature (3793)..(3793): n is a, c, g, or t
nganacncaannannncgnnannnanannntnnannnngnnnnnnnnnnnnnnntannnnnngnnnannnnnnnnnnnnannnaannncnnnnnnanngannnnnnaaannannnnnctnangntnnnannannnannnngnnnaaatactttatccctctattgataatagttgtagtgggaactatcagtctgtaataagtcagatggtagcatctggtttaatancaagcggattaacttttaccgatggtgattggcagaatatggctgttacaaaagtaaaggtaaattggactacgcttgcaaaccctttaaaccccacgagtaccgtaaataatcaacaatatatgctcgttgaattatgggctgatagaaacgctgtattacctccatttataagagtgggtgganctattgtttgtgccaatataacacttcctataagcgtacaataccctataacatcaataagaccgaatgataactgtataggtggcgagatatactttgtaaactatcatgatccgtttatgataatgcaagtatatgatatgtgttacaacggtgggttattgccagacgataacgggaattatacttgtactaataaatattttactggatttcaggtaaatcaatattcgggtgttttaaccaatcccaacaactcttttgcgtttaaagaaataactacgcttggtggttttagctcatcgggttatcctaatccatttatattgggtggtaatggaatgaaggtaggaacatatacttatatgtatcagtatgtagatgcggcaggtaatgttacaccttggagtataatgacaccgggaatacccttgccttataatacggatggcacttcaaatgcgggaaataatagcgcattatatccttggataaagacatttggtgcatcggcagctatgggagaaacagatttaggtatagtcatacaattaagaatttataacgtattaaattacgtttcaataaatatagcaagggctgattataatgctggaataccgataggcggaagcgttacacctactattttaaatataggcacagcatcagcattagcaccgggagaaatatcagtaaggacattctttgatatgagtgcttctggtactcccataacaacacagcaacaagcaaacacgttatcaactatcggtacttgtaagtcattaagatattttaataatagactatggcaaatgaatgtaaaatatgccgataggtctattgttccttcttcaatatttggtaatacaacccctttattccctgtaatggaatggatgggtattgccggacacaaagacccttatcatcatacgtaccataaaaattatatgagtggcgaaaggtttgactttgctatggtatgttttgattctactttcactaattcttttgcaataccaatacctacaggtacattaggatattatcaagtaccaaacaggagagaaccgagaacgggtaatagcgacatttattcatataattgcggttataatccttattcttcttctccacaggtaacggctattgcgggagatataaatggcaatgcaataagaacttttgaaaggtttgttacagacagatgtattgcaaaaacagattcaagttcgagttataatatttgtaataatgggcaaaaaccatacaatcttcttcatccgcacaacagggcgagtgctgtgggatacaaaccattaacacctaaaggtgattctgatacggatgtgagcgggcatgcctttagaataaacgaccaagtttataatgcaagttctggttggttagggtatgaaccagaaggatttgcacccgaatatatgtcttgcggatgggcttgtcctatagatgtaagcaaattaccttcatgggtaacatcttttgtaatagtaagaagcgaccctgcgggtagggtaatgatgcagggattgggattctatgatatganncccacaagcaaacctnatgttgganntttnaataaagattcttataaaacatggttttttagtcctgatttagtaaattacgacagtggttattctttaatatccaatagtcaaatatctgctgtaaattcagggcaatatacagcacaggcaatagcaccttatggtatgttttcagaagtttttttgggagattatcacgacccatctgctgatgaagattgggttgatatgtgttgttattgcagaataataaaagattatggtaatatatattggtcgggtaagcctccaagaataaaccccgatccacgattaaacacgcntgattcatgtgtaatgttcggcacgtggcaaaacggacaacctaataactggacttataatggcgggatttatgggaatataaatacttcttctaatcctggggaatttagtatttctggattttcnntacatacnggnnnnccttatnntnacccaggtagggttgcgggatatgaatactatgatttaacactaacaagtcccatatacaatacagcaggtggtagttcttcttcaccgatatttagacctaacggaacaaataactcatcggcaggacttgaaccaatgtatttgtttaatatagtaaacgataacgcattaataccgcagaccaatacaacaaattattacgatactggaacttttgcaaagataattagctgtttaggacagtctgacggttctacaaccaattatcctttagtagacgaaagatgggaagattgttgtaacggaataacagacggtaanggtaatcttgttgcnggtaatttaatgaatagtaattattcttatntgtatatncaagatacnaanggnaancaaacaacgtggatggatagcacttatttatctaacacacaaatangnaatataaatgctctaataaatacaactggttattatgtaggaacaactttaatatcgggattgtatagatttaccacagatacaaataacacaagtcctacttttaataggtttttcactataatatttgatgtaaataacacaacntggacnggaactaactggacnngtgctacnanttggatgccaacngcgggatatactatttggtgtagatatgatagccgaatgcctttaagnatatttggnggngattcctttattacngaaannatatttccngtngttgatacatattttgacacaannantntanntaatttntttaattttggnacatcnttnccttatttttcatggaatttaaacgacaattatttaatacctaatcatgcacaagcagcctcagatagtaatcccaactgtttgcaacagcacaacgatgtagatttgaattatattaggcaaatggtatgcgtttttaattgcgaaacaagaatgccgactgacttgtattgggaatttcctaataaagcctgtaactataattcagataaatactttcctgcaacaaattacgtaatgcgacctttagattggggtagtagctacggagataattttaccggagcaagtaattgtaanagttctnatggttacggtggcaacataatacctcaatatgacaatgattaccccaacgaatggananaatgggggtggggtggttttcattntagaccatncgtaaacatagattatatacacgataacgacactccttatacatcacaaccaatagtaggatatgtaaanaaaacnttatattgnncaagngtagcttggagtttggatagaccattaaatncgcaggacgtacntaatcttaaaacttttcttgctgccaacgtatatgacgcatcagatgatacggggtgtatagattatgcttttgatgctttaactggaaataaaggaagtaacctttttgcagtaacagatcatggcgtggttttattcccaacaatgaaaagcgttgtttcggaaaatgcaacaagtaatgatttggaagtcattgatagtacggt

SEQ ID NO: 1341 - DNA, 4000 bp, Escherichia coli
  misc_feature (1985)..(1985): n is a, c, g, or t
acatttttttttcagtaggttagttagtaagttcatttgatatattatataacttttgatattataatgaggcattatgtaatttttgtagtttaggttttattattagttttaagaagtgcaactattatatttaaaatttattattaataaaattataatgaaaatattaaaatcatattagacattttgtatgttgatcattaaattaatacaaatatcaaattatttattttatattacaaaattttttttattaataaaataaattactcacataaataagttcttctggaactttatcacatccatcttcaatttctaattcagaaagattcttaatattctttaatggaaagagatcttcagcataaatagcacgaacatcaattttttaatgattcaagttatatctttgattgatcttttatttaaattcttctaaaaaaaaataaatattatttttgtttttcatatgaaatttattattaccaatgatataatcccattcatcaattattagtataaacttttcttttattttcgaatttatatatttataaatatattttatttttttattatttaattttattttttttttattattttctttatgaatattaatcacgaatgattcattattagatggccagaattatttgccatgtactgatttgaaatagtttacaaacatgggaagcggaataataaagccaatgctctctcaagagtagaaactgattagacagggggtaaggactacgataaggatagtctcttgaaaccagagcaaatggtaggattcgacgatttagaaggtgaaagcaaattatttggctttagctaccaatttcaaggatgatttcaagaaggcctaccgacaggacaagatggctcaaaaaatatttaaagatctagcagaagacgaaggaaataacttcaataagaaatattagttagaggtagatagtcttctaataagaaaggaaaatcttaaacaagtttacgtacccacattgtttaggaaaactattatacaactaaaccacaacttagaatatgcaggttacttagggatagacaagacctcggatctagtgtcaagcaacttctactggccaaagatgaagaaagatacttcagattatgtaagagcctgtgaaacccgcgctataaagaaggatgatcaacacaaggaaaatggtaccactgtgagagttccagttgtggatttgcattggcaagaaatccaactagacttcaatacgaatttgccaataaagagatgaataagaacagatgaaggtaaataggtaaataaaaaaaaaaaagattaataaaattaaacttatttatattaatcgaggcttgataataatataatgaaattataatgaaattattttaacaataaattaaataatgtatttcaattttataaaataatttacacataacgaaataatataatttatataattttaaaaataatttacttcatttgcaataaaataataaaatatattaaaaataaattatttatttattagtttgataattatttatttccttataaatataaagttaatacgctacttattgcaatatgcctcattgtgaaattcttcactctatgttatggataatattttaattaatattttgtattacattataatacgttgtttttttttatttacttagtttaataaagtttttaactagaataataaaaatataaattattacaatataaacataatataatgtaattaattaaaatattctagaacaagccacatatttagtataaaataaatacatgtaaatttcattatgttgaatatggctaattacctattcatatttatcataaataaatcattaataaaacttcatataatataacaattataaaccaataatttatttattttactatatataattattttttactagttaaaaaaaaaaaaaaaaantaaaaatagaataaaattattttttttttaaaaaaaatgggaaggattattgatagtgataaaatgtttaataaatatctaggaatccgaaatcaggattactttgtagataaatctaaactaataaataaattaaacaaattaatagaaaaagatgagtctaaatatgtatgcattacaaaaccaagaagatttggtaaaacttcaatagctgcaatgttagttacatattatagtaaaggtataaattcaaaaaaaatatttgatgaattaaaagtttctaaagtaataaactctgataaaaatgaaaataaagtagaaatagatcaatataataaatttcaaaaaaaatatcacacaatatattttgatttctcgtatgatgttgattcctacaaaaccttaaagggttatttaaaatcaattaataaagatttaaagaaagatattaaagatttatatccaaattctaatatattaaaaaaatatagtagaaaaatttataaaaatttacaagaagtttttgtagctattaaagaaaagtttattattattattgatgaatgggactatataattagtaataatttgtttactcccaaagagcaaaagaagtatattgcttttttaaaaaatttaatcaaagatcaagtatatgtagcttttgtatatatgacaggaatattaccaatagcaaaacaaatgactcagtccacaataaattgttttaatgaatattctatgttaaatgacaaagattattaccagtattttggttttactgaacaagaagttatcaaactatgcgaaattaataaaacaaaatataatgaaaatgaaactttagaatatgaaaatatagaaaattggtataatggatataaaggttacaatggtaaaaaaatttttaattcatggtcagtgtatcatgccttacaaaataatagaattgaaaattattggatacagacaggacgatttaatgaagtggtagattcaattgactttaaaattcatggtgtaaaaaatgatattttagatttaattaaaggggatgatatatctatagaattagaaaagtatggagtggaagatctattaaaagatacagaaacgaatgattcacaagaaaaaacaaaaaaagataatgatgaagataatattaacaagaaaaagcaactctattcaaagatggttacatatggatttttaacttattgtaatggtaaaatttccattcctaataaagaattacaggaagaatttataaaaattttaaaaaaaaaaaaaacctgaattatttatatgatttaattaataattctaataaaatgttagaactgacaataaaaaaagatgttaaaggaatgtgtaaaatattagaatatagacatatgaaaacaataaaaccaaaccataaaatggatcatggtaatttaaaacgtgttattgattacgcctattttaatgcaaaagattattatgatattaaagaagaagaaaacagtgaaaagggtaacttagattatattttttatccaaaaatagaaaatgaaggaaaaaaacctgttattattatagaattaaaaacaaatggctcagccgaaaatgtaattaaccaaatacatgaaaagaaatattggtttaaaattgaagaaaaagaatttaaagaaaatattcttttagtaagaataagtttagataagaataaaaaaaaatatacatgtataatagaagaatatgctaatgtttcagaacttaaatcagctgaagatgaaatggagggagaagataaaactaaaaaaagaaaaagggaaagtagttctaactatgaatctgaaagtgtatttcaaggaacaagaagtaaaacaaaaaaaagcaaaaaataaaattgattccgaataagatatatataaaattttaaattatataatataataaatatttaaattattattattatatatataaaaatataaaaatattattttacaatatttaaatcacataacaat

SEQ ID NO: 1342 - DNA, 4000 bp, Escherichia coli
  misc_feature (1987)..(1987): n is a, c, g, or t
  misc_feature (2702)..(2702): n is a, c, g, or t
catcaccgattgacataacaataccgaaggcatagttagtagactcttctggctgcagttgacctgcgcccagcttaaagcttggcagagtctgcgcctgagtcagctgaccgccaacgagagtagtctgagtgttaacaacgttagcctgaccctgagttggagcacggaaaccagtactgtgtgaaccacgaatagacaggctgtctgacatctgcttgttaaaggtaaccttgtagttagcagtgtcaccgaagcttgtgtagtcctcataacgcagagcaccaccaaccaacaatgtatcagaaacctgagattcaacgtccatatacagcgcgtagttgcgacgagagaatgcaccagctgagtctggagagaatccagcgaagccgtgagagccaatgttaaagccctgtgcagcatactcacctactttccaagaagcttcttcaccagaaacaacttcaaaagtggtttcacgccactcggcaccaccagcgatgctagtgtcgccatactgcttctgcagatccaggttaaaggtcttttctaactgaatgtagctaccagtatagaaatcgcgctttgaatcaggacccatagatgggttgaacgtgttgttcagaccaaagtctgcttcgttgcgaccaacagaaccgcttacgtcatagcgaacgccgtccatgtttccgccagtgatttcgccacgagtaccagctgtgaaagaggtatcagtgatgttaccggtgaaacgaggagtgtagccgccaggagcctgttcgttgtgaatatagcagttagggttagccataatcgcatcgcgcagagcgtagtcagcaggatctacgtcagttgggcagttaccggacatatcgccagttacgtctgcaatcagacggttgccgtcaccatttgtaaatactccgccacggctgtctggattacggtagtagaaaccaccatccacatcgcgctcagagtagttaccaaacatgtaagcttcagcgccattgcccaggtcaagacctgagttgaagaagaaagttacatcgtcgtcaatttttggggcaccccagatctgggccggatctgtcactgaagtgttgcctaagtcgatcaggtcctgtgcgtctggacgctgcacggaacgtgaagtgtcatcagcttgcttcacctggaagctcaggttaacaaaaccagcatcagtcaaaggtaaaccaacgttacctgcaactgtagtagtggtgccgtcgccttcgctgaactcaccctgcttaacagttaggctaccgccttcagaagcgtcattcagtacaaagttcaaaacaccggcaatagcatcagaaccatactgagctgctgcgccatcacgcagtacttcaacctgcttcagagcaatgcttggaattacagagatatcagcaccctgagaaccatcgtttacaccaccgccctggaaggcgataactgatgcacggtgacgacgcttgccgttaaccaagatcagggtgctgtctgcagagagaccacgcaggttagctggacggatcatagatgccgcgtcactgataggctgcaggtgaacgttcagtgaaggaatagcaccctgaagctgcataagcaggtcagagctaccagctgagttcaactcatctgcactgagaacgtcgacaggaactggtgattcagtaacggtgcgaggtgcaccacgtgaaccaactacaacaacttcttcaagtgctgcttctgctgcaaatgcaactgtaggaagcgcagtgcttcctgcaattactgctgccgcaatagtattcattttccaaaaggtattagatttcataaatctcccccgagatgtttgtggataaagctttgggttactgtgcctataatgggcttttttataaattccgtattgttaaccgagccagatgggatctgtttctgttactgcattggtttaacgaaggtaatacgcaaaccctcatcngcaagtttactctaattgcaatctcttttcgatagtcgtttttaggtaattgaaagtcgtaaaagacttagggttaagactaattgttaacttgacccatcaatgtcttggattttttgccaggaatttctcgcaccagctttggtaccaagaaaccgggcagttcagcctgtagttgatgaaatatatgttcagcacgctgctgagaaatatcaaaatggctggcgccctcgattgggtccaatagatgtaggtagtatggcagcacccctacatcgtagactgtttcgctcagctcggataatacttgcgcatcgtcattgataccttttagcagtacagtttggttaaggattaatatgcctcggcttaatagtcgctggatcatattttgtacgctggagtcgatctcgttgctatggttaatatgcagcactattatcggcttgagtctggtggcagttatccagctaagaaatggctcatcaatgcgtgatgggatcaccactggcaatctactatgaatgcgcagacgcttgatatgagggatatctgcaatctgcttagttagccagctaagaaaattatcattggcggccagtggatcgccaccactaaaaatcacttcattaatttcttttgacctacttatataggcgatggcctgttgccactgctctttactctggcgattttcttgataggggaagtgccngcggaagcagtagcgacagttaatcgcgcaactgggactgactattaatagcaggcgattgcggtatttatgcacaatgcccggcactggattatgctgagtttcttccagtgggtctgcgctgtagcccaccgcagactgagtttcttggatcacaggcagaacctgagccaacaatgggtcattggggtcgccaattttcatacgctcaacaaatggccttggcactctcagggggaaatctgtggcggcctgatggcttggagagagttgctccggtttgagttgcaagcggcccagcagttcatcaattgagctgatgcattgactaaactcagttttccagctcggttgaatatcaatggtctgggaggtgataatggacggcataggacagcggctttggttgcaaagttaactccagcgattttacgctatttcttcagcattagtggccctgagtaataatctattgaagaccgacgaattttacatgacaagagcccttgagctcgcggctcaggctggcgctgctggtgaagtccctgtgggcgctctggtggtgcgagatgggcaggtgattggcgaaggttacaatcagcctatcagcgccattgatcccacagctcacgccgagattgtagccatgcgcaatgcggccgcccatataggtaactatcgtttaatcgactgtgatctctatgtgactatcgagccctgcaccatgtgtgttggtgccatgattcacgcccgtgtgcagagggtgatttttggtgccaaggagcctcgggctggtgccctggccagccagctgcaactgatggaaaacaagcacttcaatcatgtaatcgaatggcggggcggattgatggaaaaagactgtggcgatcttatcagtgatttttttcgccgcaagagaggcaaatagcggttttaaatggttggtacgccgttaatttcccagtctaccgatttagctggctcttcggtgtccggttcgaagtcctgctgagacagtgcatgaagctgcagataggttttgtagtactgaatatttttcacgtagagaactggctcgttgccgcgggcataaccatgtttgactgttgagtaaaatttctttttgctcaataggggcagatgcaggctaacatcgtcccagctatctgggtttttaccattgcgcaccgttaagatacgcgcatcttccaaatgaccaaagcccacgttataagcggcaagtgcaaatagagtgcgatcagggtcttcaatacgatcgggcaggcgagcctttagtt

SEQ ID NO: 1343 - DNA, 4000 bp, Escherichia coli
  misc_feature (13)..(13): n is a, c, g, or t
  misc_feature (21)..(21): n is a, c, g, or t
  misc_feature (67)..(67): n is a, c, g, or t
  misc_feature (238)..(238): n is a, c, g, or t
  misc_feature (313)..(313): n is a, c, g, or t
  misc_feature (316)..(316): n is a, c, g, or t
  misc_feature (388)..(388): n is a, c, g, or t
  misc_feature (562)..(562): n is a, c, g, or t
  misc_feature (713)..(713): n is a, c, g, or t
  misc_feature (769)..(769): n is a, c, g, or t
  misc_feature (784)..(784): n is a, c, g, or t
  misc_feature (819)..(819): n is a, c, g, or t
  misc_feature (841)..(841): n is a, c, g, or t
  misc_feature (843)..(843): n is a, c, g, or t
  misc_feature (930)..(930): n is a, c, g, or t
  misc_feature (1000)..(1000): n is a, c, g, or t
  misc_feature (1018)..(1018): n is a, c, g, or t
  misc_feature (1110)..(1110): n is a, c, g, or t
  misc_feature (1633)..(1633): n is a, c, g, or t
  misc_feature (1649)..(1650): n is a, c, g, or t
  misc_feature (1706)..(1706): n is a, c, g, or t
  misc_feature (1708)..(1709): n is a, c, g, or t
  misc_feature (1807)..(1807): n is a, c, g, or t
  misc_feature (1822)..(1822): n is a, c, g, or t
  misc_feature (1969)..(1969): n is a, c, g, or t
  misc_feature (1971)..(1973): n is a, c, g, or t
  misc_feature (1977)..(1979): n is a, c, g, or t
  misc_feature (1981)..(1982): n is a, c, g, or t
  misc_feature (1984)..(1984): n is a, c, g, or t
  misc_feature (1986)..(1986): n is a, c, g, or t
  misc_feature (1992)..(1992): n is a, c, g, or t
  misc_feature (1999)..(1999): n is a, c, g, or t
  misc_feature (2968)..(2970): n is a, c, g, or t
  misc_feature (2972)..(2975): n is a, c, g, or t
  misc_feature (2977)..(2977): n is a, c, g, or t
  misc_feature (2982)..(2982): n is a, c, g, or t
  misc_feature (2985)..(2988): n is a, c, g, or t
  misc_feature (2997)..(3000): n is a, c, g, or t
  misc_feature (3012)..(3012): n is a, c, g, or t
  misc_feature (3015)..(3018): n is a, c, g, or t
  misc_feature (3032)..(3032): n is a, c, g, or t
  misc_feature (3034)..(3034): n is a, c, g, or t
  misc_feature (3037)..(3039): n is a, c, g, or t
  misc_feature (3041)..(3041): n is a, c, g, or t
  misc_feature (3043)..(3043): n is a, c, g, or t
  misc_feature (3048)..(3049): n is a, c, g, or t
  misc_feature (3051)..(3051): n is a, c, g, or t
  misc_feature (3054)..(3054): n is a, c, g, or t
  misc_feature (3059)..(3064): n is a, c, g, or t
  misc_feature (3067)..(3067): n is a, c, g, or t
  misc_feature (3070)..(3076): n is a, c, g, or t
  misc_feature (3097)..(3097): n is a, c, g, or t
  misc_feature (3105)..(3106): n is a, c, g, or t
  misc_feature (3110)..(3110): n is a, c, g, or t
  misc_feature (3114)..(3117): n is a, c, g, or t
  misc_feature (3121)..(3121): n is a, c, g, or t
  misc_feature (3125)..(3125): n is a, c, g, or t
  misc_feature (3128)..(3128): n is a, c, g, or t
  misc_feature (3132)..(3132): n is a, c, g, or t
  misc_feature (3134)..(3134): n is a, c, g, or t
  misc_feature (3138)..(3138): n is a, c, g, or t
  misc_feature (3141)..(3141): n is a, c, g, or t
  misc_feature (3144)..(3147): n is a, c, g, or t
  misc_feature (3149)..(3150): n is a, c, g, or t
  misc_feature (3152)..(3154): n is a, c, g, or t
  misc_feature (3156)..(3157): n is a, c, g, or t
  misc_feature (3160)..(3160): n is a, c, g, or t
  misc_feature (3164)..(3164): n is a, c, g, or t
  misc_feature (3170)..(3170): n is a, c, g, or t
  misc_feature (3173)..(3180): n is a, c, g, or t
  misc_feature (3186)..(3188): n is a, c, g, or t
  misc_feature (3190)..(3191): n is a, c, g, or t
  misc_feature (3194)..(3195): n is a, c, g, or t
  misc_feature (3198)..(3199): n is a, c, g, or t
  misc_feature (3201)..(3206): n is a, c, g, or t
  misc_feature (3218)..(3221): n is a, c, g, or t
  misc_feature (3224)..(3225): n is a, c, g, or t
  misc_feature (3227)..(3228): n is a, c, g, or t
  misc_feature (3232)..(3232): n is a, c, g, or t
  misc_feature (3236)..(3237): n is a, c, g, or t
  misc_feature (3240)..(3242): n is a, c, g, or t
  misc_feature (3245)..(3246): n is a, c, g, or t
  misc_feature (3248)..(3249): n is a, c, g, or t
  misc_feature (3257)..(3257): n is a, c, g, or t
  misc_feature (3260)..(3260): n is a, c, g, or t
  misc_feature (3270)..(3272): n is a, c, g, or t
  misc_feature (3274)..(3274): n is a, c, g, or t
  misc_feature (3277)..(3277): n is a, c, g, or t
  misc_feature (3281)..(3281): n is a, c, g, or t
  misc_feature (3284)..(3284): n is a, c, g, or t
  misc_feature (3287)..(3288): n is a, c, g, or t
  misc_feature (3295)..(3298): n is a, c, g, or t
  misc_feature (3300)..(3300): n is a, c, g, or t
  misc_feature (3307)..(3309): n is a, c, g, or t
  misc_feature (3312)..(3316): n is a, c, g, or t
  misc_feature (3319)..(3319): n is a, c, g, or t
  misc_feature (3322)..(3322): n is a, c, g, or t
  misc_feature (3326)..(3326): n is a, c, g, or t
  misc_feature (3333)..(3334): n is a, c, g, or t
  misc_feature (3337)..(3340): n is a, c, g, or t
  misc_feature (3344)..(3351): n is a, c, g, or t
  misc_feature (3353)..(3356): n is a, c, g, or t
  misc_feature (3362)..(3362): n is a, c, g, or t
  misc_feature (3364)..(3376): n is a, c, g, or t
  misc_feature (3378)..(3378): n is a, c, g, or t
  misc_feature (3381)..(3381): n is a, c, g, or t
  misc_feature (3383)..(3390): n is a, c, g, or t
  misc_feature (3392)..(3394): n is a, c, g, or t
  misc_feature (3398)..(3398): n is a, c, g, or t
  misc_feature (3401)..(3408): n is a, c, g, or t
  misc_feature (3410)..(3411): n is a, c, g, or t
  misc_feature (3414)..(3414): n is a, c, g, or t
  misc_feature (3416)..(3417): n is a, c, g, or t
  misc_feature (3420)..(3420): n is a, c, g, or t
  misc_feature (3423)..(3423): n is a, c, g, or t
  misc_feature (3426)..(3427): n is a, c, g, or t
  misc_feature (3429)..(3430): n is a, c, g, or t
  misc_feature (3433)..(3436): n is a, c, g, or t
  misc_feature (3438)..(3439): n is a, c, g, or t
  misc_feature (3442)..(3451): n is a, c, g, or t
  misc_feature (3454)..(3458): n is a, c, g, or t
  misc_feature (3460)..(3466): n is a, c, g, or t
  misc_feature (3468)..(3470): n is a, c, g, or t
  misc_feature (3472)..(3477): n is a, c, g, or t
  misc_feature (3479)..(3482): n is a, c, g, or t
  misc_feature (3484)..(3488): n is a, c, g, or t
  misc_feature (3490)..(3492): n is a, c, g, or t
  misc_feature (3495)..(3497): n is a, c, g, or t
  misc_feature (3499)..(3501): n is a, c, g, or t
  misc_feature (3503)..(3503): n is a, c, g, or t
  misc_feature (3505)..(3507): n is a, c, g, or t
  misc_feature (3510)..(3510): n is a, c, g, or t
  misc_feature (3512)..(3513): n is a, c, g, or t
  misc_feature (3516)..(3519): n is a, c, g, or t
  misc_feature (3522)..(3522): n is a, c, g, or t
  misc_feature (3526)..(3530): n is a, c, g, or t
  misc_feature (3533)..(3537): n is a, c, g, or t
  misc_feature (3539)..(3539): n is a, c, g, or t
  misc_feature (3542)..(3542): n is a, c, g, or t
  misc_feature (3544)..(3547): n is a, c, g, or t
  misc_feature (3551)..(3551): n is a, c, g, or t
  misc_feature (3554)..(3556): n is a, c, g, or t
  misc_feature (3560)..(3565): n is a, c, g, or t
  misc_feature (3567)..(3567): n is a, c, g, or t
  misc_feature (3570)..(3572): n is a, c, g, or t
  misc_feature (3574)..(3574): n is a, c, g, or t
  misc_feature (3580)..(3584): n is a, c, g, or t
  misc_feature (3587)..(3588): n is a, c, g, or t
  misc_feature (3590)..(3591): n is a, c, g, or t
  misc_feature (3593)..(3597): n is a, c, g, or t
  misc_feature (3599)..(3599): n is a, c, g, or t
  misc_feature (3603)..(3607): n is a, c, g, or t
  misc_feature (3609)..(3612): n is a, c, g, or t
  misc_feature (3614)..(3614): n is a, c, g, or t
  misc_feature (3617)..(3620): n is a, c, g, or t
  misc_feature (3622)..(3623): n is a, c, g, or t
  misc_feature (3625)..(3629): n is a, c, g, or t
  misc_feature (3631)..(3632): n is a, c, g, or t
  misc_feature (3634)..(3639): n is a, c, g, or t
  misc_feature (3641)..(3641): n is a, c, g, or t
  misc_feature (3643)..(3643): n is a, c, g, or t
  misc_feature (3645)..(3645): n is a, c, g, or t
  misc_feature (3647)..(3652): n is a, c, g, or t
  misc_feature (3657)..(3659): n is a, c, g, or t
  misc_feature (3661)..(3661): n is a, c, g, or t
  misc_feature (3663)..(3670): n is a, c, g, or t
  misc_feature (3675)..(3676): n is a, c, g, or t
  misc_feature (3678)..(3678): n is a, c, g, or t
  misc_feature (3681)..(3689): n is a, c, g, or t
  misc_feature (3692)..(3692): n is a, c, g, or t
  misc_feature (3694)..(3699): n is a, c, g, or t
  misc_feature (3701)..(3701): n is a, c, g, or t
  misc_feature (3703)..(3703): n is a, c, g, or t
  misc_feature (3706)..(3707): n is a, c, g, or t
  misc_feature (3710)..(3711): n is a, c, g, or t
  misc_feature (3713)..(3714): n is a, c, g, or t
  misc_feature (3716)..(3716): n is a, c, g, or t
  misc_feature (3720)..(3720): n is a, c, g, or t
  misc_feature (3723)..(3725): n is a, c, g, or t
  misc_feature (3727)..(3728): n is a, c, g, or t
  misc_feature (3730)..(3734): n is a, c, g, or t
  misc_feature (3736)..(3743): n is a, c, g, or t
  misc_feature (3746)..(3746): n is a, c, g, or t
  misc_feature (3749)..(3749): n is a, c, g, or t
  misc_feature (3752)..(3753): n is a, c, g, or t
  misc_feature (3755)..(3762): n is a, c, g, or t
  misc_feature (3764)..(3769): n is a, c, g, or t
  misc_feature (3771)..(3774): n is a, c, g, or t
  misc_feature (3777)..(3781): n is a, c, g, or t
  misc_feature (3783)..(3787): n is a, c, g, or t
  misc_feature (3791)..(3792): n is a, c, g, or t
  misc_feature (3794)..(3796): n is a, c, g, or t
  misc_feature (3798)..(3802): n is a, c, g, or t
  misc_feature (3804)..(3804): n is a, c, g, or t
  misc_feature (3806)..(3809): n is a, c, g, or t
  misc_feature (3816)..(3816): n is a, c, g, or t
  misc_feature (3822)..(3822): n is a, c, g, or t
  misc_feature (3828)..(3828): n is a, c, g, or t
  misc_feature (3830)..(3830): n is a, c, g, or t
  misc_feature (3840)..(3840): n is a, c, g, or t
  misc_feature (3842)..(3843): n is a, c, g, or t
  misc_feature (3846)..(3846): n is a, c, g, or t
  misc_feature (3849)..(3849): n is a, c, g, or t
  misc_feature (3855)..(3856): n is a, c, g, or t
  misc_feature (3858)..(3859): n is a, c, g, or t
  misc_feature (3861)..(3863): n is a, c, g, or t
  misc_feature (3865)..(3866): n is a, c, g, or t
  misc_feature (3869)..(3869): n is a, c, g, or t
  misc_feature (3872)..(3875): n is a, c, g, or t
  misc_feature (3877)..(3879): n is a, c, g, or t
  misc_feature (3881)..(3882): n is a, c, g, or t
  misc_feature (3884)..(3884): n is a, c, g, or t
  misc_feature (3889)..(3889): n is a, c, g, or t
  misc_feature (3891)..(3892): n is a, c, g, or t
  misc_feature (3894)..(3894): n is a, c, g, or t
  misc_feature (3899)..(3899): n is a, c, g, or t
  misc_feature (3906)..(3906): n is a, c, g, or t
  misc_feature (3908)..(3908): n is a, c, g, or t
  misc_feature (3912)..(3913): n is a, c, g, or t
  misc_feature (3922)..(3923): n is a, c, g, or t
  misc_feature (3929)..(3929): n is a, c, g, or t
  misc_feature (3931)..(3932): n is a, c, g, or t
  misc_feature (3936)..(3936): n is a, c, g, or t
  misc_feature (3939)..(3941): n is a, c, g, or t
  misc_feature (3943)..(3945): n is a, c, g, or t
  misc_feature (3951)..(3954): n is a, c, g, or t
  misc_feature (3956)..(3956): n is a, c, g, or t
  misc_feature (3958)..(3958): n is a, c, g, or t
  misc_feature (3961)..(3961): n is a, c, g, or t
  misc_feature (3963)..(3966): n is a, c, g, or t
  misc_feature (3969)..(3969): n is a, c, g, or t
  misc_feature (3971)..(3971): n is a, c, g, or t
  misc_feature (3974)..(3974): n is a, c, g, or t
  misc_feature (3978)..(3978): n is a, c, g, or t
  misc_feature (3980)..(3981): n is a, c, g, or t
  misc_feature (3983)..(3984): n is a, c, g, or t
  misc_feature (3987)..(3987): n is a, c, g, or t
  misc_feature (3990)..(3990): n is a, c, g, or t
  misc_feature (3993)..(3993): n is a, c, g, or t
  misc_feature (3999)..(3999): n is a, c, g, or t
ggaggaggcggtnggggcggnggcggtgaagcccgagccgggtgaagcggcggtcgtggcggttgangcgaacgacgtgggcggcgcgagctcggcgctggcggaggcggcggctgaactggcggcggcgtacaagccgtgggtcgagaacgacggtcggacgcggagctactcggtgccgtacagcgagcactcgtccttcgtcgagctggtggagtttgtcaagcggatccgcccncggagggtcacgcccacggtcaacgccgacaccaaggcggacagggacaagatcatgaagcacttcctcgagttnacngacctcgccgcggacaagaacaggctggaccactacttcttcaacaaacggcacgcgccggaggtcaaggtngaggtgaagcgggagatggaggctgagcccgccgcggcgctcccggcttccgacggttcaaacggcggcggcatcgaccccgagatcctcgccgctctgggcgacgttctcaccccggaggagctgcgccaacagtccgcgttgtgggcagcggcgcagacggcgtcgagggcngcgcaggaggcggctcaggctgcggtgttgggtccgtttcccctcgggtgcgtggcgctggtccgcggcggcggcggcgggttcggcggcaacggcccgaggtacgtccagttcaaggacaagtcgcacgtggagcagaggctacgggcgntgggcgcgacgatcgtccatcgaatatcaccaaaggtgacgcacgtcgtggtcccngcgggcggcgaggcnttggcggaggaggagaggcggcacgggggcaaagncggcaaaggcggtggcgacgangnagccgacgggtccgctcgcaaggaggggtacgaagccccggacaccgatgacatcgacaccgatgggatcgacaccaagggtgaccngtctaagaagggtgacccgtccaagtcgaccccgcccgccgtggtcaccgaagggtgggtgatgcgtcantggcgagcccaaaagacnggcgtcgccgaagcccacgatgacgacaccgtgcgggcgcaccaggagcgcgtgaaggaggaacgcaggcgcgaggccgcggagcgaaccgncgcggccaagcgtcgccgtgaggaggctgactccggcgttgaacagaggccggggcgcgagcggacgatgagccgcgcggtgatggacagggtggggagggcgctggcgcagaggctgtttttagtgcagcggcgggacgtgtcgcgggggccggcgggggtcggcggggccgcctcgacggggcccggcgcgacaccggcgggtggcgaggataagtggcacgccgtgttcgcggtgtttggcaccacgggtaacgtgtacgagtgccacgtgtgcgccaaccccagttgcacctgccccgacttcacgggcgatttacggaccagcagctcgagcaggaaaggcggcggtcacatctgcaagcacctgctgtgggtgtacatgcgggtcctcggcgtgcaacgcgacgatccggtgctgtgccaggtggcgctgctccagtcggagctcgccgcgatgctagccgcgccttccagggcgcagagggcgtcactcgcgacagcctcggtccgggacgcgtanctcgccgccacgggtnnaacgcgcgggacggaggagctcgcgccggcaccggtgacgcgccagccgatcatgncnnagccgccggataacggggacggggacgatgcggacccggtgacgtgtcccgtgtgcttcgacccgctggaggacccggctgacgcggcggcggggtcnagggagacggacctntcggccaaggtgtggtggtgccggggtggatgcggcgggaacgtgcacagcgcgtgtatgcgacggtggatggccaagagcggcatggcgcccgcgtgtccgctgtgcagggcgacgtgggtaccccaggaagacgccgaggacgcngnnncggnnncnncntnaggtcnaccctcnggtctacccggaccgctcgcgctcccgacgtcgcccgcgtcgaccgcgggtctaccctcgggcggtgcgccgttcacgagcccggggggttcgagttacgtcaacctgcgcgcgtaccagggcggcaccgcggcgcacagggacctgagccagtacaacgacttcgccaggaaggccatcgaaaaacgggagaaggaggaacgggagcgacgggaacgggagggcggttgacggcgagtgacggcccagggttgaaacgacgattctttggcggtgggtcttcacgtcccatcgtcccacgcgtggaggcttgattcacgactagcgtattgttaccaacacgagaaacgcgcgatggatgtacccgctgactcgccgcttcctaaactggaatcttttggatttcccccctgggccgatcctcccctcgggctgcgacgtatccgggtctcagatggtgagcttgaggcccggtccgtcgttgttgtagaattccccgacccactcccgtccgtccttgtccgtgtacgtcccctgcccgtgcatcgcgttgtccacccactggcccacgtacttggtcccgtccggccaggtgtaggtgccggcgccgtggtacttgttggccacccagtcgccgtcgtacaccgccccggacttgtacgtgaacgcgcccttgccctccatcttgtcctggacccagtcgccctcgtacgtccacttgccgtccaccgagttcttccccttgccgtgcctcacgtacgtgcgaagctcggtgccatcctcgggctcggggggcggctcctcgccctcggcgagctcgcgctcggcccagtcgccgtcgtagatgtccaggccgtcgcccttggggcccgggaagatgaacttgccgttctgggggggctcgacctcctcttctccttcctcggccatggcttcgagtcggggcgcgagtgagtgtgctgctcacannntnnnngnagtcngannnngggggaaannnncccccgttggcnccnnnngggggaaccaaagncnccnnngnanaaccnngnggnccccnnnnnnccnggnnnnnnngggggttcccgggaacccggngcggcccnnccgngggnnnngttnaaanggntccncncccnggnccnnnngnngnnnannaanaacnccaagnggnnnnnnnncccccnnncnnccnnccnngnnnnnntttttttttggnnnncannannaaantttnnccnnntgnngnngcggcccnccncccccttcgnnncnccngggnccnggnnaacggcnnnntnttcgccnnnatnnnnnccnggnaccnccccgannaannnncccnnnnnnnntnnnncccggngnnnnnnnnnnnnncnaanannnnnnnnannngggnccnnnnnnnnannttntnnaanaanaanncnnggnnnntnnggnnnnnnnnnnggnnnnngnnnnnnncnnngnnnnnngnnnngnnnnngnnnttnnngnnnangnnnttnannttnnnnggngggnnnnnggnnnnncnggngnnnncccnggnnnccgnnnnnngnccnnngnaaaacnnnnnggnngnncnnnnngncccnnnnnannnntnggnnnngnncnnnnncnncnnnnnncncnanannnnnnccccnnncnannnnnnnnccccnncnccnnnnnnnnncgncnnnnnntngnccnnggnngnngngggncgnnngnngnnnnngnnnnnnnnggnggnggnncnnnnnnnncnnnnnncnnnnccnnnnnannnnntttnngnnngnnnnncngnnnnggaggangaggangaggangnccgaggaggncnnccnccngggggnncnngnnngnnggnccnnnncnnngnngnacccntnnancaacnaagccgncnaggnnccaaccggnncaggancnnccgnggnnngnnnaagccnnnngngncgnannnncgngncgncggngnngnnggnttnggngggggng

SEQ ID NO: 1344 - DNA, 4000 bp, Escherichia coli
  misc_feature (1)..(4): n is a, c, g, or t
  misc_feature (7)..(12): n is a, c, g, or t
  misc_feature (14)..(22): n is a, c, g, or t
  misc_feature (24)..(25): n is a, c, g, or t
  misc_feature (27)..(29): n is a, c, g, or t
  misc_feature (31)..(31): n is a, c, g, or t
  misc_feature (33)..(39): n is a, c, g, or t
  misc_feature (42)..(42): n is a, c, g, or t
  misc_feature (44)..(45): n is a, c, g, or t
  misc_feature (47)..(50): n is a, c, g, or t
  misc_feature (52)..(53): n is a, c, g, or t
  misc_feature (55)..(55): n is a, c, g, or t
  misc_feature (58)..(58): n is a, c, g, or t
  misc_feature (60)..(61): n is a, c, g, or t
  misc_feature (63)..(65): n is a, c, g, or t
  misc_feature (67)..(74): n is a, c, g, or t
  misc_feature (77)..(79): n is a, c, g, or t
  misc_feature (81)..(90): n is a, c, g, or t
  misc_feature (92)..(94): n is a, c, g, or t
  misc_feature (97)..(98): n is a, c, g, or t
  misc_feature (101)..(104): n is a, c, g, or t
  misc_feature (106)..(106): n is a, c, g, or t
  misc_feature (109)..(110): n is a, c, g, or t
  misc_feature (112)..(112): n is a, c, g, or t
  misc_feature (115)..(119): n is a, c, g, or t
  misc_feature (122)..(131): n is a, c, g, or t
  misc_feature (134)..(134): n is a, c, g, or t
  misc_feature (136)..(138): n is a, c, g, or t
  misc_feature (140)..(146): n is a, c, g, or t
  misc_feature (149)..(149): n is a, c, g, or t
  misc_feature (151)..(151): n is a, c, g, or t
  misc_feature (155)..(157): n is a, c, g, or t
  misc_feature (159)..(174): n is a, c, g, or t
  misc_feature (176)..(180): n is a, c, g, or t
  misc_feature (182)..(182): n is a, c, g, or t
  misc_feature (184)..(184): n is a, c, g, or t
  misc_feature (186)..(187): n is a, c, g, or t
  misc_feature (189)..(189): n is a, c, g, or t
  misc_feature (191)..(193): n is a, c, g, or t
  misc_feature (195)..(196): n is a, c, g, or t
  misc_feature (198)..(200): n is a, c, g, or t
  misc_feature (204)..(204): n is a, c, g, or t
  misc_feature (207)..(218): n is a, c, g, or t
  misc_feature (220)..(220): n is a, c, g, or t
  misc_feature (224)..(228): n is a, c, g, or t
  misc_feature (230)..(231): n is a, c, g, or t
  misc_feature (233)..(233): n is a, c, g, or t
  misc_feature (236)..(237): n is a, c, g, or t
  misc_feature (241)..(245): n is a, c, g, or t
  misc_feature (248)..(248): n is a, c, g, or t
  misc_feature (250)..(253): n is a, c, g, or t
  misc_feature (255)..(255): n is a, c, g, or t
  misc_feature (258)..(260): n is a, c, g, or t
  misc_feature (262)..(266): n is a, c, g, or t
  misc_feature (268)..(268): n is a, c, g, or t
  misc_feature (270)..(272): n is a, c, g, or t
  misc_feature (276)..(277): n is a, c, g, or t
  misc_feature (279)..(295): n is a, c, g, or t
  misc_feature (297)..(299): n is a, c, g, or t
  misc_feature (301)..(302): n is a, c, g, or t
  misc_feature (305)..(307): n is a, c, g, or t
  misc_feature (309)..(311): n is a, c, g, or t
  misc_feature (314)..(318): n is a, c, g, or t
  misc_feature (322)..(324): n is a, c, g, or t
  misc_feature (326)..(326): n is a, c, g, or t
  misc_feature (328)..(329): n is a, c, g, or t
  misc_feature (331)..(334): n is a, c, g, or t
  misc_feature (336)..(344): n is a, c, g, or t
  misc_feature (348)..(349): n is a, c, g, or t
  misc_feature (351)..(354): n is a, c, g, or t
  misc_feature (356)..(357): n is a, c, g, or t
  misc_feature (359)..(359): n is a, c, g, or t
  misc_feature (361)..(362): n is a, c, g, or t
  misc_feature (365)..(370): n is a, c, g, or t
  misc_feature (372)..(373): n is a, c, g, or t
  misc_feature (377)..(381): n is a, c, g, or t
  misc_feature (383)..(386): n is a, c, g, or t
  misc_feature (388)..(389): n is a, c, g, or t
  misc_feature (393)..(393): n is a, c, g, or t
  misc_feature (396)..(397): n is a, c, g, or t
  misc_feature (400)..(406): n is a, c, g, or t
  misc_feature (408)..(414): n is a, c, g, or t
  misc_feature (416)..(416): n is a, c, g, or t
  misc_feature (419)..(420): n is a, c, g, or t
  misc_feature (422)..(423): n is a, c, g, or t
  misc_feature (425)..(425): n is a, c, g, or t
  misc_feature (429)..(431): n is a, c, g, or t
  misc_feature (434)..(435): n is a, c, g, or t
  misc_feature (437)..(440): n is a, c, g, or t
  misc_feature (442)..(447): n is a, c, g, or t
  misc_feature (449)..(454): n is a, c, g, or t
  misc_feature (457)..(457): n is a, c, g, or t
  misc_feature (459)..(466): n is a, c, g, or t
  misc_feature (468)..(469): n is a, c, g, or t
  misc_feature (472)..(476): n is a, c, g, or t
  misc_feature (478)..(482): n is a, c, g, or t
  misc_feature (485)..(485): n is a, c, g, or t
  misc_feature (487)..(487): n is a, c, g, or t
  misc_feature (489)..(489): n is a, c, g, or t
  misc_feature (492)..(492): n is a, c, g, or t
  misc_feature (495)..(496): n is a, c, g, or t
  misc_feature (498)..(502): n is a, c, g, or t
  misc_feature (505)..(505): n is a, c, g, or t
  misc_feature (507)..(511): n is a, c, g, or t
  misc_feature (513)..(513): n is a, c, g, or t
  misc_feature (515)..(518): n is a, c, g, or t
  misc_feature (522)..(525): n is a, c, g, or t
  misc_feature (528)..(536): n is a, c, g, or t
  misc_feature (538)..(538): n is a, c, g, or t
  misc_feature (541)..(551): n is a, c, g, or t
  misc_feature (553)..(553): n is a, c, g, or t
  misc_feature (555)..(556): n is a, c, g, or t
  misc_feature (560)..(561): n is a, c, g, or t
  misc_feature (563)..(566): n is a, c, g, or t
  misc_feature (568)..(570): n is a, c, g, or t
  misc_feature (574)..(575): n is a, c, g, or t
  misc_feature (578)..(582): n is a, c, g, or t
  misc_feature (584)..(593): n is a, c, g, or t
  misc_feature (595)..(598): n is a, c, g, or t
  misc_feature (600)..(602): n is a, c, g, or t
  misc_feature (604)..(609): n is a, c, g, or t
  misc_feature (611)..(614): n is a, c, g, or t
  misc_feature (616)..(618): n is a, c, g, or t
  misc_feature (620)..(623): n is a, c, g, or t
  misc_feature (626)..(630): n is a, c, g, or t
  misc_feature (632)..(632): n is a, c, g, or t
  misc_feature (634)..(644): n is a, c, g, or t
  misc_feature (646)..(649): n is a, c, g, or t
  misc_feature (652)..(652): n is a, c, g, or t
  misc_feature (654)..(657): n is a, c, g, or t
  misc_feature (661)..(663): n is a, c, g, or t
  misc_feature (665)..(668): n is a, c, g, or t
  misc_feature (670)..(671): n is a, c, g, or t
  misc_feature (673)..(674): n is a, c, g, or t
  misc_feature (676)..(677): n is a, c, g, or t
  misc_feature (679)..(684): n is a, c, g, or t
  misc_feature (686)..(688): n is a, c, g, or t
  misc_feature (690)..(695): n is a, c, g, or t
  misc_feature (697)..(700): n is a, c, g, or t
  misc_feature (702)..(703): n is a, c, g, or t
  misc_feature (706)..(708): n is a, c, g, or t
  misc_feature (710)..(712): n is a, c, g, or t
  misc_feature (714)..(717): n is a, c, g, or t
  misc_feature (719)..(732): n is a, c, g, or t
  misc_feature (735)..(736): n is a, c, g, or t
  misc_feature (738)..(740): n is a, c, g, or t
  misc_feature (742)..(743): n is a, c, g, or t
  misc_feature (745)..(748): n is a, c, g, or t
  misc_feature (750)..(752): n is a, c, g, or t
  misc_feature (754)..(762): n is a, c, g, or t
  misc_feature (764)..(769): n is a, c, g, or t
  misc_feature (771)..(771): n is a, c, g, or t
  misc_feature (773)..(773): n is a, c, g, or t
  misc_feature (776)..(780): n is a, c, g, or t
  misc_feature (782)..(782): n is a, c, g, or t
  misc_feature (786)..(786): n is a, c, g, or t
  misc_feature (788)..(790): n is a, c, g, or t
  misc_feature (792)..(793): n is a, c, g, or t
  misc_feature (795)..(799): n is a, c, g, or t
  misc_feature (804)..(804): n is a, c, g, or t
  misc_feature (806)..(806): n is a, c, g, or t
  misc_feature (808)..(808): n is a, c, g, or t
  misc_feature (810)..(810): n is a, c, g, or t
  misc_feature (812)..(812): n is a, c, g, or t
  misc_feature (814)..(818): n is a, c, g, or t
  misc_feature (820)..(822): n is a, c, g, or t
  misc_feature (825)..(829): n is a, c, g, or t
  misc_feature (831)..(836): n is a, c, g, or t
  misc_feature (839)..(848): n is a, c, g, or t
  misc_feature (851)..(861): n is a, c, g, or t
  misc_feature (865)..(869): n is a, c, g, or t
  misc_feature (873)..(876): n is a, c, g, or t
  misc_feature (879)..(879): n is a, c, g, or t
  misc_feature (881)..(882): n is a, c, g, or t
  misc_feature (884)..(886): n is a, c, g, or t
  misc_feature (889)..(889): n is a, c, g, or t
  misc_feature (893)..(895): n is a, c, g, or t
  misc_feature (897)..(897): n is a, c, g, or t
  misc_feature (899)..(899): n is a, c, g, or t
  misc_feature (901)..(904): n is a, c, g, or t
  misc_feature (908)..(908): n is a, c, g, or t
  misc_feature (910)..(915): n is a, c, g, or t
  misc_feature (918)..(919): n is a, c, g, or t
  misc_feature (921)..(922): n is a, c, g, or t
  misc_feature (924)..(929): n is a, c, g, or t
  misc_feature (932)..(933): n is a, c, g, or t
  misc_feature (937)..(939): n is a, c, g, or t
  misc_feature (942)..(947): n is a, c, g, or t
  misc_feature (952)..(958): n is a, c, g, or t
  misc_feature (961)..(962): n is a, c, g, or t
  misc_feature (964)..(975): n is a, c, g, or t
  misc_feature (977)..(981): n is a, c, g, or t
  misc_feature (983)..(983): n is a, c, g, or t
  misc_feature (985)..(988): n is a, c, g, or t
  misc_feature (992)..(996): n is a, c, g, or t
  misc_feature (998)..(1001): n is a, c, g, or t
  misc_feature (1003)..(1004): n is a, c, g, or t
  misc_feature (1007)..(1007): n is a, c, g, or t
  misc_feature (1010)..(1010): n is a, c, g, or t
  misc_feature (1016)..(1033): n is a, c, g, or t
  misc_feature (1035)..(1036): n is a, c, g, or t
  misc_feature (1038)..(1038): n is a, c, g, or t
  misc_feature (1040)..(1041): n is a, c, g, or t
  misc_feature (1043)..(1044): n is a, c, g, or t
  misc_feature (1046)..(1046): n is a, c, g, or t
  misc_feature (1049)..(1049): n is a, c, g, or t
  misc_feature (1053)..(1061): n is a, c, g, or t
  misc_feature (2654)..(2654): n is a, c, g, or t
  misc_feature (3484)..(3484): n is a, c, g, or t
  misc_feature (3487)..(3488): n is a, c, g, or t
  misc_feature (3983)..(3983): n is a, c, g, or t
nnnnttnnnnnncnnnnnnnnngnncnnngncnnnnnnnccngnncnnnngnncnggngnngnnnannnnnnnnggnnnannnnnnnnnnannnccnngcnnnnanccnnangcnnnnngcnnnnnnnnnnggncnnngnnnnnnngcngntgannngnnnnnnnnnnnnnnnngnnnnntngnanntngnnntnngnnncttntcnnnnnnnnnnnnancctnnnnngnnanacnncccnnnnnaancnnnncngcnnnannnnngncnnnaaanngnnnnnnnnnnnnnnnnntnnngnngcnnntnnncannnnntgannnananncnnnnannnnnnnnngttnngnnnngnnantnnggnnnnnntnngcannnnngnnnngnnaacnatnntcnnnnnnncnnnnnnntnganncnnangagnnnaannannnnannnnnncnnnnnnatngnnnnnnnncnntgnnnnntnnnnnctntntnctnatnncnnnnngcngnnnnncncnnnngggnnnnccnnnnnnnnngnccnnnnnnnnnnngncnnaacnnannnngnnnagcnnaannnnnannnnnnnnnncnnnngnnnannnnnntnnnncnnngnnnntannnnnangnnnnnnnnnnnannnnccngnnnnaagnnncnnnngnnanngnncnnnnnnannngnnnnnngnnnnanncgnnnannngnnnncnnnnnnnnnnnnnntgnncnnngnncnnnngnnngnnnnnnnnngnnnnnntnangtnnnnnanctgncnnncnncnnnnngcacncncngngncnnnnncnnngcnnnnngnnnnnngcnnnnnnnnnncgnnnnnnnnnnngcgnnnnnctgnnnncgngnngnnncgnccgnnngnancnnnncggngnnnnnncgnngnntnnnnnncgnngccnnnctnnnnnngcggnnnnnnnccnncnnnnnnnnnnnncnnnnnancnnnnccannnnngnnnnannacnctnggccannnnnnnnnnnnnnnnnnanntntnntnngngangtannnnnnnnnagggaggagttaggagttaagcggcggcctaaaagtttgcggtatacctgcaatgcgccgggtactgttttggcagtattggcataagcgggattacaacaggctcggctccgcgctaactcctccctccaattcgggggttcttatgcaaattgtattgcgcggtgcggcagctgggtatgaggccgagcataccgcacgcatcttttacccggcggcggagctgagccagaccctgccggacgataccgcagaccttgtgctggctgtggctcacaggtatctgctgctggttctggtgcggcagaacggcacaaccacctgggtgcagcagcgcccgccccagggggatgcccgcacgcaggagtatgctctgtgccgcatgctgtacaccatgctgtgcggcgttaccggtatccgcccgccctggggcatgatgaccggcgtgcgcccggtgcgcatcatccatgacctgcgcgccgagggcaaaaccgaagaagaaatcgaacagcgctttttgcagcattttgactgcacgccgcgccgttttgccatggccaaaagtattgcggacctgcagcgcccggtgctggagcgcgcccagccgatggattgcagtgtgtacgcgggcattccgttctgcccgtcccgctgcagctattgcagctttgtttcccgcacggtgggggataaatccagccgtgcgctggtggccccctacgtggactgcctgtgcaaggagcttgccgctacccgcgccgctgcggacgccgcacacctcagcatcaaaacgctgtatatcggcggcggcacccccaccagcgtcaacgcgcagcagctgcgccagctgatgggcaccatggccgagcagtttgacctgcccgccctggaagagtttaccgtggaagcgggccgccctgactgtaccgacgaagaaaaactgcgcatcatcaaagaatacggcgcaacccgcatttccatcaacccgcagacattctcggatgaagtgctgcgcaacattggccgccgccacacggcgcaggatatcctggattgttaccggaccgcccgccgcgtggggcatgataacatcaacatggacttgatcgcgggtctgccgggggatacggtggaaggcttccgccatagcctgcagacggccattgacttggacccggaaaatatcaccgtgcataccctcacgctgaaacgggcgtccaacctggtggtggagcaccgcgctgcggattatgccgatgtggccgctatggtggaaagctgcgagctgctggaaaaagccggttaccgcccctactacctgtaccgccaaaaaggcaccctgcaaaacctggaaaacgtgggctggtgcaagccggggtacgagtgcctgtataatatctatatcatggaggaagtccacaccattctttctgccggtgcgggcggttctacaaagctggtggcccccggtgcacgtcacggcaagatcgagcgtatctttaattataagtacccgacagaatatatcgaccgttttgacacgatccttgcacgcaaggaaggagtgaaacagttctatgaccaatatcccanctgtggtgaatccgcgcgcccccaagcgcatggtggggtgtgagctgctcaaccttgccgcgcacaacccggctgatttggtgcagctgagcgaacagcagtaccagagccgcattgatgccgccgcggcctatgttctggcatccggccgccgtattgtcatgctgacggggccttccgctgcgggcaaaaccaccagcgccaacaagttggccgccgccatgcgcagcaaaggcgtgcgcagccgggtattgagcctggacgacttttttgtgggcgagggccgctaccccaaacagccggatggccgggatgattacgaatgcgtggaagcgctggatatcccgctggtgcagcactgcctgcagcagctggcccagaccggcgtgtgcgatgcgccgatctttgactttatgacccagctgcccgccccgcagacccagcacatcgactgcaccgacggtgtggtggttgtggagggactgcacgcctttaaccccatcctgaccgagactttgccgcaggatgctgtgctgaatatttacgccagcctgcgggaagaatatgccggaccggacggtgcgcggctgatcgccacccgcgatgttcgccttgcccgccgcattacgcgggactggcggttccgcgggcatgatgccgattttaccatcggcctgtggccccatgtctgtaaggcagaggaccagtatatcaagacgttcaagaatcgggcgaaccttgtgctggatacttcgttcagctgcgaggtggggatttgggaatattatattgaccagctgacggccagcgccaatgcgggccgcatggcnganntgcgcagccggtttgcgcattttgtacccattaatgccgcgctgatcccacagaaaagcatgctgcgggagttcattggagccgaaaaccaataaaacttcctgttacgtccaaatgtttacgatttggacataattctttgcgccacaagattgaaaaccaggcaatgatacggtataataagccttacagggaaaagccgtgaaatcgaaaataataaatttttacggcttttcattccacccggccgggctgcgcagctgtggcgcagtgccctgccggggccagatgataacgaggtgttacattatgtttgaactggatatcaataagatcaaagaacagagcatgcagtttgtggataccgcttacaaggcagccatggatattgcagataagggcaagaaccagctggatctggcatcccagcagaaccgcctggccaaggcacagcgccagctgggcgcactggtttacagcctgcataaggcagangaggaaaaccagcccct

SEQ ID NO: 1345 - DNA, 4000 bp, Escherichia coli
  misc_feature (1)..(1): n is a, c, g, or t
  misc_feature (6)..(8): n is a, c, g, or t
  misc_feature (11)..(18): n is a, c, g, or t
  misc_feature (21)..(22): n is a, c, g, or t
  misc_feature (25)..(25): n is a, c, g, or t
  misc_feature (28)..(30): n is a, c, g, or t
  misc_feature (33)..(35): n is a, c, g, or t
  misc_feature (38)..(38): n is a, c, g, or t
  misc_feature (42)..(48): n is a, c, g, or t
  misc_feature (52)..(56): n is a, c, g, or t
  misc_feature (58)..(58): n is a, c, g, or t
  misc_feature (60)..(60): n is a, c, g, or t
  misc_feature (62)..(62): n is a, c, g, or t
  misc_feature (66)..(75): n is a, c, g, or t
  misc_feature (78)..(80): n is a, c, g, or t
  misc_feature (82)..(83): n is a, c, g, or t
  misc_feature (88)..(88): n is a, c, g, or t
  misc_feature (90)..(91): n is a, c, g, or t
  misc_feature (93)..(93): n is a, c, g, or t
  misc_feature (95)..(97): n is a, c, g, or t
  misc_feature (99)..(101): n is a, c, g, or t
  misc_feature (103)..(119): n is a, c, g, or t
  misc_feature (121)..(125): n is a, c, g, or t
  misc_feature (127)..(132): n is a, c, g, or t
  misc_feature (135)..(135): n is a, c, g, or t
  misc_feature (138)..(142): n is a, c, g, or t
  misc_feature (144)..(147): n is a, c, g, or t
  misc_feature (150)..(152): n is a, c, g, or t
  misc_feature (154)..(154): n is a, c, g, or t
  misc_feature (156)..(156): n is a, c, g, or t
  misc_feature (158)..(163): n is a, c, g, or t
  misc_feature (165)..(173): n is a, c, g, or t
  misc_feature (175)..(175): n is a, c, g, or t
  misc_feature (177)..(179): n is a, c, g, or t
  misc_feature (181)..(182): n is a, c, g, or t
  misc_feature (184)..(184): n is a, c, g, or t
  misc_feature (187)..(192): n is a, c, g, or t
  misc_feature (194)..(194): n is a, c, g, or t
  misc_feature (197)..(200): n is a, c, g, or t
  misc_feature (203)..(206): n is a, c, g, or t
  misc_feature (208)..(209): n is a, c, g, or t
  misc_feature (211)..(212): n is a, c, g, or t
  misc_feature (216)..(217): n is a, c, g, or t
  misc_feature (223)..(228): n is a, c, g, or t
  misc_feature (232)..(237): n is a, c, g, or t
  misc_feature (239)..(239): n is a, c, g, or t
  misc_feature (241)..(242): n is a, c, g, or t
  misc_feature (245)..(245): n is a, c, g, or t
  misc_feature (250)..(254): n is a, c, g, or t
  misc_feature (256)..(257): n is a, c, g, or t
  misc_feature (259)..(266): n is a, c, g, or t
  misc_feature (270)..(270): n is a, c, g, or t
  misc_feature (296)..(296): n is a, c, g, or t
  misc_feature (1991)..(1991): n is a, c, g, or t
  misc_feature (3784)..(3784): n is a, c, g, or t
nggggnnnttnnnnnnnnaannaanccnnnttnnnccnaaannnnnnnaaannnnnantngnaaannnnnnnnnnttnnnannttttncnncnannntnnntnnnnnnnnnnnnnnnnnannnnntnnnnnnaanttnnnnngnnnnaannntnantnnnnnnannnnnnnnntnannngnnanggnnnnnncnaannnnaannnncnntnnaaannaaaaannnnnngggnnnnnntnannccnaaaannnnntnntnnnnnnnncccntttttttgaatttgtctatattatgncgtaacaagtgaggcttcgccgatagcagcaggcatctaatcgctgattttcgttttaaataaaaagaaattggcaattcgccaatttcgacaaattcttaatgctcttctgaaggttcagccggaattaactccccaattataaagagaagtacggtaaaaacaacagagattataattgctgttgaaaaatggaatgcagagcctgtcatggaagaaacaacatagctggccatgttgacaagcaaaaacgtccaaaaaaatgttgcgaaatatctcattatcttcacctcgtttattcctgtctttacttatattatcatacaacatttttcatgaaaacggttgtttcgcgatttttttgcgagcctttttgacatttcgtacatacattataaaaggtcatcgatggaaaggtggtgggcaaatggaaggtgtttcggaaagattttttcaaattgaaaacgagtggaatgtcattcatcttccggaaaagccgaacggattcggcatcttgatcattggcgatcgaacccattttgttgaaaatggttcaagctactggctggagcattacgggcggcgtcagctgatcaatacgttaaaaagctgcggatatacattgtttcattccaatctttacggacgccattggggcagccctcacgccgttttgttggcaaaacagctttatcatcttgtcatgaaacaagaaattttaaataaaaaaatccatatactgtctgaaggtataggagcactcgttgcgctgcagttgatggaagagatgccaaattccatccgttcatcggtgatgatcaatccttgtttggacataaaagcccaaatagcggaagagaaaaagaataaatttttttacaaacaaatgataaaagaactatcaaaagcttaccaattagatgaaaaagctgtcacccattatccctttgtccgtatacaagactttgtatcaaaaatacctgtaggcatctggcagaaaatgaacgggggaagctattcctataaaattcatggaaaaaaatatgaggaatggagaaagcagctgaaagctccaattcaattcacattttatttccaggaaaatataaatcggatccatgatatgataagaagtttttacaaagagcatgaaagaatcttatagaaatggaattgaggactgggcgaaaatgctcaataagtgagcaggctgccccctttttgtttgaaaagggcattggactaatctcttcttttttcgcatacgatacaataatagttttttcataaaggaggttttcaaaatgtcaactgccttaaagcagtgtaaacatattttaattgttggggttcatcaatttgaaggctttcatatatgttcaaaactggtagaggaaggattactagtcgatggagtggtaatcgttcctaaaaatccgttgcaaaaaaaaatatgcgaagaagaaatgatgtggctcgggcggaacgcacattttcatttattggaagaagacagctggatagaggatgcttccaaaaagcaatatgatttgatttattattgtcaaacagatcatcaaccgatagacgatgaagctgaaaaacaccgattggaaaaaacggtcgaaatcgcatccctcaagcagactccgattatttttatattttctcttgaaggagaaaatccgctggaanatagggatgaagaaattgacagctggatgcagcaaataggacaaaaatggactttcccttatttatttgtttatcttccaaccgttttcggaccttggcagccgctaggccattggatttcgaacagtttgttggaatgtacaggcatcagccgttccaagacgaatgcgaatgaaaaaattgtcattcgcgacattcttcatattgatgaaatagttccggtgttaacagaatttgacgaagatttgtttgcgaaaaaaacaatttacttgatttccgacgacaaagagcgcatcaagaaggtgatgagcttttttgacatttttcattacatttacaagcctatatcgaaaagcgaacatcatttagttgttccaaagacggtcgaaaacattgaaaagagtttgcaagaattaaaagattttttcctgcaaaatacacgcagactttatacctaaatataaaatttctttacttcattgacggcgtatagcaaaataaaagaggaatgaagtgaaacgtgaaaattttagtactaaatatacatcgtgttaaagaggaagcttcctagagaaacgcctcataagctatatttcgtgacaatcaaattgaccgtaaattcaaaagatcgttttgaacttagctgagatcgatatgtaatcatttcgattattgagaaacctcaccatttcaatgatgatgcagttcactggtttaaaggagttgcttggtatgtataaaaaaatgtttgtgatcatttttattttattatttctcgttggctgcggacaagcatcagaaaaaggaaaactgaaaaaggtgggtttgctcgttcctgaaacgattaatgatcaagtttgggggacaaaagggtataaagggctgttaaaaattcagtctgagctgaatgtagatgttttttataaagaaggaatgaattccgaagcggcggtgagggaggcggtcgaagaatttcacggaaagggagttaatttaattatcgggcacggtcacgaatatgagggtttttttagagatttgctggatcaatatccagatattcatttcgttttttttaatggtgatgcaaaaggcccgaatgccacaagtttaaattttgaggcgcatgccatgggctttttcgcaggaatggtggcagcacatatgacaaaaacaaacgaaatcggaattattgccgcttttgagtggcagcctgaagtggaggggttttatcaaggggcgcaatttgaaaatccaaacgtaaccattcacattgaatatgtccaagggtttgatcatgttgacttggcgcttgagaagctcgataagcttgtcgcagaaaatgtagatgttgtttatccggcaggcgacagatacaacgtgccagtgatcgaaaaagtgaaggaaaaaggaatatattcaattggctttgtttcagatcaaagtgatttgggcgaacaaatggttttaacaagcacagtacagcatgtggatgagttgtatttattagtcgcaaaaaaatttataaaaggcgaactggaaagcgggaatttatattttgattttcaagatggtgtgattgatttagggaagttcagccctctagtagataaagaatttaaaaataaagttttaaaatatgtggaagaatataagaaaacagggaaattgcctaacgaataatgctatggtgagataaataaaataaaaattttgggggatggttgaattcatccccttaatttttaaatagttttttaatttgattgacgaacggctttatttctttaatnattggcttcagctcagataattttgtcacaatatcatcgacttgctcaaaaattttttgatagtctgattgctcgttttgctcgtttttttcggaagttttttcagaatgaaccggaagctgccggccgaacataaattgggtaaaaaaatcgggttctggtgcttctgctttctctttttcatcttcctgccgctcgtttacgttttcatcactc

SEQ ID NO: 1346 - DNA, 4000 bp, Escherichia coli
  misc_feature (1989)..(1989): n is a, c, g, or t
  misc_feature (2227)..(2227): n is a, c, g, or t
  misc_feature (2422)..(2422): n is a, c, g, or t
  misc_feature (2490)..(2490): n is a, c, g, or t
  misc_feature (2556)..(2556): n is a, c, g, or t
  misc_feature (2722)..(2722): n is a, c, g, or t
  misc_feature (3069)..(3069): n is a, c, g, or t
  misc_feature (3212)..(3212): n is a, c, g, or t
  misc_feature (3264)..(3264): n is a, c, g, or t
  misc_feature (3480)..(3480): n is a, c, g, or t
  misc_feature (3545)..(3545): n is a, c, g, or t
  misc_feature (3653)..(3653): n is a, c, g, or t
aatattacaataccttcatggcatgtggaggaaaaagaaaaagtattttcaaatttagaaaaatataaaaataatgattatattgcttggattgggcattctacttttttaattaagttaggtgataatgtaataataactgatccggtcttttcaaaaaatgcaggaccattattttttggcccaaaaaggtatactaagcctgcattaaaattaagtgagattccaaaaacaggtttatttttattaacacacaatcactatgatcatcaagataaggatacaattagaagatatccttataaaaattcaaaagttttaactccattaaaacttggaaagtattttacaagtaatagatttaaagatgttgttgaaatggactggtacgatgaaattaagtttaatgatctcaaaattactctattgccagctgttcactggtcaaaaagaaccttttgggacacaaataaaacattgtggggaaattttttaatagaacataatggaagaaaaatattctttgcttgtgatactgggtatggagatatctataaagatctaggtaaaaaatatggacctattgatctaacaatgattaacattggtgcttatgatttcagaccaatgtttgaaaaatcatactatcacaccacaccagaagaagctctgcaaatagctaaagatctaaacagtaaaaaagttttaggtactcattggggaacttttgttttgtccttggaacctattatggatccaccaaaaagatttaaagataatgcaataaattatggttttgataaagaagacgctattgtatttaaaattggtcaaatagaatctttggaaaatattattaaataattaatttgaaactttttgaattaaagaaatattattgtttgttggtttgtttacttctttagaaatttcatagaattctaaattaggttttttacattcttttaaaaaactagaaccattaagctcgatatttaaatatctattgacatctttttcattaagtatgactggttgtctacgatgaatttctaaaacgtttttaattgcctcttctgtaactaaacaaaattgatcattttcataaattccagcaatataaataatttttttatcttctcttaaaaaataatacggaattttatttctttcttcacgtttccattcatagaaaccatctgctacaacaacacatctagttaattgtattaattttttaaaagatactttttcatcaatcgtttctagtcttgcattaatcaaaggtttaaattcatttttctttgaccaagatggaactaggccccactttaagttttctagagcatttccatttgtatattttttaattactggaagatcttgataaggatgagcattataattctctttatcctctactttaatggctgttttaactaaacttttagttttagaaaccggatttgtaaccacatatcttccacacataattaaatatctcagccgctacaatcaaagtcaatattaactttaatttaaataatttttttattggtttaaaaaatatttagattatatgtcgttaaatttatgaaatctattgaaggtaattttaataatccgaaagtaaatgaattgttaactaaacatttcattgaactaagatcagtttcaccagcaggtagtgcccacgttttagatattgctggtcttaaagatcaaagcattaagttttggagtttatgggataatgatgaattaataggatgtggtgctttaaaatttttagataaaattcatggagaatttaaatcaatcagggttgttgataaatttagaaaaaaaggtgtcggagaaaaaattattaatcaccttatagaagaggcaaaaaaattaggaataaaaaaactgagtattgaaactggttctggaaaattttttgagccagctagaaaactatttgcaaaatttgactttcaaccttgntctccttttgcacactataaagaagatccaaattcatgtttttacactaaaaatttaaattaatttaattagtaattttagattgattttgtaataataatttttttcttgtttgttcaaaatttgtttggactagaatcattaattcttcataaattttttcattttttttagtttttttagttttttcttctaaaaatgttgaaacatattcagttgttgacattcctgtttcttntttgacagctctatttgtaaagtaagcaagtccagcttgagaaacatttccagtggaagcaaaagtaattgcaggaccaaccattgctgatgattgaaaacatcctgtcaaaaacaaacttatacaaaaatataaagttattttttttatctccacattttaatcattactgatttttaatttcaactcaagacngattttgaatttcaactcaagatagttgttttttatactattcattctgagttaattgtctatattcnctgtattctctatgctttttgtaaaaaaaaacataattagaatcttggaacgaaatgatatttagncaattttttgataatgtttcgtgtacatacacatatttgattgcgtctccagaaaaaaaagaagcaataatcatagattcagttttagacaacgtagacatatatttaaaattattaaatgaattagatttaaaattagtaaaagtaatagacactcatatacatncagaccatatttctggaatggcaaaacttagagataaaacaaactgtgtaactttaatgggagacaaaactcctgcagatatagtttctatgagtattgctgatggagaagaaatcaaaataggaaatataaaattaaaagctttatataccccaggacatacatcagaaagttttagttttttaatgaaagacagagtttttacaggcgatacattgttaattcgtggaactggaagaactgattttcaaaatggaaatccatatgactcctataattcaatatttaaaattttattaaaactaccagaagagactttagtataccctgcacacgattataaaggngatttagtaagcactataggtaaagaaaaaaaattaaatccaagacttcaagtgaaatctccagatgaatatgcggaaataatgaataatttaaatttatctaatccaaaacttatggatatagtggttccaaaaaatttaanccttggaattaatttgaataaacaaacaataaataacggattagatgtaganaaatttaaagaagaaatagagaataaggataacattttgattgatttaagagaggaagatgaaattaaaaaatatggaaaaatttcaaattgtacaatgatatcttttcctaaaattgaaagttatttaagtcaaaatgaaaaagaacttaaaaataaaaaaatattgttttattgtgctgttggacacaggtctgcattagcagttcaaatttcnaaatcctacaattatataaattgttttcatttaatcggaggactaaaaaattggaatatgaaagnaatgaagacaatttaatgtcaaaaaatggagttgaaaataaattaccaatttataaattaaaaacaggtaaagagattaaaaaatattatgacctttggactgaaaanaacaactacaacaaagatatggttgattgggattattctgcgccaagagaagcaatttctgtttttgtaaaatataatcaaaataataaaataaaaatttttgatgcgggttgtggtacaggattggtgggtattgaacttaaaaagaatggatataatattatagatggtgctgacttttctcaaagcatgttaaatcaagtacctaaaaatctatatcaaaatttatataaaatagatttaaataaaaaaatatcgttaaaagataatacttatgatgcaattacatgtgttggaacatttacttatggacatgttcatccacctgcacttgatgaaatgactaa

SEQ ID NO: 1347 - DNA, 4000 bp, Escherichia coli
  misc_feature (512)..(512): n is a, c, g, or t
aggcaaactctaaaagcttaatgtcaaaccaaattaccccaatatcagagttaattgatggccttaatatcagattcgttgatgagaaaatcttccttgatgataaggatgttacagattcaatcagatccgaattaattggaaaatatgcttctgaaattgcaaaaaatgcatcaataagagagaaaattttagatgttcaaagatctttctttgtatcaccagggttagttgctgatgggcgtgatatgggaactgtagtcttccctaaggctaaaattaaaatattccttactgcaagcatagaagagcgggtaaacagaagatataaacagttgatattaaaggaaaacaatgttaatctgtccgacctatttgagaaaatcaaattaagggacgaaagtgatacaaacagaaaaatatcaccccttaaggctgcaaaagatgcttatttaattaaaacagataatctaagcattaaccaggcctttgaaaaagtaatggagattatnggtagtaagataaactaagtagcataagctgtctaataaattccaagtttattagattttattaacaaccccatcgctagatgggatcaaatgaaggtaaaaaatttaaaatggcaaccctagaaaaaacaacacaaaaatcatctgaaagtttcgctgatttatttgaagaaagtatggcgcttaaggaaatgcgtcaaggagaggtaattactgcagaagttatatcgattgatagtgactttgtaattgttaatgcaggtttaaaatcagaaagcctaatcaaaacagatgaatttcttgatgataagggcgatgttgaagtaaatttaggtgaccatgtaaaggtatcgatcgaaaaattagaagacggatatggatctacgcttctatcgcgggctagggctaaagaaatgcaagcatggcttgatctagaagatgcaatggaagaatcaagaatagttaatggttatgttagtagtaaggtaaagggaggtttaagagttactgtaaacggcattatggcttttttacccggatctttagttgatattcgaccaatcaaagatacaactccttttgaaaataaagaatgtgaattaaaaataatcaaaattgacagaaaacgaaataatgttgttgtctcaagaaaggcagtattagaagggcaaaatggagttgatctagaagccttaattgatacactcaaagaggggtctgttgttaaaggtattgtaaaaaatataacagattacggagcttttgttgatctgggtggtatagacggattgcttcacataacagacttagcatggaaaagaattaaacatccatccgaaatacttaatataggtgatgaaattgatgccagagtattgaaatttgataaagagaaaaatagggtttcacttggcttaaaacagcttgatgaagatccatgggttggattatcaagaagaagccctgttaaaacaaaagttttcggaaaggtatctaatttaactgattatggtgctttcattgaaattgaaactggtattgaaggattggtgcatgtttctgaaatggactggacaaataaaaatattcatccatcaaaggcagttcaattaggtgatgaagttgaggtaatgattcttgagattgatgaagacagaagaaggttgtcgttaggcatgaaacaatgcaaagataatccatgggacaattttgcaaatagtaataaaaaagacgataaaatcaaaggtaatatcaaatcaattacagactttggtgtatttatcggactgccaggggatattgatggtctaatccacctttcagatattgcttggtctgatcaagaatcagcattaaaaaattataacagaggagatgaggttgaatcagtcatcttatcaatcgatgtagataaagaaagaatttctttaggtattaagcaattatctgatgacccaaatgaggataaaaagactgaaaccacaaaaaaaccaaagaaagaagcgaaggaaaaaactgatgagcctgaaaatgcaggaacaactaatctaggtgcccttctaaaagaaaaactagataataaaaatgactaaatctgaattaatagccctgctttctaataggttttcgcagcttgtgcataaagatgcagagttatcagtaaaaacagttattgactcactaagtaaaagcttaagtgaaggtggtagagctgagataagaggtttcggaagttttagcctacaccacagaccagcaagagtcggtagaaaccctaaaacaggtgaaagagtaaatgttcctgaaaaatttgtcccgcattttaaaccaggcaaagaactaaaaataaaagttgataaataaataagtgcaatttataaaaaacatattcactttatagttaatttgaatatgtttttttttaaaaattatgatcgaatttgaattttggtggttattagtaatacctttattctttatcctagggtgggtttctgctcgtgttgacataaaacaaattattgcggaaagtactaatcttccagcctcgcttttcaaagctctctcataccttaactccaatcaaaatgagagtgcaataactgaacttgaaaaagctgttaaattaaaaaataattcactcgaaatacattttgctcttggctcactgctgagaagagaaggtaaatatgataaggctataaatttacatattgcccttctgaataaaagagaaattacttctgaacaagaagattcaataaaagctgaactagcgcaggattactttaaagctggtctgtatggaagatctgaatctatacttaaagatctaaaaaatgaaaaatattttcagtattcattaaatttattaagagagatatatgtacgggagagagattgggataaagccattgagtctgcttctaatttagagaagacctctggagtttcgtttagaattccaattagtcattatttttgtgaattagcaacaaaccacttaatgaacaaaaaatatggtatggcaaaaacatatcttaaaaaatctctagaagaatcaaaaaactgtgtgagagctaatatacttctcggtgacattgcccatgaagaaaaaaaatatgatgaagctattatttattggaaaaaaattgaatatcagaaaccagaatatctcggcctagtgattcaaaaaataatttctgcttatgaaattcaaaataacgttaacgaagccttatccattctttcaaggtattatgagctttataaacttaaaacaattttaggctcattgtacaaattagttttaaagaatgaaggcatagaaagggctgaggagatagccagaaatgagctaatacaaagaccgagtctgctttcacttgatcaattatttcaaatcttaaccattaagaagtcaaataaaattgaaaatattgagcttattcaacaaacaattaaaaattcaattagtgaaagaagattttttaattgcaatgaatgtggttttaaagcaaaacaatttcattggcaatgcccaggatgtaattcatgggaatcacttccatcagaaccaattgacattactttagaaaattagcttaatgacaaaacaaactgaaatttatgtagcaattgatacaaagtcagctaatgatgcaaaaaaattgattaggcagctccataataagtattgtggaataaaaattggaaaagagctatttaccgcctgtggacccgagattgtattatgggccaaaaaagagggttttaaagtatttttagacttaaagtttcatgacattcccaatactgttatgaaggcatgtgaagctgcttcaagactcaatgtggacataataaacgtccatgctctaggcggtaaagaaatgatggtggccgccaaaagcgctgtctctgataagaaaataaagttgattggggtaacgttgttaacaagtcataataaagattttctagaagag

SEQ ID NO: 1348 - DNA, 4000 bp, Escherichia coli
  misc_feature (24)..(24): n is a, c, g, or t
  misc_feature (126)..(126): n is a, c, g, or t
  misc_feature (258)..(258): n is a, c, g, or t
  misc_feature (519)..(519): n is a, c, g, or t
  misc_feature (1015)..(1015): n is a, c, g, or t
  misc_feature (1393)..(1393): n is a, c, g, or t
  misc_feature (1842)..(1842): n is a, c, g, or t
  misc_feature (1947)..(1947): n is a, c, g, or t
  misc_feature (1992)..(1992): n is a, c, g, or t
  misc_feature (2151)..(2151): n is a, c, g, or t
  misc_feature (2303)..(2303): n is a, c, g, or t
  misc_feature (2834)..(2834): n is a, c, g, or t
  misc_feature (2837)..(2837): n is a, c, g, or t
  misc_feature (2840)..(2840): n is a, c, g, or t
  misc_feature (2945)..(2945): n is a, c, g, or t
  misc_feature (2947)..(2948): n is a, c, g, or t
  misc_feature (3223)..(3223): n is a, c, g, or t
  misc_feature (3754)..(3754): n is a, c, g, or t
  misc_feature (3808)..(3808): n is a, c, g, or t
tgacactgcaccacagccttcttntctacggcgcttgcctcgccgcccatgatcttggcaatggcagcagcagccttggggccgccgggtgcgcacttgtcgcagggcacgccgtccagaacaacngccttggcgtagtcggcacagccggcgtagccgcagccgccgcagtttgcgccggccagacaggcagaaacttcctcaatgcgggggtcttcctccaccgccatgaactttgcggcagccaccagaacgatngcacccacagcgcccacgatggtgcacaggataacagcagatacaatattcatagtcctgttcctcccttacagcgtaacattgaacaggttttcgacgatgccgccgaagcccatgaaggacaggctggtgattgcagctgcgatcagggtgatgggcaggcccttgaagggtgccgggggatcgcaggcttccacgcgcttacgcacgccgctgaacatgaccatggccagcataaagccgcagcctgcgccgatggcncagatcagagcctcgatgtaggcgtagccgaagccgtgtgcagccacatctgcgccgtagtcgcccacgaccagaatggtaacggccagcacgcagcagttggtggtgatcaggggcagataaacgcccagcgagttatacagtgcaacgatgtacttcttgaggaagatctcgatgaactgcaccagcacagcgatgaccagaatgaacacgatggtctgcaggtagctcagaccagccgggtccagaatgaagatctggatggggaaggtaacggccgttgccatgaacatgacgaagatgacagcaccggacataccaacagcggaatccagctttttggaaacgcccaggaacgggcagataccgtagaacttcaccagcacatagttgttgacaaggatcatgctgaagaagatcgcagcgagtttgacgagcatcttattccgcctccttcttcagattgtcaagatcacagcagctcttgcgctcgatncgggcgtccagcttgccttccagccacacacagccggccatcaacaggccaaagcagaagaatgcaccgggagcctgcgtcatgatggacaccttggcaacgctttccggaatgatctggaagcccagccaggtgccgctgcccaggatctcacggatggaggccatcagagtagcggtgagggtgtagccgaggcccatgcccacgccgtccagtgcggaatccaccacattgttcttgcaggcgaacatctcggcacggcccagaatgatacagttgacaacgatcaggggcaggaacacgcccagagcgttgtacaggctttccatgtaggcctgcatgaacatctgcacgatggtcacaaagcctgcaatgatnacgatgtagcagggcagatgcaccttgccggggatgactttccgcagcagggagatcatgatattggagcacaccagcacgaaggtgaaggcggcgcccatgcccagtgcgctggaaactgccgtggtaacggccagaatggagcaggtgcccagaaccagacgcagaacagggttttctttgatgatgccgttggtaaggatgcttaccttggacttattttcttgtgccatttcttaccaacctccttttatgccagctcgttgaagcagttgatacaatcattgatggcagcaaacagagcggtggacgaaatggttgcgccactgtacgcatcgaaatcctgattcatcacaatgttcttggtgccgtccatgccgttgaactgtgccaggaagtcatcggtggacacattggagccgatgcccttggtctgggtagaagcgtcnacccagatgccggtctcggcaccgttggcgtcaaagcccatgatgacggtcaggatgccgccgtcaaagcccttttcctcggccttgatggcaatgccgccatcnggagcctttaccacgccggtaacattggcggtggtgtagtcggtnacttcctccagcgtagctgcgtccgaaacagagggcatcacgctgacataagcagccagcgtggtgcggcgggtgttctccttgataacgggagcggtcatgccgttcaccagagccagcagcaggctgacgatcagagagatgacggtcagcacaacnatgggcttaccggtggtttcccagctggaatttgcagtcttactcatttgccagcaccctccttcgctttctttgcaggcttcacatagccatacggggtctgacgggtcagatcattgatgtacgggacccacaggttcatgaacagcagngcgaaggacacgccctcggtgtagctgccccagtagcggatagcaaaggtaacgatgccaaggcacacgccgtacaccagcttacccttcagggtaaaggggctggtaacgtagtcggtagccatgaacacagcgccgaacagcaggccgccgctcagcacggcaaccagtgcgctgtgcagatccttggtagcgatcaggtagaacacgaacacgctgccaacgtaggaagccgggatggcgatgctgatggtcttggtagccaccagatagatcagacccagcacgatagccagtgcgcaggtctcgcccagcacaccgccgtggatgcccatgaacagatccagcaggctcagcttggagggatctgccacagccagcggggtagccttggacagctgatccaccgctgcatccgggaacacccacttattcatggaaccggcaaagctgataaacagcacgatacggcccaccagagcggggtttgcaaagttcatgccaatgccgccgaacagctgcttgacaacnatnatngccaccagatcgccgatgatcagctgaccgatgggcatacccacgggcacgttcatggccagaatgatgccggtgaccacagcggacaggtcgctgatggggttngnncgcttcagcagcttgcagtacagccactcaaaaaccacacaggccaccacggaaacggcggtgaccagcagggcgcgcacgccgaaaatgatcgcagaggcaaccacgcaggggcacagtgcaacgatcacgttagccatcaggctctgggtggtctcgtcactgcggacgtgcggggaagccgaaacaataagcttcgtatccattacttattgcctccttttttgatttcgccaagatagaaggccttggccagactcatcatctgggtgacngggcgctttgccgggcagacgaaggagcagctgccgcagttgaagcagtagtcagcgtgcagcttgcccagctcctgcacatcgcgggcggcgtaggcctgattgacctccacgggctccagacccatggggcagtactccacgcagcggccgcagcggatgcaggggttgacctgtgcgggctgtgcagctgccttgctcagcaggatcagaccggaagtggtcttggtggtggggtaggaaaggttctccacagcggggcccatcatggcaccgccggcaaccaccttgcccagctcgcccttgacgcccacatagtccagaatgtcctgataagcggtgcccacgggcacaacaacgttctggggctttgcgcaggcatcgccgtccacggtgatggtacgctggaccaccggcataccggtagccagatacttgcccagcgtggaaacgctggtcacgttcatcacgatagcgcctgcatcggcgggcagaccgccgtggggcacctcgcggccgaggcacttctcnatgaggatcagctctgcgccggtgccgtagacactgggcaggggcttgacctcnatagcgctgtcgtccttggtctttttgcacagcaggtcgatgcactcgggcttgttgttctcaataccaatgatgcacttcgggatgccggtatactgcagcacagccttgatgccgcggatgatatcatcgctgcactccagcatctcctgcgtgtcgctggtcagccacacctcgcactcggaggcgttg

SEQ ID NO: 1349 - DNA, 4000 bp, Escherichia coli
  misc_feature (2008)..(2008): n is a, c, g, or t
  misc_feature (2728)..(2728): n is a, c, g, or t
  misc_feature (2971)..(2971): n is a, c, g, or t
  misc_feature (3682)..(3682): n is a, c, g, or t
tggatgtcgggcacgtaatctgtcagcaccacatcatcactgcccggctgggcctgatattcagcaacctggataccatgctgctttagcagccgttcaaggtactgcgccagatattcattgcgcatcgccagccagattttcttatcctgtaagccgtccagcagcggaatggaaggctgtttaccgttgtagatcggaatacggacaataaactggcttcccattcccggctcagactcaacctcaatgtcaccgtccatcatgttgatcagtttttcacagatcgccagccccaatccggtcccctggaaattacgctgtacgccgttgcccacctggaaaaagggatcaaacagtcgggtcaactctttagccggaatacccacaccggtatcacgcgtgcggaacgccagatagccttgtgtgacataggcatgcagaataatacagcccgtatgggtgaatttaatggcgttattcagcaggttagaaatcacctgctgcagtcgcagaggatcaccatcaagtgcctgcggaacatcgtgctcgatatagcagtaaagcgtcaggcgcttcttcaccaccagggagagatagtttccgacaatatgggtgatcacttcgcgcggcgagaaaggtcgcggctctattttcaactgttccgattcaattttggagaagtcgagaatatcgctgatgatcttcaacagcaggctggaagagttattcatcgcggtcaccagcgagtctataccgctcggcagctgccgcgtctgcagcagatccaggttaccaatgatgccatacaacggcgtacgaagttcgtgactgaccgttgccaggaacatggatttcgactggctggcctgctctgccgcgtgggccatttcctgtaaggattgctccatgcgcacgcgggcggaaacatccaccagcacacagatcgccacgttttcattgcggtagcgggaatgcacaaagctgatttgcaggttagtattactgcccgtcaggacatcaacaaagttaacctgctgcccgccgatgatctcatttaatcgcttacggtcttcctgcgtcagcagcgtcagatagttgtgtgccaactcgttactgagaatattggtaccatcgctggtgcgtaaaatgcagatccctaccggcgctgaagcgacaattttacggttgaactgctcgtgctcttccagccggtgtgcgttttcttccgctggcaaaaacatgcgtctctcaaacagccaggcaagcgtaaacagcaggatggcgctcaggatattcagcaacagggcattgatcatcatcagtttgagctgatcgaccagcacatcggtagagaccgaccacaccacgttaagattcgacggtggcaacggttttttcagcaccagctgacggtaaccgtcaagatagccaaaccaggttttatcatcaggcaattcatttaatgaaaagcccaaaccgccccggcgcgaggtcaggagcggagcgtaattttcatccgtaatcgttgccgtgacgggcaggctaccgggctgaataaacgcatcaagctggatattttgctcgacgcccagcagggcctgaagtttatccgccacgtagatcggcatgataacagagaagtttcctacgcctggctgggcgctgctgtttacccagtagaccgggttgcgacgctcctcttccgaactgttgcggtagcgctgaaggttttcctgcaacagcttgaggctgttatcgcggttaacgttgttaccaatagcaaaatccgccagacacttgttatcgccaccaatgaggaacacccggttgagctcataagatgaggcgaaatgactcctccagtaattgatatagttactgagtgagtccagtgagttgcgccaggtcgcgctcatggcggtgcagtcatcactggaaaaaaggggggtaaactgcggttgaatcgtctttcctgccgttgaccgatctgaggcttctcccccgncgctggcgctggtgaggtggttttcagcgatgaacttaagctcgcgcatcttgcccgctgagaggcgaacgtaccagtcaattgtgccgtagttgccagcaaattcctgccgtaccttgttctctttatcgtgaagtacgctaatgatgtagaaggtggtcagcaccgcgcccagtagccagattagcagcgccaacgcgcgaaacagatagcgcgaaatgcgaagcgtcgtgcggaaagagactagatatttcaaaggtaactcgcaggtggcaaggttagtcgcatcgtgggatttttaatgctcatacactagctttatcgcagcaaaaaagccagtcggtgacgggcacccggcgcagtttgggactatttgcccctgaggaaatcatcctttgccaaacctgccgcaaaaaaaacggcaggtcgggtgatccctgacctgccgttgctcttaacgtacgacgcgctaattactcatcgtcgtccgctgcgggtacgtcatcgtcgtcattgtcgacttcaggtacgatatcgtcatccccttccgccacgctgccgtcgatggagtccagctcttcttcttccaccggctcagccacgcgttgcagtccgaccacgttctcgtcctctgccgtacgaatcagaatcacaccctgggtattacggcccacgatgctgacttcagacacacgggttctcaccagggtgccggcatcngtgatcatcatgatctgatcgctgtcgaccacctgcactgcaccaatcaccgggccattacgctcggtcactttgatggagatcacgccctgcgtcgcacgggatttggttggatactcactgttcgcggtacgcttaccgtagccgttctgcgtcacggtgagaatcgcgccctcttcacgcggcacaatcagggaaaccacacgatcgttttgcgccagcttgataccgcgtacgcccgangccgtacggcccatggcacgcacggcagattcggcgaagcgaaccactttaccggcggccgagaacagcatcgcctcgtcgttaccgttggtcagcgctacgccaatcagctcgtcatcatcgcgcaggttaatggcgatgataccggcgctgcgtggacggctgaactcctgcagaccggttttcttcaccgtgccgctcgcggttgccataaagatattgaagccttcggtgtattcgcgcacaggcagaatcgccgtgatacgttcattcgcttcaagcggcaacaggttgacgattggacgtccacgtgccccacggctggcttccggcagctggtaaaccttcatccagtagagtcggccacggctggagaagcacagaatcgtatcgtgggtgtttgccaccaacagacgatcgataaaatcttcttctttaatgcgggcggcagacttgcctttgccaccgcgacgctgcgcttcgtaatcactcagcggctgatattttacatagccctgatgcgacagcgtgacgaccacatcttcctgattgatcaggtcctcgatgttgatgtctgcgctgttcgcagtgatttccgtgcggcgctcatcgccgaactgatcgcgcatcagttccagctcttcgcgaatgacttccatcaggcgctcagaacttcccaggatgtggagcaactccgcaatttgatccagnagctgtttgtattcatccagcagcttttcatgctcaagcccggtcagtttctgtaaacgtaagtccagaatggcctgagcctgctgttcagtcaggtaatatttaccctcacgaataccaaactgcgcttccagccactctgggcgggcagcatcatcaccggcacgctccagcatggcagacacgttgcccagatcccaggattgtgcgatcaggcccgctttcgcttcggcaggcgtgggcgcacggcggatcagctcaatgatcggatcgatgttagccagcgcaatcgccaggccttcaaggatatgcgcacga

SEQ ID NO: 1350 - DNA, 4000 bp, Escherichia coli
  misc_feature (60)..(60): n is a, c, g, or t
  misc_feature (1005)..(1005): n is a, c, g, or t
  misc_feature (1944)..(1944): n is a, c, g, or t
  misc_feature (1965)..(1965): n is a, c, g, or t
  misc_feature (1992)..(1992): n is a, c, g, or t
  misc_feature (2481)..(2481): n is a, c, g, or t
  misc_feature (2627)..(2627): n is a, c, g, or t
  misc_feature (2801)..(2801): n is a, c, g, or t
  misc_feature (2883)..(2883): n is a, c, g, or t
  misc_feature (2894)..(2895): n is a, c, g, or t
  misc_feature (2915)..(2915): n is a, c, g, or t
  misc_feature (2918)..(2918): n is a, c, g, or t
  misc_feature (2921)..(2921): n is a, c, g, or t
  misc_feature (3041)..(3041): n is a, c, g, or t
  misc_feature (3110)..(3110): n is a, c, g, or t
  misc_feature (3134)..(3134): n is a, c, g, or t
  misc_feature (3137)..(3137): n is a, c, g, or t
  misc_feature (3206)..(3206): n is a, c, g, or t
  misc_feature (3610)..(3610): n is a, c, g, or t
  misc_feature (3668)..(3668): n is a, c, g, or t
  misc_feature (3680)..(3680): n is a, c, g, or t
  misc_feature (3864)..(3864): n is a, c, g, or t
  misc_feature (3959)..(3959): n is a, c, g, or t
actggaaccggttatggcctcaccaaggatgcagccaccgagcaagccaaacgggatgcngttgaacagggtctcggcgcctatatgacctccaccactacggtaacagccacctctatagaggataatatttactccaaagctcagggatttgttaagtcctttaaagtgacgaaagaaagcaaagggcccgatggtaactgggaaatcaccatcgaagcagaagtgacggatatgattgatcaagtcatggcagatgaagcagcccttcagacattactcaacgccatgaaccgtcccaggattatttttatggttcgggaacaaaacttgattgataacacgcccaccgattttgctgaaaccaaactgttagccatgttttatgaaaaaggatttgatgtggtagatcggcaaatggttcaagctttgaagggtgatgcagattatggccaagctttagcggggaacgtatccgcggctgccaagatcgcaagccagcttggggctgagattattgttattggtacagccaaaatttcttccggaggtaaaatctataatatgacttctggtcaggccgatatcaatgcaaaaattattcgggtagacacgggtgaaatcttagcggttgtacctcaggcgcggggaaagaaaccccatatatccccatccacggccggcgtgaatgccgccaatcaggccgcggaggcattggggaaaaatatcatttcccaattgatcatcaaatggagtacacagcagtcaaatttcaccaaaatatatattgtgcttaaaggggcagattttatgtcttacatgacatttgagtcattcttaaaagcccagacggtttcaggaattcggaatgcgtacgcgaaaagtttgaatgatggcgtggcggaatatgaagtggaatttgaaggcaaatctcaagccttagccatggggttggcccaaaccagtcccgatgggttgaattttaaggtgaccggattgaccggnaatcgaattacagcagaaattgtacaataattgaggtattctatgaaaagattattcggaatatgcaccctattaattggtatggccttttctcagggtgtggtgacccaattggacaaaggtagcatcaattattcagatcaatccatttcggcgatagggattggatttatcccagtaaatgtgatcaatgcagggcaagcccgccgcttggctttacggattgccaaacaggatgcgcttcgccagctaattgaaattgtaaatggggtaacactcaccagtgaaaccaccatgagcggagccatggttgatgatgtgattaacacgaaggtccgcggatttattcgtggtgcccgtcagatgggaggtccaaagtatttaagcgatacatctgtagaagtagaatattctgttcccatgagtggtatttcagatattatgcttccaccacttacagttgcggtggcacagcccggtgctccgacggaggcggcaacggcaccaacaacgggcggtattaccggtgtgatcattgatgcccgcggactcaaagcacgccctgccatggcacccagaattttagatcaaaatggcaatgcaatctatggccctggtaaatacagtagagaatatgcagtaaccaatggggtagtgggatattctaaaacattagaagcggctcaaaatgacgacagggtcaaagggaatccgctggtggtaaagggggtctcaactgcgggtaaaaacagaaccgatgtggtaatcagcaatgcagatgtttcaaaaattgattcggcgaatcgcagttacaatgtactgaaagattgcagagtgttaattctcctggattaaagtaattttagtaattaagatagtaaaataaggatgcggaataatatgagattaaaacgtatctcaatgttaatcattgggttnttggttagtggtgttgtaggncaggaagaagccaaaacgccaggcatnggaaatattgatgaaaaggatttaaaggttggtgacattgcaccatcttgggcattaatgtatgcgccaggtaagtttgaattcctgaaaaactggtcggaagaagacggaaagcgtcttcgaaaatttacatcccagccggatagacatgccgttctcatgagttttttcgccacttggtgtcagccctgtatgaaggaattgcccattttagaagatgtgtaccaaaagtataaagatgagcgtatcaaattttttctggtggatattacggaagcaactcgaaccaatccaggatatgaagatatgccaaaggctggaccttttttaaaaaagaagggtgtatccatgcaaattttattcgacactcgcggaacagtaatgaagcgctataatgcccagacattgcctcgattgtttatgatggatgggaatcggattatttcacagacaagacggggcttccatgctggggaagaggaaaaattnaccaaagaattgtctgaagaaattgaacgtcttttagcggaattacccccacctaagaatgggaaaaaataggctgtgagccagcccacagggaattgttctgtggatgttttaagttttaaaacaaaagtgagctaattatgagngtatttaaacagattattatatggtgcatggttatgagtgccggttgggcgcaaacaccgggaacccaatccgtgataaatgcagaaacgtctgcccagttggcggaaggtaaacaaaccgtcgctatcttagactttgaagggcggggtatatcccagatggaagcggccacnctcacagacagactcatgagtgaaatggtatccaccaatgcggtgattatggtggaacggaaccagatgaatgaaatcctgnaagaacagggnntgcagcagtccggctgtacntcngcngaatgtgccgccgaagtgggtgccctgttgggtgtacaaagcatgatttccggttcctttggaaaattaggtaatactttcacagtggatgccaaaatgttttccgtggaaacgggtcanaccacgcgcagtgtaagcaagacttataagggagaggtggatggattattgcccatcattgaaattgtngcctgggaactggtcgggctccangcnccagcggatatattagccagggcaggagtaaaagctccggagccagttgcaccaccaaaggaaccacgnaaacccatgagtaagggtgtgaaacgattattatgggcggtattgctggtcggcggcggcggctatggtgcttatgcggcgggattatttgatgtggccccctctcctttacctgaaccgccaaccttaccggagggttaagccatgatgaaaaaattctttttcatcactattttcgggttttccactttgctcagtcagtccgttgtgagcctggatggttccaacgactatctaaccacaaccgaaactaccggtacaaagcttgaaggtgattttactatttccggttgggtcttccccaagggtgatgcgactcagcaggtatttcataacgaactttttgaaatccagtatcaggggtcttattacagacagtttaggatctacccaggcggttacantacaacttggggggaagcttcgatcaatgaatggcaccatattgcggtaacccgtagnagccacactaangcctatgataccctctatgtatatgtggatggcaaacagagtctcatgtttgcaagggatcaatcttcaacaacaacttttgatggtactatgtatttgggccgggaccctgattatggtgaatacttcaggggttttatggatgaatttgccatttggaatacggtcctggattcaaacagcntaaaagaattatataatggcggtgtgcctaaaagcgccaccagcgtgaagtcctccaatatgctctcttactggaaaatggatgatggtacaggnacgtctgcaaccaatgccgtatcaggtagtcccagcctgtc

SEQ ID NO: 1351 - DNA, 4000 bp, Escherichia coli
  misc_feature (1)..(2): n is a, c, g, or t
  misc_feature (4)..(4): n is a, c, g, or t
  misc_feature (6)..(6): n is a, c, g, or t
  misc_feature (8)..(18): n is a, c, g, or t
  misc_feature (20)..(32): n is a, c, g, or t
  misc_feature (34)..(35): n is a, c, g, or t
  misc_feature (37)..(39): n is a, c, g, or t
  misc_feature (41)..(45): n is a, c, g, or t
  misc_feature (47)..(56): n is a, c, g, or t
  misc_feature (59)..(66): n is a, c, g, or t
  misc_feature (68)..(73): n is a, c, g, or t
  misc_feature (75)..(82): n is a, c, g, or t
  misc_feature (84)..(85): n is a, c, g, or t
  misc_feature (87)..(102): n is a, c, g, or t
  misc_feature (104)..(109): n is a, c, g, or t
  misc_feature (112)..(113): n is a, c, g, or t
  misc_feature (115)..(119): n is a, c, g, or t
  misc_feature (122)..(122): n is a, c, g, or t
  misc_feature (124)..(126): n is a, c, g, or t
  misc_feature (128)..(128): n is a, c, g, or t
  misc_feature (130)..(140): n is a, c, g, or t
  misc_feature (142)..(146): n is a, c, g, or t
  misc_feature (148)..(149): n is a, c, g, or t
  misc_feature (151)..(151): n is a, c, g, or t
  misc_feature (153)..(153): n is a, c, g, or t
  misc_feature (155)..(155): n is a, c, g, or t
  misc_feature (159)..(160): n is a, c, g, or t
  misc_feature (162)..(163): n is a, c, g, or t
  misc_feature (165)..(168): n is a, c, g, or t
  misc_feature (171)..(171): n is a, c, g, or t
  misc_feature (173)..(174): n is a, c, g, or t
  misc_feature (176)..(176): n is a, c, g, or t
  misc_feature (179)..(179): n is a, c, g, or t
  misc_feature (182)..(184): n is a, c, g, or t
  misc_feature (187)..(187): n is a, c, g, or t
  misc_feature (189)..(190): n is a, c, g, or t
  misc_feature (193)..(194): n is a, c, g, or t
  misc_feature (196)..(197): n is a, c, g, or t
  misc_feature (199)..(199): n is a, c, g, or t
  misc_feature (201)..(201): n is a, c, g, or t
  misc_feature (206)..(207): n is a, c, g, or t
  misc_feature (212)..(216): n is a, c, g, or t
  misc_feature (218)..(218): n is a, c, g, or t
  misc_feature (221)..(221): n is a, c, g, or t
  misc_feature (223)..(224): n is a, c, g, or t
  misc_feature (226)..(226): n is a, c, g, or t
  misc_feature (229)..(233): n is a, c, g, or t
  misc_feature (237)..(240): n is a, c, g, or t
  misc_feature (244)..(245): n is a, c, g, or t
  misc_feature (247)..(247): n is a, c, g, or t
  misc_feature (249)..(253): n is a, c, g, or t
  misc_feature (258)..(258): n is a, c, g, or t
  misc_feature (261)..(262): n is a, c, g, or t
  misc_feature (267)..(269): n is a, c, g, or t
  misc_feature (271)..(272): n is a, c, g, or t
  misc_feature (274)..(275): n is a, c, g, or t
  misc_feature (281)..(282): n is a, c, g, or t
  misc_feature (287)..(288): n is a, c, g, or t
  misc_feature (291)..(291): n is a, c, g, or t
  misc_feature (299)..(299): n is a, c, g, or t
  misc_feature (306)..(306): n is a, c, g, or t
  misc_feature (308)..(310): n is a, c, g, or t
  misc_feature (314)..(315): n is a, c, g, or t
  misc_feature (321)..(321): n is a, c, g, or t
  misc_feature (323)..(324): n is a, c, g, or t
  misc_feature (326)..(327): n is a, c, g, or t
  misc_feature (330)..(330): n is a, c, g, or t
  misc_feature (334)..(338): n is a, c, g, or t
  misc_feature (340)..(340): n is a, c, g, or t
  misc_feature (342)..(345): n is a, c, g, or t
  misc_feature (347)..(347): n is a, c, g, or t
  misc_feature (361)..(361): n is a, c, g, or t
  misc_feature (404)..(404): n is a, c, g, or t
  misc_feature (447)..(447): n is a, c, g, or t
  misc_feature (450)..(450): n is a, c, g, or t
  misc_feature (484)..(484): n is a, c, g, or t
  misc_feature (491)..(491): n is a, c, g, or t
  misc_feature (494)..(494): n is a, c, g, or t
  misc_feature (498)..(498): n is a, c, g, or t
  misc_feature (502)..(502): n is a, c, g, or t
  misc_feature (507)..(507): n is a, c, g, or t
  misc_feature (509)..(510): n is a, c, g, or t
  misc_feature (513)..(514): n is a, c, g, or t
  misc_feature (516)..(516): n is a, c, g, or t
  misc_feature (523)..(523): n is a, c, g, or t
  misc_feature (525)..(525): n is a, c, g, or t
  misc_feature (529)..(529): n is a, c, g, or t
  misc_feature (536)..(538): n is a, c, g, or t
  misc_feature (543)..(544): n is a, c, g, or t
  misc_feature (550)..(552): n is a, c, g, or t
  misc_feature (556)..(556): n is a, c, g, or t
  misc_feature (560)..(560): n is a, c, g, or t
  misc_feature (570)..(570): n is a, c, g, or t
  misc_feature (573)..(573): n is a, c, g, or t
  misc_feature (578)..(581): n is a, c, g, or t
  misc_feature (589)..(589): n is a, c, g, or t
  misc_feature (592)..(594): n is a, c, g, or t
  misc_feature (598)..(598): n is a, c, g, or t
  misc_feature (604)..(605): n is a, c, g, or t
  misc_feature (610)..(611): n is a, c, g, or t
  misc_feature (613)..(613): n is a, c, g, or t
  misc_feature (619)..(619): n is a, c, g, or t
  misc_feature (628)..(628): n is a, c, g, or t
  misc_feature (632)..(632): n is a, c, g, or t
  misc_feature (637)..(637): n is a, c, g, or t
  misc_feature (639)..(640): n is a, c, g, or t
  misc_feature (642)..(643): n is a, c, g, or t
  misc_feature (645)..(645): n is a, c, g, or t
  misc_feature (647)..(647): n is a, c, g, or t
  misc_feature (649)..(653): n is a, c, g, or t
  misc_feature (655)..(656): n is a, c, g, or t
  misc_feature (658)..(658): n is a, c, g, or t
  misc_feature (665)..(665): n is a, c, g, or t
  misc_feature (668)..(669): n is a, c, g, or t
  misc_feature (677)..(678): n is a, c, g, or t
  misc_feature (681)..(681): n is a, c, g, or t
  misc_feature (684)..(685): n is a, c, g, or t
  misc_feature (687)..(687): n is a, c, g, or t
  misc_feature (690)..(690): n is a, c, g, or t
  misc_feature (692)..(693): n is a, c, g, or t
  misc_feature (697)..(697): n is a, c, g, or t
  misc_feature (699)..(700): n is a, c, g, or t
  misc_feature (707)..(709): n is a, c, g, or t
  misc_feature (711)..(711): n is a, c, g, or t
  misc_feature (713)..(713): n is a, c, g, or t
  misc_feature (718)..(718): n is a, c, g, or t
  misc_feature (722)..(722): n is a, c, g, or t
  misc_feature (726)..(726): n is a, c, g, or t
  misc_feature (730)..(730): n is a, c, g, or t
  misc_feature (733)..(733): n is a, c, g, or t
  misc_feature (740)..(740): n is a, c, g, or t
  misc_feature (743)..(743): n is a, c, g, or t
  misc_feature (745)..(745): n is a, c, g, or t
  misc_feature (747)..(747): n is a, c, g, or t
  misc_feature (750)..(750): n is a, c, g, or t
  misc_feature (754)..(754): n is a, c, g, or t
  misc_feature (757)..(757): n is a, c, g, or t
  misc_feature (760)..(760): n is a, c, g, or t
  misc_feature (763)..(763): n is a, c, g, or t
  misc_feature (765)..(765): n is a, c, g, or t
  misc_feature (769)..(769): n is a, c, g, or t
  misc_feature (771)..(771): n is a, c, g, or t
  misc_feature (773)..(774): n is a, c, g, or t
  misc_feature (777)..(778): n is a, c, g, or t
  misc_feature (780)..(780): n is a, c, g, or t
  misc_feature (783)..(783): n is a, c, g, or t
  misc_feature (787)..(787): n is a, c, g, or t
  misc_feature (789)..(789): n is a, c, g, or t
  misc_feature (793)..(794): n is a, c, g, or t
  misc_feature (797)..(797): n is a, c, g, or t
  misc_feature (799)..(801): n is a, c, g, or t
  misc_feature (803)..(804): n is a, c, g, or t
  misc_feature (806)..(810): n is a, c, g, or t
  misc_feature (813)..(814): n is a, c, g, or t
  misc_feature (816)..(816): n is a, c, g, or t
  misc_feature (821)..(829): n is a, c, g, or t
  misc_feature (831)..(832): n is a, c, g, or t
  misc_feature (834)..(834): n is a, c, g, or t
  misc_feature (839)..(843): n is a, c, g, or t
  misc_feature (845)..(845): n is a, c, g, or t
  misc_feature (847)..(848): n is a, c, g, or t
  misc_feature (851)..(851): n is a, c, g, or t
  misc_feature (854)..(854): n is a, c, g, or t
  misc_feature (857)..(860): n is a, c, g, or t
  misc_feature (863)..(863): n is a, c, g, or t
  misc_feature (865)..(867): n is a, c, g, or t
  misc_feature (871)..(876): n is a, c, g, or t
  misc_feature (879)..(882): n is a, c, g, or t
  misc_feature (885)..(886): n is a, c, g, or t
  misc_feature (889)..(890): n is a, c, g, or t
  misc_feature (892)..(895): n is a, c, g, or t
  misc_feature (899)..(904): n is a, c, g, or t
  misc_feature (906)..(915): n is a, c, g, or t
  misc_feature (918)..(918): n is a, c, g, or t
  misc_feature (920)..(928): n is a, c, g, or t
  misc_feature (930)..(933): n is a, c, g, or t
  misc_feature (936)..(936): n is a, c, g, or t
  misc_feature (938)..(940): n is a, c, g, or t
  misc_feature (944)..(945): n is a, c, g, or t
  misc_feature (949)..(959): n is a, c, g, or t
  misc_feature (962)..(962): n is a, c, g, or t
  misc_feature (965)..(967): n is a, c, g, or t
  misc_feature (969)..(974): n is a, c, g, or t
  misc_feature (976)..(978): n is a, c, g, or t
  misc_feature (980)..(982): n is a, c, g, or t
  misc_feature (986)..(996): n is a, c, g, or t
  misc_feature (998)..(999): n is a, c, g, or t
  misc_feature (1002)..(1002): n is a, c, g, or t
  misc_feature (1004)..(1004): n is a, c, g, or t
  misc_feature (1006)..(1006): n is a, c, g, or t
  misc_feature (1008)..(1010): n is a, c, g, or t
  misc_feature (1012)..(1014): n is a, c, g, or t
  misc_feature (1020)..(1022): n is a, c, g, or t
  misc_feature (1025)..(1026): n is a, c, g, or t
  misc_feature (1028)..(1032): n is a, c, g, or t
  misc_feature (1034)..(1034): n is a, c, g, or t
  misc_feature (1036)..(1037): n is a, c, g, or t
  misc_feature (1040)..(1041): n is a, c, g, or t
  misc_feature (1047)..(1047): n is a, c, g, or t
  misc_feature (1049)..(1049): n is a, c, g, or t
  misc_feature (1053)..(1055): n is a, c, g, or t
  misc_feature (1057)..(1057): n is a, c, g, or t
  misc_feature (1060)..(1065): n is a, c, g, or t
  misc_feature (1069)..(1070): n is a, c, g, or t
  misc_feature (1072)..(1078): n is a, c, g, or t
  misc_feature (1080)..(1085): n is a, c, g, or t
  misc_feature (1088)..(1088): n is a, c, g, or t
  misc_feature (1090)..(1090): n is a, c, g, or t
  misc_feature (1092)..(1094): n is a, c, g, or t
  misc_feature (1099)..(1099): n is a, c, g, or t
  misc_feature (1101)..(1104): n is a, c, g, or t
  misc_feature (1106)..(1106): n is a, c, g, or t
  misc_feature (1110)..(1113): n is a, c, g, or t
  misc_feature (1117)..(1117): n is a, c, g, or t
  misc_feature (1121)..(1122): n is a, c, g, or t
  misc_feature (1126)..(1128): n is a, c, g, or t
  misc_feature (1131)..(1133): n is a, c, g, or t
  misc_feature (1135)..(1138): n is a, c, g, or t
  misc_feature (1140)..(1141): n is a, c, g, or t
  misc_feature (1143)..(1144): n is a, c, g, or t
  misc_feature (1146)..(1153): n is a, c, g, or t
  misc_feature (1157)..(1158): n is a, c, g, or t
  misc_feature (1160)..(1160): n is a, c, g, or t
  misc_feature (1164)..(1167): n is a, c, g, or t
  misc_feature (1171)..(1171): n is a, c, g, or t
  misc_feature (1173)..(1174): n is a, c, g, or t
  misc_feature (1176)..(1176): n is a, c, g, or t
  misc_feature (1183)..(1188): n is a, c, g, or t
  misc_feature (1190)..(1190): n is a, c, g, or t
  misc_feature (1192)..(1196): n is a, c, g, or t
  misc_feature (1200)..(1201): n is a, c, g, or t
  misc_feature (1206)..(1206): n is a, c, g, or t
  misc_feature (1209)..(1209): n is a, c, g, or t
  misc_feature (1212)..(1214): n is a, c, g, or t
  misc_feature (1221)..(1230): n is a, c, g, or t
  misc_feature (1232)..(1234): n is a, c, g, or t
  misc_feature (1236)..(1239): n is a, c, g, or t
  misc_feature (1241)..(1241): n is a, c, g, or t
  misc_feature (1243)..(1243): n is a, c, g, or t
  misc_feature (1245)..(1245): n is a, c, g, or t
  misc_feature (1247)..(1254): n is a, c, g, or t
  misc_feature (1258)..(1260): n is a, c, g, or t
  misc_feature (1263)..(1266): n is a, c, g, or t
  misc_feature (1269)..(1272): n is a, c, g, or t
  misc_feature (1274)..(1277): n is a, c, g, or t
  misc_feature (1279)..(1283): n is a, c, g, or t
  misc_feature (1286)..(1288): n is a, c, g, or t
  misc_feature (1290)..(1291): n is a, c, g, or t
  misc_feature (1293)..(1293): n is a, c, g, or t
  misc_feature (1295)..(1297): n is a, c, g, or t
  misc_feature (1299)..(1302): n is a, c, g, or t
  misc_feature (1304)..(1305): n is a, c, g, or t
  misc_feature (1307)..(1308): n is a, c, g, or t
  misc_feature (1310)..(1314): n is a, c, g, or t
  misc_feature (1316)..(1318): n is a, c, g, or t
  misc_feature (1320)..(1320): n is a, c, g, or t
  misc_feature (1322)..(1324): n is a, c, g, or t
  misc_feature (1326)..(1326): n is a, c, g, or t
  misc_feature (1329)..(1332): n is a, c, g, or t
  misc_feature (1334)..(1334): n is a, c, g, or t
  misc_feature (1336)..(1338): n is a, c, g, or t
  misc_feature (1340)..(1340): n is a, c, g, or t
  misc_feature (1343)..(1347): n is a, c, g, or t
  misc_feature (1349)..(1349): n is a, c, g, or t
  misc_feature (1352)..(1352): n is a, c, g, or t
  misc_feature (1354)..(1354): n is a, c, g, or t
  misc_feature (1356)..(1356): n is a, c, g, or t
  misc_feature (1360)..(1360): n is a, c, g, or t
  misc_feature (1365)..(1371): n is a, c, g, or t
  misc_feature (1376)..(1376): n is a, c, g, or t
  misc_feature (1381)..(1383): n is a, c, g, or t
  misc_feature (1386)..(1390): n is a, c, g, or t
  misc_feature (1392)..(1392): n is a, c, g, or t
  misc_feature (1395)..(1395): n is a, c, g, or t
  misc_feature (1400)..(1407): n is a, c, g, or t
  misc_feature (1410)..(1410): n is a, c, g, or t
  misc_feature (1412)..(1412): n is a, c, g, or t
  misc_feature (1415)..(1416): n is a, c, g, or t
  misc_feature (1418)..(1419): n is a, c, g, or t
  misc_feature (1422)..(1422): n is a, c, g, or t
  misc_feature (1424)..(1425): n is a, c, g, or t
  misc_feature (1428)..(1431): n is a, c, g, or t
  misc_feature (1433)..(1433): n is a, c, g, or t
  misc_feature (1435)..(1435): n is a, c, g, or t
  misc_feature (1437)..(1440): n is a, c, g, or t
  misc_feature (1443)..(1444): n is a, c, g, or t
  misc_feature (1446)..(1449): n is a, c, g, or t
  misc_feature (1452)..(1455): n is a, c, g, or t
  misc_feature (1457)..(1462): n is a, c, g, or t
  misc_feature (1464)..(1464): n is a, c, g, or t
  misc_feature (1466)..(1470): n is a, c, g, or t
  misc_feature (1472)..(1474): n is a, c, g, or t
  misc_feature (1477)..(1480): n is a, c, g, or t
  misc_feature (1482)..(1485): n is a, c, g, or t
  misc_feature (1487)..(1488): n is a, c, g, or t
  misc_feature (1490)..(1494): n is a, c, g, or t
  misc_feature (1496)..(1497): n is a, c, g, or t
  misc_feature (1499)..(1502): n is a, c, g, or t
  misc_feature (1504)..(1510): n is a, c, g, or t
  misc_feature (1513)..(1514): n is a, c, g, or t
  misc_feature (1516)..(1516): n is a, c, g, or t
  misc_feature (1518)..(1533): n is a, c, g, or t
  misc_feature (1535)..(1540): n is a, c, g, or t
  misc_feature (1542)..(1544): n is a, c, g, or t
  misc_feature (1547)..(1547): n is a, c, g, or t
  misc_feature (1549)..(1549): n is a, c, g, or t
  misc_feature (1551)..(1551): n is a, c, g, or t
  misc_feature (1554)..(1555): n is a, c, g, or t
  misc_feature (1559)..(1560): n is a, c, g, or t
  misc_feature (1562)..(1566): n is a, c, g, or t
  misc_feature (1568)..(1571): n is a, c, g, or t
  misc_feature (1573)..(1575): n is a, c, g, or t
  misc_feature (1577)..(1579): n is a, c, g, or t
  misc_feature (1581)..(1584): n is a, c, g, or t
  misc_feature (1586)..(1587): n is a, c, g, or t
  misc_feature (1589)..(1589): n is a, c, g, or t
  misc_feature (1591)..(1591): n is a, c, g, or t
  misc_feature (1593)..(1594): n is a, c, g, or t
  misc_feature (1596)..(1598): n is a, c, g, or t
  misc_feature (1601)..(1601): n is a, c, g, or t
  misc_feature (1603)..(1603): n is a, c, g, or t
  misc_feature (1605)..(1609): n is a, c, g, or t
  misc_feature (1612)..(1615): n is a, c, g, or t
  misc_feature (1619)..(1630): n is a, c, g, or t
  misc_feature (1633)..(1635): n is a, c, g, or t
  misc_feature (1637)..(1639): n is a, c, g, or t
  misc_feature (1646)..(1649): n is a, c, g, or t
  misc_feature (1655)..(1655): n is a, c, g, or t
  misc_feature (1657)..(1658): n is a, c, g, or t
  misc_feature (1882)..(1882): n is a, c, g, or t
  misc_feature (1989)..(1989): n is a, c, g, or t
  misc_feature (1991)..(1991): n is a, c, g, or t
  misc_feature (3519)..(3519): n is a, c, g, or t
  misc_feature (3838)..(3838): n is a, c, g, or t
  misc_feature (3840)..(3841): n is a, c, g, or t
nngnancnnnnnnnnnnntnnnnnnnnnnnnngnntnnncnnnnncnnnnnnnnnnccnnnnnnnntnnnnnntnnnnnnnnanntnnnnnnnnnnnnnnnnannnnnnaanncnnnnnccntnnncngnnnnnnnnnnngnnnnntnntntntncatnntnntnnnnaantnncnacngannnggnannagnntnngnanttggnnacggnnnnntnaangnncnggnnnnnaaannnnctcnnanannnnnattangannataannngnntnntttggnntatannttntaaaaccnccactanannnaaanngaaaancnntnnttncagnnnnngntnnnntnactgtatttgtttnatctaagattaaattaaatcctaaggcacttgttgcttgcacntgcataggagcaatttgataatctgtagatctctctatttctnganctgctgggttaaaccatgatggtctactgtttcnaacagtnttnccancaanatatnanncannanttatatnancatnttcaaannnaaatnnatcagnnnttanatcnttatctttangtntatannnntttgcatntannnaatnaaaatnngaatnnanatcctnaaaaatatnattnttaananngnnancntnnnnntnngntacatanttnnctagaaannttnctnnanatntnnctgntnntttattnnnantnataanaggnttanttantgnattaaanttngnancantaancgnacnaanangtgntnanntanntntancagnanttgnntcngnnntnnannnnnttnnanttttnnnnnnnnntnntnttttnnnnntntnnttnttnttnnnnttntnnnttannnnnnatnnnncanntanngnnnnattnnnnnnannnnnnnnnncanannnnnnnnnannnntanannnaaanntttnnnnnnnnnnntcnttnnnannnnnntnnnannntttnnnnnnnnnnntnntantnantnnntnnnttattnnnganntnnnnntngnnttnnttttanangttnnntnaannnnnncatnnannnnnnntnnnnnntcngntnnngtttngnnnnanattnnnntttnaatnntatnnnaannnannnnannanntnnnnnnnnaatnntngatnnnntatnanntnttgtatnnnnnntnannnnntttnnaaaancanttnnnaaaggannnnnnnnnngnnngnnnntntntntnnnnnnnntttnnncannnnttnnnnannnntnnnnnaannntnntncnnncnnnntnncnnannnnntnnngnannnanttnnnnangnnntntcnnnnntngtntntntggntgttnnnnnnnttgtnaaatnnngtnnnnntntgnctgtnnnnnnnnctntnaannannctntnnatnnnncngnannnnttnnannnngannnncnnnnnntncnnnnncnnntgnnnncnnnncnnannnnnanncnnnngnnnnnnnttnngngnnnnnnnnnnnnnnnntnnnnnnannntcngnancannatanncnnnnnannnngnnnannntnnnncnntncngnnannngtngnannnnnagnnnnagannnnnnnnnnnnatnnntnnnaataaannnntcatanannccagttacactagaatataaagttccagatgcttcatactcagctgaagacagcgctgatagtaacggattaaaatataatccatcataataatctgcaccagttgtacagcttgatgccgttgtactctccgctgcgacatatgatgatcccgcttttctctttgggtagacgggctttataaaataaaactcattgccatatatatcactgcgtaatttaangcctgtcttattagatattaacagatcagataatctagatgcttctggataagagtttaatacgcttattggatatgtgtcagtattcttccaatctatttgtccgngngcgtcatcccaaaagcttatattatcttctctcttgtttatacctgcaacagaataatctaacgtgttttcttggctttgatatccgtaatttcgaagtaatttattattataaatctctacagacgagctctgattatcgtttttatatgtattattttttgatttaaaaattaaaggtgtccgttgcttcatttttatattacggagccgttcacctgttttactatttttaatataaccaacaaccttaacacctggttcgtatttatgagggttcggtacaatatactcactacctgtaaatgcagataaatcgatattaaatgttaacccattagaataaaaattagttgttcctgtatttttaaacgataattggaatggaaaaatttcagtgctctttatgttgagtggagtgctatataagttaggattatatctttgagctagattgtttgttggatttgtattattaaataattgttttattttagcattatgtttattaccggatatatgatataaatcatttgctaaatatttttctattaatcccttttcatgtgtgaattttagattgtctatagttttattttcacctctaaaatatctccctggtaatctttcaaaatttacaaacggatcatttatacctaatagactattaggtgttgagacattattggattgaatttttaatttttttccatttttatttattgatattacttgtagtacattaggtacttcacgaagtacctttctagcaatatttaaatttaaatctttatctatcttatgtatatcatatacaaattcatctgatatgtaattttttaaattaactgaaatattatttgcaattttttgtagtttaatatcactgatttttgcatttgtacgctctcttataaattcatcactatttaacaacctggcaataaaatttttaatgtatttttgtataccaagcttagatgtttttagcttgtttttagttgtagagaatttaacctcttcacgaatgtctcgaatatttcgtaattgggattgaataatttcagcaaaatagtgaattgatagttcaagctcatatatatcatctacatctatcctctcaataaaatcttgtacaggtttatcaagtgttgataaatttaagttgtctataaattgaacgtagatactttttgcatagttggtattagtagtatcattaacttgtttttgatctttccattctataagataattattatatcttactgatagttcagaagcatcagcaatatctgtataataggctttccactcaaggaatgatattgggttggttgtattaaagtctattgtcatatactaagcccctttctaatttgataatctaaattcttgtatattacaccaccagtatcttcccagtctgcacttaaagaggttgtactacgtgtaatagtattataattgttattaaaatctataatactgtttttaatattttcatttgcagatgtcgtgtcgtatgnagtgtatggatagaagtcataaaacccatctagaccacttgaacctgatactgacgtgtctaagggccaaccccagttactatatacgttataagcagataatggatatgcagataatatatccgtatcagcaccagatacagctttactacaaacattttgtggtctaattaaagtaaattcattattaaatctttgccgcgctacaaaattagcggctgttgtaacagtatatgttgatgtagttatcttattatcaaaatctatattcctaccatcagctgagcttgtataaaagtttgaatttaagctttggtcntnncgttcataatctcctaaaagctttgtaatctttatactaaacaaatcatataatcgctttagttctggtggtggagttggtaatacaatatctatatcttcgttaaatagatcgtagaatgattgtaaattatccatattacagtaatcaacatcatta

SEQ ID NO: 1352 - DNA, 4000 bp, Escherichia coli
aggccggatcgtcccaggccagcgagccgatgaacaggctcatggtgaagccgataccggcgcagaccgacacgccgtagagcttcaaccaggttccgccggccggcatcggcgccaggcgcaacaggatgaaggcagcggccggcaggaaaacgccgatctgcttgcccaggaacaggcccagcgcgatgcccagcggcaccggctccagcagcgcggcgaccgatagaccggcaagcggcaggccggcgttggcgagcgcgaagagcggcatgatcaggaacgacacccagggcttgagcgcgtgctccagcacgatgaagggccggtcgtcgggcgcgacgctttcgtcgcgcagcggcaggcagaaagcgatcaccacgcccgccagggtggcgtgcacaccagacttcagcacgcagacccacagcaccgcgccgaccagcagatagggaccgctgcgccgcacgccgagccggttcagtgtcagcatcgtgacgatgcagatcgccgccagcaccagcgccgtcgtcgacagctcggcggtatagaagatggcgatgatcacgatggcgccgaggtcgtcgatgatcgccagcgtgacgaggaagagcttcagccccagcggtacgcgcgagcccagcaccgccaggacgccgacggcgaaggcgatgtcggtggccgctggcaccgcccagccgcgcagcgccacggcgtcgccgacattgaaccaggcgaagatcgccgccggcaccaccatgccaccgagcgccgcgaccatgggcatggcgacctgcgccggcttggacagtgcgccctcgaccacctcgcgcttgatctccagcccgaccagcaggaagaagatcgccatcagcccgtcgttgatccacagcaccagcggcttgctgagccccagctcgccgtagctgatggtgaacttggtggcgaacagccggtcgatggtggcatgcaagggcgagttggcgaggatgatcgccagcgccgccaccgcgatcagcacgatgcccggcgcggcctcgctgtgcaggaaacgatggagacggccgctggccatgggcgactcccggtgccgctcggagatttcgggcccgaattccttccccccgagcgcgggagggccatgaaaaacgcccgggcctttcggacccgggcgttgcgagcgtcgccgctcggtgggtaactagtcgcggtcgccgatcagcgacagcagcatctggaacatgttgacgaagtccaggtacaggttgagcgcgccgaagatggcgaccttctcctgaacgtcggtaccccaggcctcggcgtactgctccttgatctgctgcgtatcgtaggcggtgaagccggcgaagatcagcacgcccaccgccgcgatgatgaagtgcagcatcgagctggcgaggaagatgttcacgacgccggcgatcaggatgccgatcaggcccatgaacaggaaggtgcccatccccgacaggctgcgcttggtcgtgtagccgtagaggctgagcgcggcgaaggcggcggcggtgatgaagaacgtgcgcgccaggctggtgccggtgtagcggtagatcagcagggtgaagccgacgccgttcagcgccacgatcgcccaatagaccatcttggtcgtcgtcacgctcatggtcgcggcgcggaacgaagcgagcaggatcaggccgatcggcgccaggatggcgacccagccaaggatcgtcaggctggtgaccacgcggccgttgggcagcatccccgacttgatgaagatcgcgttcagcgccggcacgctgtagatcagcatcgcgacgatgccggacagcgccaggcccgatgccatatagttgtagacgcgcagcatatggctgcgcagaccggcgtcgaagaccgcctggtcgaccgtcgtcgaacccaccatgggccgagtgtcaaactgagccatttattgcctcccgataggcggacacacacctgccacccatattggcgaaagtcgcgacattatcaatacctgaccgcgatacccggatacgcatccacgacaaagatcacgtcgccgttgatatccccacaaaatttctggctattcattgcgcagcagggccagcggccgttgccgcgtggcgcccaccgcgcccacgaggccgaagcccagggtcagcgccatcgcccccagcacggtcagcgccaccacgtcgggcagcaggatccactccaggttcatcacgaagcggatcaccatccaggccgcgacggcgccgaacgccgccgccgccagcgcggtgacgaagcccagcgcggcgaattcgagcgagaagacgcccagcacacgtccgcgcgaggcgcccagcaccttcatcaccaccgcgtcgtgcacgcgccgccgctgcgtcgccagcatggcgccggccagcaccagcagcccggcgccgatgccgaccacgccgaccacgcgcgccgccaggccgatattggcgaggatcgagctggcgttctccagcgcctccttcacccgcacgatggtgacgttggcgaagtcgcgggtgaccacgtcgaacaccttgtcctcggcgcccggcgccgcgcgcacggtggcgaggaaggtctgcggcgcacgctccagggtgccgggcgcgaagacgaagacgaagttgatcgacagcgagctccagtcgatgcgcctgagattggcgatacgcgcctccacgtcgcggcccagcacgttgacggtgatggtgtcgccgacgcccaacccgtaagccgccgccagctcggcgtcgaaggagatcagcggcgggcctttgtagtccggcggccaccattcgccggcgacaatgcgcgaaccctccggcggtaaggccgcgtaggtcagcccgcgatcgccgtcgatcgaccagcgcgcctgcgaggggatgttggcttccgcgatcggcttgccgccgatccgggtgatgcgcccgcgcagcatcggcaccttgtcggcgccgccgacgccgtcgatcgccgtcaccgccttggtgaaggcatcgacctggctctgctggatgtcgacgaagaagaaggtcggcgcgttgaccgggatgcgtcgcgtgatctggctctgcagattgccctcgatcagcgccaccgcgaccagcacggtgagacccaggccgagcgagagcatcaccgtcggtgtcggcgcgccggggcgatggatattggccagcgccaagcgtagcacggcgaagcgcggcctgccggcccatcgcgccagcagcatcacaacgcgcgccagcagcgggaagacgatgaaggcgccgatcgaaccggcgacgaaccacagcgcgatgcgccggtcgcccgccgtcgccacggtcagcgccgccagcgccaggatcgcagcgccgatgatcgccatgtcgcgcgcccggggacgcgccgcgtcgggcgccaccgcgccgcgcatcaaggtcgcggccggcaccagccgcgccttcatcagcggccacagcgcgaagatgccggccaccagcatgccgaaggcggcggcgatgatcagcggctggccatagacgccgacccgtgcgcgcaccggcagcacgtcggcgaagaaggcgttggcgacgaagggcagggcgacgccgacgatcagccccagcacgacgccgatcgccgccagcacgccgatcagcagcaggtagctgcgcgtgaccagcgccgacggcgcgccgacgcatttgaggatggcgatggtccgcgtacggcccagcagatagctgtcgaccgcgttgccgacgccgacgccgccgaccagcagcgccgccagcccgatcagctcgaggaacacggtgagccgctcggtccaggtgcgcacgccgccgcccgcttcgctcagcccgcgcacgcgccagccggcctccgggaagcgcgcgatcaggtcctggcgataggcctgccagtcggcgcccggccgcagcgcgacgcgataatcgtgggtgcgcag

SEQ ID NO: 1353 - DNA, 4000 bp, Escherichia coli
  misc_feature (4)..(4): n is a, c, g, or t
  misc_feature (6)..(6): n is a, c, g, or t
  misc_feature (61)..(61): n is a, c, g, or t
  misc_feature (115)..(115): n is a, c, g, or t
  misc_feature (148)..(148): n is a, c, g, or t
  misc_feature (220)..(220): n is a, c, g, or t
  misc_feature (244)..(244): n is a, c, g, or t
  misc_feature (253)..(253): n is a, c, g, or t
  misc_feature (307)..(307): n is a, c, g, or t
  misc_feature (320)..(321): n is a, c, g, or t
  misc_feature (430)..(430): n is a, c, g, or t
  misc_feature (481)..(481): n is a, c, g, or t
  misc_feature (508)..(508): n is a, c, g, or t
  misc_feature (517)..(517): n is a, c, g, or t
  misc_feature (619)..(619): n is a, c, g, or t
  misc_feature (898)..(898): n is a, c, g, or t
  misc_feature (946)..(946): n is a, c, g, or t
  misc_feature (1015)..(1015): n is a, c, g, or t
  misc_feature (1033)..(1033): n is a, c, g, or t
  misc_feature (1042)..(1042): n is a, c, g, or t
  misc_feature (1045)..(1045): n is a, c, g, or t
  misc_feature (1069)..(1069): n is a, c, g, or t
  misc_feature (1072)..(1072): n is a, c, g, or t
  misc_feature (1087)..(1087): n is a, c, g, or t
  misc_feature (1121)..(1121): n is a, c, g, or t
  misc_feature (1141)..(1141): n is a, c, g, or t
  misc_feature (1226)..(1226): n is a, c, g, or t
  misc_feature (1234)..(1234): n is a, c, g, or t
  misc_feature (1243)..(1243): n is a, c, g, or t
  misc_feature (1255)..(1255): n is a, c, g, or t
  misc_feature (1309)..(1309): n is a, c, g, or t
  misc_feature (1363)..(1363): n is a, c, g, or t
  misc_feature (1366)..(1366): n is a, c, g, or t
  misc_feature (1486)..(1486): n is a, c, g, or t
  misc_feature (1543)..(1543): n is a, c, g, or t
  misc_feature (1642)..(1642): n is a, c, g, or t
  misc_feature (1672)..(1672): n is a, c, g, or t
  misc_feature (1750)..(1750): n is a, c, g, or t
  misc_feature (1772)..(1772): n is a, c, g, or t
  misc_feature (1923)..(1923): n is a, c, g, or t
  misc_feature (1950)..(1950): n is a, c, g, or t
  misc_feature (1952)..(1952): n is a, c, g, or t
  misc_feature (1954)..(1954): n is a, c, g, or t
  misc_feature (1964)..(1964): n is a, c, g, or t
  misc_feature (1972)..(1972): n is a, c, g, or t
  misc_feature (1981)..(1981): n is a, c, g, or t
  misc_feature (1991)..(1991): n is a, c, g, or t
  misc_feature (1994)..(1994): n is a, c, g, or t
  misc_feature (2001)..(2001): n is a, c, g, or t
  misc_feature (2011)..(2011): n is a, c, g, or t
  misc_feature (2031)..(2031): n is a, c, g, or t
  misc_feature (3348)..(3348): n is a, c, g, or t
tcgngnttctaaaaatgaaattttaaccgattatctgaatgtttctccttttggacgtaanaacaaggggaaaaatattgctggtattgaggaggctgctcaaggtatctttggngtatctgcagcggatttgacagttcctcaggcngcctatctggcaggtttgccacagagcccgattgtctactcaccttatacagctgacggtcaattaaaaaangcagaggatctttcttatggcttngcacgtcancaagatgtactctacaatctttatcgcggtggctatctagataagtcgcagtangaaagctataagnnttatgatatcactaaagatttcaaggctggtgagaagtctgatgccgtaagtcatgactatttgtactattctgtcatgtctgaggctcaggatgtcatgtatgattanctcgttaaacgtgacaaggtatcgagtcaagatttgaaaaatgataagacnaaggaaagctatcgtgagagggccctncaagagctncaaaccggtggctacagcgttaagacaactattgataatgcagtttataatgcgatgcaagatgctgcgagtcaatatggtggcctcctcgaccaaggtggnaatagtggagttgaagtcggaaatgtgctcatggataatgcgactggagcaattctaggatttgttggtggtcgtagttacgaaaataatcaaaataaccatgcctttgatacggcacgctccccaggctcatctattaagcctattattgcttatggaattgctattgatcaaggtttgatgggtagctcaagtatcctttctaactacccaactaattttacgggtggaacgcctattctccatgatggtgataagggtacagctatgatgaacctncaagaggcactcaatacctcatggaacattccagccttttggacttancaaatgcttcaacgtcatgatgttgatgttgagggttacatgaccaagatgggttataagattgctaantacaatatcgagagtttncctcttggnggnggaattgaaaccacggttgcccancangtaaatgcctatcanatgctttcaaatggtggcgtctatgagaagggcnatatgattgatagtattacngaccggactggcgaagttatctatcagcataaatctgaaggggttcaagtcttttcaagagctacggctagcatcatggataacntgctcaangaagtggtngttaagggagcnacaactcaatttcattctgaattgaaaaatgtcaatggtgcagcagcctcagcngactggatgggtaaaacaggaacgacagataactttgcggatgcttggttgatngtntcaacgcctggtattactcttggtggttgggctggttatgacaataatacaccaaccaattctaaaacgggttacacctataatgcgcaatatatggctcgtttgacttccgctatctanaatgccaatccaggtatttttaaaacgggagataagtttaatatcgattcaagtgcnattaaggcaagtgtgctcaaatcaacaggtcttaaaccagcaacagtgtctgtcaatggtcgtaatgtttctgtaagtggtgaaatggttgatacttantgggctaaaaatggacctggagatacgacntacaagtttgctattggtggaactgacagtgactatcaaaaagcctggtctagcattcttggagggcattaggaattnccaagaaaacttgcaaaaaagnaaaaaattaggtataatatagacaactatttgtcgtcttacttggttgaaatattgtccaatcaagagatacagcagttaaatcaacgttttttcggtcagatttagctgctatttttgtgcttatttttaggattttcaagtgttgtaangcatatttaaaggttctaaaaattcananantaagtttttngcttatcnttaatcagntaagtggatnttngtgtttnatcacttgtnaatgggacaagcaactgaanaaggcagaagacaaatatttaaagtgcacgacttgcaaagcaggtctcgaatgtagaaaaggagtagaagacttggcaggacatgacgttcaatacgggaaacatcgtacccgtcgtagtttttcaagaatcaaagaagttcttgatttaccaaacttgattgaaatccaaacggattcattcaaagaattcttggatactggtcttaaagaggtttttgaggatgtacttcctatctcaaacttcacagacactatggaattggaattcgttggttacgaattgaaagagcctaagtatacacttgaagaagctcgtatccacgatgcatcatactcagcacctatctttgtgactttccgtcttattaacaaagaaactggtgaaatcaaaactcaggaagtcttcttcggagatttccctattatgactgagatgggtactttcatcatcaatggtggtgaacgtattatcgtttctcagttggtgcgctcacctggtgtttactttaacgataaggttgataaaaacggtaaagtgggttatggatcaacagttatccctaaccgtggggcatggcttgagcttgaaacagattcaaaagacatcgcctacactcgtatcgaccgtacacgtaagattccattcacaacgcttgtgcgtgcgcttggattctcaggtgatgacgaaattgttgatatctttggtgatagcgagttggttcgtaacaccattgaaaaagatatccacaaaaacccagcagattcacgtactgatgaagcgcttaaagaaatttatgaacgtcttcgtccaggtgaaccaaaaactgccgacagctcacgtagcttgcttgtagctcgtttctttgatccacgtcgttatgacttggctgctgttggtcgttacaaagtcaacaaaaaacttaacatcaagacacgtcttttgggacaaacaattgctgaaaacttggtagatcctgaaacaggtgaaatccttgttgaagctggtactgaaatgacacgtgatgtgattgattcaatcgcagaatacttggatggtgatttgaacaaatttgtatacacaccaaacgattatgcggtggttacagaacctgttgttcttcaaaaattcaaggttgttgcaccaaatgatccagatcgtgtggttacaattgttggtaatgccaacccagatgacaaagttcgtgctttgacaacagcggatatcttggctgaaatgagctacttcctcaaccttgctgaaggtatcggtaaagtagacgatatcgaccaccttggtaaccgtcgtatccgtgcngttggtgaattgcttgctaaccaattccgtattggtttggctcgtatggaacgtaacgtacgtgagcgtatgtcagttcaagataacgaagtcttgacaccacaacaaatcatcaatattcgccctgtaactgcagctgttaaagaattcttcggttcttcacagttgtcacagttcatggaccaacacaacccattgtcagagttgtcacacaaacgtcgtttgtcagccttgggacctggtggtttgacacgtgaccgtgccggatatgaagttcgtgacgtgcactacacgcactacggtcgtatgtgtccaattgaaacacctgaaggacctaacatcggtttgatcaataacttgtcttcatacggacaccttaacaagtatggtttcattcaaacaccatatcgtaaggttgaccgtgcaactggtaaagtaaccaacgaagtagtttggttgactgccgatgaagaagatgagtacacagttgctcaggctaactctaaattgaacgaagatggaacatttgcagaagaaatcgttatgggtcgtcatcaaggtaataaccaagagtacccatcacaccttgtagatttcgtggatgtttctcctaaacaggtagttgccgttgcgacagcatgtattcctttct

SEQ ID NO: 1354 - DNA, 4000 bp, Escherichia coli
  misc_feature (1944)..(1944): n is a, c, g, or t
  misc_feature (1946)..(1946): n is a, c, g, or t
  misc_feature (1953)..(1954): n is a, c, g, or t
  misc_feature (1956)..(1957): n is a, c, g, or t
  misc_feature (1962)..(1962): n is a, c, g, or t
  misc_feature (1969)..(1969): n is a, c, g, or t
  misc_feature (1980)..(1980): n is a, c, g, or t
  misc_feature (1989)..(1989): n is a, c, g, or t
  misc_feature (2001)..(2002): n is a, c, g, or t
  misc_feature (2010)..(2011): n is a, c, g, or t
  misc_feature (2040)..(2041): n is a, c, g, or t
  misc_feature (2046)..(2047): n is a, c, g, or t
  misc_feature (2049)..(2050): n is a, c, g, or t
  misc_feature (2059)..(2059): n is a, c, g, or t
  misc_feature (2062)..(2062): n is a, c, g, or t
  misc_feature (2079)..(2080): n is a, c, g, or t
  misc_feature (3273)..(3273): n is a, c, g, or t
  misc_feature (3448)..(3448): n is a, c, g, or t
  misc_feature (3641)..(3641): n is a, c, g, or t
  misc_feature (3656)..(3656): n is a, c, g, or t
  misc_feature (3753)..(3754): n is a, c, g, or t
  misc_feature (3764)..(3765): n is a, c, g, or t
  misc_feature (3791)..(3791): n is a, c, g, or t
  misc_feature (3795)..(3795): n is a, c, g, or t
  misc_feature (3809)..(3810): n is a, c, g, or t
  misc_feature (3823)..(3823): n is a, c, g, or t
  misc_feature (3825)..(3825): n is a, c, g, or t
  misc_feature (3872)..(3872): n is a, c, g, or t
  misc_feature (3878)..(3878): n is a, c, g, or t
  misc_feature (3911)..(3911): n is a, c, g, or t
  misc_feature (3917)..(3917): n is a, c, g, or t
  misc_feature (3924)..(3924): n is a, c, g, or t
  misc_feature (3926)..(3929): n is a, c, g, or t
  misc_feature (3931)..(3931): n is a, c, g, or t
  misc_feature (3934)..(3934): n is a, c, g, or t
  misc_feature (3936)..(3937): n is a, c, g, or t
  misc_feature (3940)..(3941): n is a, c, g, or t
  misc_feature (3944)..(3945): n is a, c, g, or t
  misc_feature (3947)..(3948): n is a, c, g, or t
  misc_feature (3950)..(3951): n is a, c, g, or t
  misc_feature (3953)..(3953): n is a, c, g, or t
  misc_feature (3956)..(3956): n is a, c, g, or t
  misc_feature (3959)..(3959): n is a, c, g, or t
  misc_feature (3962)..(3962): n is a, c, g, or t
  misc_feature (3964)..(3969): n is a, c, g, or t
  misc_feature (3972)..(3972): n is a, c, g, or t
  misc_feature (3979)..(3979): n is a, c, g, or t
  misc_feature (3984)..(3984): n is a, c, g, or t
  misc_feature (3987)..(3987): n is a, c, g, or t
  misc_feature (3989)..(3989): n is a, c, g, or t
  misc_feature (3992)..(3994): n is a, c, g, or t
  misc_feature (3996)..(3996): n is a, c, g, or t
  misc_feature (3999)..(4000): n is a, c, g, or t
tgtttaaaatggccgtaataagaatttattgttgctaaagttttgtttaattctaaagtctcttttttgtttttgtttaaaaaatacaatttattcttcagccggctgaccactcttctacaaactaaaacataatcgggttttacaaaatatcccagaaaatttattccattatcaatgggctggattttggttttgtctaaattcagttttaagcttaacctttcttccaaaaaattattgattttatttctccaatgcctcaaattctctttgtctctatctaatagaatcaaatcatcaacataacgaacataatatctgcatttaagttccctttttacaaattggtccagctcgtttaaataaagattagcggaaaactgggaagaataattgccgatgggaagtccgcagtgaagaccggaataaaataatgactttcgcggcggaataaatttgaataaagaaacatctcccttggtaacatagtttttggtgggcttattgaaaataatggtttttgccagccataaaacttctttttcccaccaagagggtttgttatgctttgaaaccaactttttaaaaagggaatataaaatgtagtggttaattgccataaaaaagccggaaatatccaattgggcgtaaaatgctctttgggtataatttttagttaccttcctaataaaacttttcaaccttctaactgccaaatgagtccctttgcccttccggcaggaaaaggtatcaaagatgaattttctttcgccaataccttctatctcgttaatcaaaaggtgatgaactattctgtcccgaaaatcagcggcgaatatttctctgggcgagggatctttgatggcaaaacaaattgaacggcccgacctgtatttttttgcttccagctctttctgcagccggaaaagatttctttctaaattccactcaaactccaaagcattaatagtgttccttttgttttcccggcagtccaaataggccctataaagtttttcaaaagtaaatatagttttgtttatcataattttaggaagcccagcgaagccaacccccgatcatttctccaatttctttaacataattggtctgaaggtgggcaaaccgccttttggatattaaatttatttcttgaaccattctcaatctgatttttaactggtcaaaagcaacgcttaattctaaaattttgggatgtttttctttatcaggcagaatgtttacttctaaaactaaatcaaggcacttccaagccaaatcaataatgttttgccctaaagcatacttatattgtttgggaaaatttcttaccatctcataaagaaatttcaaaaactggtaaagttttagatataagggcagtttttggtttttaatcatttttattattagtgaatttaatgctccgcgaggaacatattttacctttaaggctaaatatcgttaatattatccctcgggctgaaattaactccctcacgcaccgcacggaaaagccgtttgccttattgttgtaattgcggttgacgctggtgttattgtaattcaggttgcggttccaggcattggtatctctctcggtagacgaccacaggttggcgttgttgctgagattgttgtaactgccatcagtgttacggtagccgccgggaagaacggaattgcttttgctcttagtcgtactccgggaatctaatgaaaattttcttttcaaagagatcccctaaccaccaatggtctctttattaagaccggcaaaagcggaatcaatttttagccgctctctcctgagggttagctcgacttagcgagcaaaccattcagaaatctggcggagcatatttaatttttaattttttccaaattccaaattccaaaatgccaaattctaatccctcacgcaccgcacggaaaagccgnangccttanngnngtaantgcggtngacgctggtgntattgtaanccaggcggcggnnccaggcannggtatctctctcggtagacgaccacaggnnggcgnngnngctgagatngtngtaactgccatcagtgnnacggtagccgccgggaagaacggctaatccagaagaggcaaagttagagtgatttctaaggagtccgtcagaccaaaggtcatattctcctgccatggctgagccttcgccattggttcctttgtagccggtagctaattcgtcatacaggaattgagttgagcaatccgtgccgccgagatcagaacatatctgacgttcaagggcaacccactcataatggctgggtatatgccagccattagggcatattccctgcacaggggttaaacaagcgggctgggactcgcctgtgccgttgcagctaactgaaccgcacatcatatcggtccaggtgtacaagccgccgtaagtggtgcagttggcagcattgtcggcatagcaatatctggttatggaacaactttgggccgtgtttccattggttacagcaagattctttgccaaccagcattggtcgcctattggaaccataccataagtaacgctgtcgtaagtaatgctgccttcgcagggctgcacttttacggtaacattaactcttaatttattatttgtgtctttagcgatagttggataataataccgattggaaacagaactattataaacagtggctgccgtaccccaggaaaatccggtgcctggatacgaggtggtggtagaggcctgccgggcttcaacatcataaccgtttgtgtagacaataaaagcgttcgcggaatcggcttcaatggaaaaatcattggtggcaacagaaatagtggcactggagttatagtaccagtttgtctcatcagttgaataccagaatacaatcctggttccatcgttaaacgcttgccagtagcgagcgccgtcataccaggttttgcgctggaaagaataggcggtagatgaggcagaagtggagtaaggaaaatatttggcaacaataacatcgcgataaattggcaaactggaggttgaactaaaaccggtcagagaagcagtatggctatgagtttggtgggctgctccggtgccggcttttcctgagccaacggtgccagcagaatctgtggtggtcagcccggtgatatcattatggctgtgggtgctggtgcctgcctgaccgccataagtagatgaagccattaaaaacctttgataaaatgggtcgctttccccatcggaaataacatcccacgggnaagagggcgtatcatcaaaaagaccaatcataccatcggggatagtagtggttgcatcaagttgatataaaaggacagcggtatagggaggtagattgtcaacggcattagtagttgttgctgaaagggtgtgggtgtgggtaatagccgaaactacgccagttgtgccttcttntatagccgaggccgtggtctcgtcgatggtcgaagtaacagtatggctgtgggtggtcgaaccgccgctactcgtagaattactaccccgaatgtaataattgtcttggatgctgtagcgagtccaactgccactaattggcacatcatcaaaaagagcaataatacctgttggaagctcggaaggaacaccnctgttgtattttatnatttttaagccacgatatagtggtacattgctggtggcatttaccgtggcgctgcctgaatgattatgggtggttggagcaacggtcgcagccgctnntccgacgccnnctttatagccaccatcagttgtgttntcanccacattaacagtnnctgtatgagtatngntgtcagaaccactggtggcagagccataactggctgctcctcgtggnaaaacntgccaaaaatcgccactgccacaggaaagacangtccantaatcancnnnngnagnannggnngcnncnncnnanaanaanatnannnnnnctngatcagncgcancancngcnnncngcnn

SEQ ID NO: 1355 - DNA, 4000 bp, Escherichia coli
  misc_feature (1)..(6): n is a, c, g, or t
  misc_feature (8)..(38): n is a, c, g, or t
  misc_feature (40)..(40): n is a, c, g, or t
  misc_feature (42)..(42): n is a, c, g, or t
  misc_feature (44)..(50): n is a, c, g, or t
  misc_feature (52)..(70): n is a, c, g, or t
  misc_feature (72)..(73): n is a, c, g, or t
  misc_feature (75)..(77): n is a, c, g, or t
  misc_feature (79)..(91): n is a, c, g, or t
  misc_feature (93)..(94): n is a, c, g, or t
  misc_feature (97)..(102): n is a, c, g, or t
  misc_feature (104)..(104): n is a, c, g, or t
  misc_feature (106)..(112): n is a, c, g, or t
  misc_feature (114)..(121): n is a, c, g, or t
  misc_feature (123)..(128): n is a, c, g, or t
  misc_feature (130)..(137): n is a, c, g, or t
  misc_feature (140)..(149): n is a, c, g, or t
  misc_feature (152)..(163): n is a, c, g, or t
  misc_feature (165)..(183): n is a, c, g, or t
  misc_feature (185)..(191): n is a, c, g, or t
  misc_feature (193)..(194): n is a, c, g, or t
  misc_feature (196)..(203): n is a, c, g, or t
  misc_feature (206)..(206): n is a, c, g, or t
  misc_feature (209)..(211): n is a, c, g, or t
  misc_feature (216)..(220): n is a, c, g, or t
  misc_feature (226)..(235): n is a, c, g, or t
  misc_feature (238)..(249): n is a, c, g, or t
  misc_feature (252)..(253): n is a, c, g, or t
  misc_feature (258)..(268): n is a, c, g, or t
  misc_feature (272)..(281): n is a, c, g, or t
  misc_feature (283)..(293): n is a, c, g, or t
  misc_feature (296)..(306): n is a, c, g, or t
  misc_feature (308)..(320): n is a, c, g, or t
  misc_feature (323)..(326): n is a, c, g, or t
  misc_feature (329)..(334): n is a, c, g, or t
  misc_feature (337)..(340): n is a, c, g, or t
  misc_feature (342)..(346): n is a, c, g, or t
  misc_feature (348)..(352): n is a, c, g, or t
  misc_feature (355)..(355): n is a, c, g, or t
  misc_feature (358)..(358): n is a, c, g, or t
  misc_feature (360)..(361): n is a, c, g, or t
  misc_feature (363)..(381): n is a, c, g, or t
  misc_feature (385)..(385): n is a, c, g, or t
  misc_feature (389)..(404): n is a, c, g, or t
  misc_feature (406)..(407): n is a, c, g, or t
  misc_feature (411)..(411): n is a, c, g, or t
  misc_feature (413)..(418): n is a, c, g, or t
  misc_feature (421)..(440): n is a, c, g, or t
  misc_feature (442)..(449): n is a, c, g, or t
  misc_feature (451)..(455): n is a, c, g, or t
  misc_feature (457)..(458): n is a, c, g, or t
  misc_feature (460)..(461): n is a, c, g, or t
  misc_feature (463)..(467): n is a, c, g, or t
  misc_feature (469)..(470): n is a, c, g, or t
  misc_feature (472)..(473): n is a, c, g, or t
  misc_feature (477)..(478): n is a, c, g, or t
  misc_feature (481)..(485): n is a, c, g, or t
  misc_feature (487)..(490): n is a, c, g, or t
  misc_feature (493)..(495): n is a, c, g, or t
  misc_feature (498)..(499): n is a, c, g, or t
  misc_feature (502)..(509): n is a, c, g, or t
  misc_feature (511)..(513): n is a, c, g, or t
  misc_feature (515)..(527): n is a, c, g, or t
  misc_feature (529)..(536): n is a, c, g, or t
  misc_feature (538)..(540): n is a, c, g, or t
  misc_feature (544)..(545): n is a, c, g, or t
  misc_feature (547)..(548): n is a, c, g, or t
  misc_feature (550)..(551): n is a, c, g, or t
  misc_feature (553)..(554): n is a, c, g, or t
  misc_feature (556)..(572): n is a, c, g, or t
  misc_feature (574)..(593): n is a, c, g, or t
  misc_feature (595)..(595): n is a, c, g, or t
  misc_feature (599)..(601): n is a, c, g, or t
  misc_feature (603)..(615): n is a, c, g, or t
  misc_feature (618)..(619): n is a, c, g, or t
  misc_feature (621)..(630): n is a, c, g, or t
  misc_feature (632)..(643): n is a, c, g, or t
  misc_feature (648)..(656): n is a, c, g, or t
  misc_feature (659)..(668): n is a, c, g, or t
  misc_feature (670)..(671): n is a, c, g, or t
  misc_feature (674)..(696): n is a, c, g, or t
  misc_feature (699)..(727): n is a, c, g, or t
  misc_feature (730)..(730): n is a, c, g, or t
  misc_feature (733)..(754): n is a, c, g, or t
  misc_feature (757)..(763): n is a, c, g, or t
  misc_feature (765)..(766): n is a, c, g, or t
  misc_feature (768)..(787): n is a, c, g, or t
  misc_feature (790)..(795): n is a, c, g, or t
  misc_feature (799)..(803): n is a, c, g, or t
  misc_feature (806)..(837): n is a, c, g, or t
  misc_feature (841)..(842): n is a, c, g, or t
  misc_feature (846)..(848): n is a, c, g, or t
  misc_feature (850)..(862): n is a, c, g, or t
  misc_feature (865)..(869): n is a, c, g, or t
  misc_feature (873)..(875): n is a, c, g, or t
  misc_feature (877)..(884): n is a, c, g, or t
  misc_feature (887)..(889): n is a, c, g, or t
  misc_feature (893)..(896): n is a, c, g, or t
  misc_feature (898)..(905): n is a, c, g, or t
  misc_feature (907)..(917): n is a, c, g, or t
  misc_feature (919)..(920): n is a, c, g, or t
  misc_feature (922)..(944): n is a, c, g, or t
  misc_feature (946)..(946): n is a, c, g, or t
  misc_feature (949)..(955): n is a, c, g, or t
  misc_feature (958)..(966): n is a, c, g, or t
  misc_feature (969)..(969): n is a, c, g, or t
  misc_feature (973)..(977): n is a, c, g, or t
  misc_feature (980)..(982): n is a, c, g, or t
  misc_feature (987)..(987): n is a, c, g, or t
  misc_feature (990)..(996): n is a, c, g, or t
  misc_feature (998)..(1005): n is a, c, g, or t
  misc_feature (1009)..(1010): n is a, c, g, or t
  misc_feature (1012)..(1013): n is a, c, g, or t
  misc_feature (1015)..(1016): n is a, c, g, or t
  misc_feature (1018)..(1041): n is a, c, g, or t
  misc_feature (1044)..(1046): n is a, c, g, or t
  misc_feature (1050)..(1052): n is a, c, g, or t
  misc_feature (1054)..(1072): n is a, c, g, or t
  misc_feature (1075)..(1078): n is a, c, g, or t
  misc_feature (1080)..(1089): n is a, c, g, or t
  misc_feature (1092)..(1108): n is a, c, g, or t
  misc_feature (1110)..(1116): n is a, c, g, or t
  misc_feature (1119)..(1125): n is a, c, g, or t
  misc_feature (1127)..(1136): n is a, c, g, or t
  misc_feature (1138)..(1139): n is a, c, g, or t
  misc_feature (1142)..(1175): n is a, c, g, or t
  misc_feature (1180)..(1184): n is a, c, g, or t
  misc_feature (1187)..(1197): n is a, c, g, or t
  misc_feature (1202)..(1209): n is a, c, g, or t
  misc_feature (1211)..(1213): n is a, c, g, or t
  misc_feature (1215)..(1218): n is a, c, g, or t
  misc_feature (1220)..(1241): n is a, c, g, or t
  misc_feature (1244)..(1253): n is a, c, g, or t
  misc_feature (1255)..(1255): n is a, c, g, or t
  misc_feature (1258)..(1264): n is a, c, g, or t
  misc_feature (1266)..(1267): n is a, c, g, or t
  misc_feature (1269)..(1273): n is a, c, g, or t
  misc_feature (1276)..(1311): n is a, c, g, or t
  misc_feature (1313)..(1313): n is a, c, g, or t
  misc_feature (1316)..(1330): n is a, c, g, or t
  misc_feature (1332)..(1341): n is a, c, g, or t
  misc_feature (1345)..(1356): n is a, c, g, or t
  misc_feature (1359)..(1359): n is a, c, g, or t
  misc_feature (1362)..(1367): n is a, c, g, or t
  misc_feature (1371)..(1382): n is a, c, g, or t
  misc_feature (1384)..(1384): n is a, c, g, or t
  misc_feature (1388)..(1392): n is a, c, g, or t
  misc_feature (1395)..(1404): n is a, c, g, or t
  misc_feature (1407)..(1409): n is a, c, g, or t
  misc_feature (1413)..(1417): n is a, c, g, or t
  misc_feature (1419)..(1437): n is a, c, g, or t
  misc_feature (1441)..(1449): n is a, c, g, or t
  misc_feature (1451)..(1465): n is a, c, g, or t
  misc_feature (1467)..(1486): n is a, c, g, or t
  misc_feature (1489)..(1507): n is a, c, g, or t
  misc_feature (1509)..(1510): n is a, c, g, or t
  misc_feature (1512)..(1515): n is a, c, g, or t
  misc_feature (1517)..(1519): n is a, c, g, or t
  misc_feature (1523)..(1527): n is a, c, g, or t
  misc_feature (1529)..(1531): n is a, c, g, or t
  misc_feature (1533)..(1537): n is a, c, g, or t
  misc_feature (1540)..(1543): n is a, c, g, or t
  misc_feature (1545)..(1546): n is a, c, g, or t
  misc_feature (1548)..(1551): n is a, c, g, or t
  misc_feature (1555)..(1558): n is a, c, g, or t
  misc_feature (1562)..(1572): n is a, c, g, or t
  misc_feature (1574)..(1575): n is a, c, g, or t
  misc_feature (1577)..(1577): n is a, c, g, or t
  misc_feature (1579)..(1580): n is a, c, g, or t
  misc_feature (1582)..(1583): n is a, c, g, or t
  misc_feature (1585)..(1587): n is a, c, g, or t
  misc_feature (1589)..(1590): n is a, c, g, or t
  misc_feature (1592)..(1592): n is a, c, g, or t
  misc_feature (1595)..(1597): n is a, c, g, or t
  misc_feature (1600)..(1604): n is a, c, g, or t
  misc_feature (1606)..(1606): n is a, c, g, or t
  misc_feature (1608)..(1613): n is a, c, g, or t
  misc_feature (1615)..(1637): n is a, c, g, or t
  misc_feature (1639)..(1640): n is a, c, g, or t
  misc_feature (1642)..(1652): n is a, c, g, or t
  misc_feature (1655)..(1669): n is a, c, g, or t
  misc_feature (1671)..(1671): n is a, c, g, or t
  misc_feature (1673)..(1689): n is a, c, g, or t
  misc_feature (1694)..(1697): n is a, c, g, or t
  misc_feature (1704)..(1725): n is a, c, g, or t
  misc_feature (1732)..(1733): n is a, c, g, or t
  misc_feature (1735)..(1736): n is a, c, g, or t
  misc_feature (1738)..(1740): n is a, c, g, or t
  misc_feature (1746)..(1747): n is a, c, g, or t
  misc_feature (3869)..(3869): n is a, c, g, or t
nnnnnnannnnnnnnnnnnnnnnnnnnnnnnnnnnnnngngnannnnnnntnnnnnnnnnnnnnnnnnnnannannngnnnnnnnnnnnnntnnaannnnnngngnnnnnnngnnnnnnnngnnnnnntnnnnnnnnttnnnnnnnnnnggnnnnnnnnnnnntnnnnnnnnnnnnnnnnnnntnnnnnnnannannnnnnnnccnaannnaaaannnnnaaaaannnnnnnnnnaannnnnnnnnnnnttnnaaaannnnnnnnnnnaaannnnnnnnnntnnnnnnnnnnnttnnnnnnnnnnncnnnnnnnnnnnnnaannnnaannnnnnttnnnntnnnnnannnnnccnaanannannnnnnnnnnnnnnnnnnntttntttnnnnnnnnnnnnnnnngnnaaancnnnnnnttnnnnnnnnnnnnnnnnnnnngnnnnnnnngnnnnngnngnngnnnnntnntnngggnnttnnnnngnnnnaannnttnnccnnnnnnnncnnngnnnnnnnnnnnnntnnnnnnnntnnngggnngnngnngnngnnnnnnnnnnnnnnnnngnnnnnnnnnnnnnnnnnnnntngggnnnannnnnnnnnnnnnttnnannnnnnnnnngnnnnnnnnnnnnggggnnnnnnnnnttnnnnnnnnnngnnccnnnnnnnnnnnnnnnnnnnnnnnttnnnnnnnnnnnnnnnnnnnnnnnnnnnnnccnaannnnnnnnnnnnnnnnnnnnnnaannnnnnnannannnnnnnnnnnnnnnnnnnnttnnnnnncccnnnnnccnnnnnnnnnnnnnnnnnnnnnnnnnnnnnnnngggnntttnnngnnnnnnnnnnnnnttnnnnntttnnnannnnnnnnaannntttnnnngnnnnnnnngnnnnnnnnnnngnngnnnnnnnnnnnnnnnnnnnnnnngnggnnnnnnnaannnnnnnnnttngggnnnnnttnnnttttnggnnnnnnncnnnnnnnntttnngnngnngnnnnnnnnnnnnnnnnnnnnnnnnttnnntttnnngnnnnnnnnnnnnnnnnnnnttnnnnannnnnnnnnnttnnnnnnnnnnnnnnnnntnnnnnnnttnnnnnnntnnnnnnnnnngnnttnnnnnnnnnnnnnnnnnnnnnnnnnnnnnnnnnnttttnnnnnggnnnnnnnnnnnaaaannnnnnnnannngnnnnannnnnnnnnnnnnnnnnnnnnnttnnnnnnnnnncnccnnnnnnntnntnnnnnaannnnnnnnnnnnnnnnnnnnnnnnnnnnnnnnnnnnanaannnnnnnnnnnnnnntnnnnnnnnnnaaannnnnnnnnnnnggnaannnnnnaaannnnnnnnnnnngngggnnnnnggnnnnnnnnnnggnnntttnnnnncnnnnnnnnnnnnnnnnnnngggnnnnnnnnngnnnnnnnnnnnnnnngnnnnnnnnnnnnnnnnnnnnggnnnnnnnnnnnnnnnnnnnanngnnnntnnngggnnnnngnnnannnnnggnnnntnntnnnnaaannnnaaannnnnnnnnnncnntngnntnngnnntnntnaannnttnnnnngngnnnnnnannnnnnnnnnnnnnnnnnnnnnntnnannnnnnnnnnnaannnnnnnnnnnnnnnanannnnnnnnnnnnnnnnnttttnnnnaaaaaannnnnnnnnnnnnnnnnnnnnnttaaaanngnngnnntttttnncccccccctctcctattgagagctagccaaagtaattttccctagcaaactacagccccatctatggaaaaatcagagttaaacgtgtaggcgatctaatacgtgttgttatccttacagccacctttactcacgcctcaaattcaagctgaaccgatccgtagctcttactgagtggcgccaattattgagcgcatagattcaggctgtgccagcaatccgatgcgagttatcatttgtctgacagcaccatctcagtaatatcgtagtttagcatttggagaccgaaacctatgggcggttagcgtaagttatggtaaaaaatatcagaagttcacaattttaaaattttagctcatagcctaagccgcccgttgtactaatatttgtaccgtttttttcaaactgataatctgcattgaatttagtgcgaccatcaggggacgaggtactcaatccaatacctaagccagcgccacaattcatttgggttgagttgccgctggcctgctcgcaattgtagcttggagtaattgttcccaaagacacattgcgtgatctagtgttccaaataaatgggatacggaattctggcgcaaatcgcagcttcaaaagtgaaattttgcctgcgtttaaacttagcgtgtcgtcagtggttccaaaagctcttcctttaaatttcacctgaccgatgtcggaagccccgtatgaaaaggagaaagtaggccaaatttcatagtttcccattctatagaccccagtaatgttactaccaatcgtttgacttaaaacgtcgtaagagctgtcgaggtctaaaaccccattgttaatttttaggctgttacgcctcattcctaccgaggcaagaagatccatgtatatgtctcttgtaagcgtcacgacataatatcctcccgcattaatagcatatccattttggttgccactgaatgtgccgtttagattagacttacccaattccaaacctatgaaataacccagcaaagagttacctgtgggccttttttcaatggcaagattgcctatcacgtaaccgctcacgttcctatcatcatcggcttggacattaaaatcgccaaaactaagcaatcgccatctcttactgaacatgcacttgttttgggaaaaatcaccgctgatgcgaatttcaccatcgttgtccgttattgaaagatccgcactgccgttaacatcaagggacttttcctgactggcttcacaatcttgtgaattaaggatcaaacgctgcctagcgcttcgcatgaggcgcgaattactggcgattgtactgcgcagggcgcggctagcttcgccggtaattacgttgcgaattgctgtttcatttttggcaaattcaaatgccacattacttgcatcaatagaaaagctgttggaggcgatatttccaaaacctattgtgtctgtgacggaattcgctgcaattataataattatagtttgaccaatgactggagttaccctgaatttgtaaacaggggcttctgaagcgtctaaggcagatgctgtgccgttggtaactgtgatgtcatcgagggtaaatccggctacctgctcactgaacgttgcaaccatgtcgaacggttcagtcacagtacttgttggaccagttaaggtgacggtcggagcggtgccatcgtaaaggatatttaattggttggaggctgtattgctattgccaccagcatcagttgcagtagcggctggcacgtttaccgtgacgaccccgtctgcagttggcgtaacgtcaaaggtgtagacgctctgtgacagggttatgagattagaaggcgtgccgttagttatcacggcgtcgtctagcccaaagcccgagacaggctcagaaaatgtagctatcacgagaaacggacctgaaaccagcgaccctgtggtactaagtgtcactgtcggtatgaccgagtctgccactgtaaatgtagaattcgcggcgctggctgcatatcctaagatgtcttcgaccgtagcgccaatggcgacatagacaacttggtctgaggtaaagtcagacgtggggtcgaccgtgattacttgccctgaaatagtggcgtcaaatgctatgtcnttgccgctggcatctgtgtctttgagtgtgattaaagcatccacattgtcatccgtaagtgcagtatcgtcgagtagccgtaccgcctcgttgaaggtaatcgtaatgttgctcgtacttgcaacatccgt

SEQ ID NO: 1356 - DNA, 4000 bp, Escherichia coli
  misc_feature (1985)..(1985): n is a, c, g, or t
  misc_feature (2944)..(2945): n is a, c, g, or t
  misc_feature (2950)..(2950): n is a, c, g, or t
  misc_feature (3522)..(3522): n is a, c, g, or t
  misc_feature (3556)..(3556): n is a, c, g, or t
  misc_feature (3598)..(3598): n is a, c, g, or t
  misc_feature (3624)..(3624): n is a, c, g, or t
  misc_feature (3634)..(3634): n is a, c, g, or t
  misc_feature (3638)..(3638): n is a, c, g, or t
  misc_feature (3642)..(3642): n is a, c, g, or t
  misc_feature (3692)..(3692): n is a, c, g, or t
  misc_feature (3767)..(3767): n is a, c, g, or t
  misc_feature (3788)..(3788): n is a, c, g, or t
  misc_feature (3863)..(3863): n is a, c, g, or t
  misc_feature (3866)..(3866): n is a, c, g, or t
  misc_feature (3923)..(3923): n is a, c, g, or t
tgatgaacctgcacgaaacttacatccaacacagcaagcaggaatttctgatttgttaaaaaatcttgctggatcaaaccaagtcttatacgctacccattcacctttcatgatttttgactatactcctggtaatcttctcgttgtagaacttgataggaaaaaacatctaagtaaaattttttatgagtactggaaagcggacgatgctacacttacgccaattctttatggattggcaaaaggattagtggattcaattactgatagagaagtgggtaataactcacgtcctctcattatagtggaaacaatgtcagatacaatgtatcttaatgcgtttgacaaatttcttcaggatccaaacatatcaatgaatcctctaaatgtagtgccggcatacgctaaaaattcagtattaccactatcaatttttcatcacaatcatggatacaacacatttgttttacttgacaacgattacgaatcaaagcaaattgctgagcaattaaaaaataataaattttcagaaacacaaatcatatttttcgagagtggaggaaaccttcttcaatcaatagaagattatatggtcactgaagattatttatacgccgtaaaccaaacttacgagataaaattgcgcagagaaggatttaccaaccttaccaaagaagaagtactaattcatggaaaaaatggaatcgttgaaaatctaaaggcagtctggaatgaacatggtgatgatgactggggtgaatttgaaagagaggaagtttgcagatacatatctggtaaaattgccttaggcgatgccagtttcttgactgaaaaaacaagagaccgattgcgtgcattatatcgattaattgctgagcgtattcgtcaataccagcatacaatacctacggaacaattttcaaatgaatgatgattgaaaactgtaaaaattcatttaaaatacgaaataaaaacaaaactaaattaaactttaattgctgacaaaaaactgatgaatagcatgaggagatattcaacaattggagtttttacctcagtgctgcttgtagtttctattttcacattattatcgatctcagaagtaaatgcggaggaagtaatttctgtaaacgcaaaaagttatgaaaatacaataattatcgaatttgaaaacgagagtacgtctaaaataaagacaattagaatatggctaggcggagataaatcattcaagtcatttaagacagaaccgggatggggcggtggaaaatattctgatagtaagctgctaatatttaccgcaacaaatacactcaatccaggtgaatcagtaaagtttggtcttacaacaaatgaaaaagtaaatgcaataaattggaaagtgcttgatcaaaatgagaacgagatagatacaagaaaaacgcctattcaggaaatttcctcaacaatttctagttttgttgaacaagaaagcgtgaaaattgaggaagttaaagagactggaagcgctctttatggtacaaagaagttcattccagaaaaatttcgagttggttcagatataagactggtgggaaatggatttggtccgggaaaaaacttacagttgtaccttgataatgctatattaaaatcagttaaaacagatgaacaaggaaactttctaactacaatctcgatatctgagacgtacaaggttgggacaagtgaatttataataaaagatgaatctggaaattttcaaagtactaatattacgattgaagaattaaaaaacagatttttaaagactgaaaaatttgaagttaataatattcctgctaaagttagacttggtgaattgctaactatttcaggtactgcatacccgcaaagtgcgattattcttgcgttccagagtaatgatagagttttagaaaaagttcgtgtagtaacagctaatgcaaatggagaatggatttttgaggaagtgatagaccagaacnacattgttggagaaaagtatgtgatttttaaaaataatcaagataaaacaacaaaaaacctgacgataaaatcaggtaatttaatagaaatttctgcttctgcagtaagatataatctgggagaaactgttagtataactggcacttctgaaccaaacaaaagtactacaatatgggtcaaggatcaaactaaaaaaataacgctctttgatattataacaagtgatggaagtggaaatttgaactatgaatttgttacagatgacacattttctactggaacttatactgtaatagtaaaacaggaagaggggtcagacgctgctgtgtttggtattggtcaatatccgtcaacaaggattgttgtgttggtggagaaaacaaattttgctcttaattctaaagcaatcttaagcattgttggtccaccatcatctaaactgtcgattgcaattttggattccaatgataatctcaaaataagtgattctattacaacaagttccattggtaaaagtaagtatgttttagatttagctgatctttctgcaggggtatatagagctgctgtttctgcaacaaatattcaagattcagttaaattttcaattggtctagaacctggctctggtgcaatttcgttagctacaactagtgaaaattattctcctggtgaatcaattttagttcttgggaatacagggaataatgctagaataactataactcttcttgatccttctggaaacatatccagccaaactgaaattttttcagatgccaatggtaatttttccacagaggatataggaattccatctaatggagtacttggtaattgggaaatcactgcacatagtcgtctggattccaagactattgatattaacgtaagtgttccaacagctaagggtataacgatacaaatagaggaagcagaattcagcattggagacacnntaatnattgtgggaatggcagtttcagacgctagtcgtcttgaaattcaaataattaatcaaagtgatcaagtgattgtatcgttagcaacttctataacatctgatgatacgtttttccttccttggatagttcctagtggttttgacactggaatatataccataagagtaacagataatgtaaacaccgatagttttgaaatattcatacaataattttagtagctcaaaacagtttttatttctcatttattgctacaagtaacatgaatttgaagagaaggatagctgaatattcaaactttccaaaaaaaggtatcttgtttagggattttagtcccattcttggtgatccctctgcaatgtcatttgttgtagaagaattttcaaagcagtttcatccaagagatgttgatgtgtttgcaggaattgaatctagaggatttattgttgcatctattcttgcacaaaaatatagcaagggcatggtaatgctaaggaaagaaggtaaactgccaggaaaaactgtaaaaacttcgtacacaattgaatacggtaaagcagtactagagatncaaaaaaatgcgttaaaggaaggtgagagggtgntaatttgtgacgatttgttagctacaggcggaacagcaaagncggcagcaaaattagtggaaagaatnggcgcaaaanttgntggntttgcatttattattgaattgactgacttgaatggaatcaaagaaataancaactacaaaacagtctcattggtgcaatactgatggttagtgatacagctgagattggaattttcggtggaacnggaatttatgattctgaattnttgcaggatagcaaagaaatcacaattgaaacaccttatggtaaaacatctgatacaattacaataggagaattnaangggaaaaaaattgcattcatgccaagacatggaaaaaaacattctattcctccacanatgataaattattgtgcaaatgtttgggccttcaaggaattaggaattacaagaattgtttccccctcggctgttgg

SEQ ID NO: 1357 - DNA, 4000 bp, Escherichia coli
  misc_feature (1668)..(1668): n is a, c, g, or t
  misc_feature (1947)..(1947): n is a, c, g, or t
  misc_feature (3355)..(3355): n is a, c, g, or t
  misc_feature (3562)..(3562): n is a, c, g, or t
attcttctcgatcagcaattttagctctatctgcacacccaaacttaccgcttccataaactgctgaagttctcattaaataacctacagaagttaataaatctagatctggttgttgaccttttgataatgaatcaacagcatttttaaatactcttaagcttttattggcccttgccaaagcaagttcgcttggtctgtaacgaccgccttcttgcttaggtgtattttgtgccaaataatctatatcctcttgtgttggcacaccatcaaaaagattaaaggttgcatcccaaacttctgcgataactctatccgttctcatgtcagctggtatttcttgtgtaaaaccaaccaatgagtaggttctatttggagtagtaaccgaataaacgcttaagccgtaaccatccttatcaacttcacggcgcgttctctcaaatttccaattctcccgtgacattcgcctaatcaaagttcgcataaagctcaaccgggtaggaaaagatgagcccattctatcgagacgcataaccgtttcaggtgatctcataaaatcagattcattctctattaatacagtttcgctagacataataaatattataaagattcaaaagatgcgtcgaaaaaatttaaccagtttttacccatgaccaattcaacgtcattttcagaaaaacctatggactttaaaccatttgaaatgtttacaaaatcacgattatctcgaaaccactcgggctgatctggaaatcctgcaaaactggccgaaccttcaccgaagtcacgatcattagtccatgtgccatttcgcatccactctacaacgctatcaggttgattttgacataggtcagttccaataccgatattattcatccccataatttctgcagtatcggcaatcatattacaaaaactttctaatgtgcagtctgaaccatccttaaggtggtgtgggtagacagaaaaaccaagcatactattactttctccaagcgcctttagaacttcgtttgacttatttctcagcgcaggatgccagaacgttggatttgcatgcgtgattgcaataggacgctctgatatttctatagcttctagggtagatctctctgaggaatgactcatatcgaccactagtccaaccctattcatttctttaataacctgtttacccattctcgtaattcctgggtcgttttcttcataacagccagttcctaaaagactttgattgttataggttaactgcataaaccttgcacctagttgatgacatacttcaacgaggccaatattatcttcgataggggagcagttttgatagccaaaaaagattgctgttcttccttctttttgagcctttctgacatcagctgcagttcggccaagaaaaattaaatttgagtagtcctcaaaacgacggttccagtcaataacattttggaccatctcctgaaagtcttcgtgataacaaattgtaacgtgaacagcactcagaccgccttggttaatttgcttaaatatctcctcactccaattattgtattgaagtgcatcaataaatagtgaagggtgcgccattatggatttccgctagaaatataagaagtcttaacttgagtataaagctctttggcataagttccttgctctctaggnccaaagcttgaattttttctacctccaaatgggacatgatagtccgtacctgctgtcggtaagttcaccataacgcagccactttctgcattccttctaaagtgacttgctcttgagagagactgagtaataattcctgaaacaagtccaaattctgtgtcatttgcaaccgataatgcctcttcataatctgcaactttgatgacgcaagccatcggtgcaaaaagctcctcacgattaactctcatagagttgtttcccccaattaataatgctggntgcatataaaaaccaggattatcaagctcaagcttgttacctccacagaccacttcacagccctcttcttttgctaaagccatatatttgaggttggaatcaagttgctgttgacttgcggctggaccaatttgagtgccttcttgaagcgcgtcaccgaccttaagagctgaagtggattggctcatgcgttctacaaactcatcatgaatggaggcatgaacaactagtctagaagacgcggtacatttttgaccagtactaccaaaagcacctccagtagcagccgcaacagcgacatccatatcagcatcatccattaccacaagtgggtttttagagcctaactctaactgaaactttgttaaatttttagcggctgcgcctgcaatctgacgacccacatcataagatccagtaaaactgattgcatgcacttttggactttcagccaacgactgtccaattgatgaacctgagcccattactaaattaaacaaaccctttggaatatcttgcttggaaatgatttcagttaatgctactgcacttgctggtgttaagttcgcaggcttccaaataacagcattaccaaatgctagtgctggagcaattttccagctcgccgttgctgttggaaagttccatggcgagatgattgcgactgttcccattggctctctgcgaacgtcaatttcaatattaggtctgactgaatccgcagtatcaccaccctgccttaggacctctgctgcatagtaagtaaaaaattgacctgccctatatacttctcctttgccttcagcaactggcttaccttcctctctggatagcagctccccaagttcagcgcttcgcgccatcatctcttcaccaatcttcatcaatacagcttgacgctgctcaaggcctgttgcagcccattgtctttgggcaacctgagccgaattgagagcatcctctaattgtgagttactggcttgagcaaattctccaatgacatcgtttgtattcgatggattgatattagaaattgaacttgcgccttttacccagtcgcccgcaatgtagttgttagaaagattagacatgattttatttcatttttcaaaaatttaaattttactctttattattgatttatcaagaatataagcacatatctaaatatagtatttttcaagtttccatgaaaaaaaatgttgcattaagtaattaattaatctaggatactttcattaaatagaaagaaattaatatgcccaattctgctgaaagacttggaagagcggctcgaagaagtgaccgcctaaaagtcaaaattgaaatgctgccgactttacgtcgaaatatccctcttacagagccaatgaatgaagagcagattgagaaaatggatgacgcttcnctgtctattctggaggaagttggcgtagaatttcatgatcctattgcactagaacactggaaggaagctggagccagtgtagagggtgagagggtgcgctttgatagaggtctaattcgagaactcatcaaatcaattccagagagcatcacaatgcatgcccgagatccagagaagtcacttgaaattggtggaaataactctatntttgttccaatgacaggtgctccgtttctgactgatcttgaaaataaaaggcgtatgcctaccctggatgatcttgctaactttcataagctttctcatatgctccctgccattcattcgagtgcccatcacatcgtagaacccatggatcatgcaatttctcatagacatttgaggataacttattcatcaatgaagcactccgataagacctttatgggtatgaccagtagtggtaagaatgctgaggatgtaattgagatgtgtaagattctctttggtgaaaaattcattgatacgcacccagtagtcaccggcaacattaatggaaactccccactagtttgggatcaaaccatgctctcagctttaagggttttttcagcacacaatcaacctgttctctgctctcctttcgttcttggtggcgccaacact

SEQ ID NO: 1358 - DNA, 4000 bp, Escherichia coli
  misc_feature (489)..(489): n is a, c, g, or t
  misc_feature (891)..(891): n is a, c, g, or t
  misc_feature (1023)..(1023): n is a, c, g, or t
  misc_feature (1281)..(1281): n is a, c, g, or t
  misc_feature (1515)..(1515): n is a, c, g, or t
  misc_feature (1544)..(1544): n is a, c, g, or t
  misc_feature (1556)..(1556): n is a, c, g, or t
  misc_feature (1562)..(1562): n is a, c, g, or t
  misc_feature (1980)..(1980): n is a, c, g, or t
  misc_feature (1987)..(1987): n is a, c, g, or t
  misc_feature (1991)..(1991): n is a, c, g, or t
  misc_feature (1993)..(1993): n is a, c, g, or t
  misc_feature (2003)..(2003): n is a, c, g, or t
  misc_feature (2006)..(2006): n is a, c, g, or t
  misc_feature (2015)..(2015): n is a, c, g, or t
  misc_feature (2017)..(2017): n is a, c, g, or t
  misc_feature (2030)..(2031): n is a, c, g, or t
  misc_feature (2038)..(2038): n is a, c, g, or t
  misc_feature (2052)..(2052): n is a, c, g, or t
  misc_feature (2060)..(2060): n is a, c, g, or t
  misc_feature (2062)..(2062): n is a, c, g, or t
  misc_feature (2064)..(2065): n is a, c, g, or t
  misc_feature (2067)..(2067): n is a, c, g, or t
  misc_feature (2673)..(2673): n is a, c, g, or t
  misc_feature (2703)..(2703): n is a, c, g, or t
  misc_feature (2709)..(2709): n is a, c, g, or t
  misc_feature (2781)..(2781): n is a, c, g, or t
  misc_feature (2793)..(2793): n is a, c, g, or t
  misc_feature (2796)..(2796): n is a, c, g, or t
  misc_feature (2953)..(2953): n is a, c, g, or t
  misc_feature (2955)..(2955): n is a, c, g, or t
  misc_feature (2985)..(2985): n is a, c, g, or t
  misc_feature (3033)..(3033): n is a, c, g, or t
  misc_feature (3063)..(3063): n is a, c, g, or t
  misc_feature (3120)..(3120): n is a, c, g, or t
  misc_feature (3204)..(3204): n is a, c, g, or t
  misc_feature (3297)..(3297): n is a, c, g, or t
  misc_feature (3420)..(3420): n is a, c, g, or t
  misc_feature (3504)..(3504): n is a, c, g, or t
  misc_feature (3549)..(3549): n is a, c, g, or t
gactccatataagactgggagtgacgaccggagtagatcatatcctgccactgcttcaccatgcccagcacccggttattcaggttcagcaccagcaccggcagatcgtactgcagcgcggtggaaagctcctgaatgttcatctggatactgccatcgcccgttacgcagatgactgtttcgtccggcagcgccatcttcacgcccagcgcagcaggcaggccaaagcccatggtgcccagaccgccggagttgatccagcgacgcggtttgtcgaaaggataatagagcgcagcaaacatctggtgctggcccacatccgaggtcacatacgcatcgcctttggtcagacggctgatggtttcaatcaccgcctgcggcttgattttgtcgctggtgcgatcaaattccaggcagtgacgactgcgccagccctcaatctcctgccaccagtcgtgcaggctctcagcgcgctggctttcgctttgngccagtaactccagcatctgctgcagcacctgcttcgcatcaccgacaatcgggatatccgccgccaccgtcttagagatagaggtcgggtcgatatcgatatgcatcaccgtggcgttgggacaatacttcgccaggttgttggtggtgcggtcatcaaagcgaacaccaataccaaaaatcaggtcggtattgtgcatcgtcatgttggcttcgtacgtgccgtgcataccgagcatgccaacgcactgacgatgagtgccagggaacgcgcccaggcccatcagcgaggtcgtcaccggaatattcaggctttcggccagctttaacagttccgcttcgcagcctgcggtaatggcaccaccaccggcgtagatcaccggcttcttcgcggccagcaangtggtcagcgcacgcttaatctgacctttatggccctgaatagtcggattgtaggagcgcatgctcaccgtatccggccagtgataaggcaacttgttggccggattcagaatatctttcggcagatcgatnaccaccggccccggacgtccggtggaagccagccagaacgcctttttcaacacggttgggatctcttcggtacttttcaccaggaagctgtgcttcactaccggacgagagatgccgaccatgtcgcactcctgaaaggcgtcatagccaatcagcgacgagggaacctgacccgagaggatcaccagcggaatcgagtccatataggcggtggcgataccggtaatcgcattggttgcgccgggtccggaggtgacnagcaccacgccgacttcaccggtggcgcgcgccaggccgtcagccatgtgcaccgcaccctgctcatgacgcaccagaatgtgatcgatacccccgacggtttgcagcgcatcatagatatccaacactgcgccacccggataaccgaatacctgcttaacgccctgatcgattaacgaacggacgaccatttcggctcctgacaacatctccatcttctgcctccaggcttgnggacccggctctgttaatacgcccgttancgcgtaccacanagcccnggtgcctgctttgccaatcaaaatcttatgtttatgcatgacagcggaaacaactgccgctgtccggttacagagaaatctgttgagtttatttttctgagagtaggtcgattaccataaccgcagttaaccgggcaggcaaaccgcaaacccacgtaaattaaaaggcaggggcgtaaaggctctgcccgataagaattggctgcgcggattaaactaattacgcggcagaaccgcagaggaaaatgctgattaagaaattattttcagcgtgatctaagaaataacgaaaacttattacccggctgccctggcccacaatcgcctgacacttttcttttctggcgtaattaaccattaaatcgttgaagcgcattcgattatgctaaagagcaggtgatatatcctgtatcctcgngagacancttncngataaagtcnttnattttcaananaataaaatcaaanncccgcanaatcagtgctcatncccgggtngntnncntccgcagccactacggcgctgttcattacgctgcctgaccgttaaataacagaatatcttcctctggcaccactaagaatacccctgcattgaaggttgacatccctgagtgattccagtaccaatatgtacagcacaacattttataaggtttgaatccatgtttcgttctgttcgccttctcggtctactactaaacgcactcagcttgcgcggtagacttgtgggcggaatcaaacactgattcaaacctgctgaaagttaaaaacccgcgcctgtcgcgggtttttttatgctcgttgccaggccagaaaaagcataaggatgattacgatgagccagcaagtcattattttcgataccactctgcgcgacggtgagcaggcattacaggccagcctgagtgtgaaagaaaaattgcagattgctttagcgctggagcgcatgggcgtggatgtgatggaagtcggtttcccggtctcctcaccgggcgactttgagtctgtgcagaccattgcgcgcaccattaaaaacagtcgggtttgcggtctggcacgctgtgtggaaaaagatattgatgcggcgtacgaatcactgcgcgttgcngaagccttccgtattcatacctttatcgcnacctcnccgatgcacatcgccaccaaactgcgcagcacgctgccggaagtgattgagcgtgcggtgcatatggtgaancgtgcgcgtaantanaccagcgacgttgagttctcctgcgaagatggcggccgtaccccgattgatgacctgtgccggatggtagaagccacgattaacgccggtgccaccaccatcaacatcccggataccgttggctacaccctgccaggcgagtatgcccacatcatcngngagctgatgaatcgcgttcctaacatcganaaagcgattatctctgttcacacccacgatgacctgggtatggcaacnggcaacgccctggctgccgtacaggcgggngcgcgtcaggttgaaggaacgatgaatggcctgggtgaacgtgccggtaactgtgcnctggaagaggtgatcatggcgattaaaacccgccagcagatcatgaacgtgcataccaatatcaatcatcaggaaatctaccgnaccagccagatggtcagccagatctgcaacatgccgatcccggcgaacaaggcagtggtcggctctaacgccttcgctcactcctcgggtatncatcaggatggcgtgctgaagaaccgcgagaactatgaaatcctgacgccggaatcgatcggcttacacaaaatccagctgaacctgacctcacgttctggccgcgcggcggtaaaacatcgnatggaagagatgggctatgccgagcaggattacaatctggatacgctgtatgacgccttcctgaaactggccgataaaaaaggncaggttttcgattacgacctggaagcgctggccttcatcaacaancagaatgaagagccggaacatttccagctgcacgaatttaacgtccagaccggttccagcatcaccgccaccgcctctgtcaatctgggctgcggcgatgtcgctaaatcggatgcagccaccggtaatggcccggttgacgcggtctaccaggcgattaaccgtatcacccagttcgacgctgagctggttaactacaagctgaccgcgaaaggccacggcgagaatgcgctgggtcaggtcgatatcgtcgtgagctacaacggccgcaagttccacggcattggtctggcgaccgatattgtggagtcctccgccaaagcgatggtcaacgctctgaacaatatctggcgtgcccgtcaggttgaacaagaattgcagcgcaaatttaaagatcagaaggaaaccgtataaccatgtccagctcatctcatatcgcagttttacccgg

SEQ ID NO: 1359 - DNA, 4000 bp, Escherichia coli
  misc_feature (136)..(136): n is a, c, g, or t
  misc_feature (191)..(191): n is a, c, g, or t
  misc_feature (220)..(220): n is a, c, g, or t
  misc_feature (494)..(494): n is a, c, g, or t
  misc_feature (1944)..(1944): n is a, c, g, or t
  misc_feature (1991)..(1991): n is a, c, g, or t
  misc_feature (2049)..(2049): n is a, c, g, or t
  misc_feature (2290)..(2290): n is a, c, g, or t
  misc_feature (2319)..(2319): n is a, c, g, or t
  misc_feature (3560)..(3560): n is a, c, g, or t
  misc_feature (3625)..(3625): n is a, c, g, or t
  misc_feature (3664)..(3664): n is a, c, g, or t
  misc_feature (3811)..(3811): n is a, c, g, or t
  misc_feature (4000)..(4000): n is a, c, g, or t
agacgctcgagctcgccgacttcccgcactacctcgggctgatcgaagaggaggcgttccggtgcaaagagatcaccgggaccctgctccagctcgtccgcgatcccgggagccgccgcgccccgaccgacctcancgcgctcgtcctcaaggcgaccgagctcctcttccaccagccccgcttcgccganggccggttcgtgaccgagctcgaccaggngctcccggcggtcgcggtcaacgagggccagatccgccaggtcttcatcgccctcgcctcgaacgcgctcgaggcgatggaggggcgcggccggctgacggtgcgctcgcgcctgcatcgcggcgaggtcgaggtggagttcgaggacgaggggccgggcgttccggacgaggtcctgccgcgtatcttcgacccattcttcacgaccaagccgccggggcaggggaccggcctcggactcgccatcgcccaggggatcgtgacggaccacggnggccggatcgaggtcacctcgcggcccggcaaggggagcctcttccgggtggtgctgcccgcgtgagttgcaaggtccgcgtcctggtcgccgacgacgagcgcaacctgcgcgagctcatcatgcgcgagctcgcgcgcaaggggcacgacgtggacggcgtcggcgacggcgccgcggcgctcgagcggctcgtggcggcgccgtacgacgtcgtggtcctcgacatgaagatgccgaagaaggagggtatcgaggtcctgcgcgagctccagtccttccccgagcatccgcaggtgatcgtgatgacgggctttcaggaggtctccacggcggtcgaggcgatgaagctcggcgcctacgactacctcaccaagcccatgaagatcgaggagctcgacgtcctcatccgcaaggccgcggagaaggcccagctcctccgcgacaacgaggcgctgcgcgcgtacgccccgggcgccgagccgttcggtggcatcctcaccaagagtccccagatgcaggaggtcctccggatcatcgagcggattgcgcccaccgactcctcggtgctcgtcctgggcgcgagcggtaccggcaaggagctggtggcgcgcgcgatccacgagcgctcggcgcgagccgggcggcccttcgtccccatccactgcggcgccctgccgcgtgaggtgttcgagtcggagctcttcggccacgagaagggcgcgttcacaggcgcggtgggcgccaagcccgggctcgtcgagctggccgacggcggcaccctcttgctcgacgagatcggcgagatggagccggacagccaggtgaagctcctgcgcgccctcgagaccggcaccttcttccgcgtcggcgccacgcggccgcggcgcgtggacgtgcggctcgtggcggcgaccaaccgcgacctcgccgaggcgatgaagacgggcgagttccgccaggacctctacttccggatcaacacgatcatgatcaagctgccgcccctccgggagcggcgggaggacatcgcgctcctggccaaccacttcgtggtggccaacgccacgtacggcgccaagcggctcggcccccgcgccctcgccgtgctcgaggggtacgcatggcccggcaacgtccgcgagctgctccacgccatcgagcgcgcggtgatcctctcgaagggcgaggagatccagccggaggacctgccgccggaggtcttgggcgcgccgccggcgccggccgtttcgtcgggggcgagcctcgaaacgatggagcgccagcacatcgtcacgacgctgcgccaggtcggcggccaccggggcaaggccgcggcgctgctcgccatcgacccgaagacgctctaccggaagatcatcgcgtacgggatcgcgcccgacgagttcaggtgagaaccccccgggtgatcggctctcctgcccacccnaaaagttgacgcccgccaggctgacctggtgcaatggccgaggccancgcgaggagccggcacattctaaagcagctactggtgagcgtcgggctgttcgtcgcnctgcccagtgtggcagcggctcagcgcatcgcgctggacgcgtcggcctgggttccgagtgtcatggccgccgaggccaaggtcgaaggcggggccctgccaggcacggccttcgacttcaagcaggatcttggaatcgacgacgagccgctggccgatctccgcctcagcgtcttcaccgggccgaacagcaggctgcgcctggcgtatacccgcgcgagctacgcgggcgacacgatcntcgatcgaacaatccagttcaacgggtcngttttcccggcctcgacccgcgtcgtgtccgacctcgacctgcactatgcgcgactcgggtggatctggcagctcccggtgatcccggacaaactgagagtgggtccggtcgtcgaggccaaggccttcgtggccagcgctacgctggacgcgccagcgaccacgccgcgactgcgagagaccgagagggtcgccgtcgtgatcccgagcgccggcctggcgctcgacctgagcctgcaccccctgatcgacctgttcgccgagggctccgccctgactctgggcgaccggggacgggtcatcgacgccgaggcgggggtgcgcgtccacctggtcaagttcctcaccatgatcgccgggtatcggttcttcgaggtgcgcggcgaggaggaccacagtttcgcgcggctgcaactgtccggcccgttcgtcggcgtgaccttcaggttctgaccgagcgcgtcgcgcgctaagtccttaacgtgcttgcgcgctccggccgtgcgtgtacactggacctgtcggccggatgggccggatctcgcctccgatgcaacgtgtcttccggttcgcggggcgtgtacgaccagcggaagacagtccgagggggttcacatggcgtcaaaactgtatatcggcggtctcgcgtactcgaccacgagcgacgggcttcgcgagttcttcagccagtccggcagcgtcctgtcggcgacggtgattaccgatcggttctccgggcagtcacgcggcttcggcttcgtcgagatggcgacggcggaagaggcgcagaacgcgatcgctcagctcaacgggcgggagctcgacggccggaagatcacggtcgaggtctcgaacccgcagggccagcgcaccggcggcccgcggcccggcggcaatcggccgagcggcggcgggcgtggccctggcgggggacgcggtccggggggcgggcgcgacagcggctacgcccaccggccctcgaagcccgtgaagtggtagtgcggacttctggaattcgcggggctggggccccgccgtccgaggtttcggagggggccctcaggccccctccgagctaaagatccggtcgtagcggccgtactcgcgggccgcgtccatgaaccacttcacggcgtccggatccgagcgcggcgggatctcgcacgaggtggacaggatgaacgccgaggtcctcgcggccgtgtcgatgcagcgccggacgtcggcggccatcgcctccnggctcgtcttctcgaacttcgtcgcgtccacgttgccgatcgcgacgacgcggccgcgggacacntccgtgaaccgcttgagctggtccacgtagagcttcggntccgcctgctggtcgaggtcgaacgagatcgtcgtgaagccgcaccgaatgaggtcctcgtagatcgggtaggtcgttccgcagatgtgtgtcgtcacgccgaccttcttcgccttgaagtaatccacgagctccttgtggtagggngcgatgaactcccggtaattgtcgggcgagatcaggctgatcgaggcggtgggctccgagaagctgagcccgatgcccgtggccacgatcgcgtctccccagttcttgcagaagtcggtcgtgatccgcatcaggtcatggatgaacttcgggtcctcgaaggtgtccaggagcatcgtctcggggttn

SEQ ID NO: 1360 - DNA, 4000 bp, Escherichia coli
  misc_feature (99)..(99): n is a, c, g, or t
  misc_feature (448)..(448): n is a, c, g, or t
  misc_feature (761)..(761): n is a, c, g, or t
  misc_feature (1229)..(1229): n is a, c, g, or t
  misc_feature (1982)..(1986): n is a, c, g, or t
  misc_feature (1988)..(1988): n is a, c, g, or t
  misc_feature (1991)..(1997): n is a, c, g, or t
  misc_feature (1999)..(1999): n is a, c, g, or t
  misc_feature (2002)..(2006): n is a, c, g, or t
  misc_feature (2152)..(2152): n is a, c, g, or t
  misc_feature (2166)..(2168): n is a, c, g, or t
  misc_feature (2173)..(2174): n is a, c, g, or t
  misc_feature (2179)..(2179): n is a, c, g, or t
  misc_feature (2182)..(2183): n is a, c, g, or t
  misc_feature (2185)..(2185): n is a, c, g, or t
  misc_feature (2191)..(2191): n is a, c, g, or t
  misc_feature (2193)..(2193): n is a, c, g, or t
  misc_feature (2195)..(2198): n is a, c, g, or t
  misc_feature (2200)..(2200): n is a, c, g, or t
  misc_feature (2203)..(2204): n is a, c, g, or t
  misc_feature (2207)..(2207): n is a, c, g, or t
  misc_feature (2209)..(2211): n is a, c, g, or t
  misc_feature (2213)..(2213): n is a, c, g, or t
  misc_feature (2215)..(2218): n is a, c, g, or t
  misc_feature (2220)..(2224): n is a, c, g, or t
  misc_feature (2226)..(2231): n is a, c, g, or t
  misc_feature (2233)..(2239): n is a, c, g, or t
  misc_feature (2243)..(2246): n is a, c, g, or t
  misc_feature (2251)..(2251): n is a, c, g, or t
  misc_feature (2254)..(2254): n is a, c, g, or t
  misc_feature (2260)..(2263): n is a, c, g, or t
  misc_feature (2265)..(2269): n is a, c, g, or t
  misc_feature (2272)..(2274): n is a, c, g, or t
  misc_feature (2278)..(2278): n is a, c, g, or t
  misc_feature (2283)..(2289): n is a, c, g, or t
  misc_feature (2293)..(2293): n is a, c, g, or t
  misc_feature (2295)..(2303): n is a, c, g, or t
  misc_feature (2306)..(2310): n is a, c, g, or t
  misc_feature (2312)..(2312): n is a, c, g, or t
  misc_feature (2315)..(2315): n is a, c, g, or t
  misc_feature (2317)..(2322): n is a, c, g, or t
  misc_feature (2325)..(2328): n is a, c, g, or t
  misc_feature (2330)..(2330): n is a, c, g, or t
  misc_feature (2333)..(2334): n is a, c, g, or t
  misc_feature (2336)..(2337): n is a, c, g, or t
  misc_feature (2340)..(2343): n is a, c, g, or t
  misc_feature (2345)..(2351): n is a, c, g, or t
  misc_feature (2354)..(2355): n is a, c, g, or t
  misc_feature (2357)..(2366): n is a, c, g, or t
  misc_feature (2369)..(2372): n is a, c, g, or t
  misc_feature (2375)..(2376): n is a, c, g, or t
  misc_feature (2378)..(2384): n is a, c, g, or t
  misc_feature (2386)..(2386): n is a, c, g, or t
  misc_feature (2389)..(2393): n is a, c, g, or t
  misc_feature (2396)..(2397): n is a, c, g, or t
  misc_feature (2403)..(2403): n is a, c, g, or t
  misc_feature (2407)..(2415): n is a, c, g, or t
  misc_feature (2418)..(2422): n is a, c, g, or t
  misc_feature (2425)..(2426): n is a, c, g, or t
  misc_feature (2429)..(2429): n is a, c, g, or t
  misc_feature (2432)..(2434): n is a, c, g, or t
  misc_feature (2441)..(2442): n is a, c, g, or t
  misc_feature (2446)..(2448): n is a, c, g, or t
  misc_feature (2451)..(2460): n is a, c, g, or t
  misc_feature (2463)..(2465): n is a, c, g, or t
  misc_feature (2467)..(2468): n is a, c, g, or t
  misc_feature (2470)..(2490): n is a, c, g, or t
  misc_feature (2492)..(2497): n is a, c, g, or t
  misc_feature (2501)..(2502): n is a, c, g, or t
  misc_feature (2504)..(2510): n is a, c, g, or t
  misc_feature (2512)..(2531): n is a, c, g, or t
  misc_feature (2533)..(2538): n is a, c, g, or t
  misc_feature (2540)..(2540): n is a, c, g, or t
  misc_feature (2543)..(2546): n is a, c, g, or t
  misc_feature (2548)..(2567): n is a, c, g, or t
  misc_feature (2569)..(2573): n is a, c, g, or t
  misc_feature (2577)..(2588): n is a, c, g, or t
  misc_feature (2591)..(2592): n is a, c, g, or t
  misc_feature (2594)..(2594): n is a, c, g, or t
  misc_feature (2597)..(2598): n is a, c, g, or t
  misc_feature (2600)..(2603): n is a, c, g, or t
  misc_feature (2605)..(2609): n is a, c, g, or t
  misc_feature (2611)..(2616): n is a, c, g, or t
  misc_feature (2618)..(2619): n is a, c, g, or t
  misc_feature (2621)..(2622): n is a, c, g, or t
  misc_feature (2624)..(2633): n is a, c, g, or t
  misc_feature (2635)..(2637): n is a, c, g, or t
  misc_feature (2643)..(2643): n is a, c, g, or t
  misc_feature (2645)..(2651): n is a, c, g, or t
  misc_feature (2653)..(2658): n is a, c, g, or t
  misc_feature (2660)..(2664): n is a, c, g, or t
  misc_feature (2667)..(2667): n is a, c, g, or t
  misc_feature (2669)..(2676): n is a, c, g, or t
  misc_feature (2678)..(2679): n is a, c, g, or t
  misc_feature (2681)..(2694): n is a, c, g, or t
  misc_feature (2696)..(2701): n is a, c, g, or t
  misc_feature (2704)..(2705): n is a, c, g, or t
  misc_feature (2707)..(2715): n is a, c, g, or t
  misc_feature (2717)..(2723): n is a, c, g, or t
  misc_feature (2726)..(2730): n is a, c, g, or t
  misc_feature (2732)..(2732): n is a, c, g, or t
  misc_feature (2735)..(2735): n is a, c, g, or t
  misc_feature (2737)..(2757): n is a, c, g, or t
  misc_feature (2759)..(2760): n is a, c, g, or t
  misc_feature (2768)..(2769): n is a, c, g, or t
  misc_feature (2771)..(2771): n is a, c, g, or t
  misc_feature (2773)..(2783): n is a, c, g, or t
  misc_feature (2786)..(2794): n is a, c, g, or t
  misc_feature (2798)..(2798): n is a, c, g, or t
  misc_feature (2800)..(2802): n is a, c, g, or t
  misc_feature (2804)..(2811): n is a, c, g, or t
  misc_feature (2815)..(2815): n is a, c, g, or t
  misc_feature (2817)..(2817): n is a, c, g, or t
  misc_feature (2819)..(2819): n is a, c, g, or t
  misc_feature (2822)..(2832): n is a, c, g, or t
  misc_feature (2834)..(2843): n is a, c, g, or t
  misc_feature (2845)..(2845): n is a, c, g, or t
  misc_feature (2847)..(2849): n is a, c, g, or t
  misc_feature (2851)..(2853): n is a, c, g, or t
  misc_feature (2857)..(2858): n is a, c, g, or t
  misc_feature (2860)..(2865): n is a, c, g, or t
  misc_feature (2869)..(2882): n is a, c, g, or t
  misc_feature (2885)..(2886): n is a, c, g, or t
  misc_feature (2888)..(2895): n is a, c, g, or t
  misc_feature (2897)..(2906): n is a, c, g, or t
  misc_feature (2908)..(2912): n is a, c, g, or t
  misc_feature (2915)..(2918): n is a, c, g, or t
  misc_feature (2921)..(2925): n is a, c, g, or t
  misc_feature (2930)..(2930): n is a, c, g, or t
  misc_feature (2933)..(2937): n is a, c, g, or t
  misc_feature (2942)..(2948): n is a, c, g, or t
  misc_feature (2950)..(2951): n is a, c, g, or t
  misc_feature (2953)..(2955): n is a, c, g, or t
  misc_feature (2960)..(2966): n is a, c, g, or t
  misc_feature (2968)..(2972): n is a, c, g, or t
  misc_feature (2975)..(2997): n is a, c, g, or t
  misc_feature (2999)..(3003): n is a, c, g, or t
  misc_feature (3005)..(3023): n is a, c, g, or t
  misc_feature (3026)..(3030): n is a, c, g, or t
  misc_feature (3032)..(3038): n is a, c, g, or t
  misc_feature (3040)..(3052): n is a, c, g, or t
  misc_feature (3055)..(3105): n is a, c, g, or t
  misc_feature (3107)..(3117): n is a, c, g, or t
  misc_feature (3119)..(3119): n is a, c, g, or t
  misc_feature (3121)..(3121): n is a, c, g, or t
  misc_feature (3125)..(3129): n is a, c, g, or t
  misc_feature (3131)..(3132): n is a, c, g, or t
  misc_feature (3135)..(3137): n is a, c, g, or t
  misc_feature (3139)..(3144): n is a, c, g, or t
  misc_feature (3146)..(3146): n is a, c, g, or t
  misc_feature (3148)..(3158): n is a, c, g, or t
  misc_feature (3160)..(3172): n is a, c, g, or t
  misc_feature (3175)..(3180): n is a, c, g, or t
  misc_feature (3182)..(3185): n is a, c, g, or t
  misc_feature (3187)..(3191): n is a, c, g, or t
  misc_feature (3194)..(3205): n is a, c, g, or t
  misc_feature (3207)..(3207): n is a, c, g, or t
  misc_feature (3209)..(3220): n is a, c, g, or t
  misc_feature (3222)..(3228): n is a, c, g, or t
  misc_feature (3232)..(3236): n is a, c, g, or t
  misc_feature (3238)..(3269): n is a, c, g, or t
  misc_feature (3272)..(3281): n is a, c, g, or t
  misc_feature (3290)..(3291): n is a, c, g, or t
  misc_feature (3293)..(3294): n is a, c, g, or t
  misc_feature (3298)..(3299): n is a, c, g, or t
  misc_feature (3303)..(3317): n is a, c, g, or t
  misc_feature (3326)..(3329): n is a, c, g, or t
  misc_feature (3331)..(3340): n is a, c, g, or t
  misc_feature (3343)..(3343): n is a, c, g, or t
  misc_feature (3345)..(3348): n is a, c, g, or t
  misc_feature (3350)..(3353): n is a, c, g, or t
  misc_feature (3358)..(3363): n is a, c, g, or t
  misc_feature (3365)..(3365): n is a, c, g, or t
  misc_feature (3367)..(3369): n is a, c, g, or t
  misc_feature (3372)..(3377): n is a, c, g, or t
  misc_feature (3379)..(3385): n is a, c, g, or t
  misc_feature (3387)..(3391): n is a, c, g, or t
  misc_feature (3394)..(3395): n is a, c, g, or t
  misc_feature (3397)..(3398): n is a, c, g, or t
  misc_feature (3401)..(3401): n is a, c, g, or t
  misc_feature (3404)..(3404): n is a, c, g, or t
  misc_feature (3407)..(3407): n is a, c, g, or t
  misc_feature (3409)..(3414): n is a, c, g, or t
  misc_feature (3416)..(3425): n is a, c, g, or t
  misc_feature (3430)..(3431): n is a, c, g, or t
  misc_feature (3433)..(3448): n is a, c, g, or t
  misc_feature (3450)..(3474): n is a, c, g, or t
  misc_feature (3476)..(3481): n is a, c, g, or t
  misc_feature (3483)..(3484): n is a, c, g, or t
  misc_feature (3487)..(3493): n is a, c, g, or t
  misc_feature (3496)..(3496): n is a, c, g, or t
  misc_feature (3499)..(3504): n is a, c, g, or t
  misc_feature (3506)..(3511): n is a, c, g, or t
  misc_feature (3513)..(3513): n is a, c, g, or t
  misc_feature (3516)..(3520): n is a, c, g, or t
  misc_feature (3523)..(3524): n is a, c, g, or t
  misc_feature (3526)..(3548): n is a, c, g, or t
  misc_feature (3550)..(3551): n is a, c, g, or t
  misc_feature (3553)..(3555): n is a, c, g, or t
  misc_feature (3557)..(3559): n is a, c, g, or t
  misc_feature (3562)..(3569): n is a, c, g, or t
  misc_feature (3571)..(3576): n is a, c, g, or t
  misc_feature (3578)..(3582): n is a, c, g, or t
  misc_feature (3584)..(3594): n is a, c, g, or t
  misc_feature (3597)..(3601): n is a, c, g, or t
  misc_feature (3603)..(3603): n is a, c, g, or t
  misc_feature (3605)..(3611): n is a, c, g, or t
  misc_feature (3614)..(3622): n is a, c, g, or t
  misc_feature (3624)..(3628): n is a, c, g, or t
  misc_feature (3631)..(3631): n is a, c, g, or t
  misc_feature (3634)..(3636): n is a, c, g, or t
  misc_feature (3640)..(3641): n is a, c, g, or t
  misc_feature (3643)..(3643): n is a, c, g, or t
  misc_feature (3645)..(3651): n is a, c, g, or t
  misc_feature (3653)..(3656): n is a, c, g, or t
  misc_feature (3659)..(3670): n is a, c, g, or t
  misc_feature (3673)..(3678): n is a, c, g, or t
  misc_feature (3680)..(3683): n is a, c, g, or t
  misc_feature (3686)..(3688): n is a, c, g, or t
  misc_feature (3690)..(3694): n is a, c, g, or t
  misc_feature (3697)..(3700): n is a, c, g, or t
  misc_feature (3703)..(3706): n is a, c, g, or t
  misc_feature (3708)..(3709): n is a, c, g, or t
  misc_feature (3711)..(3711): n is a, c, g, or t
  misc_feature (3713)..(3713): n is a, c, g, or t
  misc_feature (3715)..(3715): n is a, c, g, or t
  misc_feature (3719)..(3723): n is a, c, g, or t
  misc_feature (3725)..(3727): n is a, c, g, or t
  misc_feature (3730)..(3734): n is a, c, g, or t
  misc_feature (3736)..(3736): n is a, c, g, or t
  misc_feature (3738)..(3738): n is a, c, g, or t
  misc_feature (3741)..(3746): n is a, c, g, or t
  misc_feature (3748)..(3749): n is a, c, g, or t
  misc_feature (3751)..(3751): n is a, c, g, or t
  misc_feature (3753)..(3753): n is a, c, g, or t
  misc_feature (3756)..(3765): n is a, c, g, or t
  misc_feature (3769)..(3774): n is a, c, g, or t
  misc_feature (3777)..(3782): n is a, c, g, or t
  misc_feature (3785)..(3786): n is a, c, g, or t
  misc_feature (3788)..(3790): n is a, c, g, or t
  misc_feature (3792)..(3793): n is a, c, g, or t
  misc_feature (3795)..(3798): n is a, c, g, or t
  misc_feature (3800)..(3805): n is a, c, g, or t
  misc_feature (3807)..(3810): n is a, c, g, or t
  misc_feature (3812)..(3812): n is a, c, g, or t
  misc_feature (3814)..(3815): n is a, c, g, or t
  misc_feature (3817)..(3821): n is a, c, g, or t
  misc_feature (3823)..(3824): n is a, c, g, or t
  misc_feature (3826)..(3833): n is a, c, g, or t
  misc_feature (3835)..(3835): n is a, c, g, or t
  misc_feature (3837)..(3841): n is a, c, g, or t
  misc_feature (3844)..(3852): n is a, c, g, or t
  misc_feature (3854)..(3857): n is a, c, g, or t
  misc_feature (3860)..(3864): n is a, c, g, or t
  misc_feature (3866)..(3866): n is a, c, g, or t
  misc_feature (3868)..(3869): n is a, c, g, or t
  misc_feature (3872)..(3877): n is a, c, g, or t
  misc_feature (3879)..(3888): n is a, c, g, or t
  misc_feature (3891)..(3899): n is a, c, g, or t
  misc_feature (3903)..(3903): n is a, c, g, or t
  misc_feature (3906)..(3912): n is a, c, g, or t
  misc_feature (3914)..(3915): n is a, c, g, or t
  misc_feature (3917)..(3920): n is a, c, g, or t
  misc_feature (3931)..(3933): n is a, c, g, or t
  misc_feature (3939)..(3939): n is a, c, g, or t
  misc_feature (3942)..(3946): n is a, c, g, or t
  misc_feature (3948)..(3949): n is a, c, g, or t
  misc_feature (3952)..(3955): n is a, c, g, or t
  misc_feature (3957)..(3957): n is a, c, g, or t
  misc_feature (3960)..(3961): n is a, c, g, or t
  misc_feature (3963)..(3963): n is a, c, g, or t
  misc_feature (3965)..(3965): n is a, c, g, or t
  misc_feature (3967)..(3967): n is a, c, g, or t
  misc_feature (3975)..(3975): n is a, c, g, or t
  misc_feature (3982)..(3982): n is a, c, g, or t
  misc_feature (3984)..(3985): n is a, c, g, or t
  misc_feature (3990)..(3992): n is a, c, g, or t
  misc_feature (4000)..(4000): n is a, c, g, or t
gcagccacccttgaaagagtgcgtaacagctcactggtcaagtggtcctgcgccgatgatgtaacggggctcaagcacgacaccgaagctgcgggatcnctcatatggctcggccatggggggcgacctccatggtccaggccgagggatcggtaggggagcgttctgacgcgagtgaagcggcggggtaacccagcggtggacgcgtcagaagtgagaatgccggcatgagtagcgaaagacgggggaggagcccgtccgccgaatgcccaagggttcctggggaaggttcatccgcccagggttagtcgggacctaaggcgaggccgagaggcgtagccgatggacgactggttgatattccagtaccacctcatccgcgccaagcccgaatccgaggtactaagggaaccccttcgggggctaccgaccaactcggtactagggnagcgaaggggggacgcaggagggtaggtcgacccacgcgatggtcgtcgtggggcaagtgcgtaggggggttccccaggcaaatccggggagccatcaaccctgaggcacgatgccgagccgctctaggtgaagcgactgatcccatgctgccgagaaaagcctctagcgagtggttgaggtgcccgtaccccaaaccgactcaggtgggcaagtagagaatactcaggcgatcgagagaaccctggttaaggaactcggcaaattgcctccgtaacttcgggagaaggaggaccacggtagggtgacggccntcgcggcccgagctcgatgtggtggcacaaaccaggcccaagcgactgtttactaaaaacacaggtccgtgcgaagtcgtaagacgatgtatacggactgacacctgcccggtgctggaacgttacggggaggggtcagctcccttcggggggcgaagctccgaacctaagcgccagtaaacggcggccgtaactataacggtcctaaggtagcgaaattccttgtcgggtaagttccgacctgcacgaatggtgcaacgacttgggcactgtctcaaccggggactcggcgaaattgcagtacgagtaaagatgctcgttacccgcgacaggacggaaagaccccgggacctttactgcagcttggtgttgggttctggcagatgttgcgtaggataggcgggaggcttcgaagcccgggctccggctcgggtggagccaaccttgaaataccgcccttcatctgtngggactctaacctcggtccgtgatccggatcggggacagcgcctggtgggcagtttgactggggcggttgcctcctaaagcgtaacggaggcgcccaaaggttccctcagcctggttggcaatcaggcgtcgagtgcaagggcacaagggagcttgactgcgagaccgacgggtcgagcaggtgcgaaagcagggcctagtgatctgacgactccttgtggaagggtcgtcactcaacggctaaaaggtaccccggggataacaggctgatcgctcccaagagtccatatcgacggagcggtttggcacctcgatgtcggctcgtctcatcctggggctggagcaggtcccaagggtcgggctgttcgcccgttaaagaggcacgcgagctgggtttagaacgtcgtgagacagttcggtccctatccgtcgtgggcgtaggagacttgcggggagctgcccctagtacgagaggaccggggcggacgaacctctggtgtgccagttgtcgcgccagcggcacggctggttagccacgttcggaagagataagcgctgaaagcatctaagtgcgaaactcgcccctagatgaggtctcccactgggcaaccaggtaaggcccctcgcagactacgaggttgataggccggaggtgtacgcgtggcaacacgttgagccgaccggtactaataggccgaggacttgactttgctcgcgctcgctatcgcagttcccgagctctgctcgggggcnnnnntnccnnnnnnntnccnnnnncaacggatcgggagacgccgtttcggtggtcatagcggaggggaaacacccggtcccatcccgaacccggaagttaagccctccagcgccgatggtactgcccgggcaactgggtgggagagtaggtcgccgccggacaccttcgnaagagccgcccccnnnggggnngcttntcnngntggggncncnnnngngcnnccngnnncncnnnngnnnnncnnnnnngnnnnnnncccnnnncgggnccnaagggnnnncnnnnnggnnncccncccgnnnnnnncccngnnnnnnnnnccnnnnncnggncnnnnnnccnnnncnggnngnnggnnnngnnnnnnnccnngnnnnnnnnnnccnnnnggnncnnnnnnncnggnnnnnccnngggggnggcnnnnnnnnnggnnnnngcnnagnggnnnccccccnngggnnnggnnnnnnnnnnggnnntnngnnnnnnnnnnnnnnnnnnnnngnnnnnnccgnngnnnnnnncnnnnnnnnnnnnnnnnnnnngnnnnnncnggnnnncnnnnnnnnnnnnnnnnnnnncnnnnncccnnnnnnnnnnnngcnngnccnncnnnncnnnnncnnnnnngnngnngnnnnnnnnnncnnngggggngnnnnnnncnnnnnngnnnnnggngnnnnnnnngnncnnnnnnnnnnnnnngnnnnnnggnnannnnnnnnngnnnnnnnggnnnnncnccngnnnnnnnnnnnnnnnnnnnnngnnggggcccnngngnnnnnnnnnnnggnnnnnnnnngggnannncnnnnnnnnggcngncnggnnnnnnnnnnncnnnnnnnnnntncnnnannncccnngnnnnnncccnnnnnnnnnnnnnnccnngnnnnnnnngnnnnnnnnnncnnnnnccnnnnccnnnnncctcnccnnnnnccccnnnnnnncnngnnnccccnnnnnnntnnnnnggnnnnnnnnnnnnnnnnnnnnnnncnnnnngnnnnnnnnnnnnnnnnnnnccnnnnngnnnnnnngnnnnnnnnnnnnncgnnnnnnnnnnnnnnnnnnnnnnnnnnnnnnnnnnnnnnnnnnnnnnnnnnncnnnnnnnnnnncncncccnnnnncnnggnnncnnnnnngnannnnnnnnnnncnnnnnnnnnnnnnccnnnnnncnnnngnnnnnggnnnnnnnnnnnnanannnnnnnnnnnncnnnnnnncccnnnnngnnnnnnnnnnnnnnnnnnnnnnnnnnnnnnnnggnnnnnnnnnnggggggggnngnngggnngggnnnnnnnnnnnnnnnggggggggnnnncnnnnnnnnnnccngnnnnannnngcccnnnnnngngnnnccnnnnnncnnnnnnngnnnnnggnngnnccnggnggngnnnnnncnnnnnnnnnncgccnncnnnnnnnnnnnnnnnncnnnnnnnnnnnnnnnnnnnnnnnnngnnnnnnannggnnnnnnnggnccnnnnnngnnnnnngnggnnnnnggnncnnnnnnnnnnnnnnnnnnnnnnngnngnnngnnnggnnnnnnnngnnnnnngnnnnncnnnnnnnnnnnccnnnnngngnnnnnnnggnnnnnnnnngnnnnnccnccnnncccnncngnnnnnnncnnnnggnnnnnnnnnnnnggnnnnnngnnnnggnnngnnnnnccnnnnccnnnncnntncnancccnnnnncnnnggnnnnnangnggnnnnnngnncngnttnnnnnnnnnngggnnnnnnggnnnnnnggnngnnngnngnnnngnnnnnntnnnngncnncnnnnnanngnnnnnnnncngnnnnnccnnnnnnnnncnnnnaannnnncngnnccnnnnnngnnnnnnnnnnggnnnnnnnnngggnggnnnnnnngnncnnnncgaaggggggnnnttgganggnnnnngnnaannnngnggnncncncnggcaccgnggccgcngnnccggnnnaacgccgn

SEQ ID NO: 1361 - DNA, 4000 bp, Escherichia coli
  misc_feature (1)..(1): n is a, c, g, or t
  misc_feature (4)..(5): n is a, c, g, or t
  misc_feature (8)..(9): n is a, c, g, or t
  misc_feature (12)..(13): n is a, c, g, or t
  misc_feature (16)..(17): n is a, c, g, or t
  misc_feature (19)..(19): n is a, c, g, or t
  misc_feature (21)..(25): n is a, c, g, or t
  misc_feature (27)..(32): n is a, c, g, or t
  misc_feature (34)..(34): n is a, c, g, or t
  misc_feature (36)..(39): n is a, c, g, or t
  misc_feature (41)..(49): n is a, c, g, or t
  misc_feature (51)..(52): n is a, c, g, or t
  misc_feature (58)..(63): n is a, c, g, or t
  misc_feature (66)..(66): n is a, c, g, or t
  misc_feature (68)..(70): n is a, c, g, or t
  misc_feature (72)..(74): n is a, c, g, or t
  misc_feature (76)..(78): n is a, c, g, or t
  misc_feature (80)..(84): n is a, c, g, or t
  misc_feature (86)..(86): n is a, c, g, or t
  misc_feature (90)..(90): n is a, c, g, or t
  misc_feature (92)..(93): n is a, c, g, or t
  misc_feature (97)..(97): n is a, c, g, or t
  misc_feature (99)..(99): n is a, c, g, or t
  misc_feature (101)..(102): n is a, c, g, or t
  misc_feature (104)..(105): n is a, c, g, or t
  misc_feature (107)..(115): n is a, c, g, or t
  misc_feature (117)..(119): n is a, c, g, or t
  misc_feature (121)..(123): n is a, c, g, or t
  misc_feature (128)..(131): n is a, c, g, or t
  misc_feature (133)..(134): n is a, c, g, or t
  misc_feature (136)..(137): n is a, c, g, or t
  misc_feature (139)..(139): n is a, c, g, or t
  misc_feature (141)..(141): n is a, c, g, or t
  misc_feature (145)..(147): n is a, c, g, or t
  misc_feature (149)..(152): n is a, c, g, or t
  misc_feature (154)..(157): n is a, c, g, or t
  misc_feature (159)..(159): n is a, c, g, or t
  misc_feature (161)..(161): n is a, c, g, or t
  misc_feature (163)..(163): n is a, c, g, or t
  misc_feature (165)..(168): n is a, c, g, or t
  misc_feature (172)..(179): n is a, c, g, or t
  misc_feature (181)..(184): n is a, c, g, or t
  misc_feature (186)..(189): n is a, c, g, or t
  misc_feature (191)..(191): n is a, c, g, or t
  misc_feature (193)..(197): n is a, c, g, or t
  misc_feature (199)..(206): n is a, c, g, or t
  misc_feature (209)..(211): n is a, c, g, or t
  misc_feature (213)..(213): n is a, c, g, or t
  misc_feature (215)..(215): n is a, c, g, or t
  misc_feature (217)..(221): n is a, c, g, or t
  misc_feature (223)..(225): n is a, c, g, or t
  misc_feature (229)..(230): n is a, c, g, or t
  misc_feature (233)..(236): n is a, c, g, or t
  misc_feature (238)..(239): n is a, c, g, or t
  misc_feature (242)..(243): n is a, c, g, or t
  misc_feature (245)..(245): n is a, c, g, or t
  misc_feature (247)..(248): n is a, c, g, or t
  misc_feature (250)..(250): n is a, c, g, or t
  misc_feature (253)..(255): n is a, c, g, or t
  misc_feature (259)..(259): n is a, c, g, or t
  misc_feature (261)..(261): n is a, c, g, or t
  misc_feature (263)..(264): n is a, c, g, or t
  misc_feature (268)..(269): n is a, c, g, or t
  misc_feature (271)..(271): n is a, c, g, or t
  misc_feature (273)..(276): n is a, c, g, or t
  misc_feature (278)..(284): n is a, c, g, or t
  misc_feature (287)..(289): n is a, c, g, or t
  misc_feature (293)..(298): n is a, c, g, or t
  misc_feature (300)..(303): n is a, c, g, or t
  misc_feature (305)..(311): n is a, c, g, or t
  misc_feature (313)..(313): n is a, c, g, or t
  misc_feature (315)..(324): n is a, c, g, or t
  misc_feature (326)..(326): n is a, c, g, or t
  misc_feature (329)..(329): n is a, c, g, or t
  misc_feature (335)..(336): n is a, c, g, or t
  misc_feature (338)..(341): n is a, c, g, or t
  misc_feature (343)..(344): n is a, c, g, or t
  misc_feature (346)..(346): n is a, c, g, or t
  misc_feature (350)..(357): n is a, c, g, or t
  misc_feature (360)..(363): n is a, c, g, or t
  misc_feature (365)..(366): n is a, c, g, or t
  misc_feature (370)..(371): n is a, c, g, or t
  misc_feature (374)..(377): n is a, c, g, or t
  misc_feature (380)..(380): n is a, c, g, or t
  misc_feature (382)..(385): n is a, c, g, or t
  misc_feature (388)..(392): n is a, c, g, or t
  misc_feature (394)..(395): n is a, c, g, or t
  misc_feature (397)..(397): n is a, c, g, or t
  misc_feature (399)..(402): n is a, c, g, or t
  misc_feature (405)..(405): n is a, c, g, or t
  misc_feature (411)..(411): n is a, c, g, or t
  misc_feature (413)..(413): n is a, c, g, or t
  misc_feature (415)..(417): n is a, c, g, or t
  misc_feature (420)..(422): n is a, c, g, or t
  misc_feature (424)..(426): n is a, c, g, or t
  misc_feature (428)..(428): n is a, c, g, or t
  misc_feature (430)..(433): n is a, c, g, or t
  misc_feature (436)..(436): n is a, c, g, or t
  misc_feature (438)..(438): n is a, c, g, or t
  misc_feature (441)..(443): n is a, c, g, or t
  misc_feature (446)..(446): n is a, c, g, or t
  misc_feature (448)..(448): n is a, c, g, or t
  misc_feature (450)..(451): n is a, c, g, or t
  misc_feature (453)..(453): n is a, c, g, or t
  misc_feature (455)..(456): n is a, c, g, or t
  misc_feature (459)..(460): n is a, c, g, or t
  misc_feature (462)..(466): n is a, c, g, or t
  misc_feature (468)..(468): n is a, c, g, or t
  misc_feature (470)..(475): n is a, c, g, or t
  misc_feature (477)..(478): n is a, c, g, or t
  misc_feature (480)..(482): n is a, c, g, or t
  misc_feature (484)..(484): n is a, c, g, or t
  misc_feature (487)..(488): n is a, c, g, or t
  misc_feature (490)..(491): n is a, c, g, or t
  misc_feature (493)..(493): n is a, c, g, or t
  misc_feature (498)..(505): n is a, c, g, or t
  misc_feature (510)..(510): n is a, c, g, or t
  misc_feature (513)..(513): n is a, c, g, or t
  misc_feature (517)..(518): n is a, c, g, or t
  misc_feature (521)..(522): n is a, c, g, or t
  misc_feature (525)..(526): n is a, c, g, or t
  misc_feature (528)..(530): n is a, c, g, or t
  misc_feature (533)..(534): n is a, c, g, or t
  misc_feature (536)..(538): n is a, c, g, or t
  misc_feature (540)..(544): n is a, c, g, or t
  misc_feature (546)..(547): n is a, c, g, or t
  misc_feature (549)..(549): n is a, c, g, or t
  misc_feature (551)..(552): n is a, c, g, or t
  misc_feature (554)..(561): n is a, c, g, or t
  misc_feature (563)..(564): n is a, c, g, or t
  misc_feature (567)..(568): n is a, c, g, or t
  misc_feature (570)..(570): n is a, c, g, or t
  misc_feature (572)..(573): n is a, c, g, or t
  misc_feature (575)..(575): n is a, c, g, or t
  misc_feature (577)..(577): n is a, c, g, or t
  misc_feature (579)..(580): n is a, c, g, or t
  misc_feature (590)..(590): n is a, c, g, or t
  misc_feature (592)..(593): n is a, c, g, or t
  misc_feature (595)..(595): n is a, c, g, or t
  misc_feature (597)..(600): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (617)..(620): n is a, c, g, or t
  misc_feature (624)..(625): n is a, c, g, or t
  misc_feature (627)..(630): n is a, c, g, or t
  misc_feature (632)..(632): n is a, c, g, or t
  misc_feature (634)..(638): n is a, c, g, or t
  misc_feature (640)..(640): n is a, c, g, or t
  misc_feature (644)..(644): n is a, c, g, or t
  misc_feature (647)..(648): n is a, c, g, or t
  misc_feature (650)..(650): n is a, c, g, or t
  misc_feature (655)..(655): n is a, c, g, or t
  misc_feature (659)..(659): n is a, c, g, or t
  misc_feature (661)..(661): n is a, c, g, or t
  misc_feature (663)..(663): n is a, c, g, or t
  misc_feature (665)..(666): n is a, c, g, or t
  misc_feature (669)..(669): n is a, c, g, or t
  misc_feature (671)..(671): n is a, c, g, or t
  misc_feature (673)..(674): n is a, c, g, or t
  misc_feature (676)..(678): n is a, c, g, or t
  misc_feature (680)..(680): n is a, c, g, or t
  misc_feature (683)..(683): n is a, c, g, or t
  misc_feature (685)..(692): n is a, c, g, or t
  misc_feature (695)..(697): n is a, c, g, or t
  misc_feature (700)..(701): n is a, c, g, or t
  misc_feature (703)..(703): n is a, c, g, or t
  misc_feature (705)..(705): n is a, c, g, or t
  misc_feature (707)..(707): n is a, c, g, or t
  misc_feature (709)..(709): n is a, c, g, or t
  misc_feature (712)..(713): n is a, c, g, or t
  misc_feature (715)..(715): n is a, c, g, or t
  misc_feature (719)..(719): n is a, c, g, or t
  misc_feature (723)..(724): n is a, c, g, or t
  misc_feature (726)..(728): n is a, c, g, or t
  misc_feature (730)..(730): n is a, c, g, or t
  misc_feature (732)..(733): n is a, c, g, or t
  misc_feature (736)..(739): n is a, c, g, or t
  misc_feature (741)..(743): n is a, c, g, or t
  misc_feature (745)..(746): n is a, c, g, or t
  misc_feature (748)..(748): n is a, c, g, or t
  misc_feature (750)..(750): n is a, c, g, or t
  misc_feature (752)..(752): n is a, c, g, or t
  misc_feature (756)..(758): n is a, c, g, or t
  misc_feature (762)..(763): n is a, c, g, or t
  misc_feature (765)..(765): n is a, c, g, or t
  misc_feature (767)..(768): n is a, c, g, or t
  misc_feature (770)..(770): n is a, c, g, or t
  misc_feature (773)..(774): n is a, c, g, or t
  misc_feature (776)..(776): n is a, c, g, or t
  misc_feature (779)..(779): n is a, c, g, or t
  misc_feature (784)..(784): n is a, c, g, or t
  misc_feature (786)..(786): n is a, c, g, or t
  misc_feature (789)..(792): n is a, c, g, or t
  misc_feature (794)..(795): n is a, c, g, or t
  misc_feature (799)..(799): n is a, c, g, or t
  misc_feature (801)..(801): n is a, c, g, or t
  misc_feature (803)..(803): n is a, c, g, or t
  misc_feature (807)..(808): n is a, c, g, or t
  misc_feature (811)..(812): n is a, c, g, or t
  misc_feature (815)..(816): n is a, c, g, or t
  misc_feature (818)..(821): n is a, c, g, or t
  misc_feature (823)..(823): n is a, c, g, or t
  misc_feature (828)..(829): n is a, c, g, or t
  misc_feature (833)..(833): n is a, c, g, or t
  misc_feature (835)..(838): n is a, c, g, or t
  misc_feature (840)..(842): n is a, c, g, or t
  misc_feature (844)..(844): n is a, c, g, or t
  misc_feature (847)..(847): n is a, c, g, or t
  misc_feature (849)..(849): n is a, c, g, or t
  misc_feature (853)..(853): n is a, c, g, or t
  misc_feature (856)..(856): n is a, c, g, or t
  misc_feature (858)..(862): n is a, c, g, or t
  misc_feature (864)..(865): n is a, c, g, or t
  misc_feature (867)..(868): n is a, c, g, or t
  misc_feature (870)..(871): n is a, c, g, or t
  misc_feature (873)..(873): n is a, c, g, or t
  misc_feature (875)..(876): n is a, c, g, or t
  misc_feature (879)..(879): n is a, c, g, or t
  misc_feature (883)..(883): n is a, c, g, or t
  misc_feature (885)..(888): n is a, c, g, or t
  misc_feature (890)..(892): n is a, c, g, or t
  misc_feature (896)..(896): n is a, c, g, or t
  misc_feature (899)..(899): n is a, c, g, or t
  misc_feature (901)..(902): n is a, c, g, or t
  misc_feature (904)..(904): n is a, c, g, or t
  misc_feature (907)..(907): n is a, c, g, or t
  misc_feature (909)..(910): n is a, c, g, or t
  misc_feature (912)..(913): n is a, c, g, or t
  misc_feature (916)..(920): n is a, c, g, or t
  misc_feature (922)..(922): n is a, c, g, or t
  misc_feature (924)..(930): n is a, c, g, or t
  misc_feature (933)..(934): n is a, c, g, or t
  misc_feature (936)..(937): n is a, c, g, or t
  misc_feature (940)..(940): n is a, c, g, or t
  misc_feature (946)..(946): n is a, c, g, or t
  misc_feature (950)..(956): n is a, c, g, or t
  misc_feature (960)..(961): n is a, c, g, or t
  misc_feature (964)..(964): n is a, c, g, or t
  misc_feature (966)..(967): n is a, c, g, or t
  misc_feature (971)..(973): n is a, c, g, or t
  misc_feature (976)..(979): n is a, c, g, or t
  misc_feature (982)..(982): n is a, c, g, or t
  misc_feature (984)..(984): n is a, c, g, or t
  misc_feature (988)..(990): n is a, c, g, or t
  misc_feature (993)..(993): n is a, c, g, or t
  misc_feature (995)..(995): n is a, c, g, or t
  misc_feature (997)..(997): n is a, c, g, or t
  misc_feature (1003)..(1003): n is a, c, g, or t
  misc_feature (1006)..(1006): n is a, c, g, or t
  misc_feature (1010)..(1011): n is a, c, g, or t
  misc_feature (1014)..(1014): n is a, c, g, or t
  misc_feature (1016)..(1016): n is a, c, g, or t
  misc_feature (1019)..(1019): n is a, c, g, or t
  misc_feature (1021)..(1022): n is a, c, g, or t
  misc_feature (1024)..(1024): n is a, c, g, or t
  misc_feature (1026)..(1026): n is a, c, g, or t
  misc_feature (1028)..(1031): n is a, c, g, or t
  misc_feature (1033)..(1033): n is a, c, g, or t
  misc_feature (1037)..(1037): n is a, c, g, or t
  misc_feature (1040)..(1040): n is a, c, g, or t
  misc_feature (1045)..(1045): n is a, c, g, or t
  misc_feature (1048)..(1048): n is a, c, g, or t
  misc_feature (1050)..(1050): n is a, c, g, or t
  misc_feature (1054)..(1054): n is a, c, g, or t
  misc_feature (1056)..(1056): n is a, c, g, or t
  misc_feature (1058)..(1058): n is a, c, g, or t
  misc_feature (1060)..(1061): n is a, c, g, or t
  misc_feature (1064)..(1064): n is a, c, g, or t
  misc_feature (1066)..(1067): n is a, c, g, or t
  misc_feature (1069)..(1070): n is a, c, g, or t
  misc_feature (1073)..(1073): n is a, c, g, or t
  misc_feature (1075)..(1075): n is a, c, g, or t
  misc_feature (1077)..(1078): n is a, c, g, or t
  misc_feature (1080)..(1080): n is a, c, g, or t
  misc_feature (1083)..(1083): n is a, c, g, or t
  misc_feature (1085)..(1086): n is a, c, g, or t
  misc_feature (1089)..(1091): n is a, c, g, or t
  misc_feature (1094)..(1096): n is a, c, g, or t
  misc_feature (1098)..(1098): n is a, c, g, or t
  misc_feature (1102)..(1104): n is a, c, g, or t
  misc_feature (1107)..(1107): n is a, c, g, or t
  misc_feature (1110)..(1110): n is a, c, g, or t
  misc_feature (1114)..(1116): n is a, c, g, or t
  misc_feature (1118)..(1121): n is a, c, g, or t
  misc_feature (1124)..(1124): n is a, c, g, or t
  misc_feature (1126)..(1126): n is a, c, g, or t
  misc_feature (1128)..(1133): n is a, c, g, or t
  misc_feature (1135)..(1135): n is a, c, g, or t
  misc_feature (1137)..(1137): n is a, c, g, or t
  misc_feature (1144)..(1144): n is a, c, g, or t
  misc_feature (1148)..(1149): n is a, c, g, or t
  misc_feature (1152)..(1153): n is a, c, g, or t
  misc_feature (1157)..(1158): n is a, c, g, or t
  misc_feature (1160)..(1160): n is a, c, g, or t
  misc_feature (1162)..(1163): n is a, c, g, or t
  misc_feature (1166)..(1168): n is a, c, g, or t
  misc_feature (1172)..(1172): n is a, c, g, or t
  misc_feature (1175)..(1178): n is a, c, g, or t
  misc_feature (1180)..(1180): n is a, c, g, or t
  misc_feature (1182)..(1183): n is a, c, g, or t
  misc_feature (1186)..(1188): n is a, c, g, or t
  misc_feature (1191)..(1191): n is a, c, g, or t
  misc_feature (1198)..(1198): n is a, c, g, or t
  misc_feature (1200)..(1200): n is a, c, g, or t
  misc_feature (1205)..(1207): n is a, c, g, or t
  misc_feature (1267)..(1267): n is a, c, g, or t
  misc_feature (1423)..(1423): n is a, c, g, or t
  misc_feature (1517)..(1517): n is a, c, g, or t
  misc_feature (1967)..(1967): n is a, c, g, or t
  misc_feature (1969)..(1969): n is a, c, g, or t
  misc_feature (1972)..(1972): n is a, c, g, or t
  misc_feature (1983)..(1986): n is a, c, g, or t
  misc_feature (1988)..(1993): n is a, c, g, or t
  misc_feature (2000)..(2003): n is a, c, g, or t
  misc_feature (2005)..(2011): n is a, c, g, or t
  misc_feature (2013)..(2014): n is a, c, g, or t
  misc_feature (2016)..(2021): n is a, c, g, or t
  misc_feature (2023)..(2026): n is a, c, g, or t
  misc_feature (2030)..(2031): n is a, c, g, or t
  misc_feature (2034)..(2036): n is a, c, g, or t
  misc_feature (2038)..(2043): n is a, c, g, or t
  misc_feature (2051)..(2051): n is a, c, g, or t
  misc_feature (2331)..(2331): n is a, c, g, or t
  misc_feature (2384)..(2384): n is a, c, g, or t
  misc_feature (2430)..(2430): n is a, c, g, or t
  misc_feature (2443)..(2443): n is a, c, g, or t
  misc_feature (2468)..(2470): n is a, c, g, or t
  misc_feature (2479)..(2489): n is a, c, g, or t
  misc_feature (2496)..(2496): n is a, c, g, or t
  misc_feature (2498)..(2498): n is a, c, g, or t
  misc_feature (2500)..(2502): n is a, c, g, or t
  misc_feature (2504)..(2508): n is a, c, g, or t
  misc_feature (2510)..(2513): n is a, c, g, or t
  misc_feature (2515)..(2519): n is a, c, g, or t
  misc_feature (2521)..(2526): n is a, c, g, or t
  misc_feature (2528)..(2529): n is a, c, g, or t
  misc_feature (2531)..(2537): n is a, c, g, or t
  misc_feature (2540)..(2544): n is a, c, g, or t
  misc_feature (2547)..(2560): n is a, c, g, or t
  misc_feature (2562)..(2562): n is a, c, g, or t
  misc_feature (2564)..(2578): n is a, c, g, or t
  misc_feature (2580)..(2583): n is a, c, g, or t
  misc_feature (2586)..(2593): n is a, c, g, or t
  misc_feature (2595)..(2596): n is a, c, g, or t
  misc_feature (2600)..(2600): n is a, c, g, or t
  misc_feature (2605)..(2607): n is a, c, g, or t
  misc_feature (2613)..(2614): n is a, c, g, or t
  misc_feature (2616)..(2618): n is a, c, g, or t
  misc_feature (2621)..(2623): n is a, c, g, or t
  misc_feature (2626)..(2628): n is a, c, g, or t
  misc_feature (2630)..(2630): n is a, c, g, or t
  misc_feature (2632)..(2632): n is a, c, g, or t
  misc_feature (2636)..(2637): n is a, c, g, or t
  misc_feature (2639)..(2639): n is a, c, g, or t
  misc_feature (2641)..(2646): n is a, c, g, or t
  misc_feature (2649)..(2649): n is a, c, g, or t
  misc_feature (2651)..(2651): n is a, c, g, or t
  misc_feature (2653)..(2656): n is a, c, g, or t
  misc_feature (2658)..(2658): n is a, c, g, or t
  misc_feature (2660)..(2666): n is a, c, g, or t
  misc_feature (2668)..(2669): n is a, c, g, or t
  misc_feature (2671)..(2671): n is a, c, g, or t
  misc_feature (2673)..(2674): n is a, c, g, or t
  misc_feature (2676)..(2676): n is a, c, g, or t
  misc_feature (2678)..(2686): n is a, c, g, or t
  misc_feature (2688)..(2688): n is a, c, g, or t
  misc_feature (2693)..(2711): n is a, c, g, or t
  misc_feature (2713)..(2715): n is a, c, g, or t
  misc_feature (2717)..(2717): n is a, c, g, or t
  misc_feature (2719)..(2719): n is a, c, g, or t
  misc_feature (2721)..(2725): n is a, c, g, or t
  misc_feature (2727)..(2732): n is a, c, g, or t
  misc_feature (2734)..(2735): n is a, c, g, or t
  misc_feature (2737)..(2742): n is a, c, g, or t
  misc_feature (2745)..(2749): n is a, c, g, or t
  misc_feature (2752)..(2752): n is a, c, g, or t
  misc_feature (2754)..(2758): n is a, c, g, or t
  misc_feature (2760)..(2760): n is a, c, g, or t
  misc_feature (2762)..(2766): n is a, c, g, or t
  misc_feature (2768)..(2769): n is a, c, g, or t
  misc_feature (2771)..(2772): n is a, c, g, or t
  misc_feature (2774)..(2775): n is a, c, g, or t
  misc_feature (2778)..(2779): n is a, c, g, or t
  misc_feature (2781)..(2783): n is a, c, g, or t
  misc_feature (2785)..(2785): n is a, c, g, or t
  misc_feature (2787)..(2787): n is a, c, g, or t
  misc_feature (2790)..(2795): n is a, c, g, or t
  misc_feature (2797)..(2803): n is a, c, g, or t
  misc_feature (2806)..(2807): n is a, c, g, or t
  misc_feature (2809)..(2809): n is a, c, g, or t
  misc_feature (2811)..(2814): n is a, c, g, or t
  misc_feature (2821)..(2821): n is a, c, g, or t
  misc_feature (2825)..(2825): n is a, c, g, or t
  misc_feature (2829)..(2829): n is a, c, g, or t
  misc_feature (2832)..(2833): n is a, c, g, or t
  misc_feature (2835)..(2835): n is a, c, g, or t
  misc_feature (2837)..(2838): n is a, c, g, or t
  misc_feature (2840)..(2840): n is a, c, g, or t
  misc_feature (2843)..(2845): n is a, c, g, or t
  misc_feature (2847)..(2848): n is a, c, g, or t
  misc_feature (2850)..(2854): n is a, c, g, or t
  misc_feature (2856)..(2856): n is a, c, g, or t
  misc_feature (2859)..(2859): n is a, c, g, or t
  misc_feature (2861)..(2861): n is a, c, g, or t
  misc_feature (2863)..(2865): n is a, c, g, or t
  misc_feature (2867)..(2870): n is a, c, g, or t
  misc_feature (2872)..(2872): n is a, c, g, or t
  misc_feature (2874)..(2893): n is a, c, g, or t
  misc_feature (2895)..(2905): n is a, c, g, or t
  misc_feature (2907)..(2910): n is a, c, g, or t
  misc_feature (2914)..(2914): n is a, c, g, or t
  misc_feature (2916)..(2917): n is a, c, g, or t
  misc_feature (2919)..(2920): n is a, c, g, or t
  misc_feature (2922)..(2922): n is a, c, g, or t
  misc_feature (2926)..(2926): n is a, c, g, or t
  misc_feature (2929)..(2929): n is a, c, g, or t
  misc_feature (2931)..(2934): n is a, c, g, or t
  misc_feature (2936)..(2945): n is a, c, g, or t
  misc_feature (2947)..(2947): n is a, c, g, or t
  misc_feature (2949)..(2950): n is a, c, g, or t
  misc_feature (2952)..(2960): n is a, c, g, or t
  misc_feature (2962)..(2962): n is a, c, g, or t
  misc_feature (2964)..(2964): n is a, c, g, or t
  misc_feature (2967)..(2967): n is a, c, g, or t
  misc_feature (2971)..(2971): n is a, c, g, or t
  misc_feature (2973)..(2973): n is a, c, g, or t
  misc_feature (2977)..(2977): n is a, c, g, or t
  misc_feature (2979)..(2979): n is a, c, g, or t
  misc_feature (2981)..(2981): n is a, c, g, or t
  misc_feature (2985)..(2986): n is a, c, g, or t
  misc_feature (2988)..(2988): n is a, c, g, or t
  misc_feature (2990)..(2990): n is a, c, g, or t
  misc_feature (2992)..(2994): n is a, c, g, or t
  misc_feature (2998)..(2999): n is a, c, g, or t
  misc_feature (3002)..(3003): n is a, c, g, or t
  misc_feature (3007)..(3010): n is a, c, g, or t
  misc_feature (3012)..(3016): n is a, c, g, or t
  misc_feature (3018)..(3020): n is a, c, g, or t
  misc_feature (3024)..(3024): n is a, c, g, or t
  misc_feature (3026)..(3031): n is a, c, g, or t
  misc_feature (3033)..(3038): n is a, c, g, or t
  misc_feature (3041)..(3042): n is a, c, g, or t
  misc_feature (3044)..(3044): n is a, c, g, or t
  misc_feature (3046)..(3046): n is a, c, g, or t
  misc_feature (3048)..(3049): n is a, c, g, or t
  misc_feature (3054)..(3073): n is a, c, g, or t
  misc_feature (3075)..(3075): n is a, c, g, or t
  misc_feature (3077)..(3078): n is a, c, g, or t
  misc_feature (3080)..(3080): n is a, c, g, or t
  misc_feature (3082)..(3082): n is a, c, g, or t
  misc_feature (3084)..(3085): n is a, c, g, or t
  misc_feature (3089)..(3090): n is a, c, g, or t
  misc_feature (3094)..(3095): n is a, c, g, or t
  misc_feature (3097)..(3098): n is a, c, g, or t
  misc_feature (3102)..(3105): n is a, c, g, or t
  misc_feature (3109)..(3109): n is a, c, g, or t
  misc_feature (3111)..(3112): n is a, c, g, or t
  misc_feature (3114)..(3114): n is a, c, g, or t
  misc_feature (3119)..(3121): n is a, c, g, or t
  misc_feature (3124)..(3125): n is a, c, g, or t
  misc_feature (3127)..(3128): n is a, c, g, or t
  misc_feature (3130)..(3131): n is a, c, g, or t
  misc_feature (3133)..(3133): n is a, c, g, or t
  misc_feature (3135)..(3135): n is a, c, g, or t
  misc_feature (3137)..(3140): n is a, c, g, or t
  misc_feature (3147)..(3148): n is a, c, g, or t
  misc_feature (3153)..(3153): n is a, c, g, or t
  misc_feature (3158)..(3159): n is a, c, g, or t
  misc_feature (3163)..(3163): n is a, c, g, or t
  misc_feature (3167)..(3169): n is a, c, g, or t
  misc_feature (3172)..(3173): n is a, c, g, or t
  misc_feature (3175)..(3175): n is a, c, g, or t
  misc_feature (3178)..(3178): n is a, c, g, or t
  misc_feature (3181)..(3184): n is a, c, g, or t
  misc_feature (3186)..(3187): n is a, c, g, or t
  misc_feature (3190)..(3191): n is a, c, g, or t
  misc_feature (3193)..(3194): n is a, c, g, or t
  misc_feature (3196)..(3197): n is a, c, g, or t
  misc_feature (3200)..(3200): n is a, c, g, or t
  misc_feature (3204)..(3204): n is a, c, g, or t
  misc_feature (3206)..(3207): n is a, c, g, or t
  misc_feature (3209)..(3209): n is a, c, g, or t
  misc_feature (3211)..(3212): n is a, c, g, or t
  misc_feature (3215)..(3217): n is a, c, g, or t
  misc_feature (3220)..(3221): n is a, c, g, or t
  misc_feature (3223)..(3224): n is a, c, g, or t
  misc_feature (3226)..(3228): n is a, c, g, or t
  misc_feature (3233)..(3233): n is a, c, g, or t
  misc_feature (3236)..(3237): n is a, c, g, or t
  misc_feature (3245)..(3246): n is a, c, g, or t
  misc_feature (3250)..(3256): n is a, c, g, or t
  misc_feature (3258)..(3259): n is a, c, g, or t
  misc_feature (3263)..(3264): n is a, c, g, or t
  misc_feature (3267)..(3267): n is a, c, g, or t
  misc_feature (3269)..(3269): n is a, c, g, or t
  misc_feature (3275)..(3278): n is a, c, g, or t
  misc_feature (3280)..(3284): n is a, c, g, or t
  misc_feature (3286)..(3287): n is a, c, g, or t
  misc_feature (3289)..(3293): n is a, c, g, or t
  misc_feature (3300)..(3309): n is a, c, g, or t
  misc_feature (3311)..(3311): n is a, c, g, or t
  misc_feature (3313)..(3313): n is a, c, g, or t
  misc_feature (3315)..(3316): n is a, c, g, or t
  misc_feature (3318)..(3318): n is a, c, g, or t
  misc_feature (3322)..(3322): n is a, c, g, or t
  misc_feature (3325)..(3326): n is a, c, g, or t
  misc_feature (3328)..(3328): n is a, c, g, or t
  misc_feature (3331)..(3332): n is a, c, g, or t
  misc_feature (3334)..(3338): n is a, c, g, or t
  misc_feature (3340)..(3341): n is a, c, g, or t
  misc_feature (3343)..(3344): n is a, c, g, or t
  misc_feature (3347)..(3349): n is a, c, g, or t
  misc_feature (3353)..(3353): n is a, c, g, or t
  misc_feature (3355)..(3358): n is a, c, g, or t
  misc_feature (3360)..(3363): n is a, c, g, or t
  misc_feature (3365)..(3365): n is a, c, g, or t
  misc_feature (3367)..(3372): n is a, c, g, or t
  misc_feature (3374)..(3375): n is a, c, g, or t
  misc_feature (3377)..(3378): n is a, c, g, or t
  misc_feature (3380)..(3380): n is a, c, g, or t
  misc_feature (3383)..(3383): n is a, c, g, or t
  misc_feature (3386)..(3386): n is a, c, g, or t
  misc_feature (3388)..(3389): n is a, c, g, or t
  misc_feature (3391)..(3392): n is a, c, g, or t
  misc_feature (3394)..(3396): n is a, c, g, or t
  misc_feature (3398)..(3398): n is a, c, g, or t
  misc_feature (3400)..(3401): n is a, c, g, or t
  misc_feature (3404)..(3405): n is a, c, g, or t
  misc_feature (3415)..(3416): n is a, c, g, or t
  misc_feature (3419)..(3419): n is a, c, g, or t
  misc_feature (3421)..(3421): n is a, c, g, or t
  misc_feature (3423)..(3424): n is a, c, g, or t
  misc_feature (3427)..(3427): n is a, c, g, or t
  misc_feature (3429)..(3430): n is a, c, g, or t
  misc_feature (3432)..(3433): n is a, c, g, or t
  misc_feature (3435)..(3436): n is a, c, g, or t
  misc_feature (3438)..(3439): n is a, c, g, or t
  misc_feature (3441)..(3441): n is a, c, g, or t
  misc_feature (3444)..(3445): n is a, c, g, or t
  misc_feature (3447)..(3451): n is a, c, g, or t
  misc_feature (3453)..(3454): n is a, c, g, or t
  misc_feature (3456)..(3458): n is a, c, g, or t
  misc_feature (3461)..(3464): n is a, c, g, or t
  misc_feature (3467)..(3467): n is a, c, g, or t
  misc_feature (3469)..(3469): n is a, c, g, or t
  misc_feature (3473)..(3473): n is a, c, g, or t
  misc_feature (3475)..(3483): n is a, c, g, or t
  misc_feature (3485)..(3487): n is a, c, g, or t
  misc_feature (3491)..(3491): n is a, c, g, or t
  misc_feature (3493)..(3495): n is a, c, g, or t
  misc_feature (3497)..(3499): n is a, c, g, or t
  misc_feature (3501)..(3502): n is a, c, g, or t
  misc_feature (3505)..(3507): n is a, c, g, or t
  misc_feature (3509)..(3514): n is a, c, g, or t
  misc_feature (3517)..(3517): n is a, c, g, or t
  misc_feature (3519)..(3519): n is a, c, g, or t
  misc_feature (3521)..(3521): n is a, c, g, or t
  misc_feature (3523)..(3524): n is a, c, g, or t
  misc_feature (3527)..(3528): n is a, c, g, or t
  misc_feature (3532)..(3532): n is a, c, g, or t
  misc_feature (3534)..(3534): n is a, c, g, or t
  misc_feature (3536)..(3536): n is a, c, g, or t
  misc_feature (3540)..(3540): n is a, c, g, or t
  misc_feature (3543)..(3543): n is a, c, g, or t
  misc_feature (3548)..(3548): n is a, c, g, or t
  misc_feature (3551)..(3551): n is a, c, g, or t
  misc_feature (3553)..(3555): n is a, c, g, or t
  misc_feature (3560)..(3560): n is a, c, g, or t
  misc_feature (3562)..(3562): n is a, c, g, or t
  misc_feature (3565)..(3565): n is a, c, g, or t
  misc_feature (3567)..(3568): n is a, c, g, or t
  misc_feature (3574)..(3579): n is a, c, g, or t
  misc_feature (3581)..(3582): n is a, c, g, or t
  misc_feature (3584)..(3585): n is a, c, g, or t
  misc_feature (3587)..(3587): n is a, c, g, or t
  misc_feature (3592)..(3593): n is a, c, g, or t
  misc_feature (3596)..(3597): n is a, c, g, or t
  misc_feature (3601)..(3601): n is a, c, g, or t
  misc_feature (3605)..(3605): n is a, c, g, or t
  misc_feature (3607)..(3607): n is a, c, g, or t
  misc_feature (3609)..(3612): n is a, c, g, or t
  misc_feature (3614)..(3614): n is a, c, g, or t
  misc_feature (3617)..(3617): n is a, c, g, or t
  misc_feature (3620)..(3620): n is a, c, g, or t
  misc_feature (3623)..(3624): n is a, c, g, or t
  misc_feature (3626)..(3627): n is a, c, g, or t
  misc_feature (3629)..(3629): n is a, c, g, or t
  misc_feature (3632)..(3632): n is a, c, g, or t
  misc_feature (3636)..(3636): n is a, c, g, or t
  misc_feature (3638)..(3638): n is a, c, g, or t
  misc_feature (3643)..(3646): n is a, c, g, or t
  misc_feature (3651)..(3651): n is a, c, g, or t
  misc_feature (3654)..(3654): n is a, c, g, or t
  misc_feature (3657)..(3659): n is a, c, g, or t
  misc_feature (3661)..(3662): n is a, c, g, or t
  misc_feature (3664)..(3664): n is a, c, g, or t
  misc_feature (3667)..(3668): n is a, c, g, or t
  misc_feature (3671)..(3671): n is a, c, g, or t
  misc_feature (3676)..(3676): n is a, c, g, or t
  misc_feature (3679)..(3680): n is a, c, g, or t
  misc_feature (3683)..(3683): n is a, c, g, or t
  misc_feature (3686)..(3687): n is a, c, g, or t
  misc_feature (3689)..(3691): n is a, c, g, or t
  misc_feature (3695)..(3698): n is a, c, g, or t
  misc_feature (3702)..(3703): n is a, c, g, or t
  misc_feature (3706)..(3708): n is a, c, g, or t
  misc_feature (3711)..(3714): n is a, c, g, or t
  misc_feature (3718)..(3719): n is a, c, g, or t
  misc_feature (3724)..(3724): n is a, c, g, or t
  misc_feature (3727)..(3728): n is a, c, g, or t
  misc_feature (3730)..(3730): n is a, c, g, or t
  misc_feature (3736)..(3737): n is a, c, g, or t
  misc_feature (3741)..(3741): n is a, c, g, or t
  misc_feature (3744)..(3744): n is a, c, g, or t
  misc_feature (3748)..(3749): n is a, c, g, or t
  misc_feature (3751)..(3754): n is a, c, g, or t
  misc_feature (3756)..(3756): n is a, c, g, or t
  misc_feature (3758)..(3758): n is a, c, g, or t
  misc_feature (3763)..(3763): n is a, c, g, or t
  misc_feature (3765)..(3765): n is a, c, g, or t
  misc_feature (3770)..(3770): n is a, c, g, or t
  misc_feature (3773)..(3774): n is a, c, g, or t
  misc_feature (3779)..(3781): n is a, c, g, or t
  misc_feature (3785)..(3785): n is a, c, g, or t
  misc_feature (3787)..(3789): n is a, c, g, or t
  misc_feature (3792)..(3793): n is a, c, g, or t
  misc_feature (3795)..(3795): n is a, c, g, or t
  misc_feature (3797)..(3797): n is a, c, g, or t
  misc_feature (3800)..(3802): n is a, c, g, or t
  misc_feature (3804)..(3805): n is a, c, g, or t
  misc_feature (3810)..(3811): n is a, c, g, or t
  misc_feature (3814)..(3814): n is a, c, g, or t
  misc_feature (3816)..(3816): n is a, c, g, or t
  misc_feature (3819)..(3819): n is a, c, g, or t
  misc_feature (3822)..(3822): n is a, c, g, or t
  misc_feature (3824)..(3826): n is a, c, g, or t
  misc_feature (3834)..(3837): n is a, c, g, or t
  misc_feature (3839)..(3841): n is a, c, g, or t
  misc_feature (3843)..(3843): n is a, c, g, or t
  misc_feature (3845)..(3846): n is a, c, g, or t
  misc_feature (3848)..(3848): n is a, c, g, or t
  misc_feature (3852)..(3852): n is a, c, g, or t
  misc_feature (3854)..(3855): n is a, c, g, or t
  misc_feature (3858)..(3862): n is a, c, g, or t
  misc_feature (3865)..(3867): n is a, c, g, or t
  misc_feature (3869)..(3869): n is a, c, g, or t
  misc_feature (3871)..(3871): n is a, c, g, or t
  misc_feature (3875)..(3876): n is a, c, g, or t
  misc_feature (3878)..(3878): n is a, c, g, or t
  misc_feature (3880)..(3881): n is a, c, g, or t
  misc_feature (3888)..(3888): n is a, c, g, or t
  misc_feature (3890)..(3890): n is a, c, g, or t
  misc_feature (3893)..(3894): n is a, c, g, or t
  misc_feature (3896)..(3900): n is a, c, g, or t
  misc_feature (3902)..(3902): n is a, c, g, or t
  misc_feature (3908)..(3909): n is a, c, g, or t
  misc_feature (3911)..(3911): n is a, c, g, or t
  misc_feature (3915)..(3917): n is a, c, g, or t
  misc_feature (3920)..(3921): n is a, c, g, or t
  misc_feature (3923)..(3923): n is a, c, g, or t
  misc_feature (3925)..(3925): n is a, c, g, or t
  misc_feature (3929)..(3930): n is a, c, g, or t
  misc_feature (3932)..(3935): n is a, c, g, or t
  misc_feature (3940)..(3940): n is a, c, g, or t
  misc_feature (3944)..(3945): n is a, c, g, or t
  misc_feature (3948)..(3948): n is a, c, g, or t
  misc_feature (3950)..(3955): n is a, c, g, or t
  misc_feature (3957)..(3957): n is a, c, g, or t
  misc_feature (3960)..(3960): n is a, c, g, or t
  misc_feature (3962)..(3962): n is a, c, g, or t
  misc_feature (3964)..(3964): n is a, c, g, or t
  misc_feature (3966)..(3966): n is a, c, g, or t
  misc_feature (3971)..(3971): n is a, c, g, or t
  misc_feature (3974)..(3974): n is a, c, g, or t
  misc_feature (3980)..(3980): n is a, c, g, or t
  misc_feature (3983)..(3983): n is a, c, g, or t
  misc_feature (3985)..(3986): n is a, c, g, or t
  misc_feature (3989)..(3989): n is a, c, g, or t
  misc_feature (3992)..(3992): n is a, c, g, or t
  misc_feature (3994)..(3994): n is a, c, g, or t
  misc_feature (3996)..(3996): n is a, c, g, or t
  misc_feature (3998)..(3999): n is a, c, g, or t
ntannttnnatnntanngnannnnntnnnnnngnannnngnnnnnnnnnannaacaannnnnntanannncnnncnnncnnnnngntttnanntaananannanngnnnnnnnnntnnncnnnacagnnnngnnannananacannncnnnntnnnntngnangnnnngttnnnnnnnnannnnannnnancnnnnngnnnnnnnnttnnntntntnnnnnannncagnncannnnannatnntntnntngannnaaananannaaanntncnnnnannnnnnnttnnntttnnnnnnannnnannnnnnncncnnnnnnnnnnanaanagaaannannnnanngnaaannnnnnnngcnnnncnnaacnnaannnnctncnnnntannnnnanngnannnnaanaagaananannnacnnnannntntnnnnaananagnnnagngnannanannaannannnnngngnnnnnntnncnnngnagnnannanaaacnnnnnnnnaaaanaanaaannaannaanntnnngtnnannnannnnntnntnannannnnnnnncnnatnnangnntntntnnaaaaaaaaananncnannnnaanaanaanaaaaanannnngggnncnnnnangnnnnntnaaanaanncnaacanaatntnancnnaanantnngnnnanaanannnnnnnnttnnnggnnanantntnganntnggtntttnncnnncncnnaannnntnnncnntngngnaagnnnaagnntnanntnttnnanaantttcncnaannnnanncccncngntttnnaannttnngnnnnanaaaanntttntnnnngnnnanaanangcgnganannnnntnnanntnnangnnaanaaangnnnntnnnaaanaantnngnttngnncnnaannnnnanannnnnnnttnngnnttnaaaaanaaannnnnnnaaannttntnnaaannnggnnnnaantnaaannnatntntntttttnaangggnnttntnttntnnanangnnnnangganaanttttnttntnaaantngncnnaananntnnaanantnngnaangnnagnnnaannncnaaannnggnggnaaannnannnnttntntnnnnnncncnaaaaaanaaanngtnnaaanntntnnaannnaaanttnnnncntnnggnnnttntttatanancctcnnngtaggtacgtgtaccaaaagagaaacaacgaaataatatttaaaagaagcaataatgccnaaacaaaaaacaaaatctagtgcaaagaagcgtttcaagctaacaggtactggtaaaatcaaaagaaagcacgcttttaagagtcacatcttaacaaagaagtctaaaaaacgtaagcttaaattaactcacgatggtttggtagacaaatctgangagagtaatgtaaaacaaatgcttcgaatgaagtaattgctttgcggttaactaaattttataaccctggagttaggccaatataaaagaactnacacaaatgagtcgcctgctacaaaaaacaattaaattatgccaagatcagtaaacagcgttgccaaaagagcacgtagaaaaaaagtattaaaacaagccaaaggttactttggaagaagaaagaatgtttggacggtagccaaaaatgcagtagacaaagcaatgtcttactcatacagagaccgtagaaacaaaaagagaacttttagagcattgtggatcacgcgtatcaacgcaggtgcacgccaacacggaatgtcttactctcaatttatgggagggatgaaaacagcaggaattgaattgaaccgtaaggttcttgcagatttagcaatgaatcatccagaagcttttgaagcaattgtaaagaaagtaaaataagacaatccaataatcatattatttcgtagtaaaaatcccgttgcaaatgcaacgggatttttttatntnctntacctaaaaannnngnnnnnnaaaaaannnncnnnnnnnanncnnnnnngnnnntttnnttnnnannnnnnaaagtgtnttacattttattaattctatctatcaaggctcttcctttagcttcaagctcttgatttactgctttaaaatgcgctttggcattctcaaggtctctttggttaacctttacaatcaattcatcaaatcctacaattgcatcatcaatgatagattgagactctttggtttcttttgaagggtttgttaactcccaaatgtatacagcttcaatgatatctcccattacgtagttgatatctttttttaaatctctcttatttgccataatgtgttccgcnaagtgcggtttttaaattactaattaataagttgcaaagttacaaactcttanacaatataaccttgcaaaagtaaagcagttttttctttaattttcntaccataacaacnccaattagacatcctctggcctacnnntcaaaaaannnnnnnnnnnttttttntntnnntnnnnntnnnncnnnnnannnnnngnntnnnnnnnaannnnnctnnnnnnnnnnnnnntnannnnnnnnnnnnnnnannnnatnnnnnnnntnnaatnttatnnnaaaccnnannntgnnntgnnntngntttnntntnnnnnntgncntnnnntncnnnnnnncnntncnntncnnnnnnnnnanctcgnnnnnnnnnnnnnnnnnnncnnnantntnnnnncnnnnnntnntnnnnnncannnnntgntnnnnnantnnnnnannanncnntgnntnnnananaannnnnntnnnnnnngtnngntnnnnaacaaancccntctnttnntntnntnttnnngnncnnnnntntanantnnncnnnncntnnnnnnnnnnnnnnnnnnnngnnnnnnnnnnnannnnaggngnntnntntttntgnannnngnnnnnnnnnnanannannnnnnnnntntnatncaananaaanananaaanngntntnnntaannttnntttnnnntnnnnntnnntttntnnnnnnannnnnnttnncntntnnttttnnnnnnnnnnnnnnnnnnnntntnntntnanntaanntaanntnntttnnnncaanannanaaaannntanngnnanngnanannnnaaaaaanntaaantaaanncaangcannntanntnaancannnnannaanncnntnnaanaaanannancnnaannnttnntnnannnataanaannaaaaaaannaaannnnnnnannccannccnangcaaannnntnnnnntnngnnnnnaaaaaannnnnnnnnntncnannanaaanaannantannannnnnanncnnaannntaanannnntnnnntntnnnnnntnncnntngcnctngnncnngnnncngnngcnnttgcatttgnnttngntnnagntnnanncnnanntntanntnnnnntnntnnnttnnnnatngntatngnnnnnnnnntnnntggngnnngnnngnntannntnnnnnnagnancngnngcnntggnantngtantgnttttnctnannnaaaangnaantnnggttgnnnnnncnntnncngttcnnatnnaaancctngncnnnnantgnttnttnntnncnttnttantngttgnnnnaattnaanttnnngnngntannttnaaatnagnnaanttnntnnncctnnnncccnnccnnntannnntggnntttgnaanngntttggnnatcntantttnntnnnntnancttgntnttttnaannaaaannnaaangnnnaanngnantgnnngnntgggnntancnttnggntnnngttagggnnnntnnncntnncnatgncnnttnnnnntgnnntncntaanntnannaaaaaantnccnncnnnnntnattgcnntngtgnnngtnncngnaatnntnnnntttgnaaanntanannnnnntnccntngncncattnatnaaaganggngnnggngangnantnna

SEQ ID NO: 1362 - DNA, 4000 bp, Escherichia coli
  misc_feature (2189)..(2189): n is a, c, g, or t
  misc_feature (3703)..(3703): n is a, c, g, or t
ggaaagtccgtatggttcagttaaatgaatcttacagcaacgaaagtgaattgaaaaacctaatcataactttagagcgcgcacctaagcaaaaagcagttttaatggcgcttttaagtagtggaaattccaaggatgtttggcaggaagtcgaacatttaaaaaaacaggcagctgtaggaagtgctcctttcaaggcccttattgataggggtgtactcaaggaagagtttcaagaaaaaaatcgagtattaattcaatcaactccagatgagaataaggccaaaaccctttcacctgctcaaaatagagcctttattgaattgaatgaaaaattgaaaaaggatagggtagtattgtttgaaggggttactgcttcaggaaaaacagaggtctacattcgtttaatcgaagaagaattaaaaaagggcaagcaagtactctacctcttgcccgaaatttcacttacttcacagattgtttcacgcttatccgcacgttttggaagtcgggttttggtttatcattcgcgtttttccattcacgaaagaactgaagtttggaatcgagttttagaaggaaatcaaaaaggacaagttgtagtaggagcacgttctgcagtgttattgccttttaaagatatagggttagtgatagtagatgaagaacacgaaaactcctataagcagtttgaccctgcaccgagatatcaagcaagggacagtgctatttatctcgctaatgcaatgaatacttctgtggttttgggatctgcaactccctcgatggaaaccgctgaaaacgctcgaaatggaaaatacggctgggttaaattaacagcgcgttatggtggagtagctctacccaacatccagttaatcgaccttaaggaagctcatcgtaaaaagacaatgaaagaaatgttttcatttcaactgattgaagctattcaaaatacgttagagctaggtaaacaggttattttatttcaaaacagaagaggatatgcaccgataatggagtgtgaaagttgtggtcattcaccccagtgcacccaatgcgatgtctctatgacctatcatcaagcccaaaatcaattgaggtgtcattattgtgggtataacgttccaatgcccacccagtgtcatgcttgtggaatgccaacactatctactaaaggagtaggtactcaacagattgaagaacaaattcaaaaatattttcctcaagcctccgtgaggagaatggattgggatagtactagaggaaaatggagttttgatcaaattattgaagattttgacaaagaacgcatacaaatactggtgggtacccagatggtggtcaaagggttggattttaaaaatgtattattagtgggtgtgatcaatgcagatcatgttttgaatttacccgattttagagcacatgaaagaagttatcaaatgctctgtcaagttgcaggtcgtgctggtagatccgatcaaaaaggacaagtcttaatacagacctttcagccaagtcatccaatattacaacaagtaattaaccacgattttgatgctttatttgaagtgcaaaagaatgaacgaaagcaatttcgctatcctccttactttagaatgatacgtataactttcaaaagccgtcaatttgaaacagtaacaacagcctcagattggttttccagcgtaattaagcagtcttataaaggtactgtgcttggtcctgtattgcctcctgtgtctcgagtacgcaatcaatacatcaaacatttgataataaaagtagatcatcagctcaatacttcaacggtaaagaagttagtaaacaaaaccttcaagagttttcaggcgatagcggcttttcggtcggttcgggtaaattttgatgtagatccgtattaaaaataaaaaggaggaataaattcctcctttttgccccaaatcttaccatgaacttaacctacttatgttcaggtgatgtaaatgtagaataatattttgaaaaagcaaggacaataatatattaaataaaaaggaggaataaattcctcctttttgccccaaatcttaccatgaacttaacctacttatgttcaggtgatgtaaatgtagaataatattttttaaaagcaagaaaatatattaaataaatttttaaaatattcagcacaatttttattcaanaactcgtcctgtttttagattttatagaatgaaataatctttttattttattttgctttatcagaagagaactgtacttttgcagtcctaaaatataatatatgaatcattacgaatctgttttcattttaaatcccgttctatctgagactcagatagaggaagcagttcaaaagtatgttagctttattaaagcccaagaggggtcattgacccatcaagaaaattggggtcttaaaaagcttgcttatcctattgaaaataagaaaagcggcttctatcatcttcttgaatttactgctcctaacgaaactgtatcagctttagagctcgaatttcgcagagacgaacgcgtcatgcgctacctcactgtgaagttggacaagcacgcgcaagcatgggcggaaaaaagaaaaaaaagaaacaaagcaaaagcataagcaatgtctaagatagaagaacaaaacactggaaaaaaagaaggggaaattcgataccttaccccgttaaatatcgatacttcttcacagaaaaaatactgtcgtttcaaacgctcaggtattaagtatgtggactacaaggaccctgattttttattgaaatttgtaaatgagcaaggtaaaattttacctagaagacttaccggtacttctttaaaataccaacgtaaggtttctgtagctgttaaaagagcacgtcatctggctttaatgccttatgtagctgatatgttaaaataataaagcactcatcatggaattaatattaaaagaagacgtacaaaatcttgggtttaaagacgacatcgtgagtgttaaaaacggttacggtagaaattttttaattccccaagggaaagcagttatcgcaacaactactgctcgtaaggtgctggctgaaaatttaaaacaacgtgcttttaaagaacagtccatcatagatgaagcgaataaaagagccgatgaaatcaaagcccttgaaattaagttggcttctaaagtagggtcaggagacaaattgtttggatcaatcaccaatgcagatttagctcaagccatcagtgcaaagactagtgaacttgacaaaaagtttatttctcttcctggtaaatccatcaaacgcctcggtaaatacgttgcccaagtgaggttacaccgagaggtaagttttgaactaccatttgaaatagtggcagacactacagcctaaaactatcaaaacccactctcaagtgggtttttttatatccctttcctatgcgataccacaaactatcagaagcacagtttcgtgagatgcacaaagaattttctatatttttagcagctcaagggattaataaaaaagaatgggataaaataaaagaggagtcactggaaaaggttgatcatctcttgaatgcatttagtgatatggtatgggataggattataagtacttgtgcctatctagaattctcaaccccagatcagctatacctttttcatactcaagaaaagagtgcaacagtgttngtagtaaaaataagccctcaattcacagatttaactactgaagcaggttttgagatactcttgaatcagcttcattctgataaagtaacactgtacaccgcatcaaagccctacactcccagtagaaacgaatttatatatagttatttaaaaaagggggctaccctttcaaagggtgggcgctatagtcgtttacaaagttatttttccaattcgtcaaaataaaagatatttgtagaacaaaatacactatggcaattaaaccagcgacaacaaaagggacgcgtgatttttcat

SEQ ID NO: 1363 - DNA, 4000 bp, Escherichia coli
  misc_feature (1)..(1438): n is a, c, g, or t
  misc_feature (1484)..(1484): n is a, c, g, or t
  misc_feature (1489)..(1489): n is a, c, g, or t
  misc_feature (1497)..(1502): n is a, c, g, or t
  misc_feature (1507)..(1507): n is a, c, g, or t
  misc_feature (1509)..(1510): n is a, c, g, or t
  misc_feature (1512)..(1513): n is a, c, g, or t
  misc_feature (1515)..(1518): n is a, c, g, or t
  misc_feature (1520)..(1522): n is a, c, g, or t
  misc_feature (1524)..(1530): n is a, c, g, or t
  misc_feature (1532)..(1533): n is a, c, g, or t
  misc_feature (1536)..(1536): n is a, c, g, or t
  misc_feature (1538)..(1542): n is a, c, g, or t
  misc_feature (1544)..(1548): n is a, c, g, or t
  misc_feature (1551)..(1555): n is a, c, g, or t
  misc_feature (1985)..(1985): n is a, c, g, or t
  misc_feature (1992)..(1992): n is a, c, g, or t
  misc_feature (1996)..(1996): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcaataggaggaatgcttcgaagacatctcttccctaataaanttttnattaaaannnnnnaattnannanntnnnntnnnannnnnnntnnttnannnnntnnnnnatnnnnnaaaaaaaaaaaaaaaaaaaaaaaaaaaaaaaaaatcatgacaatatcactaatattaaatatttcctattttctccacaactttaaattactataattaaaatattatttctattattattatagaataaaaataacaaaataaataaattttatttaaaacttttttttttttaaaaattattaattttttttatttatttaatattctttttttacacatttataaatttaaaaattaaataataatgattaattacgagatacaaattatgaaaaaaaaaatgtatattctatttaaaattatttacttcgaaattataattagattataaaaataattattatacaaaattattttttctaaataaaaatataaaaaataaacataattatattattattaaaaattttgaaatttcgttgttttntttttantttnattttttaaaaaaaaaaaaaaaaaaaaaaaaaaaggaatgcttggattttgtttttttttataaatattaaattctaatcattttataaaaatacatataagttaaggataaaattaaactactttttcttctctttgaatgaattaattttatattttttttttctttatattcttttttttaaattgtaataattaaattatcaaattccatttaaatttttctgaatttttttgttattaataatttttagaatttcttttattgacttcattttatacagtgaattataaaaattctttaaattttatttcacctttttttcattttctttcttcttcttccttgctgaaaataaaattaagtgaaaaacaagatagacaatgaaatagctctttttctttttttttcgtaatattttttattgaaatactaattatttaatacttctaaatttttcaaaaattttctttggaatagataattcattttttttctttttttttgccttcattcaaatcaaaagcttcttttgtactttctttaaaagaataaataatttaatgaatataaaaatttaattcattaatacgaagaactcgaatgtaaaaaaatatatatatatttttttaaaacaagtttctcctaaaaataaattaaatgcttaaatggttgttttcctttatcatatttattgattttattcctttcctttctttttctttcttgttttaaaaatcttttgataaaaaaattttattcttcgaatgtgaaaacattttttctaaaaaaaaacttatattaataaaattaatattataattttatcttattcataataaattataaattatgtcataaaagattttttgtgtattttttttttgttttataattttttaaattatactttttttacaaattagtttgtaaaaaaataagcttttaataattatgacgttatatttaaacaactattaactactaatttaagtttctttaaaaaaaatgaaaaattaaaaatgtcatggttttttaataaataataactatattaatatttataatattcaaaaaaaataattaaatagtttaaattcatttataaaataatatctaatttttataaataattctaataaaatattatttaatttttttcttcctttgttcactcctatttcgttttattttattaaataatctatattatttaattaataatttaatgtgaaacaaagaaataaaaaagttatgatataaatatattactttttaaaataaaaactattatattttttatatcttttctaattctatgttaaatatataactactaaatgattgtaaatttgaatatctataaagaaaaaatgcattgtaaaaaaattattaaatagtactttttcttttttctttaatccttctttttgtaatattaaaaaaaactaatcatgggtttatatgggtttaaattaaataaaatagttttaaaatatgattaaatgttttgcgcaattaataatttttcataaattaaatatgtatatataggaatcccatattggaattataaataaattaaaaacccttccccacactttaaatttaattttttaataatattttaaaaggatattggaaaaaaaaacttttaaaacgttaaacgtaaaataatttaaaataacttataaatattaaataagaaaaagagaaaaactaaatattgttttttttctctttttctccccttgattttttttaaataatttaatgacggtaagtaacagtaccacgagtgaaaatgaataaatcatccataactctaagacccttgttacgaattaaaggagtagtaccaacagtgaatacatcatccttttggttagctgggaaagtctttggacgtaattgaccagcagagttgtatggaccacaaatttgaccactagtagtcatacgaacttcatctaaaagctttaaacgaagaagttgagagataa

SEQ ID NO: 1364 - DNA, 4000 bp, Escherichia coli
  misc_feature (1)..(14): n is a, c, g, or t
  misc_feature (16)..(17): n is a, c, g, or t
  misc_feature (19)..(20): n is a, c, g, or t
  misc_feature (22)..(23): n is a, c, g, or t
  misc_feature (25)..(26): n is a, c, g, or t
  misc_feature (28)..(34): n is a, c, g, or t
  misc_feature (37)..(38): n is a, c, g, or t
  misc_feature (40)..(47): n is a, c, g, or t
  misc_feature (49)..(50): n is a, c, g, or t
  misc_feature (53)..(53): n is a, c, g, or t
  misc_feature (56)..(56): n is a, c, g, or t
  misc_feature (58)..(59): n is a, c, g, or t
  misc_feature (61)..(62): n is a, c, g, or t
  misc_feature (64)..(65): n is a, c, g, or t
  misc_feature (67)..(69): n is a, c, g, or t
  misc_feature (72)..(77): n is a, c, g, or t
  misc_feature (79)..(79): n is a, c, g, or t
  misc_feature (82)..(84): n is a, c, g, or t
  misc_feature (86)..(89): n is a, c, g, or t
  misc_feature (91)..(92): n is a, c, g, or t
  misc_feature (94)..(94): n is a, c, g, or t
  misc_feature (97)..(98): n is a, c, g, or t
  misc_feature (100)..(101): n is a, c, g, or t
  misc_feature (103)..(103): n is a, c, g, or t
  misc_feature (105)..(109): n is a, c, g, or t
  misc_feature (112)..(118): n is a, c, g, or t
  misc_feature (121)..(122): n is a, c, g, or t
  misc_feature (124)..(125): n is a, c, g, or t
  misc_feature (127)..(127): n is a, c, g, or t
  misc_feature (129)..(131): n is a, c, g, or t
  misc_feature (133)..(133): n is a, c, g, or t
  misc_feature (136)..(136): n is a, c, g, or t
  misc_feature (139)..(140): n is a, c, g, or t
  misc_feature (142)..(144): n is a, c, g, or t
  misc_feature (146)..(146): n is a, c, g, or t
  misc_feature (148)..(148): n is a, c, g, or t
  misc_feature (150)..(152): n is a, c, g, or t
  misc_feature (154)..(155): n is a, c, g, or t
  misc_feature (157)..(158): n is a, c, g, or t
  misc_feature (160)..(167): n is a, c, g, or t
  misc_feature (169)..(170): n is a, c, g, or t
  misc_feature (172)..(176): n is a, c, g, or t
  misc_feature (178)..(178): n is a, c, g, or t
  misc_feature (180)..(181): n is a, c, g, or t
  misc_feature (183)..(188): n is a, c, g, or t
  misc_feature (190)..(192): n is a, c, g, or t
  misc_feature (194)..(196): n is a, c, g, or t
  misc_feature (198)..(198): n is a, c, g, or t
  misc_feature (200)..(200): n is a, c, g, or t
  misc_feature (202)..(202): n is a, c, g, or t
  misc_feature (204)..(206): n is a, c, g, or t
  misc_feature (208)..(213): n is a, c, g, or t
  misc_feature (220)..(222): n is a, c, g, or t
  misc_feature (224)..(225): n is a, c, g, or t
  misc_feature (227)..(228): n is a, c, g, or t
  misc_feature (230)..(230): n is a, c, g, or t
  misc_feature (233)..(234): n is a, c, g, or t
  misc_feature (236)..(237): n is a, c, g, or t
  misc_feature (239)..(239): n is a, c, g, or t
  misc_feature (245)..(246): n is a, c, g, or t
  misc_feature (248)..(248): n is a, c, g, or t
  misc_feature (250)..(253): n is a, c, g, or t
  misc_feature (256)..(259): n is a, c, g, or t
  misc_feature (262)..(262): n is a, c, g, or t
  misc_feature (264)..(266): n is a, c, g, or t
  misc_feature (269)..(272): n is a, c, g, or t
  misc_feature (274)..(274): n is a, c, g, or t
  misc_feature (276)..(278): n is a, c, g, or t
  misc_feature (280)..(282): n is a, c, g, or t
  misc_feature (284)..(285): n is a, c, g, or t
  misc_feature (287)..(288): n is a, c, g, or t
  misc_feature (290)..(291): n is a, c, g, or t
  misc_feature (293)..(300): n is a, c, g, or t
  misc_feature (302)..(303): n is a, c, g, or t
  misc_feature (305)..(305): n is a, c, g, or t
  misc_feature (310)..(310): n is a, c, g, or t
  misc_feature (312)..(313): n is a, c, g, or t
  misc_feature (315)..(317): n is a, c, g, or t
  misc_feature (322)..(328): n is a, c, g, or t
  misc_feature (331)..(337): n is a, c, g, or t
  misc_feature (339)..(341): n is a, c, g, or t
  misc_feature (344)..(344): n is a, c, g, or t
  misc_feature (346)..(346): n is a, c, g, or t
  misc_feature (348)..(351): n is a, c, g, or t
  misc_feature (354)..(362): n is a, c, g, or t
  misc_feature (365)..(369): n is a, c, g, or t
  misc_feature (371)..(379): n is a, c, g, or t
  misc_feature (384)..(387): n is a, c, g, or t
  misc_feature (389)..(390): n is a, c, g, or t
  misc_feature (392)..(393): n is a, c, g, or t
  misc_feature (395)..(404): n is a, c, g, or t
  misc_feature (406)..(412): n is a, c, g, or t
  misc_feature (415)..(416): n is a, c, g, or t
  misc_feature (418)..(419): n is a, c, g, or t
  misc_feature (421)..(430): n is a, c, g, or t
  misc_feature (432)..(433): n is a, c, g, or t
  misc_feature (435)..(435): n is a, c, g, or t
  misc_feature (437)..(438): n is a, c, g, or t
  misc_feature (442)..(442): n is a, c, g, or t
  misc_feature (444)..(449): n is a, c, g, or t
  misc_feature (451)..(451): n is a, c, g, or t
  misc_feature (456)..(459): n is a, c, g, or t
  misc_feature (464)..(473): n is a, c, g, or t
  misc_feature (475)..(479): n is a, c, g, or t
  misc_feature (481)..(483): n is a, c, g, or t
  misc_feature (489)..(495): n is a, c, g, or t
  misc_feature (497)..(498): n is a, c, g, or t
  misc_feature (500)..(500): n is a, c, g, or t
  misc_feature (502)..(503): n is a, c, g, or t
  misc_feature (509)..(513): n is a, c, g, or t
  misc_feature (515)..(516): n is a, c, g, or t
  misc_feature (518)..(518): n is a, c, g, or t
  misc_feature (520)..(520): n is a, c, g, or t
  misc_feature (522)..(522): n is a, c, g, or t
  misc_feature (525)..(525): n is a, c, g, or t
  misc_feature (528)..(529): n is a, c, g, or t
  misc_feature (531)..(532): n is a, c, g, or t
  misc_feature (534)..(535): n is a, c, g, or t
  misc_feature (538)..(538): n is a, c, g, or t
  misc_feature (540)..(544): n is a, c, g, or t
  misc_feature (546)..(548): n is a, c, g, or t
  misc_feature (551)..(551): n is a, c, g, or t
  misc_feature (553)..(553): n is a, c, g, or t
  misc_feature (555)..(557): n is a, c, g, or t
  misc_feature (559)..(561): n is a, c, g, or t
  misc_feature (564)..(568): n is a, c, g, or t
  misc_feature (571)..(571): n is a, c, g, or t
  misc_feature (573)..(578): n is a, c, g, or t
  misc_feature (581)..(592): n is a, c, g, or t
  misc_feature (594)..(599): n is a, c, g, or t
  misc_feature (601)..(604): n is a, c, g, or t
  misc_feature (606)..(606): n is a, c, g, or t
  misc_feature (609)..(609): n is a, c, g, or t
  misc_feature (611)..(618): n is a, c, g, or t
  misc_feature (621)..(623): n is a, c, g, or t
  misc_feature (625)..(629): n is a, c, g, or t
  misc_feature (631)..(634): n is a, c, g, or t
  misc_feature (636)..(651): n is a, c, g, or t
  misc_feature (653)..(654): n is a, c, g, or t
  misc_feature (657)..(658): n is a, c, g, or t
  misc_feature (660)..(664): n is a, c, g, or t
  misc_feature (666)..(667): n is a, c, g, or t
  misc_feature (669)..(675): n is a, c, g, or t
  misc_feature (677)..(680): n is a, c, g, or t
  misc_feature (684)..(686): n is a, c, g, or t
  misc_feature (688)..(691): n is a, c, g, or t
  misc_feature (693)..(693): n is a, c, g, or t
  misc_feature (695)..(698): n is a, c, g, or t
  misc_feature (700)..(710): n is a, c, g, or t
  misc_feature (712)..(713): n is a, c, g, or t
  misc_feature (715)..(715): n is a, c, g, or t
  misc_feature (717)..(724): n is a, c, g, or t
  misc_feature (726)..(730): n is a, c, g, or t
  misc_feature (732)..(733): n is a, c, g, or t
  misc_feature (735)..(739): n is a, c, g, or t
  misc_feature (742)..(745): n is a, c, g, or t
  misc_feature (748)..(751): n is a, c, g, or t
  misc_feature (753)..(753): n is a, c, g, or t
  misc_feature (755)..(755): n is a, c, g, or t
  misc_feature (757)..(760): n is a, c, g, or t
  misc_feature (762)..(762): n is a, c, g, or t
  misc_feature (764)..(764): n is a, c, g, or t
  misc_feature (766)..(766): n is a, c, g, or t
  misc_feature (768)..(768): n is a, c, g, or t
  misc_feature (770)..(772): n is a, c, g, or t
  misc_feature (774)..(775): n is a, c, g, or t
  misc_feature (778)..(781): n is a, c, g, or t
  misc_feature (783)..(783): n is a, c, g, or t
  misc_feature (789)..(790): n is a, c, g, or t
  misc_feature (792)..(803): n is a, c, g, or t
  misc_feature (805)..(809): n is a, c, g, or t
  misc_feature (811)..(813): n is a, c, g, or t
  misc_feature (815)..(820): n is a, c, g, or t
  misc_feature (822)..(824): n is a, c, g, or t
  misc_feature (826)..(835): n is a, c, g, or t
  misc_feature (837)..(838): n is a, c, g, or t
  misc_feature (840)..(840): n is a, c, g, or t
  misc_feature (842)..(843): n is a, c, g, or t
  misc_feature (845)..(845): n is a, c, g, or t
  misc_feature (847)..(847): n is a, c, g, or t
  misc_feature (849)..(850): n is a, c, g, or t
  misc_feature (852)..(853): n is a, c, g, or t
  misc_feature (855)..(856): n is a, c, g, or t
  misc_feature (859)..(862): n is a, c, g, or t
  misc_feature (864)..(870): n is a, c, g, or t
  misc_feature (872)..(872): n is a, c, g, or t
  misc_feature (874)..(874): n is a, c, g, or t
  misc_feature (876)..(880): n is a, c, g, or t
  misc_feature (882)..(882): n is a, c, g, or t
  misc_feature (884)..(895): n is a, c, g, or t
  misc_feature (898)..(901): n is a, c, g, or t
  misc_feature (903)..(905): n is a, c, g, or t
  misc_feature (908)..(912): n is a, c, g, or t
  misc_feature (914)..(915): n is a, c, g, or t
  misc_feature (917)..(920): n is a, c, g, or t
  misc_feature (923)..(924): n is a, c, g, or t
  misc_feature (926)..(929): n is a, c, g, or t
  misc_feature (931)..(935): n is a, c, g, or t
  misc_feature (937)..(947): n is a, c, g, or t
  misc_feature (949)..(952): n is a, c, g, or t
  misc_feature (954)..(961): n is a, c, g, or t
  misc_feature (964)..(966): n is a, c, g, or t
  misc_feature (969)..(969): n is a, c, g, or t
  misc_feature (971)..(971): n is a, c, g, or t
  misc_feature (974)..(976): n is a, c, g, or t
  misc_feature (978)..(978): n is a, c, g, or t
  misc_feature (980)..(981): n is a, c, g, or t
  misc_feature (983)..(984): n is a, c, g, or t
  misc_feature (986)..(990): n is a, c, g, or t
  misc_feature (992)..(993): n is a, c, g, or t
  misc_feature (996)..(1004): n is a, c, g, or t
  misc_feature (1007)..(1007): n is a, c, g, or t
  misc_feature (1009)..(1011): n is a, c, g, or t
  misc_feature (1013)..(1013): n is a, c, g, or t
  misc_feature (1015)..(1015): n is a, c, g, or t
  misc_feature (1017)..(1022): n is a, c, g, or t
  misc_feature (1024)..(1024): n is a, c, g, or t
  misc_feature (1027)..(1027): n is a, c, g, or t
  misc_feature (1029)..(1029): n is a, c, g, or t
  misc_feature (1031)..(1031): n is a, c, g, or t
  misc_feature (1033)..(1035): n is a, c, g, or t
  misc_feature (1037)..(1037): n is a, c, g, or t
  misc_feature (1039)..(1039): n is a, c, g, or t
  misc_feature (1042)..(1047): n is a, c, g, or t
  misc_feature (1049)..(1050): n is a, c, g, or t
  misc_feature (1052)..(1056): n is a, c, g, or t
  misc_feature (1059)..(1065): n is a, c, g, or t
  misc_feature (1067)..(1068): n is a, c, g, or t
  misc_feature (1071)..(1072): n is a, c, g, or t
  misc_feature (1075)..(1075): n is a, c, g, or t
  misc_feature (1077)..(1079): n is a, c, g, or t
  misc_feature (1081)..(1082): n is a, c, g, or t
  misc_feature (1084)..(1084): n is a, c, g, or t
  misc_feature (1086)..(1087): n is a, c, g, or t
  misc_feature (1089)..(1090): n is a, c, g, or t
  misc_feature (1092)..(1094): n is a, c, g, or t
  misc_feature (1096)..(1096): n is a, c, g, or t
  misc_feature (1099)..(1102): n is a, c, g, or t
  misc_feature (1104)..(1104): n is a, c, g, or t
  misc_feature (1106)..(1113): n is a, c, g, or t
  misc_feature (1116)..(1116): n is a, c, g, or t
  misc_feature (1118)..(1123): n is a, c, g, or t
  misc_feature (1126)..(1126): n is a, c, g, or t
  misc_feature (1128)..(1134): n is a, c, g, or t
  misc_feature (1136)..(1137): n is a, c, g, or t
  misc_feature (1139)..(1139): n is a, c, g, or t
  misc_feature (1141)..(1145): n is a, c, g, or t
  misc_feature (1148)..(1148): n is a, c, g, or t
  misc_feature (1152)..(1153): n is a, c, g, or t
  misc_feature (1155)..(1166): n is a, c, g, or t
  misc_feature (1168)..(1170): n is a, c, g, or t
  misc_feature (1172)..(1172): n is a, c, g, or t
  misc_feature (1174)..(1174): n is a, c, g, or t
  misc_feature (1176)..(1178): n is a, c, g, or t
  misc_feature (1180)..(1181): n is a, c, g, or t
  misc_feature (1183)..(1183): n is a, c, g, or t
  misc_feature (1185)..(1188): n is a, c, g, or t
  misc_feature (1190)..(1190): n is a, c, g, or t
  misc_feature (1192)..(1195): n is a, c, g, or t
  misc_feature (1200)..(1201): n is a, c, g, or t
  misc_feature (1204)..(1205): n is a, c, g, or t
  misc_feature (1207)..(1207): n is a, c, g, or t
  misc_feature (1211)..(1216): n is a, c, g, or t
  misc_feature (1218)..(1222): n is a, c, g, or t
  misc_feature (1226)..(1228): n is a, c, g, or t
  misc_feature (1230)..(1230): n is a, c, g, or t
  misc_feature (1232)..(1232): n is a, c, g, or t
  misc_feature (1234)..(1235): n is a, c, g, or t
  misc_feature (1242)..(1243): n is a, c, g, or t
  misc_feature (1245)..(1250): n is a, c, g, or t
  misc_feature (1254)..(1256): n is a, c, g, or t
  misc_feature (1259)..(1260): n is a, c, g, or t
  misc_feature (1262)..(1262): n is a, c, g, or t
  misc_feature (1266)..(1268): n is a, c, g, or t
  misc_feature (1270)..(1272): n is a, c, g, or t
  misc_feature (1275)..(1275): n is a, c, g, or t
  misc_feature (1277)..(1277): n is a, c, g, or t
  misc_feature (1281)..(1282): n is a, c, g, or t
  misc_feature (1284)..(1287): n is a, c, g, or t
  misc_feature (1289)..(1289): n is a, c, g, or t
  misc_feature (1291)..(1294): n is a, c, g, or t
  misc_feature (1296)..(1298): n is a, c, g, or t
  misc_feature (1300)..(1300): n is a, c, g, or t
  misc_feature (1323)..(1323): n is a, c, g, or t
  misc_feature (1609)..(1609): n is a, c, g, or t
  misc_feature (2136)..(2136): n is a, c, g, or t
  misc_feature (2181)..(2181): n is a, c, g, or t
  misc_feature (2455)..(2455): n is a, c, g, or t
  misc_feature (2461)..(2461): n is a, c, g, or t
  misc_feature (2572)..(2572): n is a, c, g, or t
  misc_feature (2596)..(2596): n is a, c, g, or t
  misc_feature (2605)..(2605): n is a, c, g, or t
  misc_feature (2662)..(2662): n is a, c, g, or t
  misc_feature (2671)..(2671): n is a, c, g, or t
  misc_feature (2686)..(2686): n is a, c, g, or t
  misc_feature (2689)..(2689): n is a, c, g, or t
  misc_feature (2699)..(2699): n is a, c, g, or t
  misc_feature (2761)..(2761): n is a, c, g, or t
  misc_feature (2764)..(2764): n is a, c, g, or t
  misc_feature (2773)..(2773): n is a, c, g, or t
  misc_feature (2827)..(2827): n is a, c, g, or t
  misc_feature (2836)..(2836): n is a, c, g, or t
  misc_feature (2974)..(2974): n is a, c, g, or t
  misc_feature (2995)..(2995): n is a, c, g, or t
  misc_feature (3076)..(3076): n is a, c, g, or t
  misc_feature (3175)..(3175): n is a, c, g, or t
  misc_feature (3214)..(3214): n is a, c, g, or t
  misc_feature (3244)..(3245): n is a, c, g, or t
  misc_feature (3247)..(3247): n is a, c, g, or t
  misc_feature (3253)..(3253): n is a, c, g, or t
  misc_feature (3340)..(3340): n is a, c, g, or t
  misc_feature (3430)..(3430): n is a, c, g, or t
  misc_feature (3461)..(3461): n is a, c, g, or t
  misc_feature (3463)..(3463): n is a, c, g, or t
  misc_feature (3469)..(3469): n is a, c, g, or t
  misc_feature (3496)..(3496): n is a, c, g, or t
  misc_feature (3574)..(3574): n is a, c, g, or t
  misc_feature (3649)..(3649): n is a, c, g, or t
  misc_feature (3652)..(3652): n is a, c, g, or t
  misc_feature (3759)..(3761): n is a, c, g, or t
  misc_feature (3799)..(3799): n is a, c, g, or t
nnnnnnnnnnnnnntnntnntnntnntnnnnnnnttnntnnnnnnnntnntcntcntnntnntnntnnnaannnnnntnctnnnannnntnntncannanntncnnnnnttnnnnnnnttnntnntncnnntnttncannannngntncnnnanntnntnnnnnnnntnntnnnnnancnntnnnnnnannngnnntnantncnnntnnnnnnttttttnnncnnanncnaannanncntttttnncntnnnnaannnnttncnnnaannnntngnnntnnngnnanncnnannnnnnnnanncnttttngnntnnnttttnnnnnnnaannnnnnntnnnttnantnnnnttnnnnnnnnnaannnnncnnnnnnnnnaaaannnntnntnntnnnnnnnnnntnnnnnnnttnnannannnnnnnnnnannantnntttncnnnnnntnttttnnnnttttnnnnnnnnnntnnnnngnnntttttnnnnnnngnnantnncttttnnnnntnntngnanttnaanngnntnnttnannnnnannnttngncnnncnnnaannnnnttncnnnnnnccnnnnnnnnnnnnannnnnntnnnnanccnannnnnnnnaannngnnnnntnnnngnnnnnnnnnnnnnnnnannttnncnnnnncnncnnnnnnntnnnntttnnntnnnnancnnnntnnnnnnnnnnntnntnannnnnnnnannnnngnnannnnnaannnnggnnnngntngnnnnantngnancnnnannaannnncntgtttnnannnnnnnnnnnngnnnnntnnntnnnnnnannncnnnnnnnnnngnnantnnantnannanngnnaannnncnnnnnnntngntnnnnncntnnnnnnnnnnnnaannnntnnnttnnnnntnnannnnttnntnnnntnnnnngnnnnnnnnnnnannnntnnnnnnnnaannnttnanttnnngntnnannannnnntnnttnnnnnnnnnttngnnntngnannnnnntnaangnancnnnantnaannnnnnannannnnnaannnnnnnannccnnaancnnnanntncnncnnannngnttnnnnancnnnnnnnnaantnnnnnnaantnnnnnnnannantnnnnnccnaaanncnnnnnnnnnnnncnnnantngnnnanntncnnnngncnnnnaaaannaanntnaaannnnnnannnnnaaannnantngnnttttttnntnnnnnnaaannnccnncntttnnnannnttnantttnnannnntncnnnntnnnantaggaatcttaatttttaggtantaatgtagctaattttaaaacatgcatcatactgcttttcatttcttgataagacatttgtacgatgggttgacgagcaatgacgataaaatctacatcttgcgccaattggtcgtccagttccattaaaatatgacggattcttctttttagacgattacgcgtaaccgcatttccaagttttttgctgacagagattcccacacgaaaatgggattggtcttccttattatatttataaataacgaattgacggttcgctgtcgattttcccttgtggaatacnttttgaaattcgcggtctttctttactcgaaacgatttcttcatctacttgaatctctccagtcactcaaatggtttttaaaaaaaaagaccactgagacgttcagtgatctaagctgctaaaacttttctacctttacggcgtctgcttgctaatactctacggccattttttgtgctcatacgtttacggaatccgtgaactttttgacgtttgcgtttgcttggttgatatgttcttttcattcgtgtgcacctcctactgtaaatgaaatatctagtctccctagacagtctagtacattataaatataaaatgtttacttgtcaatataaactatctaatcactaaattactgaagtatcataacataatcagactaaaaatttctacaaataactgttgatttcgctctatttttttagttattcacatcgatggtggatagtttttttgcataaaagacgatttccacagacttataaacaatttatccacaaaataacatcctgtttacaaaaattatncacaatggtggataactctattaaattccttttatatcaactttntttgttgtttataactgctctttttttgtgtatatctctgtgaatttccacttttttattcgacttatccaccgttttgtggataaacttatccaaatctcactttttttgtgattttctccatccgattgtggaaaacttttttgaaagatggtacactgttaaatggattagaatcttgaaaacgatagaaggaggtgcatttatgaattccatccaagaattttggaaactattattagaacactttgaaaaaacaaattccgaatttacntttaancactggattaaaccagctgaaccgattcgaattgaacaaaatattctctatattaaagtgccttctaaaacatttgcgagatattggcaagataaccttattagagacatnatggaaattggatatgattacttnagacaatcntttgaaccacgttttatcgattcagaagatgaaggtccagtaaacactccattccancaaggagtngaagaaattcaaccnaanattcctgaanctccaacaatggttgccatcgaggaagactcgcatttgaatcctaaatatacatttgaaacnttnattattggnaaaggaaaccaaatggccacggctgccgcgcattacgttgcggataatcctggnaatacctanaaccctcttttcttctatggaggtgtaggtcttggaaaaactcatttaatgcaagccattgggaataaatataagaagagccatccaaacgcacgtgtcaaatacgtgacgagtgaagagtttatgaatgaaatgatngcttcgattggatcaaaaacnccgcaagaattccgcaatcgttaccgtaatgtggatatcttactggtcgatgatattcaattcctagcgaaaaaagaagcnactcaagaagagttcttccatacatttaatgcgcttttcaataaccaaaaacaaatcgtattaacgagtgaccgtcaaccaacggaaattaaagaattncaagaacgtctcgtttctcgtttcgtatcggggttatcngtcgatatcactccaccagacttagaaacnngnattgcnatcttacaaaataaagcacaatcacttggatttaatattcctattgaagtgttgagttatgtcgcaggtcatattcaatcaaacgtncgtgaattagaaggagctctgatgcgtcttcaagcgtactcagtgatggttggtcaagatatttcaacagacctggctgcagaagcgttncaatcgttccttcctggaggcgacgaaaaantnctttcnattcatgatatccaaagcgccgttgcnaaatactacaatattacggtcgaagatattaaaggaaagaaaagaacgaagacaatggttcaaccgcgtcaaatcgcnatgtacctttctcgtgaattaacacgtgtttctcttcaaaagattggtgctgattttggtcgtgaccactcaacngtnattcacgcctatgaaaaaattagccaagaagctaaagatgatccagaaacgattcgcgtgattaatgaaatcaagcattcgctcggttattaagctgtggataagtnnnaaaaaacggtggagttttccacaatggttatccacaantaaaaatggtctctgttataaggaaaatagacttttccacaatatacacaggccctactactattactattttattaataaataaattaaatataaaagcacaccctaaaggaggcagttatgaaattttcagtaaacagacaagggttcttaaaaaatcttgtagatgtgcaacgtgcaattccatcaaaaacaacaatt

SEQ ID NO: 1365 - DNA, 4000 bp, Escherichia coli
  misc_feature (169)..(169): n is a, c, g, or t
  misc_feature (196)..(196): n is a, c, g, or t
  misc_feature (1988)..(1988): n is a, c, g, or t
  misc_feature (2677)..(2677): n is a, c, g, or t
  misc_feature (3423)..(3423): n is a, c, g, or t
cttcgaccgccaggtcgtcgttccgcgtcccgacatcgatggccgcgagcagattctcggcgttcacatgaagaaggtgccgctggcgcccgacgtcgacgcgcgcgtcatcgctcggggcacgcccggcttctccggcgccgacctcgccaacctcgtcaacgaggcngcgttgctggccgcccgccgcggcaancggctggtcgcgatgaaggagttcgaggaggccaaggacaaggtgctgatgggcaccgagcgcaagtccatggtgatgaccgaggacgagaagcgcatgaccgcctatcacgaggccggccacgccatcgtcgccctccacgagcccgcctcggatccgatccacaaggcgacgatcattccgcgcggccgcgcgctgggaatggtcatgcgcttgccagagcgcgacagctattcctatcaccgcgacaagatgtacgcgaacctcgccgtctcgatgggcggacgcgtcgcggaagaagtcatcttcggctatcacaaggtctcttcgggggcgtccagcgacattcaatatgcaacgacgctcgcgcgcgacatggtcacgcgctggggcatgtccgacgcattggggccgctccaatatgccgagccggacgaggaggtgttcctcggctattcggtcaaccgcacgcgccagatgtcgaacgagaccgcgcaggcgatcgacaacgagatccgccggatcgtcgaggaaggctacgagcgcgccaagcacgtcctcgacgagcaccgcgacgagctggaatcgctcgcgcaggccttgctcgagttcgaaactctgtcgggcgacgagatcaagaaggtcctggccggcgaaaccatagatcgcggcggcgcaaagggcccaacgatcccggccgccggctcctcgatccccaaggccaagcgtcccaagagcggaaccattggcgggccggcagccgccggcgtctagttcggaggccgttcacgcccaaacgcggtccctcggcgacgcggcgttcgcggagtggatctgaccatgcgcaaggcaatcgtcctgagttttgccctatcccttgcagcgccggcgctcgccgcgccgtccggcagcgcgcagagcttcctcgatcgcgcgaacaggctcaaggcgaaggggccgctggcattgttcgacggcgactatgcgcgcctcaaggccgaggccaccgccgccggaaagtcgatcggtgacgatcgcattgccgccgagcgcgccggcaggccgatcctctactgttcgccttcgccgcgcgcccggctcggctcgttcgagttcatcgatgggctggaggccattccgccggcggagcgcgctcgaatggacctgaagcaggcgatgcttcgcgtccttcagaagaaatacccctgccgccgctaaggcgacgagctacatcgctccgatcgcgaccgatgccgcaaagaacagcgccgcggcaatgaatgcgaaggtcagcagcgccatggttcgcatgatcgcgctgaacttccccagctcataggtctgcttcagatgccggtacatgtggaacggcggcacgaagaacagcagggacgcgatggtcgtgaagccgatggacacaaggagcccgccggcgatcaccagcatcatcatgaacgaaagcgagtaagtgacgaataccgcgtggtcgtaggtgttgtatcgccgcctgagcgggaacagcagccacatgaagggtatcgacagcgggatcagcatccagctgaacttggacaccgaatcctggacccgcatcgagacgacttccggattgtccttggcgttctggatgaagggccggatccagcccggcatgtcgtcgccgggatcgtttacgaccatcggcgtgccgctcagcatcttctgggtgtcggcaatgtcctccttgcgcttggcgatcttgcggtcgagctgggcgaggtccttgcccgccgccgcgccggccttgcgctgngcctcgagcttggcgagcttggccgtgtcgtccttgatctcggtcttgaggccctccttgaaggtcgtggtaccggcgccgccgagcgccccggtgaaattgagcaccgcgaacatcgcgaagaccgtgaagaggtagagggcgatcggcgagatgaaccgggcgcgctcgccggcgatgtagcggcgggtcatgatcccggggcaccaggcgagcatcggcagggtgcgccagatcttgccttcgaaattgaacaaggcggtgacgaaatcctggaagaaagcccttaccgagcggtggatgtgggctttctggccgcaggccgcgcaataggggccggtcagcttcgctccgcagttgaggcaattcctctcatgggtgtggccgtccgctacggcctcgcccgcacccggctcgaccgctcgggcgagcaacccgccggtgaccgcatcgccgatcgcgtcgaaatcccccatggggcggatattaggcgggcatcggcgctcatgctagctgccgctggtgcctcgcatcggtctcctcggcggctcgttcaatcccgcgcaccgcgggcaccggcggatcagcctggaagcgatccgggcgctcggcctcgacgaggtctggtggctggtctcgcccggcaatcccttgaaggcgggcgcgaaggacatggcgcgcttcgaggngcggttcgcgtcggctgaagtgatggctcgcggcgcccgcatccgggtcagcgatttcgagcggcgcgagggcatccgctactcgatcgacaccgtccgcaggctcaagcggcggcaccccgagcaccgcttcatctggttgctcggaagcgacaccctgccaaattttcacaaatggcgcgattataggaatttagcccgcgaactgccggttgccgtgattcgccgtcccggttatgattcagcggcccacgcggcgtgcgcgatgggctggctgaggcggttcgtccacccgtccggccaggcgagccactggacggaatggagtgcaccggcgatcgtcttccttcgcctgccccccgatccgacctccgctaccgccattcgcgcgcaagacccaagctggtatcgccgatcctcttcgctcgcgcagcgtcgcgggcggacggccatgcccctgtccgccaggagaccccttgaccgagcaccccgctgaagcagccgacacgagcgggcgtccccccgcgagcgtcgatgaactccacaagctcgttctgaaatcgctcgacgacgaccaggcgcaggaggtcgtctcgatcccgctcgcgggcaagtcgaacatcgcggaccatatggtgatcgcgtccggccgctcgacccgccaggtcgcgtccatggccgttaagcttgccgacaagataaaagagcaatttgggcgaaacgtcaggatcgaggggcttccggcngcggactgggtgctgatcgacgccgacgacgtgatcgtgcacatattccgtcccgaagtcagaaatttttacaatttggaacgaatgtgggcatttggggatgaatcgatgagcgctgcgcgcgggtgagggacatgcggttcattgggattctactgtcgcttctggcgttcgttgccgtcccggcgactgcggcgtcttcgcccgacctcgtcaccgtggagcagcagctgagcgcgatgctcgcggactcgtcggccgacgtcggaatcgccgcgctcgatctcaacaccggcgagacgatcagcatcaagggcgacacgcccttcccgatggcgagcacggtcaaggtcgcgatcgccgcgctctatctgtcgcaggtcgaccatggccagaagacgctcgacgactcgatccacggccagcctgtccggaccttgatgaacaagatgctgatttacagcgacaatcacgccgccgatatcctgttcaaggacgtcggcgggccgcgcgcggtgcatcactatctgacgaccaacgggatccatggcgttcgcgtcgaccgcaccatcgccca

SEQ ID NO: 1366 - DNA, 4000 bp, Escherichia coli
  misc_feature (10)..(10): n is a, c, g, or t
  misc_feature (37)..(37): n is a, c, g, or t
  misc_feature (75)..(75): n is a, c, g, or t
  misc_feature (87)..(88): n is a, c, g, or t
  misc_feature (94)..(94): n is a, c, g, or t
  misc_feature (109)..(109): n is a, c, g, or t
  misc_feature (170)..(170): n is a, c, g, or t
  misc_feature (200)..(200): n is a, c, g, or t
  misc_feature (309)..(309): n is a, c, g, or t
  misc_feature (324)..(324): n is a, c, g, or t
  misc_feature (336)..(336): n is a, c, g, or t
  misc_feature (396)..(396): n is a, c, g, or t
  misc_feature (539)..(539): n is a, c, g, or t
  misc_feature (541)..(545): n is a, c, g, or t
  misc_feature (547)..(548): n is a, c, g, or t
  misc_feature (553)..(555): n is a, c, g, or t
  misc_feature (557)..(557): n is a, c, g, or t
  misc_feature (559)..(559): n is a, c, g, or t
  misc_feature (562)..(563): n is a, c, g, or t
  misc_feature (566)..(566): n is a, c, g, or t
  misc_feature (569)..(575): n is a, c, g, or t
  misc_feature (577)..(577): n is a, c, g, or t
  misc_feature (579)..(582): n is a, c, g, or t
  misc_feature (584)..(585): n is a, c, g, or t
  misc_feature (587)..(587): n is a, c, g, or t
  misc_feature (589)..(593): n is a, c, g, or t
  misc_feature (595)..(595): n is a, c, g, or t
  misc_feature (597)..(597): n is a, c, g, or t
  misc_feature (599)..(599): n is a, c, g, or t
  misc_feature (602)..(602): n is a, c, g, or t
  misc_feature (604)..(608): n is a, c, g, or t
  misc_feature (611)..(611): n is a, c, g, or t
  misc_feature (613)..(613): n is a, c, g, or t
  misc_feature (617)..(619): n is a, c, g, or t
  misc_feature (621)..(622): n is a, c, g, or t
  misc_feature (625)..(628): n is a, c, g, or t
  misc_feature (630)..(635): n is a, c, g, or t
  misc_feature (637)..(644): n is a, c, g, or t
  misc_feature (646)..(647): n is a, c, g, or t
  misc_feature (649)..(649): n is a, c, g, or t
  misc_feature (652)..(653): n is a, c, g, or t
  misc_feature (660)..(662): n is a, c, g, or t
  misc_feature (664)..(664): n is a, c, g, or t
  misc_feature (666)..(667): n is a, c, g, or t
  misc_feature (670)..(670): n is a, c, g, or t
  misc_feature (672)..(682): n is a, c, g, or t
  misc_feature (685)..(686): n is a, c, g, or t
  misc_feature (689)..(689): n is a, c, g, or t
  misc_feature (694)..(698): n is a, c, g, or t
  misc_feature (700)..(700): n is a, c, g, or t
  misc_feature (704)..(710): n is a, c, g, or t
  misc_feature (716)..(716): n is a, c, g, or t
  misc_feature (718)..(720): n is a, c, g, or t
  misc_feature (722)..(722): n is a, c, g, or t
  misc_feature (724)..(725): n is a, c, g, or t
  misc_feature (727)..(728): n is a, c, g, or t
  misc_feature (730)..(740): n is a, c, g, or t
  misc_feature (742)..(743): n is a, c, g, or t
  misc_feature (745)..(747): n is a, c, g, or t
  misc_feature (749)..(749): n is a, c, g, or t
  misc_feature (752)..(752): n is a, c, g, or t
  misc_feature (755)..(755): n is a, c, g, or t
  misc_feature (757)..(760): n is a, c, g, or t
  misc_feature (763)..(763): n is a, c, g, or t
  misc_feature (765)..(766): n is a, c, g, or t
  misc_feature (769)..(773): n is a, c, g, or t
  misc_feature (776)..(781): n is a, c, g, or t
  misc_feature (783)..(784): n is a, c, g, or t
  misc_feature (786)..(786): n is a, c, g, or t
  misc_feature (788)..(789): n is a, c, g, or t
  misc_feature (794)..(796): n is a, c, g, or t
  misc_feature (798)..(806): n is a, c, g, or t
  misc_feature (808)..(808): n is a, c, g, or t
  misc_feature (812)..(814): n is a, c, g, or t
  misc_feature (820)..(822): n is a, c, g, or t
  misc_feature (824)..(827): n is a, c, g, or t
  misc_feature (829)..(836): n is a, c, g, or t
  misc_feature (838)..(845): n is a, c, g, or t
  misc_feature (847)..(848): n is a, c, g, or t
  misc_feature (850)..(852): n is a, c, g, or t
  misc_feature (854)..(855): n is a, c, g, or t
  misc_feature (857)..(862): n is a, c, g, or t
  misc_feature (865)..(869): n is a, c, g, or t
  misc_feature (871)..(872): n is a, c, g, or t
  misc_feature (874)..(874): n is a, c, g, or t
  misc_feature (877)..(878): n is a, c, g, or t
  misc_feature (880)..(882): n is a, c, g, or t
  misc_feature (884)..(884): n is a, c, g, or t
  misc_feature (890)..(891): n is a, c, g, or t
  misc_feature (893)..(910): n is a, c, g, or t
  misc_feature (913)..(919): n is a, c, g, or t
  misc_feature (921)..(930): n is a, c, g, or t
  misc_feature (932)..(938): n is a, c, g, or t
  misc_feature (940)..(940): n is a, c, g, or t
  misc_feature (942)..(946): n is a, c, g, or t
  misc_feature (948)..(950): n is a, c, g, or t
  misc_feature (953)..(965): n is a, c, g, or t
  misc_feature (968)..(968): n is a, c, g, or t
  misc_feature (970)..(971): n is a, c, g, or t
  misc_feature (973)..(973): n is a, c, g, or t
  misc_feature (975)..(976): n is a, c, g, or t
  misc_feature (980)..(980): n is a, c, g, or t
  misc_feature (982)..(986): n is a, c, g, or t
  misc_feature (988)..(990): n is a, c, g, or t
  misc_feature (992)..(993): n is a, c, g, or t
  misc_feature (995)..(1001): n is a, c, g, or t
  misc_feature (1004)..(1008): n is a, c, g, or t
  misc_feature (1010)..(1010): n is a, c, g, or t
  misc_feature (1012)..(1013): n is a, c, g, or t
  misc_feature (1015)..(1016): n is a, c, g, or t
  misc_feature (1018)..(1018): n is a, c, g, or t
  misc_feature (1022)..(1031): n is a, c, g, or t
  misc_feature (1033)..(1038): n is a, c, g, or t
  misc_feature (1041)..(1043): n is a, c, g, or t
  misc_feature (1045)..(1045): n is a, c, g, or t
  misc_feature (1050)..(1055): n is a, c, g, or t
  misc_feature (1057)..(1063): n is a, c, g, or t
  misc_feature (1065)..(1065): n is a, c, g, or t
  misc_feature (1069)..(1072): n is a, c, g, or t
  misc_feature (1074)..(1074): n is a, c, g, or t
  misc_feature (1077)..(1079): n is a, c, g, or t
  misc_feature (1093)..(1093): n is a, c, g, or t
  misc_feature (1105)..(1105): n is a, c, g, or t
  misc_feature (1108)..(1108): n is a, c, g, or t
  misc_feature (1129)..(1129): n is a, c, g, or t
  misc_feature (1134)..(1134): n is a, c, g, or t
  misc_feature (1137)..(1138): n is a, c, g, or t
  misc_feature (1986)..(1986): n is a, c, g, or t
  misc_feature (1989)..(1989): n is a, c, g, or t
  misc_feature (2011)..(2011): n is a, c, g, or t
  misc_feature (2021)..(2021): n is a, c, g, or t
  misc_feature (2487)..(2487): n is a, c, g, or t
  misc_feature (2545)..(2545): n is a, c, g, or t
  misc_feature (3079)..(3079): n is a, c, g, or t
  misc_feature (3281)..(3281): n is a, c, g, or t
  misc_feature (3827)..(3827): n is a, c, g, or t
  misc_feature (3986)..(3986): n is a, c, g, or t
ggagccgtcnggaagggtgatcgtgagttccgccatngcgggtcaggcctcctggtggatcgtctgcgtgctcgncgtctggaatcnncccgtngagccggccgtgccntgaatccccatgtccatcctgtgagggtatgggagttccccgtccgggacgcagacgatancgaccctcccctccacgatcgtccacccgncccggccctaggattccgaaccgaacgaccgaccgggacaaccggcagctacgaaaggttcaggcacgtggggatcgtcgacggcaagcgactgctcatcaccggggtnctcaccgatgcatcnctggccttctcngtggcccggctggcccaggaggagggcgccgaggtggtgctcaccggggcgggcagaggnctgcgcctcaccgaacgaacggcgcgcaagttgccccatccggtcgaggtgctggaattcgacgtgacctcgcgcgagcagaccgatgccctgcgtcaacggctcaccgagacctgggggcgggtggacggcgcactacacgncnnnnnanncgccnnngnantcnnccnggnnnnnnncntnnnngnngncnnnnngncngncgngnnnnnggncntggnnntnnccnnnnannnnnncnnnnnnnngnncnagnnggtggcnnngntnntgncnnnnnnnnnnnccnncgncggannnnncntcgnnnnnnncttcgncnnncncnncnncnnnnnnnnnnncnncnnnanggncgncnnnnagncnnccnnnnngtnnnnnncnngntnnctggnnngnnnnnnnnncngggnnnacatcnnngnnnncnnnnnnnncnnnnnnnngnncnnnannannnnnnccnnnnncnntnccnncnnngntgcctnngnnnnnnnnnnnnnnnnnnggnnnnnnntnnnnnnnnnngnnnnnnncncnnnnncnnncgnnnnnnnnnnnnnggncnngntnncggncnnnnncnnngnnannnnnnncgnnnnngngnncnncnacgnnnnnnnnnncnnnnnnggnnncngaccnnnnnncnnnnnnncngccnnnntnccnnnctcagtcgtagagngagacgttgctnccngcccggtccgtgcagtgggcntcggncannggatacgggttgacggcgttctgtgcaccacccgggtggtactcgaagtgcaggtggacgccctgggcgttgccgctgtcgcccatgtagccgatcacgtcaccggcctccacctcaccctccctgccgtaggccgagaggtgcgccccgtagtagtagtcgccgtcggcggccaccaggtcgaaggatcgccccccgacgctgtcccaccggtaggagacgactccgtccaccggcgccaggagcgggtcgtggcgcttgccgacgaggtccacgccctcgtggctccgcccgcctgatcgtggagccccccaggtgtcgcggaacttcgtgcgtgcgccgatcggacacacccagtcagccgacgtgatctggcggaccaccgccgaacggttgctccgggtgtgggcaccacgcctgagttgcctccgactggtctccgagaggccatcgaagacgtcgtcgtaggtggaccgcatgcggtcggcgtccctcacgatgtcggcgaccatccggttcacctgcaggagcgccgcagccgccgacctctgcctggatcgtgcggaggcgagcaggcgggccatcgagcgatagcgggtctcagcctcggccaggcccgccacggccagcggcaacacgtcagaggcggcctcgatcagcggcagcagccccgcatcccgctcgatgacgagggcccgtgacgggtcgctggtgaagaccacggaccgttccgacacctgggcgacggcagtcgagggaagggccaggaggagcgcgacggacgcgccgaccaggccggggaggcgggacaccgccggattctatccgctggttgattcccgaccgtnacnggccggtatggccccggtcacngcgttccctnctcggactcgtcgggaatctcccccacgagttcctctaccacgtcatccatggacaggatccccacccaggatccggaaccatccacgaccaccgccatctggctgcgggatcgccgcaggccctgcaggacgtcgtccagcaggaggtccgtgtgcagcaccagcaggctgcgtatcgactccaatggcaccggctcgtcccgagcctcgggtggaagcctgagcaggtccttggcgtgcaccatgcccacgacctcacccgtgcgtcgatccagcaccggaagtcgggtgtggccgctggaggccatgacatcctccacctccaccagcggtagccgcctgtccacggccaccaccgacggccgggccaccatcacagatgccgccgtctgccgtcccaggtccagcactcctgtcaacaggtcgtgctcgaagctttcgatgagtccttcatcacgcgacgcntccagcagggcggtgagttccggcgctccgaccgcccggcggatctcgtcgacgggcntgaggccgaagggccgtaccgccatggcggccaaccggtcgactacgacgattccgggtctcaggaccgcgacgaacgccccgtgcagccgaaccgtccagcgaagcgtccgctccggatcggcaatcgcgaagttcttcggaaccagctcaccgaacagcatctggaacacggcaaccagcccgatcgccagcaccagtgccgtcgtggacgacacacctgacggcaggccggcggcatcggccagggactcgaggtgacgtccgatcgtcggctcggccaggatgcccagggcgatgctgctcaccgtgattcccagttgcgcccccgacatctggaccctcaggtcccgtcgtgcggccagagccctggacgccgacacggagccctccgccgctgccgcctcgaggctggacggacgtgccgccaccagggcgaactcggtcgccacgaacagtgcgttcacggccacgagggctacgacgaccagcagcgagagcaggatcatgtggaatccccgccgtcgggaggaangacgatccggagagtggcgatccgccgaccctccaccgccaccacctcgatcttccagccttcgtgctcgaccatcgccgtcggctgcggcaggcgccccaggcgttggaggacgaagccggcgagggtctcgtacgggcccggaggcaaccggagtccggtgatgtccgccacctcgtccaggttcagtcgacccgacacnacgttgcgtcccggcccgtccaacctggtgcgcaccacccgggtgtcgtgctcgtcgtcgatctcgccgactatctcctcaagggcgtcctccaccgtgacgattcccgccgtacccccgtgctcgtcgaccacgacggccatgtggccccggtgctcacgcaggtcggcgagcaggtcatccaggaagcgggtctcgggaacggcaagcacgtcatgcatcagctcgacgaccggggcatgcccacgcaacgctgccggcctccgcaggagggacttcacgtgtaccacgcccacgacgtggtcgagatcggattcgaagaccggaaagcgcgagtggccggtcctcgccgacctctccaggaggtcagccccagttgcgtccagacggagtgcctccacgtccagcctcggtacgagcacgtcggcaaccatcttctcgctgaaccggatcgatcgggtgaacagctccacgtcggaactgtccaacgtggcgtccgaggactcccgcaccaggtcacccagctcgtcgagcgtgcgcgaggancccagttcctcgcgtggctccacccccacccaccgcaggaccgcattggccgacccgttcaggaccacgacgacaggtcgcacgaccaccccgtaggcgagcaccagcggagccagtcgacgcgacaccgcttccggcgccgcaagggccacgtacttnggcacctgctcccc

SEQ ID NO: 1367 - DNA, 4000 bp, Escherichia coli
  misc_feature (449)..(449): n is a, c, g, or t
  misc_feature (1252)..(1252): n is a, c, g, or t
  misc_feature (1987)..(1987): n is a, c, g, or t
  misc_feature (2526)..(2526): n is a, c, g, or t
  misc_feature (2529)..(2529): n is a, c, g, or t
  misc_feature (2547)..(2547): n is a, c, g, or t
  misc_feature (2749)..(2749): n is a, c, g, or t
  misc_feature (2972)..(2972): n is a, c, g, or t
  misc_feature (3620)..(3620): n is a, c, g, or t
taagagtaatataactaatattaaaaaacgtttcataccttgaaattaaattaagctttcctcacaaaaacatggctcaatggataaaaactgaattcggttccatcgctttacttagtaatcatgacccctttcctaagactgatcaagcgcttattgaacctaatggccttatcgcaatatcaaaaacacttgaagctaaaaaaattattgaggcttataagcaaggaatatttccttggttcaatgaacacgaacctattttatggtggtcacccgatccaagattaatattgttccctgaagaccttataatttcatcgtcactatccaagaaaattaggaaaaataattatcgatttttaatagacaatgatttttcatctattattaaacattgcagtgagattaaaagaaaaggccaagatggcacatggattgacgatcgnattattaatgcatacacagaattacatcaatcaaaaattgctcattcttttgaaatctatgttaatgaaaatctcgtcggcggcctttatggaatagttttagatggcgttttctttggtgaatctatgtttcattatgaaagagacgcctctaaaatagcttttgttcttgccattcagcatctaaaaaacataggcattaagatggtagactgtcagatgaaaacgaatcatcttttaagtttaggtgctaaagagatctctcgtgaccgatttattcaactacttaatacttatattaaaacatgagccttcctgacgaattatcaagtcataagattcaattctacgtcacaacaagttatgcctgtggctacatagaaggtcgagcatctcaatcattagttgctacgcctcatcaccttattagccaaaaacacttcgatgatcttataaaaaaaggctttcgaaggagcggtaaatttacgtacaaaccttattgcgaactttgtagtgcatgtattcctattcgtatcaatgttaaagattttatgcgctcaaaaagcgctaaaagaattattaaaaatcatcagcatcttcaaacttctgtacttcccctttcctttcacgaggatcatttcaagctttatttggaatatcaaaaaaatagacatgaaaaaataaaagcaacggatgatgatgttaatcagtacagtgagtttttattacaaagcaatattgatagtcgattaattcaatttcaagatcaaggggatttaaaaattgtaagttttgtcgatatngttgaagacggcatttctgcggtgtatacattttttgatacgtctgataaatcattcagctatggaacttattccatactatggctcattaattggtgtgctgaaaaaaaattagattatgtttatttgggctactggattcaagaaagcaaaaagatgaattacaaaactcactttaaaccttttgagctattcatcaataacgaatggcgatcatttaatagtgaacatgatacaattcaattgttaaacaatatcaaataaatcaactatatacagtgaataaaattcttatttttggtgtcggtcttatcggaggatctattgcactctctgcaaaaaaatcaggtctcgcttcagatattgttggcgtcggcagaaaccaagataatctcaatgatgccattaaacttaaacttattgatcgtacgagccaagaattaaataaagatattgcagaggctcatatcattattattgcaacaccggtggcgcaattccccttgatacttaaaacgattcaacctcatttatcttcacataccattatcactgatgttggaagtaccaaaacaagtgttattgagtcagcaaaacaaattttaggtagtcaatactcacagtttattggcggtcaccctattgctggatctgaaaaacatggtgcaacggcagcacatattgatttatttaaagataaaaatgtgattttaacgccagatcaagatacatctnctcgtgcaaaagaggtaattgaagcgctatggaaaaatgcaggcgctatagtttcaaatatgtctcatagcgatcatgacaaaatattttcaacaatcagccatcttccacatcttttagctttttcactcgtggatatgattacccaaagagcaaatgcaaatgaacttttaaaatttgctgcaagtggatttaaagattttacaagaattgcagcaagctctcctgagatgtggaaagacattacactcgcaaataaaaaatttatccttgatgatattaagcactttgaaaatcaaatcaaattgctaaaagaagctattgagcatgaagatgaaaaaaagattttgacgttattcgaaaatgcaagcaaaactcgaagcgaatggtctcgataatttaagcgcatgacaaatcaaaagaaattaaaagctgttcaatctgtttctggtcaagttactctccctggatctaaaagtatcactaaccgtattcttcttttgtctgccattgcagatggtgcaacaactatcataggnccncttgtttctgatgacacncttcatatgattgatgcattaaaaaaacttcaagttgatcttacgcaaaaagataatggtgacattctcattcatggtactcgaggtaattttaaaaataaatcagctgaaatttttttaggtaatgcgggtactgcatttaggcctttaactgcagcattatctttttccaagggccaatacacgctaagcggtttgcctngaatgcatgaacgccctattaaagatcttgttgacgcgctcttgcaattaaatgcagatataacctatctcggtcaagaaggttatcctcctttaaagatatctccatctgaaattatgattaacggtcctataaaaattaggggggatatttcaagtcaatttttaacatctcttctaatggcaatgccacttacaaaaaaagaagtggttattgaaatcgngggtgatttaatttcaaaaccttacattgatattacgcttaatctaatggcgcgatttggtatacatgttaaaaaaatagactggaaacattttgttattcccggttcaagttcctacgtgagcccaggtgaaatatttgttgaaggtgacgcttcatcggcctcttatttcttagcagcaggggcgcttgccggcgatatcgaagttaaaggtattggtagaaatagcattcaaggtgatgtgaaattcgctgaggctttagtacttatgggcgctgacataaatatccttgaagcatctattcaggttacaaaagtcgctgctcttcaagcaataaatcttgattgtaatcatattccagatgctgcgatgacgcttgcggtattagccctatttgcaaaaggcacgactaagcttcttaatattggaagctggcgcgttaaagaaactgatcgcattaaagccatggcaactgaacttagaaaattaggtgcggctgttactgaaggtaatgattttatagaaatcacacctcctcttaagattaaagagcatgttgagattgatacttatgacgatcatcgaatggctatgtgtttttctctagttagtctaagaaatataccaatcacaattaacgacccggngtgtgtcaacaaaacatttccaacttactttgaggtcttagaaagtatagtaaagacataaatgacatctcacattcctattatcgcgattgacggcccttcagcttctggaaaaggaacagttgctaaacttgttgcggaaaaactaaattttcactatctagattcagggtcaatctaccgaacgatcgcttatgcaggtcgcttacaaaatatacccctcaataatgaggctttacttcttaaagttctcgagaaagctaacttaagctttaaaaatgatcatattttactcaatggtaaagatgtatctgaggctatacgtagcgaggaatcgggtcgaggagcctctgaagttgcggttcacagagctctcagag

SEQ ID NO: 1368 - DNA, 4000 bp, Escherichia coli
  misc_feature (214)..(214): n is a, c, g, or t
  misc_feature (220)..(220): n is a, c, g, or t
  misc_feature (277)..(277): n is a, c, g, or t
  misc_feature (575)..(576): n is a, c, g, or t
  misc_feature (1964)..(1964): n is a, c, g, or t
  misc_feature (1985)..(1985): n is a, c, g, or t
  misc_feature (1987)..(1987): n is a, c, g, or t
  misc_feature (2805)..(2805): n is a, c, g, or t
  misc_feature (2850)..(2850): n is a, c, g, or t
  misc_feature (3264)..(3264): n is a, c, g, or t
  misc_feature (3363)..(3363): n is a, c, g, or t
ggatcgctccgccgggaagatgctcatgatgactgccgtcacggaggcattggcaaagccgtagcaaaggccggcaaacgcaagtgcggatatcgcccaaggaagcgatgcattgcgctcggcgatgtaggccacgctgcccagtccaaggatcgaaagtccggcgagcaagaaggctacgttggatcttttggcggccagcaatggctccgtnatgaancacgcgagaaagccggccgccgccatcggcaggcagcccagtccaaataccaacccnctttggcgcaagtcgacctgaatgaaataggatgcccacagcatcgaaccgacgatagccgcgaacgtgaacacgcccacgcatacctgcggcgccatcgccaacccacgcatccacgtgtcaagccgcagcgcggcttcgcgtttcacaagcagccagatgatgagcgcggcggccagcgcgtagcagagcatggcccagtcatactggcctacaaaaaccgcaaccgccgcaagcatggcggccaccgccagctcacccagaatcgaaggcctgcgtgccgtgcttggcggcgcgnntttttcacgaatccggaagccgacaaagacgataggaatcgtggcaagagcggtcacccagaagattgaccgccagccccaggcatccaacagcatgccgcccaacacgggtgacagaccaaaacccgccatcccggcggcggaccagatactcatcgccgccgctaatttgctgggaggcgtgtgagagcgcaacagcacaagcgcggatggcgacagtaacgcggcgaatgcgccttgaacaaaacgcaggccgatcaatagcgcttcagcgctgaccagcgcacagaagattgacgtgaccgcgaaccccgtcatgctcaacaggaaaatccggcgcgcgcccaggcggtcgcacagcgcgccgccgggccgcagaccggcaatccgcgccaacagatagcccgagataatccactgcacttgcgcggcggtgaagtgcaggtccgatgcgatatgcggaagcgcgaggctcaccgcgccgcccatcgacgcgccaacatacgttgccgccgcagcgccgacgaccaccagtttctcgctggcgcttaaccgaggggcgggcggcgtttggatcattggcgtcctcaatgaccaacggcggtcaggtcatgcggcataaaggttgtatcccatcgccttcgccacggccgccaccatcagctgcccccggacgctattgcccacggggtccaaaggcggcgagaacgcagcaattcccatcttgcctggcacaacagcaagaatgccgccgccaacgccactctttgccggcaggccaaccgtataggcccaatcgccagagctgccgtacatgccttccatggtcatttccgccaaaagaaatggggcattggcagccgtaagcacacgttctttggtgatgggattgacgcccttgccagcaatcgtggcgcccatcgtcgccaactgcacggtggataccagcgttgagcactgacgcgtatagacgtcgcacgcctccatggggtcgcagtacatggcgtcggccgagtacagcagccaggcaatcgcgcgattatggaaattcgtgctttgctcggattggttgacgtcgtgcgacatctcaagctttgcgccggcaagccgcgactgcatgtcgaggatgcgcgtccagcgttcttcgacggaacttgccttgatgacgcttgtggtcgacatcgcgccggcgttgaccagcggagacaaaggcttgtcgccatgcaattccaatgcaatgaccgaattgaacggcagtccggtcgggtccgcgcctatcttttcctgtacggcgtccggccccacatcctccaaggccagcgccagggtgcagactttggaaattgactcgatggcgaacgggtagtcggtgtcgccggcggcgaagncgtcgccgtcgacggtcacgncnacgacgcctgacaggtcggacggcacctttgccagatagggaatgtagtcagcgttggcgccgcctggcgccgcgtgatgttgagcgtaggcagccgccaccgccgccttcagcgtattgagatcaatagccatgagaatctccggcgatcaccgggaaatccgtttatcggatttcccggattcacctatcaggttctggaggaaggcgagcccgccgagccgcttgccgccggcgaagcgctgcttgtagccacgggcgtacccgtcaccgttgtgctgggtaccgtctttttttcctgccaggtgaacggcgcaaaatcactgtccgcatcacgccagccgggtttgcgcaccatgtagatcaagaacggaatgatgcagaagaagacggtcaagcccaccagtatttcaacgtacgtggaggggctgcccacggagatctgactgggcggaatgaagctgaagacaaacgccagcaaggaaccgacgaatccggcgccaccgatgatgtacatccccatgtccccgcccggtatgcggtagggccgcggacggtcgggctggctgcggcgcagataaattgccgcggcgaacatcaacaggtacatcaccagatagaggatgaccgtcagctggctcagcatctggtacaccgcctgcaccgaaggcagcaccacgaacagcgtcgccaacaggctcacgatgaccgcctgaagcaacaggatgtgcgtggccatgccgtgcgaattggtgtgttgccaccaccgcggcaaatagcccgccttagccaccaccaacaagccggacgatgggccngccacccaggtcaccacacccgcaagcaccccaatggccaaggcnacggcgacgacgggacccagccaggccacgccagcccacttgaacatgtcgttgtaggccaccagcagactctgtgtgaggttgatgtctgactgagggatgacaaacgcaatcgccagcgtacccagcacgaagatcagcaccgtgcccaccgccgacaacatgatggcgatggggtagttgcgtttcgggttgtcgacttcctggacgtggatggcgttcatttccatgccggcataaaacaggaagatgcttgccgccagcacgatgttgtcaaagttggtgaagtcgggaatcacctcaccccaagacaacttgatttgcggcgtgttgcccgcaaacaaatacgagaaccccagcacgatgaggataattgccggaatgatggtgccgactatccccccccacttgganacctttgcaaaggtctccacgccacggaacgcaatgaatgtggctagccaatagatgccgagcacgatggccaggatgaagtacttgttggcggacagngcttcatcccatcgctggtccggcccgatgaacgccagggataccgccccgaacgtgagcgcggtaggaaaccagacggtgacctcgacccacaacatgaacatggcgaggaaggccaggcgtggcccgaaggcctcgcccacccagcggaagatcccgcctttctcggaccatcccgttgccagttcagctgcaaccagcgatacgggaattaggaaaaatacggcggcaaagaggtaatagaagatggagctcaagccgtattcggcttctgccggcaaaccacgcaggctgaccaccgcgacgatgttcatgatcgcgacggtgccgattccgagtttcttgagcgacggcttgctcaccgctttgtttggaagcgagtcaggcatagatcattcccccagaatggagatctattgacgatcgtgtgggatagcttcagaccaggttcaggtgtggttgaacccttcttcactggcgacgccgtgcaacgacgggtgctcagccagataggccagtgcgcccttcatgtcctcgatcagcagcgctgcgaaatccatctcgaacccgcgccggcacatgatgcgcatcacgacggtgtcagacatcttcccgttcagtgcgaatgccggcactt

SEQ ID NO: 1369 - DNA, 4000 bp, Escherichia coli
  misc_feature (78)..(78): n is a, c, g, or t
  misc_feature (1010)..(1010): n is a, c, g, or t
  misc_feature (2632)..(2632): n is a, c, g, or t
attttacttccctccttaacaattttacctttccctaactctaaaatttcattaattcctggaagctctacccctaanccatttcccctaggatatctaaatgcacatggtctatcgttgatgctcaccgcagtattaatcattctaacgagttcagcttcatcactagcggccatcaccacgaaatttggcaaagtggataaataagtaatatcaaaagcacccgcatgtgtgggtccatctgcaccaactaaacctgctctatcaattgcaaatctaacaggaagactttgaatagcaacatcgtgaacaacctggtcgtaagctctttgaagaaaggtagagtaaattgcagcaaaaggtttataaccttccgtggttagacccgctgcaaatgtcactgcatgctgttctgcaattccaacatcaaacattcgatctggaaatttttttccaaaaatatccatgccagtacctgaaggcatagctcctgtaattcctataattttcgtatcgttttcagcatgtttaattaaagtgttagcaaacactttcgtataagatggtgtattagatcttggtttagattgttctccagtaacaacattaaatttactaacaccatgatatttatctctagaatcctcggctggcttatatcctttgcccttttttgtaacgacatgaaccaagataggcccatcatattttaaatttttaacattattcaaaactggaattaaactgtccaaattatgaccatcaatcggtccaacataataaaaaccaagttcgttaaataacgttcctccggaaactatatctcttataaatacttcagcttttcctgctttatctttaaacttttttgaaaatatagaagtaatagatttaatagtttctctgaaactaaagtaagtctttccagataacagctttgctaaatatgaactcatggctccaacaggtctcgcaattgacatgtcgttatcatttaaaactacaattanttttgatttcatcgctcccgcattattcattgcctcataagccatacctgcactcatagctccatctcctattacagcaataacatgattagaatctttcgataggctttttgcaactgccatacccaatgatgaagaaatagaagtcgaactatgagctgctccaaaagtatcatattcactttctgatctttttgtaaaacccgaaagacctccaccttttcttaaagttctgattctatctcttcgaccagtaattattttatgaggataagcttgatgcccaacgtcccaaaccaatttatcttttggtgtatcaaatacgtaatgtaacgcgatggttaattctactacccccaaacccgctcctaagtgtccaccagttgttgaaacaacatcaatcaattcctctctaagctcttttaccaattgcttgagttcttcttcttttaattttcttaaatctgatggataattaacatgatctaacaaactagttttcgacatttaaaattctcttgttaatatgaattcaatagattctaataaatcgttggctttaataccatattttttaatttgttgatccaattttttttttagagttttagcaaaatttaatgtttcgctatagcctaataaatttaccaatgttgcctttcctttcttttcgtcacttttagttggctttccaactgtcgcactatcacctttataatcaattaaatcatcgacaatttgaaacagtaaaccaatttgtaaaccgatctctttcaataattttctttttttgatattatattcattaataacagcaatactttcacaacagaaaccaaacaattctccagtttttttcttttgcatattaattatattcttttttgaaatatttttattttcaaaagtcaaatctaaatattgaccaccagctagaccggaatgaccagaacaattagataacgctctgattagctcaactttaatcttttgtgatatctttaaatcactaccagacaaaatttcaaacgctaaagtaagcaaggaatttccagctaagatagcagtaaattcattaaattttttatgtgtcgaaggtctacctcttctcaaatcatcgttatccattgaaggcaaatcatcgtgcattaatgaatatgagtgcaaacattcaactgccgcaccaataataattaattttttgtagtctattctaaaaatttttccagtattaactactatggccgatctaaatcgtttaccaccagagaaaacaccatatttcatgggtttaattaagtgcgacttactattttgttttgaaaaaacacttttcaagtatgagtctgtgtcctgtgcaatagtgtttaatttaccggaaaaatttgccatataagttatttcaaatctttagaggaaatttttccatttttatctaaggtggactgtttaatttcattagcttttttcttaaattgctcttgaatatgaaaatttaaatatatcattctgttatattgttctatcgagctctctaggtcagtctcggtattttctagctttgtaattatttctttaatttcgctttgtgcttcttttatggattttgtgcttatatcagntggaatattttttaatttcataatatatccatatactaattaatttatgaaaaatatctattcaaatatatataaaccaaatttgattaacttaaaaaaagcaaaaaaaaacatagaaaataataatattattggaatgccaactgaaaccgtttatggcctagcaggaaacgcttactccaataaatcagttacaaaaatttttaaattaaaaaaaagaccaatttttaatcctcttataattcactttaaaaacttaaaggatttaaaaaatgacgcaatcttgaataatacttttacaaaactttataaggctttttgcccaggaccaattacttttatattaaaaagaaagatcaaatcaaagatttctaaaatagctactgcaagaaaaaaaactgttgctgttagaattcctaaacataaagttgcaagaaatttgcttaaaattttaaatgcaccacttgcagctccaagtgcaaatatcgcgtctaaacttagcccaacttgtgcaaaagatgttgtggatgaatttggaaataaaattaaattcatactggatggcggtcaatgtaaaattggacttgaatcgacaataatagatttaactgtaaaacccactattttaagaccaggaagtatatctgctgaaaaaattcagaaaatattaaaaaaaaaaattactattaataataagccaaaaaaaatcaaagggcccggacaattaaaattacattactcccccggaataccaattataatgaacaggaaatatcctgaaaaaaatcaggcatttattagttttggaaaaaaatttaaacacggaaaaaataattttaatctgagtaaaaatggcagtttaaaagaagcggcaaataatttatataaaatcatgagaaaaataaaaaaaagaaattttaaatcaatagctgtcactcaaatacctaatattgaactaggtcgcgcaatcaacgatagactgataaaagcgtcaaataaatgaataaagaaacaattatagttgatggtttaactaagcaatttaaaaacatattagctgtcaataatataagttttaaaattggtaaaggtaaaattattggtctcctcggaccgaatggatgtggtaagtcaactaccataggtatgatgcttggtttgataaaacctagttcaggaacagttattatcaatggtcaaaatattgaacagaaccgaacagacttgctggaaaaaatgaattttatttctccatatgttgaattgccaaaaaaactaacagttgaagaaaaccttaaggtttatggaagattatatggagtaaaaaatttaaaagataaaatttctgatttaatggaaaaattaaat

SEQ ID NO: 1370 - DNA, 4000 bp, Escherichia coli
  misc_feature (408)..(408): n is a, c, g, or t
  misc_feature (1654)..(1654): n is a, c, g, or t
  misc_feature (1682)..(1682): n is a, c, g, or t
  misc_feature (1800)..(1800): n is a, c, g, or t
  misc_feature (1804)..(1804): n is a, c, g, or t
  misc_feature (1808)..(1808): n is a, c, g, or t
  misc_feature (1986)..(1986): n is a, c, g, or t
  misc_feature (3855)..(3855): n is a, c, g, or t
  misc_feature (3858)..(3858): n is a, c, g, or t
acattacaaacgcccagatcggttacgtgtcagagtacggtgagccggaagagaatataccggcgcggccgtggctcaagccgggcattgaagcggcacagggccagatcaacaagcgccttgatgccgctgccaacgctgcgctcaacggcgatgaccggcgagtgaagcagcagatgaacggcgcaggccaggccgctgtcacgtcgatcaagggccgcataaccgcgggcatcgagccggagcttgcgagttacacgatttcggaacgccagcgcatcggcgcgctgggcacaacgccgttgatacgcacgggcgcctttctgaactcgatcacatatgtgctggtcaagtagcatgactatccagctaggtcgtatcaccacatctgggttgttcgccaccccnatccagcgcacgcggcgaacggctaccgtgaacgactacggcgagacgcagaccacgagcataaccgaatacatccgcgcgacggttacgaccgcaagcgggctggccgcggagcgcatacctgacgcaacacagcgcgtcggcgctatcgtagtgtcgacgactttcgagctactagacgccaaggccggtcaccagccggacactttgaccgtcaaaggcgctgactacaccgtcgcagcggttgagaactacgcccagaacggctactatagggcgctttgcacagtgcgggcggcgtccggcacgtgaatcgaaaaggcgagacggtatgaccaaatatgcaaacaacgacacactgaccagcagcgatgcgtgggcgtgttcctggcatcgccgagatcagcgggcatagagtatggcgccgccaactaacactaccgcaaccggcggctacctgcagccaaccaatagggcgtatggcgacatgctactccatcccgtccacgacgttatcgcgggctgtacgggcattggcgagtcgctcatccggccgcgctggcagcgcgaaccgccgcagcgcccgcggcacgataccaattgggtagcgttcggcgtacagacgatcaaccaagacgcctgggcggcggaaggcgaaggcttttcggcgcgccatgaacagattgagtttctgtgctcgttctacggcccagacgccatggacaacgttgcgcggttcacgacgaccgcgcaactgagcgcgaaccttgagctggccgagtattatggcctgtactacggatcatgctcgcagatcacgcccgcgcccgttcttttgaacgagcaatattacaacagatatgacgtaacagtagagtatcggagacgtgttgaattaaggtatgatgttctaactgtatcgtcgaccgcggtcgatttacacaatgacgttggaatgcctaaacagcacgtggttatcacggaatgagtattggagaaagatatgagtgaagggctttcagtcagcgacattgtaaacgtcgacgttaatctgtcgccgatcgcggcgggcacgcgcaacttcggttcgctgctgctgctcggcaacacgcccacaattgcggttggcgaagacccgcgcgagtacagccagatggaaggcgtcgccgcggattttggggtcaacgatcctgagtaccaggccgctgctgcgttttttgcgcagtcgcccaagcccaattttctntacattgcgcgatgggccgcgacggccnccgctgcgaagctcaacggtggttttctcgccgatgccgcgcccggcgacttcaccggtatcagcgacggcgagctgagcatcgagatcgacagcgtactagtgacagcaaacgtcgntgantcgncacccattgatttgacgggcgaaacgtcgctgaatggtgtggcgtcggcaattcaaaccgcgctttcggcattttcgaccggcaccgaggttatttggaattcgagcttttcccggtttgaggtaacgtccggcacgacaggtgttacatccactattgcctatgccacacccactgngggcggcggtaccgacctggcacccttgcttggcctcaccgttgaatatgcgtcggcaccgttccagggcgtcgatgctcaggaacttgaccaggccgtgcaggatcaagcaaaccggtcgaccgcgtggtacggtctggcgctggcggcggaggctaccgacgacgctattgttgcgacagcggatgttatcgaagcgcagggcacgtcgcgcatatttggcgtgacgacccaagacccgcagaccgtcgactcaactattgtcgacgacctggcctcacgcctgatggaaggcggctacgctcgcacagcaattcagtacagttcaagcgatccctacgctttcgtaagcgcaatgggccgcgcgttcaccgttaattacacggcgcagaacaccgtcatcacgctcaaattcaagcaggagcccggaacccaggcggagttgctgaacacaacccaggcgcgcacgcttgcggacaagaattgcaacgtgtttgtcaagtacaacaacgctaccgccatcctacaggagggcgtcatgtgcaacggcgactacttcgatgagcggcacgggcttgattggttgcagaattatattcagacaaacctgtacaacttgctctacacgtcgcagacgaaaatcccgcagactgatccgggcgtcaaccaactccagacgaacgttgagcggtcttgcgcgcaagccgtcgtgaatggcctactggccgcgggcgtttggcaatccacagttgtgttcgggtcgttgcacaccggtgatacgctgcccaagggctactacacctatgccgcaccgatccgtacacagagcgcatccgaccgagcagcgcgcaaatcacccgcgatccaggtggcggcgaagctcgccggcgcggttcattccgttgacgttatcgtaaacgtcaaccgctaggagaccacaacatggcaacgtatagttttggagacgttagcgcgacgctggccgcccccggcgcgtccatcgcgcttggtgccggttcggcaaacgcggaagagggcatcaccctgtcgttcaccaccgaccgcaatatgatgacgattggcgcggacggcgagggcatgcagaccaagcgccaggacaagtccggcacggtcacaatccgcctactcaaaacgtcgccgaccaacgcgctactcaataccgcgttcaccgcccagtctgtcgattcagcaatgtggggcctcaacgttataacggtcagcaacagccaggccggcgacctttgggcctgccgcgaatgtgccttcgttcgcatcccggattacacctatgcgcaagacggcgacaccgttgagtgggagttccatgctgtgaagattgatccagtaatcggggcgtataacgtatgaccaccgaaatccaccacaagggcgcgacttaccggatcgacaatctgacggcatttcagcagttgcacgtatcgcggcgtatttcgccgctgatcgcgccactgctgccgatcgttcaggacttggagagtgaatctgttagcctagaagatgccgcagcgcatcttgggcctatcacagacctgctcgcgagcctcggcgacgaaaccgttgagtatattgtcaacacgacgttgagcgttgttaagcgcgagcagggcaactactattacccgatctgggcgaacggtcagctgatgtacgacgacctgacgatggcggacggcatgcagctggcctaccaagtcattgtggatcagctgggcggttttatcgacggattcctgcaaagcgccgggcaggagtccgtgtcggcgaagacaccagcgagtaccgcgaactagggccggaagaatggcttatgcgccctgtgattaaggnctngtgccggtatgagtcgctaatcgacgggacggtggggctggaagatattgcgttcatgaacgatatgattggagcctacgatggctgaagagaacgtcatgcgcagcttcgtgacgaagctgggcttcaaggtcgatgataa

SEQ ID NO: 1371 - DNA, 4000 bp, Escherichia coli
  misc_feature (1986)..(1986): n is a, c, g, or t
  misc_feature (1991)..(1991): n is a, c, g, or t
  misc_feature (2010)..(2010): n is a, c, g, or t
  misc_feature (2064)..(2064): n is a, c, g, or t
aagagcagaagttgctggatttacagattcttattacaagtatggaactgttccattggtacttaaaaagaatttaaaaaaatattcaacatggaaatctttaaacaataaagatgtaacgattgctacaacacttgggacttctcaagaggaaaaagctaaagagttctttcctttgtctaaattacaatcagttgagtcacctgcaagagactttcaagaagtattagctggtagagctgatggaaacattacaagttcaacagaggctaataaattagttgtcaagtaccctcaattagcaattgttcctgatggagaaaaaaatcctgcctttttagcaatgatggttagtaaaaatgatcaagtttggaatgattatgtaaatgagtggatcaaaagtaaaaaatcctctggtttctttaataaactactcgctaaatataatttaaaaagcttataaaaaattagatattaatctctaattcattataactttaagagtgaaaaatttactttttttacttttaattttaccccttacctcttgtagtggtcaggaattgggttggtttattctatcacctaacaatgttgaaggtttaacaaacctaaaatttttattaagtggtttaactacaactatttatatttcagtagtatctataattatatctgcaattttagggtttatcgttgcaattccttctttagctaagaataaatttttaacatacataaatattggatatgtggaaattgtaagagcaataccgttacttgttttaatattatggatttattatggtttacctataatgactggattaagtttcagtccatttgtgtctggaataattgcgctggcaataagtgaaagtgcttttcaagcagaaatttttagagcaggaataaactcaattaaaaaatcacaatgggaagcaggctcatcactgggtttaactttttataaaaggttaagattagtaattcttccacaagcaattaaaaatatccttcctgcattaggcaaccagtttgtatatgtattaaaaatgtcttcattggtatcaattataggtattggtgacttaacaagaaaagcaaatgaattagttgtgtcaacctatagaccattagaaatttatacatttttaatcttggaatatttaattttgatattaattgtttctttcatagtaagaaaatttgaaaaaaaacttaaacaagatggtaataattaatgagtaatttagactatgatgttgaactaaatgatggtgttattacttttaaaaacattaatactacacttggttttgttcggtataatgagacagccgaagtggagtatatttttgttaaccccatgtttagacgtcaaggacttgctaaaaaactattaagtatcgttgaggaaaaaactaaaatcaaacccacacctcaagacccaatcagtcctttaggtgaaaagctctttaaaattaataaacaagagattaactagaattttggagcacctgttaacagaactaccctattagctttaatttttcttagattttctgtaatcccaaggataatcaaattccatagaccacatacctattttattaattcttgcataatcttcatcagatacaaatttttttgaataccttctataggcaaatgcatagccacttctaactaaataacttgataagctttcgttattaacaaaacattcagccagtgttcttttgtattgatcttttccttcactaatacattcaacgctattgtttgaaattttatcaataaggatttgttttgctgtaattccacaaggatccttagctccttcgttaaggcaagtttgttttaattcaggtgtatctatccctgtaaatctaattttttctccattaagatgaattgtgtctccatctacaattttgattgtttgagatttgacttggttaatagttaaaataaatattagtnctganacactaataagaaaaatgnctttttttttgtttaaaaacattatttaaaaaatatccaataaagatgattacngcaatacccataaaccaattggttgccatgatggtataaaaaatatccgcataatctcctcctctaatattaattacataccataatgataagaacggaaatgcagttaaccttagaacgcttaagtaaagactataaattggttttttaagtgcctgaaagactgctgttgtaataaagaatactgggtaaataggagctattaatgcagcaacttttaaatatatagcaccatgataaatagcttctacattatctgtaaactgagatacaaaaaactctgcaccgaagaataaaaccacacctgctacggccataaacgatgatccaaaaaataatgccttagtataaagctctctaatacggttataatttttagcaccaaagttttgtccaccgatagaaagtactgctgtatttaaaccaattactggaagtaagaagacttgctcaactcttaaagctgcaccatagcctgctgttgcaagatcaccaaattgtccaataaaatataatatgttaaaaatacctactccaataaacaacatactaatcataattggcattgcttgtgcgaacaattctttaagaagaataaacttaggaataaagcatttaatagataaatactttcttaatttacatgagttaattttataggctaaataaatagtaccaatagattgagcgataacagttgctattgcaaggccacctataccataagctggaacaattccgtatccccagataaataatgggtttaaaaaaatatttaaaaagaagctaaagataagaacatttctataacttttagtatctccctgtgcatttaaagctccatttaaagagatttggatcataactataaatgttccataaaaaattatatctaaatactctctagttaaagcgataccagcagcatcagagcccataacactcaagagaaaattagaggcgtttaatccaaataaagtaactacaatagaagtaaccaatgaaaaaattactgattgagcaataaatagtgaagctttattaatttttttagcacctaataaattgccaatacatgagttcgttgcagctccaataccaacaccaacagcaatgataacaaaatatatgggaaatgacttagcaatagcacctatagcttctgcagaaattctacccgcaaaccatgtatcaactaaattataaaatgtttgaaataatgaaccaacacttgctgggatagttacttttctaagtaattcccaaattggatctttagttaatttaatggctttggacaattatttttcctatttaaattctttttgaaatatatgcttcgatccagtctttttagcaaggtttatttgcttttgtctcattcgaaatctctctttttgagtttgagttaaattatcatgacagtttacgcatgaaacaccctcctcatattttttagacttcttatcttttggtgaaaccggttttctacatccactacacattgagtatgtgccagttattaatccatgtttaacactgattctgttatcaaagacaaaacattccccattccataaactttcctttttcttaatattttttaaataatttaaaattccaccttttaactgataaacatttttaaaaccttttttttctaaaaatactgaagctttctcacatcttattccaccagtacaaaacattgcaattggttttgttttttttagtttattcaggtattttggaaattctctaaaattagcaacatcaggattaactgatcttttaaaggtacccacattatattcaaatggttttcttgaatctaaaactaatgtgtctttatcattaattaacttattccattttttaggatctatatgattatttttcttattttttgatgacaaagaaagacccatgggaacta

SEQ ID NO: 1372 - DNA, 4000 bp, Escherichia coli
  misc_feature (320)..(320): n is a, c, g, or t
  misc_feature (524)..(524): n is a, c, g, or t
  misc_feature (1680)..(1680): n is a, c, g, or t
  misc_feature (1845)..(1845): n is a, c, g, or t
  misc_feature (1985)..(1985): n is a, c, g, or t
  misc_feature (2133)..(2133): n is a, c, g, or t
  misc_feature (2211)..(2211): n is a, c, g, or t
  misc_feature (3175)..(3175): n is a, c, g, or t
gagctttgtctccatctgcactaagattgcagtctgtagctgccgaagcatctgtgttgctcagtgctttagcgaaggcattaccagtagaatgtacgtattctgagcgtactgtccagtctttaaccttgtattctgcagagaaggcatagcgtcgttgttgcaggctacgtacaccagagtgtgtggttccggctgcgtctgtccacgtacccttgcgagcatacgaacctgtccagccgaaacaacctaagcgcataccttcaacaggcattacccatacgccaccaatgatgttcttctgctggtcgacatctctnacgttgataccctgtccgtcgaaaactccaacttgatagtgtacaaggttcctaccagcattattctttaagaagtcaccttgtatctgtacaccaatatctcgaccgtttgaaggatgcgcaccagcacggtcagagaagcttgccaacttctgaacactttgtgctacgctcatgaaaccttggtcgatagggtggataggnttgtcgaatgtaaatggattcttgaactgtcccgccttaacacggaagaagtcatacttctgccactcgatgaataagtcgactacacggggtgatgcgcccaaagtagaggtgttaccattaaactgtaactgtgctttccaataccaatcatttaagatacggccatcaagagagacacgaccaagacggaggttgaatgtgtttgacttgttgttatgcataccattgtattggtattgaacgataccaaagcctgacagcttaacgttattaatccatttcggtgcttcttgtgctttgctgagaagcgagcatagcatcataacagataagataattgtttttctcataactatatgaatttaggtaatgataatatcttaggttgataacttggctgttaacgatgcaaagatagtgttttatcaaacataaacaaaatattatgatgtttttattgtgtgtttttctttgtgatggcgattgataatgttatccttatatataataaggtgaaattgtctgtgatgtcagtaacaaaggaggaaaaacctgtgaactgacaagacagacaatttttctttcgatattatagctttactatctcttttctaatagtactacattctcaacgtgtggggtgtgagggaacatgtctacgggttgaacagctgctaccttgtagtcaacatcgagtagagcgaggtcgcgtgcctgtgtggcagggttgcaactcacataaacaattcgttttggacttgctccaaggattacgtttacaacgtcttggtgcatgccagcacgtggagggtcggtgatgatgacgtctggacgaccgtgttcatggatgaagtcttccgtaaggatgtctttcatgtcacctgcatagaagagcgtattgtctattttattaacctcagaattgacctttgcgtcttctatagcttctggaacatactcaataccaataacttgtttggccttcttggcgacgaaattggctatggttcccgttcctgtatacaggtcgtaaacaagttcgtcacctgtaaggttagcaaactcgcgcgctacagaataaagatggtatgcttgttcggtattggtttgatagaagctctttggtcccaccttaaacttcaagtcctccatngtctcaaagatatggtcatttcccttgaagagagtgaggtcgaggtcgttaaaggtgtcgttacctttctgattatcaacgtagaagagtgatgtaatctgtgggaaacggtcggcaatatgctgcattaatgcttttgcacgttcgtcatctccctcctcatcntagtggaactgtatgagtaccatccattcgccggtattagagttacgcaccataatatcacggagtaggccatgctgtgcacgaatgtcatagaacttcatccctgtctggtgtgcatagtcgcgaatgtcattacgtanctcattacagaggttgtccatcaaccagcatttctcgatagggtagaccttgtcaaaagctcctgtgatgtggaatccgatagctccttcttctaagccagcgtcttctggcagagcttgaagctcctcagctgtgtaccatctcttnttagcgcagccgaattcgagcttgttacgatattcctttgtatgtaccgaacccatgatagggcggaactcaggaagntcaaccttgccgatacggcttagttggtcgtaaacttgttgttgctttgcctttagttgctcttcgtaagggaggttctgccacttacaaccaccgcagataccgaaatgttcacacataggttcttgacgaatattgctcttgctaatgaagcggatgacggtagcttcacagtagttgcgcttcttcttgcgtatctgaaggtctacaacgtctcctggtactacaaaaggaacaaagataaccttgtcgtctacgtgcgtaacacactttccttcggctgctacagcctctattgtgacattctccagaatgggtaatggctttctttttctactcataatctgttttgtatttcgttgcaaagttactaattttttcttgtttgtggtttacatgatgatatttatcggttctgtgtacgccaacaaagtaaaaatgtaaggtcaacatagcaaattttacagaaaagtttgctactttacctatttattggtatatttgcactatacaaataactaaaattcattatcatttttaacttatgagcgaaaagagagtttatacctttggtaatggtaaggctgaaggtaaagctgacatgagaaatctccttggaggcaagggtgctaacttggcagagatgaatcttattggtgttccggttcctccaggctttacaattaccacagatgtatgtacagagtattatgagaaaggtaaagagactgtagtaggtttgctaaaggcagaagtagagaacagcgttaaacatgttgaaagtttaatgaactcaacctttggagacccatctaaccctctgttggtgagtgtacgttcaggtgcacgtgcttctatgcctggtatgatggataccattcttaaccttggtcttaatgatgctgtggttgatggattggttaagaagacaggtaatgcacgttttgcttatgacagttatcgncgttttgtacagatgtacggcgacgttgtattgggcatgaagcctgtaaataaggaagatatcgacccattcgaggctattattcagaaggttaaggctgagcgtggcattaagcttgataacgagatgaccgttgatgacttgaagcaacttgttgtactcttcaagaatgctatcaaggaacagaccggtaaggaattcccaaatgatcctatggagcagttgtggggtgctatatgcgctgtgttcgactcatggatgaacgagcgtgctatcctttatcgtaagatggaaggtattccacaggagtggggtacagccgtaaccgtacaggctatggtatttggtaatatgggtgatagctctgctacaggtgtttgcttctctcgtgatgctggtactggtgagaatctcttcaatggtgagtatcttatcaacgcacagggtgaggatgttgttgcaggtatccgtactccacagcagattactaaggaaggttcactccgttgggctgctcagcagaatatcgatgaagagactcgtgctgctaagtatccttctatggaagaggctatgcctgaactttatgcacagctgtttgccctccaggataagttggagaagcactaccatgatatgcaggatatggagttcactgtacaagaaggtaagctctggttcctccagactcgtaacggtaagcgtacaggtactgctatggttaagattgctatggaccttcttcacgagggagagattgacgagaagactgcactcttgcgttgtgaaccaaataaactcgacgagcttcttcatcctgtattc

SEQ ID NO: 1373 - DNA, 4000 bp, Escherichia coli
  misc_feature (472)..(472): n is a, c, g, or t
  misc_feature (572)..(572): n is a, c, g, or t
  misc_feature (1041)..(1041): n is a, c, g, or t
  misc_feature (1095)..(1095): n is a, c, g, or t
  misc_feature (1146)..(1146): n is a, c, g, or t
  misc_feature (1227)..(1227): n is a, c, g, or t
  misc_feature (1584)..(1584): n is a, c, g, or t
  misc_feature (1658)..(1658): n is a, c, g, or t
  misc_feature (1662)..(1662): n is a, c, g, or t
  misc_feature (1665)..(1665): n is a, c, g, or t
  misc_feature (1674)..(1674): n is a, c, g, or t
  misc_feature (1983)..(1983): n is a, c, g, or t
  misc_feature (1988)..(1988): n is a, c, g, or t
  misc_feature (2279)..(2279): n is a, c, g, or t
  misc_feature (2432)..(2432): n is a, c, g, or t
  misc_feature (2879)..(2879): n is a, c, g, or t
  misc_feature (2981)..(2981): n is a, c, g, or t
  misc_feature (3050)..(3050): n is a, c, g, or t
  misc_feature (3429)..(3429): n is a, c, g, or t
cctctggtaagcccgccagcagaatcgcgcccaagatgacacccgggatgtgtcccaagccacccaggacaaccatcgcgacgatcatgatggactccatcagtgagaatgattctggtgagacgaagccttggaaagccgcgaacaaaacacccgaaatgccaccaaatgatgcccccataccgaaggccatcaatttgaggttacgggtgtttagtcccattgccttggccgcgatttcgtcttcacgaatggccatccaagcccggccgatgcgcgagttttcaattcgatagcaaataaagatggtcatgatgaccatcaacaagaacaggtagtagtacagcgagaccgattcgatcgtcacaaaacccaaatctagcggtcgcccaaaatcgacaccgaacaggttgacgtcatcaatgcgcatcaaacctttcggtccattcgtgatgttgatgggacgatccanattgagcagaaaaatacgcacaatctcaccaaaacccaaggtcacgatcgccagatagtcaccgcgtagcttgagggttggcgcccctaaaagcatgccngccacacccgcaatgaacgctgcgatcgccaaaacaacccatatgttgtagtggacgccatctggaaatgcgctggccaagtttgcgaattggctcaacaagtgaggcgaagccaataagccaaacacataagcgccgacggcaaagaacgcgacgtagcccaagtccaacaagcccgcgtaccccacaacaatattcagccccaacgccagcatgatgtagagcaacaccatatcgatgatgcgtacccaagagttaccgaatggctgtaacaagaatggcaacaccatcaacaagatgccgcacgccaagaagacaataaatttatttcgctttgagttcatatgctttgcctcttcatgcgcgatcggcgacgcgctcacccatcagaccagacggtcgcaacgtcagcaccacaatcagcacaacgaacgcgaagatgtccgagtactggctacccaaaacaccnccggttagagcacctaagtagcctgcgccaatgccctcaatcaagccgagcgcnagccccccgaccaccgcgccgcccaagttaccgataccaccgaagacggcngcagtaaatgctttaaggccaggcatgaaacccataaagtgctggaccgtaccgtagttaagcgcccacatcacgcccgcnaatgcggccaaaacggcgccgatcacaaacgtaaccgaaatcacggtatcgggtcggatccccatcagaccagcaacacgcgggttctcagccgtcgctcgcatcgcgcgtcccagcttggttcggttaaccaggtaaagcaacccggccaacgtcactgcagttgcgcccagaataaaaatttgtgtcactgagatcacggcaccgccaatggcgatgggctcggttggcaacacagcagggaatggctttggattgggcttccaaatgatcatcgccatggtttgcaagaacaatgacataccgatcgcggtgatcagcggcgccaaacgaggcgcgttgcgcagcgggcggtangcaacccgctcgatcgtgaaattcaggatgccacacacaacaaaggagatgagcaacgccaggatgaggagganccanccnggtgcaccnggcatggcatcctgcatgatgctgatcacactccaactggtcatggcgccgaccatcagcacctcgccgtgggcaaagttaatcaggccaataatgccgtaaaccatcgtgtagccgagcgccacgagcgcatacatgctgcctaaaacaagaccattgatgatctgttgcagaaaaatatccataaaagaattgctccattgggccaccgataaggggcagcgatctggggtcctgcgcgcgaggaccgcgcggcgaacccgtgattgtagccaacctaaacttacaaattaggttgaatgtggtaanccgcngatcgggtaaaccctagagaggccgatggccgctggattcaacgggcgactttgtttgggggggtggcaccggcatttagcgcccgcaactccgcgagacgggcaccaattttgatctccaagccacggtccacaggctcataaaaacgttcagacgtcagtccctcaggcaggtaagtttcgccagctgcaaaggcccccggctcatcgtgagcgtagcgatagcccatcccgtgcgccatttccttcatgagagccgtcggcgcattgcgcaaatggttgggtaccggncgggaaccgtcgcgcttcaccagcgataccgctgatttgtaggccagataagcggcattcgatttgggggccatcgcgaggtagatggcgcactgcgccaatgcgagctcgccctcgggggagcccagccgctcatagacttcactggcatcnaaagccgttcgcagtgcccggggatcagccagcccgatgtcttcattggccatgcggatgagacgccgagccacataccgcgggtctgccccgccatcaagcaaacgaaccaaccaatacaacgcggcgtctgggtcagagccacggaccgatttatgcagggcgctgatggtgtcataaaagacatcaccccctttgtcgctacggcgcaaggtctcacccagcgagcgcaacagccaatcgtctgataccgtccgaaccttttgctgaagcgcgctaacgcaaatgatttcgagcgtatttaaaaggcggcgtgcatcaccatccgcataacgaaccaaccgatcagccgcatcggcatcgaattgaggcatgtcgggttcaagacaagccctggctaaaagcacgtgcaaagcatcatccgagagcccgcgaagcacgtagacngcggctcgagataacaaagcgctgttgacctcaaaagacgggttctcggtcgtcgcaccgataaaggtgaacaagccagactcgacatgtggcaaaaatgcntcctgctgactcttgttgaagcggtgaacctcatcaacaaaaacaagggttgcacgtgggaccagatcnctaagggcttgttgcgctctctcgacagcctcacgtatctccttgacaccacccaatacggcgctgattgtgatgaattgcgcatcaaaggcctgcgccattaaactggcaatcgttgtcttccccacacccggtgggccccacaaaatgcaactgtggggttggccactttcaaaagccagtcgcaagggcaatccgtcacccaacagatggtcttggccaatgacatcaatcaatgctttgggacgcagccgctgcgccagcggtacatgactaccggcgcgaggcgcgcttgcagttgagccgctcatgggcgaatgatatcggcacccgacggcggcacgaagcgaaaaacggcagcctcggccccattttctancgccgccagttttgcaaaacgcatgtccgaggtttggccgaaattatcaaccatcaccaaagcacgcaactgcgtcgaatcgaagccaacacgcatgagcttgagagtgccatcgggctgtttggggacagcttcaacccatttcagcccaccctcggtcggcatcggggtcaacacataaacggcgcgaagcgcattcaagtcgccactccccgccacaagagccgcaggcgtattgccaagggcttgcgcctgatctcgaacggtgacttggttcaaatccggatcccaaagccatagcgaacgcccatcggcgacgatggtctgtggaaaaggcttttggtagtcaaatcgaaacttaccggggcgcgagaacatgaactcacccgtggaacgggtttgtttggcacgcgtttgccctgacttcatgggggcggtcacggtttgctcaaaactgagctgcccagacggggtggcgcgcaaaaggctttgcaaatcgctaacgctatcggcccaggcgggatgcgccacggcgatcgcgcaaaaaaacagtgcgacgaagtgccgtttg

SEQ ID NO: 1374 - DNA, 4000 bp, Escherichia coli
  misc_feature (669)..(669): n is a, c, g, or t
  misc_feature (2852)..(2852): n is a, c, g, or t
  misc_feature (3878)..(3878): n is a, c, g, or t
  misc_feature (3901)..(3901): n is a, c, g, or t
  misc_feature (3930)..(3930): n is a, c, g, or t
ttggtaaccaaagttcatgttgaggtcgtgaagttgtgtaaagatggctacacggtatttatgattggtcatgctggacatcctgaagtagaaggcaccatgggccaagtagataaaggtatcttcttaattgagagtattgcggatgtagaaaagcttactttctcagccaatgagaatttagcctttgtcacgcaaaccaccctatcggtagacgaaactaaagaaattgtgaatgcactcaccaaaaagttccctaaaattattcaacctaagaagcaagatatttgctatgccacgcaaaaccgccaagatgcggtcaagtttatggctcctcaagtagagctagtgattgtcgtgggtagtaaggcaagttcgaactccaatcgcctgcgagaattggctgaaaaacttggcgtaccggcctacatggtggatgccccagagcagctccaggcagagtggtttgtaggcaagaagcgtatcggtcttacagcaggagcttcagcgccagagagtctagcgcaagcgatcgtagcgcgcattcaagagcttggcccacgccaagtacgctctttagacggcgttgtggaagatgtgactttctccctgcctaagaatttaacccacccaagttaagcgggaagtattgaggctcaaactactttnttaagaagtgttcttaagattgcacacatcgtcatgatttcttcattagagaccgtgagagcgggcataaaacgaagaagatcgggacgaggggaattaatcaacaagccttcaggttgatgctctctcgctaaatcaactaattttccgccaatatccttgcccagcattaaggcacgcagtaatcctttgcctcgctcgccttgaaggccgaactcagacgatagctttagtaattcggattggagcaatgcacctttagtgacaaccgattgcaaaaatcctggagctagcagctgctcgattacgctaattccgactgcggtcatcaaggcatttccgttataagtaccgccttgatctcccggcacaaaacaggcaacctcatccctacagagtagcgcagctaatggcacgcctccaccgattcctttgcccaaggacatgatgtcaggttcaatcccataattttgataggcaaacaacttaccagttcggccaaagccagcttgaacttcatcaacaattaacagcagattatgttctttagtcagttggcgtaaatcgcgcatgaactgatcatcgcatggaatcacaccaccctcaccttgaactggctccagcatcaccgccacactcttgtctgtgatgcatttcttcacggagttaatgtcgttaagctctgcttttggaaaacccggtacttgcggcgcaaacatcgtatcccaaccaggcttacccgaggcactcatagttgccaacgtgcgtccatggaaactatggtcaaaagtaattatttcgtaggccccatttttatggagttgcccccactttctagctagcttaatcgcaccctcatttgcctctgcaccactatttgcgaagaagactttatcaaagcagctattttcagttaatagatccgataaacggatcattggctcgttgtaaaaagcaggactcggattaattaatttttgggcttgctgatgcaaggcgttcacaatcccaggattgcaatgacccaaacaattgacagcccagccttgtaagaaatctaaatagcgtttgccattctggtcggttagccacgaaccctttccctccaccatgacgatgtcaggtcgtttagtgataaacatcaccgaatgggcatcaacgggacgagggtcaataggtttgttcattacgtaatcatacaaaagatcggcaaataatgggtatttagtctacccacttaggtctaagcacccactaaatcagcctcactggtaaaggaatcggcaaaaaactcatcttcaggtaactgacactctctcataaaatcagttcgagctgcctgaatgacgaccggcgccccacaggcatagacctggtatttagaaagatcagagaagtcttgcatgacagcgtgatggacaaagccagttcttccggtccatccatcatcaggtaaggcctccgatatgacgggggtgtaatgaaagtttgggagtgagagtgtaaattcgtggcagagggcatccatgtataaatcctttggacgcctgccgccccagtaaaaatagatctctcggcttatctttttttcctgaatatgaagcaatatggctttaattggtgcaaagcctgtaccagatgctaaaaagataatgggtttcttagactcttcttgtaagaagaagcttcctaggggaccctcaaagcgcaatatatccttttctttaatcttcctaccatcactcgcctgtccaaaaagggggtcggtaaacaagccgcccgatagatgacgaatatgtagctcgagcggcccctcctcatgcggcgcgcttgcaattgaatatgcacgtcgtttattgtctttaagtaggaactctagatactgtcctgccaagaactggaaacgctcactcgcaggaagctgcaacttcaaaatagctacatcgtcacttggaaattcaattgtattaattcggcaaggaactttacgaaccggtatatccccgccaccttgaacctcacgcacatcgatgaggaggttggattgtggatgcgcacaacataatagagtggcgccagccgtttcatccgatggatttaaggcgctctggctatggtccccatgggatacctttcccgagaggagtttgcctttgcaggagccacacgcaccatttttacanccatagggtaggttaatgccttgacgaagagccgcctcgagaacggtctcatcgtcctctaccaaaaacgttttaccactcatctttagctcaacctgatacgacaattccacttctcctaataaaaacattacgatgctgggtatgacttgtatttcttctgcatttcgtcgcccccgaatcctcatcattggctgtggggatattggacaacgcgttgttgcccatttaggaaaaacacaggccaaaccaaaaatctttgcactgagctcaagcccagagcgctttgcagcactgcgccaacaaggcatcacacccatcgagggtaaccttgatcaccctgagaccttgtggcgaattacccgcttagcatccaaggtgattcatctagcgcctcctcaaaatgaaggtgaaaacgatcttcgaacacgcaatctcatccaaattttatcccagggggcaggatctgtcagacgctttgtctacgtcagcactacaggggtatacggcaatcgtcatggtgattatgtggacgaaaccagcgcacccttagcaaccagtgcgcgttccaagcgacgtttggatgctgaatctgttttgcgacattgggcaattcatcagggtgtcaatctcagcattttgagggtgccagggatttatggccccaatcgcttaccgattgagcgcttacaagcaaacacgcccgccctcaacagtaaagaggatgcgtattccaaccacattcatgcagatgatttagccagacttgtacttggagccctttttattggaaagcctcaacggattgtgaatgcgtgtgacggcagtgagcaaaagatgggggactattttgatgaggttgcaactgctctaaatttaccaaaacctaaacgcttatctcgggaagaagttcgttctgcagtaagccccatgctttggtcgtttatgtctgaatcgcggcgtgttcgtaatgcacggctgaccgagttaaaacgcaaattactctacccgaaagtggctgactanctaaagacccttaaaagatagtnattacttccagctatcttttagaccaacnctttggttaaagactaagtgacctggtttgctatcaaggcgatcagcaacaaaataaccatggcgctcaa

SEQ ID NO: 1375 - DNA, 4000 bp, Escherichia coli
  misc_feature (56)..(56): n is a, c, g, or t
  misc_feature (251)..(251): n is a, c, g, or t
  misc_feature (293)..(293): n is a, c, g, or t
  misc_feature (335)..(335): n is a, c, g, or t
  misc_feature (548)..(548): n is a, c, g, or t
  misc_feature (1079)..(1079): n is a, c, g, or t
  misc_feature (1379)..(1379): n is a, c, g, or t
  misc_feature (1487)..(1487): n is a, c, g, or t
  misc_feature (1506)..(1506): n is a, c, g, or t
  misc_feature (1922)..(1922): n is a, c, g, or t
  misc_feature (1988)..(1988): n is a, c, g, or t
  misc_feature (1997)..(1997): n is a, c, g, or t
  misc_feature (2015)..(2015): n is a, c, g, or t
  misc_feature (2162)..(2162): n is a, c, g, or t
  misc_feature (2165)..(2165): n is a, c, g, or t
  misc_feature (2494)..(2494): n is a, c, g, or t
  misc_feature (2827)..(2827): n is a, c, g, or t
  misc_feature (3614)..(3614): n is a, c, g, or t
  misc_feature (3881)..(3881): n is a, c, g, or t
cagtagcgtagagtacatcaggatttgcaggtgaaatatccataccgattctcccnacatctcctcccggaaatccgttttctaccttattccaatgcgctccgccatcggtgcttttgtacatcgcgctgttggggccgccgctgaggtgcgtgtacacgtgtcttctacgttgatgggcggtggcataaagcgtttgtgggtcgcgcggatccatatgaatttcgttgaaaccagtatggtcgtcgacntatagaatacgcgtccaagtttgaccgccattttttgattcntaaataccgcgttctccgccggaggaccacaatggaccatangctgccacgtaaatatgatttccattcgtagggtttatggcaatcatgccaatatgttcgcttgtttcaagaccacttttggtccaggtttttcccgcatcacgactcacataaagaccgtctccgtaagccactgagcgctggttgttgttttctcctgttccaacccaaattacattagagttgttagggtcaatcgcgatacaacctgtnctgtagctgccttggctgtcgaatataggttcgaaagtggtgccattattcgtggttttccagacgcccgaagaggccaatgccaagtacattgttccggggtttttcgtatcaacggctaaatctgcgattcgtccagaagtggttgcagggccgacgttgcgaaatttgaacgcactgaggctggttttcgcccaaagcggctggtcttccttgcttttgcgctgggcttgtgcaggaagcgtgaatagaattgcaaaaagaacgactacggctgaggtagtacggcgaaatgaatggctcattcggaagagtatttaaatgaattggaccacaataagtgcagtcactgcaaattacgttaaaagatgcaaaacgccttagaatttccaggtcgacccgatggacagcatagagcgctgtctcgtgatggctagtgcctcggtataggttgcactgaacgggtaatattgtgtggattgacggagttggctccagctcatgaaaaaggtgtggccttcgctttgtaangagatgcctaaactgcgacgccactgcgcgtcttgcccttgttgaaaggcattggtatagccgctacctgcgcgcactgtgatggggcctaaacgcaattcagcccctgcagcaaaggtatgttggtcgtccaattcttcgttgacgatttggttgaggtaccgttcttctctgctcaaagctgcagcaaaaccgtgtgggatgtaggtgtgactcaacgtgataaggcctaatcggccacctactaacgtgaaacccgacttgagcttcggcgcagtcatcatgctccattggtagagnagaccgtatccttctgctttcgatatgatttggttgacggaagaacggaacgcaatcatctccgtatcccagttttgtgtaaaactgtacacctgaggaaggtcaacngcaattccaatgcgcatancttgtgtagggcggtataaaagtcctgcgttcgcagtgatgccaatgccactgttgtcccaataatccacaacatcaaaggaggtgaggtctgtagtttcgctgtagctctcttcatgcgtcaccgtcactttttcgaaagagtgcacgattttaaccgatgcgccgtagtaaagctgtttgctcgcttctgcaccaaagcccaaagtccattgatttttcattccggtacggcggagatcgtgctcgaagtctgtgttgttgagatttgcggtgctgtagtattcacccgtcgtgtcgttgcggtcggaagcatagctttggtagagcatgtcttcatacggacctacccacggtagatcgtctggcgaataatagtggctgttttctaaccattgctgctggatgctgcccccnccagtctgattgtaacgtaagttttgacgaaataaatcgtctgaattgtaggtaaagaaaatattnacacccgantcaggctctttacttatntagccaaggttggcaacattcatacttagggcattcccggttgggaagttgttgctgtttttgaaatgcgtcgtactgtagaaggaaagatcgctaccgaatgcagcctgtcggtagaggcctgctccagcaggattttcagcaagngcngtgaaagaaccactcattgcggtcattgcgccggagaggctattgtaacgtgcatcaccccacaaaaccggctggttaagcgtcgcaaagtagtccacactttggctcttacctagaaaagtcaaaaagaggagtagtgacagtaatcgaagttttttcatcgtctacgagagccgcttgagttggaagtggttccgctacgtgttggagcggaaggcgtgtacgtactgtttgttgaaggtgcgctctcgctgcggaaactggcgctccgttcgtagcttgatcgtgtcgttggagcatattgcttctcattgcgcgtggatcgaatnggttgaaccgcactcgagggcctgctgctgccagttgggcgcattgtcgaaggctgacgaagtgatttttgagcagattcgacaagcggttctgcccaccctctggaagtcttcgatactggtgcggaagccccctctgtaacgacttcgcttctccaatctgaagaataattggcaatgcgaccgctggtactcccttgtccgccgcttctgcggtatttgtttggacggcggccaccgtaatttacccccgttttaatagggtcatttgagggtgaggaagtggtgttgccaaaattggtcactccattccacgcattccatccgttgccntatggattatagccgtatccgtatgcattgtacccataagggttatagcccatgccccatgtgttgttccagccgtatggattgtagccaaaaggttgcatgccccaattgttattccatccgaatgaattgtatccagaggtgtggtagcccatcgaactccaagcgtttccgcccatgccattgttccattgtggatagtaataggtgccgaatcccggggtccaatagcttctgccgttgttccaccagttagaggatgatccttgaagtggtgttacgagcattgattgttcgccttcccagatgagtgcatagtcatcctcagtatatggctcgctatccattactcccatggattttgcaccggcaaatcgcggcgcaggaagcgcagggttgtaataattttcgtcctcgaaataattatccgtcaaactcacagaagtcccacatgatgataacatgagggaagaaatgaaaagtagtagtatgggcttcttcataacttcagtagatttgcgtttcagattaaccaaggtacaaaagttataccaagctaaaattcatggcaaaatatctcacaacacgcgaggaggattactcaaaatggtacaatgaattggtagtcaaagctgatttggctcaaaattcaggtgtgcgcggttctatggtgataaagccctatggctttgctatttgggaaagcatccaagcggatcttgacagacggtttaaggaaacgggtcacatgaacgcgtatttcccgctattcataccgaaatcatanttttccaaagaagcttcacacgtggacggttttgccaaggaatgtgcggtagtgactcattatagattaatggatgaccccaatggtggtggcgtagtcgtagatccttcggcgaaattggaggaggaattgattgtccgccccacgtctgaaaccattatttgggacacttacaaagattggatacagagttaccgcgaccttcctattctagtgaatcaatgggcgaacgtggtacgttgggaaatgcgtacacgcttattcctnagaacgtcagagtttttatggcaagaaggtcataccgctcacgctacgaaggaagaggccatcactgaggcagagacgatgttaaatgtctacacggactttgttcaggacgtcatggc

SEQ ID NO: 1376 - DNA, 4000 bp, Escherichia coli
  misc_feature (1987)..(1987): n is a, c, g, or t
  misc_feature (1990)..(1990): n is a, c, g, or t
  misc_feature (1997)..(1997): n is a, c, g, or t
  misc_feature (2424)..(2424): n is a, c, g, or t
  misc_feature (2426)..(2426): n is a, c, g, or t
  misc_feature (2428)..(2428): n is a, c, g, or t
  misc_feature (2438)..(2438): n is a, c, g, or t
  misc_feature (2461)..(2462): n is a, c, g, or t
  misc_feature (2470)..(2471): n is a, c, g, or t
  misc_feature (2476)..(2476): n is a, c, g, or t
  misc_feature (2480)..(2480): n is a, c, g, or t
  misc_feature (2488)..(2488): n is a, c, g, or t
  misc_feature (2491)..(2491): n is a, c, g, or t
cgtaaaattcataatttatagaacaagaattaaagtaattgttgttccaatcaagataatacaaatttaatctctaaaggtaattatattatctctaaagattataaatgtggttggcgtgaccttaagaaataggctaaacctttatattcctttgcttcctctactattatcaaatccaaggagaggatgaatattacttctcctaaagatcaattagttcgttaggctgaatattataggaattttgcttcagatattactagccatagtttaaatagcaattattgaactgttgtttttagaaacagtcagagatattctcagtcatagaatattaatgatcccataactatcaccgaatttagaattattgttctatcaatgaagaataataagacatcagaccctgataatatttccactgaattttacaaagcaatgttttacggtatggatctagaagaaaagtaccctagttccacaaaatgtcttgaaattttattaaataaagtttcatatcttaatatatatttataatgtatttttacgtttaaatgtatacaatatattaatattttttaataattaataaataaagtaatggacaatctctttagagtctaaaaaaaaaaaaattgttatatatatatataaaatagatatttttttgttatagtttttgtacataataataatgtaccaatatataaattattatttattatctattattttttatttattatatattatttactatttactatttatttatttattatttattacttagaagtattaatattaatttgtaataaataataaataataaacattatttattacaaattaatattaatacttctaatggtcgtatcatattcttgttgggcaaagggttatacaagaatttgaatggtctatcgttataaaacactatattcggtgacaagcccctgaaaggaataataaaaaaacatgaaaattttattaatttgtcatttacaatctaaaattgttggatacaaacaaaataatggtaatatttttatttttcttccagatgaaaaaaaaaagttattaaaaacctcaatctaataaaagaagaaaagaaaaattattaatcaaatattcaataaatacaagattgattttctatctagcattttatcatgcttgataataataacgatattttacatatattcatattttaaacaaaatttttaaaattttggataatttattaaaaaaaattagaagaaacgataaataattgctgaaaaacagaattaatatagaaaaaagcttaagaaatgaattaaatataaagataattagttgaaatacttaatatccatgattatacatttattaacgcccaataatttttcactatgtttaatacaagacatatcgaaataaagttttatttcacttttactgaaaacaattagtaaaactccgtaatatttttacatattaccattatttttattaccattattttctatatcactaataagcaaatcatatggaaaatcaataaggtatcaaagctttctataacttcttttggaggagtacaatattacaaccaagagaacaacataaataaaaatattcatttgtcatgaattatcttattatgatatgtttcctttttgttttgtcttattatcactatatatagacatagctttaatccacatcataagattttatattacattacatatgcgattttaaatttttcgtatttcatatatttctattaaatttttccacataatactttaattatttttttattatttatcaatttaataaaaaaatatattatttagattaattaatgaatcaaaaaaagtttatttcttttttaatgaataaaaattaaaaaaataaaaaggaattacaattataatatagcaaatgatatatgtttaataaaaatatgtagtaaaaaaaaaaaaaaaaatanatnattttanaaattaaaataagtataaataataactattgtaataaaaataataataataatatgctacatttatatgatgctaaaacaactgtgtattgaatgtatatatatatatattcaactttatatatatatcatttataaaatgtatataacattaatatatgataataaaaaaatattgtatatatttatttggaatttatatcaaattagtttatatataaatgtacttgttatttttaaaacactttaaataatttttataagtatatgtatatatacatatactaattaagtaatcaattaaaatatatatatatatatacattaccgaagaattactgataaaacaatatatatatataatatatagttatagatttatttgtaattatgtttttttttttttttttttttttttaaaaaaaatntntntaaataaatntttataaaaaaaaaataataatnntttaatannattantctnaaaatatnaantatttcaagtaattttatttcttagctaaagaccttttaaaatatataatacgatacaacaatacatattatctataatattatttttttataataattttattacataattttttttttaacactatttaattagtaaaaacatattttattaaaatcatttatttttaattaaaacaatttttattgtgaaataattattttataatgaaatgtttactatagatagggaaattattggcaatatacgttcaaccaaatttattattatgttctaataatttagcattataacagagaaactagtattaagagaaatgaaaaaaaaaaaaaaatttttttctacaaaatttttacttatttaattggtttttattaatttatttattacagattattagaattattaaaaaattattataattttatggctataataattaattaataaggaataataaatagaaataatagcaatacaataactataaaataataataagtataataaataaattaataaagatcaattaaataattaaaaattataatactggtttcactgtaataatattgatttattgatttatcagaccatgataataaattattattctttattatttttattttattattattaatatgaaatttttaataattttaatacaagtacataatgtataatgtatatagatatgtatacattaaatctttattattgaaatattttattataatattataaattaacatgtgatttgattgaaagtaaaccaatcaaattcatattgataattgtttactatcaaaagagaattgataataataatttttaatactctcttttatttgagaagtgttacaatatggtatgttaaagattaatgaataatcaaaatgaatgatgaatgatgaacgatgaattatttagtttgataaaatttttattatggtgaattagtgatgtatatgtgcttgacattgcattaatttaaaattaaaaaatactttaattattatttacaaataataacgatgtaatggaaaaattgatggattgttgaaaatgttttgtttttgattttgttctttttaaaaataataaaaatggatgagaaataaaaatttaaaagtttaaaagttattctaacagttattattttttatttattataaatgatatattaaaatataatggtaaattatattagtccatcgtcgtatctgacaaaaactcattccaacacattcttcgtctccttaacactaacattgatggtaagcaaaagcttcaatttgctttaacttccattcgtggttgtggtagacgttacgctaacattgtttgtaagaaggctgaaatcgatctttccaagcggtaaatgtcttagaatgaaataagaataaaaatattgtgaagataaattagttttttattattattattaatattggtaaatattggtaaatatacttattattttaaaaaatattataaattaatag

SEQ ID NO: 1377 - DNA, 4000 bp, Escherichia coli
  misc_feature (1)..(180): n is a, c, g, or t
  misc_feature (465)..(467): n is a, c, g, or t
  misc_feature (469)..(472): n is a, c, g, or t
  misc_feature (477)..(478): n is a, c, g, or t
  misc_feature (480)..(481): n is a, c, g, or t
  misc_feature (486)..(486): n is a, c, g, or t
  misc_feature (489)..(489): n is a, c, g, or t
  misc_feature (491)..(491): n is a, c, g, or t
  misc_feature (493)..(494): n is a, c, g, or t
  misc_feature (496)..(499): n is a, c, g, or t
  misc_feature (502)..(502): n is a, c, g, or t
  misc_feature (505)..(505): n is a, c, g, or t
  misc_feature (507)..(508): n is a, c, g, or t
  misc_feature (513)..(513): n is a, c, g, or t
  misc_feature (515)..(515): n is a, c, g, or t
  misc_feature (520)..(523): n is a, c, g, or t
  misc_feature (525)..(526): n is a, c, g, or t
  misc_feature (528)..(529): n is a, c, g, or t
  misc_feature (532)..(535): n is a, c, g, or t
  misc_feature (538)..(538): n is a, c, g, or t
  misc_feature (540)..(543): n is a, c, g, or t
  misc_feature (546)..(548): n is a, c, g, or t
  misc_feature (553)..(553): n is a, c, g, or t
  misc_feature (555)..(555): n is a, c, g, or t
  misc_feature (560)..(560): n is a, c, g, or t
  misc_feature (563)..(566): n is a, c, g, or t
  misc_feature (570)..(570): n is a, c, g, or t
  misc_feature (572)..(572): n is a, c, g, or t
  misc_feature (577)..(577): n is a, c, g, or t
  misc_feature (581)..(584): n is a, c, g, or t
  misc_feature (589)..(589): n is a, c, g, or t
  misc_feature (591)..(593): n is a, c, g, or t
  misc_feature (595)..(596): n is a, c, g, or t
  misc_feature (599)..(599): n is a, c, g, or t
  misc_feature (601)..(601): n is a, c, g, or t
  misc_feature (605)..(605): n is a, c, g, or t
  misc_feature (609)..(609): n is a, c, g, or t
  misc_feature (612)..(615): n is a, c, g, or t
  misc_feature (624)..(624): n is a, c, g, or t
  misc_feature (626)..(627): n is a, c, g, or t
  misc_feature (629)..(630): n is a, c, g, or t
  misc_feature (634)..(634): n is a, c, g, or t
  misc_feature (638)..(638): n is a, c, g, or t
  misc_feature (645)..(646): n is a, c, g, or t
  misc_feature (649)..(649): n is a, c, g, or t
  misc_feature (651)..(652): n is a, c, g, or t
  misc_feature (656)..(657): n is a, c, g, or t
  misc_feature (659)..(661): n is a, c, g, or t
  misc_feature (663)..(663): n is a, c, g, or t
  misc_feature (665)..(665): n is a, c, g, or t
  misc_feature (670)..(670): n is a, c, g, or t
  misc_feature (674)..(674): n is a, c, g, or t
  misc_feature (678)..(678): n is a, c, g, or t
  misc_feature (682)..(682): n is a, c, g, or t
  misc_feature (684)..(684): n is a, c, g, or t
  misc_feature (686)..(686): n is a, c, g, or t
  misc_feature (693)..(694): n is a, c, g, or t
  misc_feature (696)..(699): n is a, c, g, or t
  misc_feature (701)..(701): n is a, c, g, or t
  misc_feature (703)..(709): n is a, c, g, or t
  misc_feature (711)..(717): n is a, c, g, or t
  misc_feature (719)..(721): n is a, c, g, or t
  misc_feature (723)..(726): n is a, c, g, or t
  misc_feature (728)..(729): n is a, c, g, or t
  misc_feature (731)..(731): n is a, c, g, or t
  misc_feature (733)..(737): n is a, c, g, or t
  misc_feature (741)..(747): n is a, c, g, or t
  misc_feature (749)..(752): n is a, c, g, or t
  misc_feature (754)..(754): n is a, c, g, or t
  misc_feature (756)..(765): n is a, c, g, or t
  misc_feature (767)..(772): n is a, c, g, or t
  misc_feature (775)..(775): n is a, c, g, or t
  misc_feature (778)..(780): n is a, c, g, or t
  misc_feature (782)..(782): n is a, c, g, or t
  misc_feature (785)..(788): n is a, c, g, or t
  misc_feature (791)..(796): n is a, c, g, or t
  misc_feature (798)..(807): n is a, c, g, or t
  misc_feature (810)..(823): n is a, c, g, or t
  misc_feature (825)..(825): n is a, c, g, or t
  misc_feature (827)..(832): n is a, c, g, or t
  misc_feature (834)..(837): n is a, c, g, or t
  misc_feature (839)..(840): n is a, c, g, or t
  misc_feature (842)..(842): n is a, c, g, or t
  misc_feature (844)..(844): n is a, c, g, or t
  misc_feature (846)..(858): n is a, c, g, or t
  misc_feature (860)..(878): n is a, c, g, or t
  misc_feature (880)..(897): n is a, c, g, or t
  misc_feature (899)..(900): n is a, c, g, or t
  misc_feature (903)..(905): n is a, c, g, or t
  misc_feature (907)..(911): n is a, c, g, or t
  misc_feature (913)..(914): n is a, c, g, or t
  misc_feature (919)..(932): n is a, c, g, or t
  misc_feature (934)..(938): n is a, c, g, or t
  misc_feature (940)..(940): n is a, c, g, or t
  misc_feature (942)..(943): n is a, c, g, or t
  misc_feature (946)..(950): n is a, c, g, or t
  misc_feature (952)..(960): n is a, c, g, or t
  misc_feature (962)..(969): n is a, c, g, or t
  misc_feature (971)..(972): n is a, c, g, or t
  misc_feature (974)..(979): n is a, c, g, or t
  misc_feature (981)..(982): n is a, c, g, or t
  misc_feature (984)..(987): n is a, c, g, or t
  misc_feature (989)..(992): n is a, c, g, or t
  misc_feature (994)..(999): n is a, c, g, or t
  misc_feature (1001)..(1002): n is a, c, g, or t
  misc_feature (1004)..(1008): n is a, c, g, or t
  misc_feature (1010)..(1014): n is a, c, g, or t
  misc_feature (1016)..(1017): n is a, c, g, or t
  misc_feature (1019)..(1019): n is a, c, g, or t
  misc_feature (1021)..(1030): n is a, c, g, or t
  misc_feature (1033)..(1039): n is a, c, g, or t
  misc_feature (1041)..(1042): n is a, c, g, or t
  misc_feature (1044)..(1045): n is a, c, g, or t
  misc_feature (1047)..(1050): n is a, c, g, or t
  misc_feature (1052)..(1053): n is a, c, g, or t
  misc_feature (1055)..(1056): n is a, c, g, or t
  misc_feature (1058)..(1062): n is a, c, g, or t
  misc_feature (1065)..(1080): n is a, c, g, or t
  misc_feature (1082)..(1084): n is a, c, g, or t
  misc_feature (1087)..(1091): n is a, c, g, or t
  misc_feature (1093)..(1099): n is a, c, g, or t
  misc_feature (1101)..(1107): n is a, c, g, or t
  misc_feature (1109)..(1117): n is a, c, g, or t
  misc_feature (1119)..(1120): n is a, c, g, or t
  misc_feature (1122)..(1123): n is a, c, g, or t
  misc_feature (1126)..(1128): n is a, c, g, or t
  misc_feature (1130)..(1132): n is a, c, g, or t
  misc_feature (1134)..(1134): n is a, c, g, or t
  misc_feature (1136)..(1136): n is a, c, g, or t
  misc_feature (1138)..(1140): n is a, c, g, or t
  misc_feature (1143)..(1144): n is a, c, g, or t
  misc_feature (1146)..(1146): n is a, c, g, or t
  misc_feature (1149)..(1149): n is a, c, g, or t
  misc_feature (1151)..(1158): n is a, c, g, or t
  misc_feature (1160)..(1171): n is a, c, g, or t
  misc_feature (1173)..(1173): n is a, c, g, or t
  misc_feature (1175)..(1175): n is a, c, g, or t
  misc_feature (1178)..(1179): n is a, c, g, or t
  misc_feature (1181)..(1181): n is a, c, g, or t
  misc_feature (1184)..(1188): n is a, c, g, or t
  misc_feature (1190)..(1193): n is a, c, g, or t
  misc_feature (1198)..(1210): n is a, c, g, or t
  misc_feature (1212)..(1213): n is a, c, g, or t
  misc_feature (1215)..(1218): n is a, c, g, or t
  misc_feature (1220)..(1221): n is a, c, g, or t
  misc_feature (1223)..(1225): n is a, c, g, or t
  misc_feature (1227)..(1230): n is a, c, g, or t
  misc_feature (1232)..(1235): n is a, c, g, or t
  misc_feature (1237)..(1237): n is a, c, g, or t
  misc_feature (1239)..(1240): n is a, c, g, or t
  misc_feature (1242)..(1242): n is a, c, g, or t
  misc_feature (1244)..(1259): n is a, c, g, or t
  misc_feature (1261)..(1267): n is a, c, g, or t
  misc_feature (1269)..(1272): n is a, c, g, or t
  misc_feature (1274)..(1276): n is a, c, g, or t
  misc_feature (1280)..(1282): n is a, c, g, or t
  misc_feature (1284)..(1284): n is a, c, g, or t
  misc_feature (1286)..(1296): n is a, c, g, or t
  misc_feature (1298)..(1301): n is a, c, g, or t
  misc_feature (1304)..(1305): n is a, c, g, or t
  misc_feature (1307)..(1328): n is a, c, g, or t
  misc_feature (1330)..(1331): n is a, c, g, or t
  misc_feature (1333)..(1335): n is a, c, g, or t
  misc_feature (1337)..(1338): n is a, c, g, or t
  misc_feature (1340)..(1343): n is a, c, g, or t
  misc_feature (1345)..(1346): n is a, c, g, or t
  misc_feature (1348)..(1348): n is a, c, g, or t
  misc_feature (1350)..(1350): n is a, c, g, or t
  misc_feature (1353)..(1355): n is a, c, g, or t
  misc_feature (1357)..(1358): n is a, c, g, or t
  misc_feature (1360)..(1360): n is a, c, g, or t
  misc_feature (1362)..(1372): n is a, c, g, or t
  misc_feature (1374)..(1376): n is a, c, g, or t
  misc_feature (1378)..(1384): n is a, c, g, or t
  misc_feature (1386)..(1389): n is a, c, g, or t
  misc_feature (1391)..(1392): n is a, c, g, or t
  misc_feature (1394)..(1395): n is a, c, g, or t
  misc_feature (1397)..(1403): n is a, c, g, or t
  misc_feature (1405)..(1412): n is a, c, g, or t
  misc_feature (1414)..(1414): n is a, c, g, or t
  misc_feature (1416)..(1419): n is a, c, g, or t
  misc_feature (1421)..(1427): n is a, c, g, or t
  misc_feature (1429)..(1429): n is a, c, g, or t
  misc_feature (1431)..(1440): n is a, c, g, or t
  misc_feature (1442)..(1450): n is a, c, g, or t
  misc_feature (1452)..(1460): n is a, c, g, or t
  misc_feature (1462)..(1466): n is a, c, g, or t
  misc_feature (1470)..(1472): n is a, c, g, or t
  misc_feature (1474)..(1476): n is a, c, g, or t
  misc_feature (1478)..(1478): n is a, c, g, or t
  misc_feature (1480)..(1484): n is a, c, g, or t
  misc_feature (1487)..(1497): n is a, c, g, or t
  misc_feature (1499)..(1501): n is a, c, g, or t
  misc_feature (1503)..(1503): n is a, c, g, or t
  misc_feature (1505)..(1509): n is a, c, g, or t
  misc_feature (1511)..(1514): n is a, c, g, or t
  misc_feature (1516)..(1516): n is a, c, g, or t
  misc_feature (1518)..(1519): n is a, c, g, or t
  misc_feature (1521)..(1537): n is a, c, g, or t
  misc_feature (1539)..(1551): n is a, c, g, or t
  misc_feature (1554)..(1554): n is a, c, g, or t
  misc_feature (1556)..(1558): n is a, c, g, or t
  misc_feature (1560)..(1565): n is a, c, g, or t
  misc_feature (1567)..(1567): n is a, c, g, or t
  misc_feature (1569)..(1570): n is a, c, g, or t
  misc_feature (1572)..(1572): n is a, c, g, or t
  misc_feature (1574)..(1574): n is a, c, g, or t
  misc_feature (1576)..(1583): n is a, c, g, or t
  misc_feature (1586)..(1591): n is a, c, g, or t
  misc_feature (1593)..(1595): n is a, c, g, or t
  misc_feature (1598)..(1598): n is a, c, g, or t
  misc_feature (1600)..(1601): n is a, c, g, or t
  misc_feature (1607)..(1607): n is a, c, g, or t
  misc_feature (1610)..(1611): n is a, c, g, or t
  misc_feature (1613)..(1613): n is a, c, g, or t
  misc_feature (1617)..(1619): n is a, c, g, or t
  misc_feature (1621)..(1624): n is a, c, g, or t
  misc_feature (1626)..(1626): n is a, c, g, or t
  misc_feature (1628)..(1629): n is a, c, g, or t
  misc_feature (1632)..(1633): n is a, c, g, or t
  misc_feature (1635)..(1636): n is a, c, g, or t
  misc_feature (1638)..(1638): n is a, c, g, or t
  misc_feature (1640)..(1641): n is a, c, g, or t
  misc_feature (1646)..(1650): n is a, c, g, or t
  misc_feature (1652)..(1654): n is a, c, g, or t
  misc_feature (1656)..(1656): n is a, c, g, or t
  misc_feature (1658)..(1660): n is a, c, g, or t
  misc_feature (1662)..(1664): n is a, c, g, or t
  misc_feature (1669)..(1669): n is a, c, g, or t
  misc_feature (1671)..(1671): n is a, c, g, or t
  misc_feature (1673)..(1673): n is a, c, g, or t
  misc_feature (1675)..(1678): n is a, c, g, or t
  misc_feature (1680)..(1682): n is a, c, g, or t
  misc_feature (1684)..(1687): n is a, c, g, or t
  misc_feature (1689)..(1691): n is a, c, g, or t
  misc_feature (1694)..(1694): n is a, c, g, or t
  misc_feature (1697)..(1699): n is a, c, g, or t
  misc_feature (1702)..(1707): n is a, c, g, or t
  misc_feature (1710)..(1715): n is a, c, g, or t
  misc_feature (1717)..(1717): n is a, c, g, or t
  misc_feature (1719)..(1719): n is a, c, g, or t
  misc_feature (1722)..(1723): n is a, c, g, or t
  misc_feature (1728)..(1728): n is a, c, g, or t
  misc_feature (1730)..(1733): n is a, c, g, or t
  misc_feature (1735)..(1738): n is a, c, g, or t
  misc_feature (1741)..(1741): n is a, c, g, or t
  misc_feature (1743)..(1743): n is a, c, g, or t
  misc_feature (1747)..(1747): n is a, c, g, or t
  misc_feature (1785)..(1785): n is a, c, g, or t
  misc_feature (1963)..(1963): n is a, c, g, or t
  misc_feature (1965)..(1965): n is a, c, g, or t
  misc_feature (1971)..(1972): n is a, c, g, or t
  misc_feature (1977)..(1977): n is a, c, g, or t
  misc_feature (1987)..(1987): n is a, c, g, or t
  misc_feature (1991)..(1991): n is a, c, g, or t
  misc_feature (2079)..(2079): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgaccagttctcaagatttggctcagcttggggaggcccatcataccggaaacgccctgcatgatcctgactctctctggcctagcggcggcgtcgctctaagcacgcgctagcgagacgagcattgctgctgatcgcagacccccaattgaggcttgggccctgacacgcaacgcactcgaattaattcgggcggcacttaacactagctacgagcgcgcaacgtaagaaaacactgaaaccagcgttttaagacaaggtattcccgttgttctcttttacnnnannnngatcnngnnccagngcnananngnnnntgnccntnnccatnancatannnntnncnnttnnnnttncnnnntcnnncatgntngcgantannnncagnancatgnccannnntgatnannngnnatngnagcnccancannnntcaacacgnanncnnagcncatnatcattnngcncnnctanntnnngntngtgtnaggngcgngcgngntncccatgnngnnnngngnnnnnnncnnnnnnnannncnnnncnnanannnnncacnnnnnnncnnnncncnnnnnnnnnncnnnnnncancgnnnanggnnnncgnnnnnncnnnnnnnnnnatnnnnnnnnnnnnnncncnnnnnncnnnngnnancncnnnnnnnnnnnnngnnnnnnnnnnnnnnnnnnnannnnnnnnnnnnnnnnnngnngcnnntnnnnntnnagatnnnnnnnnnnnnnnannnnntnanngtnnnnnannnnnnnnnannnnnnnngnntnnnnnncnngnnnngnnnntnnnnnntnncnnnnncnnnnncnncncnnnnnnnnnnctnnnnnnncnncnncnnnncnngnncnnnnnccnnnnnnnnnnnnnnnnannncgnnnnntnnnnnnncnnnnnnncnnnnnnnnnanncnncannntnnncncnannnccnngntcntnnnnnnnnannnnnnnnnnnnangnttnngngtnnnnntnnnnatcgnnnnnnnnnnnnntnngnnnntnnannntnnnngnnnntngnngntnnnnnnnnnnnnnnnntnnnnnnntnnnntnnncgtnnncngnnnnnnnnnnncnnnnganngnnnnnnnnnnnnnnnnnnnnnngnnannngnncnnnntnncncntcnnncnngngnnnnnnnnnnncnnncnnnnnnncnnnncnngnncnnnnnnntnnnnnnnncnannnncnnnnnnnancnnnnnnnnnncnnnnnnnnncnnnnnnnnncnnnnntctnnngnnntngnnnnnagnnnnnnnnnnnannntncnnnnncnnnntncnntnnnnnnnnnnnnnnnnncnnnnnnnnnnnnntgntnnngnnnnnngntnntntntnnnnnnnnttnnnnnntnnnttntnnttattnatnntnaatnnntnnnnantnnttnntnntngnnactgnnnnntnnntncnnncnnnttgcnantngnnnntnnntnnnngnnnctngcnnntgnnnnnngannnnnngncnctnnccctngnnnntnnnnctntngctnttggctcttggctcttggctcttggctcttggctcttngctttcgactttcgactttcgactttcgactttcagcctgctagagcctagttcttagtcttatctcttaggtctaacttggatttctttaatgttctgtttgcgggtttatcctagctgcttcctcgctgcttgctgcttgctgcttgctgcttgctgcttgctgcttgctgcttgntncttgtnncttgnttcttgtttnttgntttttggtttttggtttttggtttttggtttttggtttttggtttttgcgggatgttgatggatctcatccattgtgcacgataggtntaggtcttaacctagggccaccaaacccaaaaagcagtcaagggccctgttgcgtccagcgctgaaacagtcctcccaatgctcgaagcaccggcctagggggcaacttagcagcagctagagcggcttgattcagtcgtccaggcacgcacaccacctcttgagaaaagagcgcttcgatacctgcacgtgcaacatactccggggacagaacaagcgcctcaggcagctcatccaaaggtagttcggcaacgaggtccgtgcgagtgatccccgggcagagcgcggtcaaactgatgcccgagcctcttaactcctcgttcagggcttccgtgagcattagaagatatgccttggcagcgccgtactgagccaaccctgggacgggatgaaacgctcccatggaggcaacattcaaaatacgaccctttcgacgtgccttcatctgaggaatcagccgatgcataagcagtgacggcgtggtcatattgagttgcattaagccttcaacgccgtgaggctcggtctctaaaaacgatttgtggggtgcgccacccgcattattgacaagaatgtcgatctcccgatcagcgacagccgccaataactctgagggtccctctggcttcgacaaatcgatcgcgagacaaacgggctccgcagttttgggcaaactggccgccaccgctgcaagccgctcaagacctcgagccaccaagatgagccgcagcccccgctcggcaaggcctcgtgcaatcgccgcgccaataccggcggatgcgccagtaactaacgccgtggctggtcgggctttgctagcactcactgcaggaccctcctcgtttgctgggacccatcattcacgaccgcgcggctgtcttcttcataggcttctttattgccttcttcatcgcctcttggtcaatcgaaccaattgaatgaacgggttttgaagcactaacaccgctaggactgtgatttaaagggtgaaaattgttccagataatcaatctcttcgctgacataacgccgctcttctgacagaaagcgatcgaccgccgctttgaatcccgaatgcgcaatatagtgggcgctataggtttcacttggcaagtagccccgtgcaagcttgtgttcgccctgagcgcccgcttcaactcgctcaagcccgcgctcaatcgcgaactctatcgcctggtagtagcagacttcgaaatgcaaaaacggacgatgctcgatacagccccaatttcggccaaacaagcattcacttccaataaagttgatcgcgccggcaatgtatcggtcaccagaacggcacatcaccaataaaattcggtcggccatcgtctcacccactcgcgagaaaaacgatcgggtcaaatagggcgacccccactttcgactaccagtatccatataaaagcgaaaaaaatgatcccagtgtgtttcggtgatcatgtccccggtgagtcgctcaatcacgagatcaccctgaaccgcatctcgtctttcacgccgaatgttcttgcgttttttactcgacagatcggacaagaaggcatcaaagctgtcgtagtcttgattctgccagtggtactgcttatgcgtgcgtaggagccatccttcttcacctcgccttcgccacgcagcttggtccaggaagttaatgtgaactgagctgatatcgtgatggtctgccagttgttgggcgccacgtgcaagcgcggtttcggccgccacatccatcgtcagcaggcggcgcccggtcgcaggtgtgaaaggcacggcactgagaagctttgggtaatagcggccgccggctctttcgaaggcgtcggcccaactataatcaaagatatattcgccttgggaatgccctttcaaatataaaggcatcacgccgcacaccgcatcagcg

SEQ ID NO: 1378 - DNA, 4000 bp, Escherichia coli
  misc_feature (1152)..(1152): n is a, c, g, or t
  misc_feature (1979)..(1979): n is a, c, g, or t
  misc_feature (1985)..(1985): n is a, c, g, or t
cttcgtcatacatccttctcaatggtggaggtagtacccaaacttgagaagcttatagactttgatatcccagaggaagatatggatatacagtttacacgttcgggtggtccaggtggacaaaacgtaaacaaacgcgagacagcggtaaggatagtgcacagagagtctgggctttctgtacatatagacggagagcgttctcaagcacaaaacaaagaaaaggcattagagcttttaaggggaaagcttttcaaaaagcgcgaagaagaccgtaaaaagcatgaaaaaggtctatcagtgagtgctactacaagcatagaatggggaagccagatacgctcttacgtgcttcatccgtataagatggttaaagaccacaggacagatgtagaggtccgtgatgtagagaaagtcttggacggtgagatacaagattttctagacgcggaaaagaatttagagtaaaatagatagatattatcatctatgatttattttgatcaagtttcaaaactatacactggtgggcatacagcacttgataaagtgactctatcaatcgccccaaaagaattcgtctctattgtcgggcattcaggtgctggtaagacaacactcatcaaaatgcttttagcagaagatattcctacgcaaggaggtgtcttttttgagtcgtctgacatccacggatttaggagaccacaacttaatagttttagaagacgcataggaactgtgtttcaagacttcagacttttgccgaataagactgcatatgaaaacatcgcttttgctatggaggcagcaggtaagagtgacgaagagatagcttctgacgtacctcatgtgttggagcttgtagaccttggcgacaagatgtggaactttccacatgaactttcaggtggtgaaaaacaaagagtggcaatagcgcgcgctattgtgaatcaacctgatattataatagccgacgagcctacaggaaacctagacccgataaatacatttgagatagtacagattttaaaaaagattaacgacttaggtacaatggtaatacttacaactcacaacaaaggtgtggtagattcagttggtgggcgagtaataacgatggatagtggacgagtaatacgagatgataagaanggtaaatatgctttataaaattaaggagccagagcaaagcgaaggcgactataattttaaaagcccccttcttttaccagctttgctggataaggagggggcaatatgatgctaagacttcttttacacctttggtgaaaaggagatgggcacaaattagattttgctttatgttacaatgtattatgtatatttaataaagaaaaaaagtaaaggtggagacttttatattggatatacttctaatttagaaaataggttggatcaacatggtgttttaaaagaagatttaatatattatgaagcttataaggataaatatgatgcaactacacgtgaacaacaattgaaagaatttaaaagttcatggggtcaattaaaaaaaagaattatgcgaagtaaattataaaaattaacccacctccttttccagctgatatgctggcaaaagaagggggtgatgattttctaaacactcacttcgttcgcgaagaaaatctatcatgataggaataaatttaaaaagaataataaaatcaggttttgtgagtttctggagaaacggagtagtttcttttgcttcaatccttgtgatgacgatgactctcttcatgcttggttcaatcctttttgtaaatgcgacgcttgacgcttcacttactcaaatccgcgacaaagtagatatcaatgtatactttgtaaccacagcaccagaggacgacatactaacccttaaaacctctatagagacacttcctgaagttgcaaacgtagaatacgtctctcgtgagaaggctcttgcagagtttacgcttcgccatcagaangaccancttacattacaagctctagaggagctcggcgagaacccgctcggcgctaatttgaatattaaagctaaagagacttcacaatacgaaggcatagcgactttcttggaaggcgagaccgctctctctacgcttgacgatactcctattatagacaaggtgaattatttacagaacaaaaccgcaatagacaaactaagtaagatagttgattcagcagaaaggtttgggtttattataattgcaatactcgtcatcgcatcattgattatttctttcaatactatacggctggctatctatacgtctaaagacgaaatagcggtaatgaagctcgtcggtgctagcaattcttacattcgcggaccgtttgtgtttgaaggtattatgtatggtatcgtcgcgggcctcgtcacccttatactcttctatcccttgaccgtctggctcgggccacttactgaaaacttctttagtgatataaatctgtttgattattatataaatagtttttcaaaaatattctttattgtcttaggttcaggtatattgctcggtgcaatatcaagttacattgcagtgtggaggtatcttaggaaataatgaaaaagaaacataaatatatatttgtaataggaggagtaatttccggagttgggaaaggtattactacatcatcaatagcgaaaatcatccaagcacgcggacttaaagtcactgcacttaagatagacccgtatgtaaacgtagacgcaggtactatgaaccccacagagcatggggaagtgtttgtgcttgccgatggcgacgagacagaccaagacatgggcaattacgaacgcttcttaggtgtgacgctcgacaggctcaactacatgacgacagggcgtgtgtaccagagtgttatagaaaacgaacgcaacctcgcttacaaaggcaagtgtgtgcaagtagtgccacacataccgcttgagactataggacgtatcaagaatgcagcaaaaaaagcagatgctgatgttacggtaatagaggtaggtgggacagtaggtgagtatgagaatatcctcttcttagaatctgcacgtatgatgaagatagaaaacccagacgatgtagcatttataatggtgtcttacctcccaacccctgctaaagtcggcgagatgaagacaaagccgacacaacatgcgacgcgccttgcaaaccaagccggcatacagcccgatgtcataatagctcgtagtgaacttcctattgatcaaaagagaaaagagaagttggcattgttttgtaatattgcgccagagcaagtggtgtcagcccctgatgcagacagtatttacgacataccgcttaattttgagaaagataatattggggatatagttctggatcgtttgaagctcaagaaaacaaagtcaaaaacaggacttaagagttgggaagactttgtgaaaagaagtaagaaggttttagctggtaaaaaagaagttcacatagcaatagttggtaagtattttgatacaggggacttcgtactctctgacgcttacatttctattatagaggcacttaagttctcagcctatgatgtgggagtgaagccggtcttgcattggctgagctctaaagagtttgataaaccaagttcacttaaaaagctttcaaagtatgacggcatactaatccctggtgggtttggtgagacaggtatagacggcaagcttaaagtaatacaatatgcgcgcgagaagaagataccgtactttgggatctgctatggtatgcagttggcagtgatagagtatgcgcgcaatgtcctgaagatgaaagatgcaaatacagcagagatagatagcgaagccaaagagttagtgatagatataatgcccgaccaaaaagaaaaattaaaagataaaaattatggaggtagtatgcgactcggctcataccctgcaaagttagagaaggggagcatagcgcgcaaggcttatggtacagatacgataagtgaa

SEQ ID NO: 1379 - DNA, 4000 bp, Escherichia coli
  misc_feature (3)..(3): n is a, c, g, or t
  misc_feature (5)..(5): n is a, c, g, or t
  misc_feature (7)..(7): n is a, c, g, or t
  misc_feature (16)..(19): n is a, c, g, or t
  misc_feature (22)..(23): n is a, c, g, or t
  misc_feature (26)..(30): n is a, c, g, or t
  misc_feature (33)..(41): n is a, c, g, or t
  misc_feature (43)..(43): n is a, c, g, or t
  misc_feature (46)..(49): n is a, c, g, or t
  misc_feature (51)..(51): n is a, c, g, or t
  misc_feature (53)..(53): n is a, c, g, or t
  misc_feature (55)..(55): n is a, c, g, or t
  misc_feature (58)..(62): n is a, c, g, or t
  misc_feature (69)..(69): n is a, c, g, or t
  misc_feature (71)..(75): n is a, c, g, or t
  misc_feature (79)..(79): n is a, c, g, or t
  misc_feature (85)..(87): n is a, c, g, or t
  misc_feature (89)..(89): n is a, c, g, or t
  misc_feature (94)..(94): n is a, c, g, or t
  misc_feature (97)..(97): n is a, c, g, or t
  misc_feature (99)..(99): n is a, c, g, or t
  misc_feature (102)..(102): n is a, c, g, or t
  misc_feature (108)..(108): n is a, c, g, or t
  misc_feature (111)..(111): n is a, c, g, or t
  misc_feature (114)..(114): n is a, c, g, or t
  misc_feature (116)..(116): n is a, c, g, or t
  misc_feature (118)..(118): n is a, c, g, or t
  misc_feature (124)..(124): n is a, c, g, or t
  misc_feature (133)..(133): n is a, c, g, or t
  misc_feature (136)..(137): n is a, c, g, or t
  misc_feature (142)..(142): n is a, c, g, or t
  misc_feature (146)..(146): n is a, c, g, or t
  misc_feature (149)..(150): n is a, c, g, or t
  misc_feature (153)..(153): n is a, c, g, or t
  misc_feature (155)..(157): n is a, c, g, or t
  misc_feature (160)..(160): n is a, c, g, or t
  misc_feature (163)..(163): n is a, c, g, or t
  misc_feature (166)..(166): n is a, c, g, or t
  misc_feature (170)..(171): n is a, c, g, or t
  misc_feature (174)..(175): n is a, c, g, or t
  misc_feature (179)..(181): n is a, c, g, or t
  misc_feature (184)..(184): n is a, c, g, or t
  misc_feature (187)..(190): n is a, c, g, or t
  misc_feature (198)..(200): n is a, c, g, or t
  misc_feature (205)..(207): n is a, c, g, or t
  misc_feature (209)..(209): n is a, c, g, or t
  misc_feature (212)..(212): n is a, c, g, or t
  misc_feature (215)..(215): n is a, c, g, or t
  misc_feature (218)..(218): n is a, c, g, or t
  misc_feature (221)..(223): n is a, c, g, or t
  misc_feature (226)..(226): n is a, c, g, or t
  misc_feature (228)..(228): n is a, c, g, or t
  misc_feature (231)..(231): n is a, c, g, or t
  misc_feature (234)..(234): n is a, c, g, or t
  misc_feature (236)..(239): n is a, c, g, or t
  misc_feature (241)..(242): n is a, c, g, or t
  misc_feature (244)..(244): n is a, c, g, or t
  misc_feature (247)..(247): n is a, c, g, or t
  misc_feature (251)..(251): n is a, c, g, or t
  misc_feature (256)..(257): n is a, c, g, or t
  misc_feature (260)..(260): n is a, c, g, or t
  misc_feature (265)..(267): n is a, c, g, or t
  misc_feature (271)..(272): n is a, c, g, or t
  misc_feature (276)..(280): n is a, c, g, or t
  misc_feature (282)..(282): n is a, c, g, or t
  misc_feature (284)..(291): n is a, c, g, or t
  misc_feature (293)..(296): n is a, c, g, or t
  misc_feature (298)..(304): n is a, c, g, or t
  misc_feature (307)..(308): n is a, c, g, or t
  misc_feature (311)..(311): n is a, c, g, or t
  misc_feature (314)..(317): n is a, c, g, or t
  misc_feature (319)..(320): n is a, c, g, or t
  misc_feature (323)..(332): n is a, c, g, or t
  misc_feature (334)..(336): n is a, c, g, or t
  misc_feature (339)..(339): n is a, c, g, or t
  misc_feature (344)..(347): n is a, c, g, or t
  misc_feature (349)..(349): n is a, c, g, or t
  misc_feature (352)..(352): n is a, c, g, or t
  misc_feature (354)..(366): n is a, c, g, or t
  misc_feature (369)..(369): n is a, c, g, or t
  misc_feature (371)..(371): n is a, c, g, or t
  misc_feature (373)..(377): n is a, c, g, or t
  misc_feature (379)..(389): n is a, c, g, or t
  misc_feature (394)..(394): n is a, c, g, or t
  misc_feature (397)..(397): n is a, c, g, or t
  misc_feature (402)..(407): n is a, c, g, or t
  misc_feature (409)..(409): n is a, c, g, or t
  misc_feature (411)..(414): n is a, c, g, or t
  misc_feature (416)..(416): n is a, c, g, or t
  misc_feature (418)..(421): n is a, c, g, or t
  misc_feature (425)..(426): n is a, c, g, or t
  misc_feature (428)..(430): n is a, c, g, or t
  misc_feature (432)..(432): n is a, c, g, or t
  misc_feature (437)..(437): n is a, c, g, or t
  misc_feature (439)..(440): n is a, c, g, or t
  misc_feature (442)..(444): n is a, c, g, or t
  misc_feature (449)..(449): n is a, c, g, or t
  misc_feature (452)..(452): n is a, c, g, or t
  misc_feature (454)..(455): n is a, c, g, or t
  misc_feature (457)..(459): n is a, c, g, or t
  misc_feature (461)..(462): n is a, c, g, or t
  misc_feature (464)..(465): n is a, c, g, or t
  misc_feature (469)..(471): n is a, c, g, or t
  misc_feature (473)..(473): n is a, c, g, or t
  misc_feature (475)..(475): n is a, c, g, or t
  misc_feature (479)..(479): n is a, c, g, or t
  misc_feature (481)..(481): n is a, c, g, or t
  misc_feature (486)..(493): n is a, c, g, or t
  misc_feature (496)..(496): n is a, c, g, or t
  misc_feature (499)..(499): n is a, c, g, or t
  misc_feature (504)..(504): n is a, c, g, or t
  misc_feature (507)..(508): n is a, c, g, or t
  misc_feature (511)..(513): n is a, c, g, or t
  misc_feature (516)..(517): n is a, c, g, or t
  misc_feature (520)..(524): n is a, c, g, or t
  misc_feature (527)..(527): n is a, c, g, or t
  misc_feature (529)..(530): n is a, c, g, or t
  misc_feature (534)..(536): n is a, c, g, or t
  misc_feature (539)..(541): n is a, c, g, or t
  misc_feature (545)..(545): n is a, c, g, or t
  misc_feature (549)..(549): n is a, c, g, or t
  misc_feature (553)..(553): n is a, c, g, or t
  misc_feature (556)..(557): n is a, c, g, or t
  misc_feature (559)..(565): n is a, c, g, or t
  misc_feature (569)..(569): n is a, c, g, or t
  misc_feature (571)..(572): n is a, c, g, or t
  misc_feature (574)..(575): n is a, c, g, or t
  misc_feature (578)..(582): n is a, c, g, or t
  misc_feature (585)..(586): n is a, c, g, or t
  misc_feature (589)..(597): n is a, c, g, or t
  misc_feature (604)..(604): n is a, c, g, or t
  misc_feature (607)..(608): n is a, c, g, or t
  misc_feature (611)..(612): n is a, c, g, or t
  misc_feature (617)..(617): n is a, c, g, or t
  misc_feature (622)..(624): n is a, c, g, or t
  misc_feature (628)..(630): n is a, c, g, or t
  misc_feature (632)..(632): n is a, c, g, or t
  misc_feature (638)..(638): n is a, c, g, or t
  misc_feature (642)..(642): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (667)..(667): n is a, c, g, or t
  misc_feature (670)..(670): n is a, c, g, or t
  misc_feature (673)..(675): n is a, c, g, or t
  misc_feature (683)..(683): n is a, c, g, or t
  misc_feature (686)..(688): n is a, c, g, or t
  misc_feature (691)..(691): n is a, c, g, or t
  misc_feature (694)..(698): n is a, c, g, or t
  misc_feature (703)..(705): n is a, c, g, or t
  misc_feature (715)..(715): n is a, c, g, or t
  misc_feature (718)..(718): n is a, c, g, or t
  misc_feature (721)..(721): n is a, c, g, or t
  misc_feature (724)..(725): n is a, c, g, or t
  misc_feature (734)..(734): n is a, c, g, or t
  misc_feature (738)..(742): n is a, c, g, or t
  misc_feature (745)..(745): n is a, c, g, or t
  misc_feature (748)..(748): n is a, c, g, or t
  misc_feature (752)..(753): n is a, c, g, or t
  misc_feature (756)..(760): n is a, c, g, or t
  misc_feature (763)..(763): n is a, c, g, or t
  misc_feature (765)..(768): n is a, c, g, or t
  misc_feature (773)..(773): n is a, c, g, or t
  misc_feature (778)..(779): n is a, c, g, or t
  misc_feature (782)..(783): n is a, c, g, or t
  misc_feature (786)..(787): n is a, c, g, or t
  misc_feature (792)..(793): n is a, c, g, or t
  misc_feature (796)..(797): n is a, c, g, or t
  misc_feature (800)..(800): n is a, c, g, or t
  misc_feature (803)..(804): n is a, c, g, or t
  misc_feature (809)..(809): n is a, c, g, or t
  misc_feature (814)..(816): n is a, c, g, or t
  misc_feature (819)..(820): n is a, c, g, or t
  misc_feature (825)..(826): n is a, c, g, or t
  misc_feature (830)..(831): n is a, c, g, or t
  misc_feature (842)..(842): n is a, c, g, or t
  misc_feature (844)..(844): n is a, c, g, or t
  misc_feature (849)..(849): n is a, c, g, or t
  misc_feature (854)..(855): n is a, c, g, or t
  misc_feature (857)..(858): n is a, c, g, or t
  misc_feature (861)..(862): n is a, c, g, or t
  misc_feature (865)..(865): n is a, c, g, or t
  misc_feature (869)..(869): n is a, c, g, or t
  misc_feature (877)..(877): n is a, c, g, or t
  misc_feature (879)..(879): n is a, c, g, or t
  misc_feature (882)..(886): n is a, c, g, or t
  misc_feature (889)..(889): n is a, c, g, or t
  misc_feature (894)..(894): n is a, c, g, or t
  misc_feature (898)..(898): n is a, c, g, or t
  misc_feature (903)..(903): n is a, c, g, or t
  misc_feature (906)..(907): n is a, c, g, or t
  misc_feature (915)..(915): n is a, c, g, or t
  misc_feature (918)..(918): n is a, c, g, or t
  misc_feature (921)..(921): n is a, c, g, or t
  misc_feature (928)..(928): n is a, c, g, or t
  misc_feature (933)..(933): n is a, c, g, or t
  misc_feature (935)..(935): n is a, c, g, or t
  misc_feature (937)..(938): n is a, c, g, or t
  misc_feature (940)..(941): n is a, c, g, or t
  misc_feature (946)..(947): n is a, c, g, or t
  misc_feature (951)..(953): n is a, c, g, or t
  misc_feature (955)..(957): n is a, c, g, or t
  misc_feature (960)..(960): n is a, c, g, or t
  misc_feature (965)..(966): n is a, c, g, or t
  misc_feature (971)..(972): n is a, c, g, or t
  misc_feature (974)..(974): n is a, c, g, or t
  misc_feature (978)..(979): n is a, c, g, or t
  misc_feature (984)..(987): n is a, c, g, or t
  misc_feature (990)..(992): n is a, c, g, or t
  misc_feature (994)..(994): n is a, c, g, or t
  misc_feature (996)..(997): n is a, c, g, or t
  misc_feature (1000)..(1000): n is a, c, g, or t
  misc_feature (1005)..(1007): n is a, c, g, or t
  misc_feature (1010)..(1010): n is a, c, g, or t
  misc_feature (1012)..(1016): n is a, c, g, or t
  misc_feature (1023)..(1023): n is a, c, g, or t
  misc_feature (1027)..(1028): n is a, c, g, or t
  misc_feature (1031)..(1032): n is a, c, g, or t
  misc_feature (1035)..(1035): n is a, c, g, or t
  misc_feature (1037)..(1037): n is a, c, g, or t
  misc_feature (1039)..(1046): n is a, c, g, or t
  misc_feature (1048)..(1051): n is a, c, g, or t
  misc_feature (1053)..(1054): n is a, c, g, or t
  misc_feature (1057)..(1057): n is a, c, g, or t
  misc_feature (1061)..(1061): n is a, c, g, or t
  misc_feature (1064)..(1066): n is a, c, g, or t
  misc_feature (1069)..(1070): n is a, c, g, or t
  misc_feature (1072)..(1073): n is a, c, g, or t
  misc_feature (1079)..(1079): n is a, c, g, or t
  misc_feature (1081)..(1081): n is a, c, g, or t
  misc_feature (1084)..(1087): n is a, c, g, or t
  misc_feature (1093)..(1094): n is a, c, g, or t
  misc_feature (1096)..(1096): n is a, c, g, or t
  misc_feature (1098)..(1099): n is a, c, g, or t
  misc_feature (1102)..(1102): n is a, c, g, or t
  misc_feature (1110)..(1110): n is a, c, g, or t
  misc_feature (1113)..(1114): n is a, c, g, or t
  misc_feature (1118)..(1119): n is a, c, g, or t
  misc_feature (1122)..(1122): n is a, c, g, or t
  misc_feature (1124)..(1125): n is a, c, g, or t
  misc_feature (1129)..(1129): n is a, c, g, or t
  misc_feature (1131)..(1131): n is a, c, g, or t
  misc_feature (1136)..(1136): n is a, c, g, or t
  misc_feature (1140)..(1140): n is a, c, g, or t
  misc_feature (1147)..(1147): n is a, c, g, or t
  misc_feature (1149)..(1150): n is a, c, g, or t
  misc_feature (1156)..(1157): n is a, c, g, or t
  misc_feature (1162)..(1162): n is a, c, g, or t
  misc_feature (1166)..(1166): n is a, c, g, or t
  misc_feature (1169)..(1173): n is a, c, g, or t
  misc_feature (1176)..(1176): n is a, c, g, or t
  misc_feature (1179)..(1179): n is a, c, g, or t
  misc_feature (1182)..(1183): n is a, c, g, or t
  misc_feature (1187)..(1188): n is a, c, g, or t
  misc_feature (1191)..(1191): n is a, c, g, or t
  misc_feature (1199)..(1199): n is a, c, g, or t
  misc_feature (1201)..(1201): n is a, c, g, or t
  misc_feature (1211)..(1211): n is a, c, g, or t
  misc_feature (1213)..(1219): n is a, c, g, or t
  misc_feature (1223)..(1225): n is a, c, g, or t
  misc_feature (1227)..(1228): n is a, c, g, or t
  misc_feature (1233)..(1234): n is a, c, g, or t
  misc_feature (1237)..(1237): n is a, c, g, or t
  misc_feature (1242)..(1242): n is a, c, g, or t
  misc_feature (1245)..(1245): n is a, c, g, or t
  misc_feature (1247)..(1247): n is a, c, g, or t
  misc_feature (1250)..(1251): n is a, c, g, or t
  misc_feature (1255)..(1259): n is a, c, g, or t
  misc_feature (1261)..(1263): n is a, c, g, or t
  misc_feature (1271)..(1271): n is a, c, g, or t
  misc_feature (1273)..(1273): n is a, c, g, or t
  misc_feature (1277)..(1278): n is a, c, g, or t
  misc_feature (1284)..(1287): n is a, c, g, or t
  misc_feature (1298)..(1298): n is a, c, g, or t
  misc_feature (1303)..(1304): n is a, c, g, or t
  misc_feature (1307)..(1308): n is a, c, g, or t
  misc_feature (1313)..(1315): n is a, c, g, or t
  misc_feature (1319)..(1319): n is a, c, g, or t
  misc_feature (1322)..(1322): n is a, c, g, or t
  misc_feature (1327)..(1328): n is a, c, g, or t
  misc_feature (1331)..(1331): n is a, c, g, or t
  misc_feature (1334)..(1336): n is a, c, g, or t
  misc_feature (1339)..(1339): n is a, c, g, or t
  misc_feature (1341)..(1343): n is a, c, g, or t
  misc_feature (1348)..(1348): n is a, c, g, or t
  misc_feature (1356)..(1356): n is a, c, g, or t
  misc_feature (1361)..(1361): n is a, c, g, or t
  misc_feature (1366)..(1368): n is a, c, g, or t
  misc_feature (1372)..(1372): n is a, c, g, or t
  misc_feature (1375)..(1375): n is a, c, g, or t
  misc_feature (1379)..(1379): n is a, c, g, or t
  misc_feature (1382)..(1382): n is a, c, g, or t
  misc_feature (1386)..(1386): n is a, c, g, or t
  misc_feature (1389)..(1390): n is a, c, g, or t
  misc_feature (1394)..(1403): n is a, c, g, or t
  misc_feature (1408)..(1409): n is a, c, g, or t
  misc_feature (1411)..(1411): n is a, c, g, or t
  misc_feature (1415)..(1420): n is a, c, g, or t
  misc_feature (1423)..(1424): n is a, c, g, or t
  misc_feature (1427)..(1427): n is a, c, g, or t
  misc_feature (1430)..(1430): n is a, c, g, or t
  misc_feature (1433)..(1433): n is a, c, g, or t
  misc_feature (1436)..(1436): n is a, c, g, or t
  misc_feature (1442)..(1443): n is a, c, g, or t
  misc_feature (1445)..(1445): n is a, c, g, or t
  misc_feature (1513)..(1513): n is a, c, g, or t
  misc_feature (1515)..(1517): n is a, c, g, or t
  misc_feature (1520)..(1520): n is a, c, g, or t
  misc_feature (1525)..(1526): n is a, c, g, or t
  misc_feature (1534)..(1534): n is a, c, g, or t
  misc_feature (1546)..(1546): n is a, c, g, or t
  misc_feature (1552)..(1552): n is a, c, g, or t
  misc_feature (1556)..(1556): n is a, c, g, or t
  misc_feature (1561)..(1562): n is a, c, g, or t
  misc_feature (1566)..(1567): n is a, c, g, or t
  misc_feature (1576)..(1576): n is a, c, g, or t
  misc_feature (1586)..(1587): n is a, c, g, or t
  misc_feature (1589)..(1589): n is a, c, g, or t
  misc_feature (1591)..(1591): n is a, c, g, or t
  misc_feature (1593)..(1594): n is a, c, g, or t
  misc_feature (1600)..(1601): n is a, c, g, or t
  misc_feature (1604)..(1604): n is a, c, g, or t
  misc_feature (1615)..(1615): n is a, c, g, or t
  misc_feature (1618)..(1619): n is a, c, g, or t
  misc_feature (1631)..(1631): n is a, c, g, or t
  misc_feature (1634)..(1634): n is a, c, g, or t
  misc_feature (1639)..(1640): n is a, c, g, or t
  misc_feature (1642)..(1642): n is a, c, g, or t
  misc_feature (1644)..(1644): n is a, c, g, or t
  misc_feature (1646)..(1646): n is a, c, g, or t
  misc_feature (1652)..(1652): n is a, c, g, or t
  misc_feature (1654)..(1657): n is a, c, g, or t
  misc_feature (1663)..(1663): n is a, c, g, or t
  misc_feature (1669)..(1676): n is a, c, g, or t
  misc_feature (1678)..(1678): n is a, c, g, or t
  misc_feature (1681)..(1681): n is a, c, g, or t
  misc_feature (1683)..(1687): n is a, c, g, or t
  misc_feature (1696)..(1696): n is a, c, g, or t
  misc_feature (1702)..(1706): n is a, c, g, or t
  misc_feature (1708)..(1709): n is a, c, g, or t
  misc_feature (1711)..(1711): n is a, c, g, or t
  misc_feature (1714)..(1714): n is a, c, g, or t
  misc_feature (1718)..(1720): n is a, c, g, or t
  misc_feature (1724)..(1724): n is a, c, g, or t
  misc_feature (1730)..(1730): n is a, c, g, or t
  misc_feature (1735)..(1735): n is a, c, g, or t
  misc_feature (1738)..(1738): n is a, c, g, or t
  misc_feature (1743)..(1743): n is a, c, g, or t
  misc_feature (1747)..(1748): n is a, c, g, or t
  misc_feature (1753)..(1753): n is a, c, g, or t
  misc_feature (1837)..(1837): n is a, c, g, or t
  misc_feature (1935)..(1935): n is a, c, g, or t
  misc_feature (1984)..(1984): n is a, c, g, or t
  misc_feature (1986)..(1986): n is a, c, g, or t
  misc_feature (1992)..(1992): n is a, c, g, or t
  misc_feature (1995)..(1995): n is a, c, g, or t
  misc_feature (2013)..(2013): n is a, c, g, or t
  misc_feature (2033)..(2033): n is a, c, g, or t
  misc_feature (2354)..(2354): n is a, c, g, or t
  misc_feature (3084)..(3084): n is a, c, g, or t
  misc_feature (3173)..(3173): n is a, c, g, or t
aanantnaaaaaattnnnnttnnttnnnnnggnnnnnnnnntnttnnnntntntnccnnnnnttggttntnnnnngaanattaannntnttttnaananaanccaaanggnaananancaaggngttaaattnccnnaaggngttnccnngtntnnnaanaanccnaaanngcnntttnnnggngannnnaaaaaggnnntaaannntnttnttnttnaannnggngnaanttntnnnnanntntanacantaaannttnaaaannnaaannaaannnnntntnnnnnnnntnnnnannnnnnnttnnggnaannnntnnccnnnnnnnnnngnnnaanaaaannnntnaanannnnnnnnnnnnnccntngnnnnntnnnnnnnnnnnttaanaanggggnnnnnncngnnnntngnnnntttnnannngnaaaancnntnnnaaaanaangnnannncnntnngggnnnantnaaananaaaannnnnnnnaanaanaattnttnnaannnaannttnnnnnttnanntttnnnaannnaaanatanaggnccnnannnnnnntttntnncnnttnnnnnggnnaannnnnnnnnggttttnccnnaanntaaangtttnnntaannncnaaaaanaaanaattnttnaaaanatatatnaattnttnttnnnaatttttntcnnnaanagnnnnntgggnnnataggaattnttntcnttnnagaggattntaannnnntgnaanaggnnggnnnnnttntnnnnaattnaattnnccnnatnnttggnnatnnttntgnnccggnaattnnnggnnttaanntttnnaatttggtttntnttccncgggnnannaannaanaaanccaatttntnttnnnnnaanataanaaanagttnaannaaaaaggnttnttnttttttnaattntntnncnntaaanngcgnnnannnttnttggnnttccnngngaannaattnnnngannntntnnggnaaccnnnggngnnnnnatttttnaaannttnnggntntnnnnnnnncnnnngnnttntggngannnttnngnntttaananatnnnntggaanngngnnttnattttccncannaaannggngnntttntnggttntccnttaaaananntgaaannttttntttntcnnnnnggnaanggnnaccnnatntgtggggngnggaaggtttntnnnnnnntggnnnanncaaanngcnctttnttntnttnnaaannnnntnnnaatttttntnaaanncaattnnnnttgggaaaaanatttnnttnnttggnnncaanaanggccnnggnggnnnaanannnttggngtaatttnttggnccggnnnaggnaanacanaanaaanggnncaannnnnnnnnnaaggnntnaaannnnnnggnnaanaanttnaanttaaanntntttctgaagtatccgtagatgacgcagcagcttacgaaaaactagctcttggctgtgctgatatgggngnnnaanaattnnaagaaggngaatttgaaccnttctanacanaattnnaagnnaaattgggnggtaaaaaannancnanntttggnnccnatggttggggnggnncttggttagaanacnggggnncncncnttaaanannnnggtggngaattnnnnnnnnanggngnnnnncttttgggngaaccnnnnnannanggnaaannncaangccaanaattnggnaaaantttnncgaangcttaatttgatctcaacaatatacaaaggctgtaataacgataaattcgttattacagccttttttacatttattatatatancatcaatgtttcaattagaacgaaaaatttctttctaatgaatacaaagaatatttataaagcatatatataaatcccgatatagatatgaagaatangcattacttctatagaattccatattatttatttttgcaagagcttatntnttactnatnaaaaaaaatgataactgnaaaataatgtgatgaaaaanacaatgtttatatatgttcttcgctattgatgaatatgcttgcataattacaaataactttaatgcatattgtcgttgcatttttgtgtacatagaactataatcaagttagggaacctaacaaaaaattaggttgctacaaaattagttagaatgaatctcaacatactaattaattcggaggctgaagctttcagtccacaaaatagtaaccaataccgatgagaggaaggttattttatgagtacactagaacgattacaggtgatagctcatgggttggccgttcaatttgggccttcttgtgaggtattgattcangacttgcagcgtgatatcgatacatcacttgtatatattgaaaatggtaccataactaatcgtcatgttggcgatggaccatctcatgccgttttagatgtactaagttatgacgacggtagcgaaggtcgattcggttaccttacaaaaactaaggatggtcgaatattaaaatcatctactatgtatatccgtgatgatacggggtgcatagcctacttgctagggattaaccaagacataaccgagctagttatgatgcatcgggccttggatagtttagtaaatacaggtcaaggtgatgctggatctgttgaaaaaattactacaagcgtgtcagaactgttagatgatttattactagaagcagaacgtttagtggggaaacctgggccactcatgagtaaggtggaacgtcttaaagcaattacctacttaaatgaaaaaggggcttttcttatctctaaatcttcagagaagatagcagagtattttaatatttctaagtttaccctttatagtgatttaaatactgtaaaggaagaatcctaggaggcaaatatggaacgaattcagtggaaacgtaatacgatggcaccatctagcgacaagtttttgtcggttatggatgttagagaaattaagaaagctaaagcgtttcacgaaagtttcccgcaatatacggtaactccacttgtttcacttaaaaatttagcatctcatatcggtnttgattctctcttcgtaaaagatgagtcctatcgctttggtctaaatgctttcaaagtgttgggcggttcttatgcgatggggaaatangtggctcaacaacttggtaaaacagttgaagatgtaccatatgatgtattaacatctgcaaaattaaaagaagaattcggccaagctacattcttcactgcaactgatggtaaccacggtcgcggcgtagcctgggctgcaaataaattaggtcaaaaatctgtagtattcatgccaaaaggctctacagaataccgcagaaaacaaatcgaaaatgaaggcgctacagtaacaatcgaagaattcaactacgatgaatgtgtacgcctagcaactaaaaaatctaaagaagttccaaatggtgttgtagttcaagatacagcatgggaaggttatgaagaaattccaaactggatcatgcaaggctatggcacaatggctatggaaacagcagctcaattagaagctgaaaactgcaaagttccaactcatgtattcgtacaagctggtgtaggttctcttgctggttccgtagtaggttacttcactaacttatatagcaatgcagctaaaaaacctaaattggttgttgttgaagcagaagcagcagcttgcttatacaaaggcgctgtagctgatgatggggaacctcgcattgtagaaggcgaccttgaaacaatcatggcaggcttagcatgtggcgaaccaaatacagtttcttgggatatcttaagaaaccacgcagacgtattcgtatctgctccagactgggtagcacgtttaggtatgcgcgttggtggtgcaccaattaaaggcgatactccaattacaactggtgagtctggtgcggttccattaggtcttgtaatggcacttatgacaatgcc

SEQ ID NO: 1380 - DNA, 4000 bp, Escherichia coli
  misc_feature (39)..(39): n is a, c, g, or t
  misc_feature (1316)..(1316): n is a, c, g, or t
  misc_feature (1738)..(1738): n is a, c, g, or t
  misc_feature (1929)..(1929): n is a, c, g, or t
  misc_feature (1950)..(1950): n is a, c, g, or t
  misc_feature (2454)..(2454): n is a, c, g, or t
  misc_feature (2844)..(2844): n is a, c, g, or t
  misc_feature (2889)..(2889): n is a, c, g, or t
  misc_feature (3230)..(3230): n is a, c, g, or t
  misc_feature (3775)..(3775): n is a, c, g, or t
  misc_feature (3777)..(3777): n is a, c, g, or t
  misc_feature (3823)..(3823): n is a, c, g, or t
  misc_feature (3876)..(3876): n is a, c, g, or t
tcgccgctctcgtcgaacagcagcgagctgctggcgcgnaccgtgcctacgacctacgacgtgctgatcgccctgttcggcggcctggcgggcatcgtggcgcagacgcggcaggaccgcacgtcgaccgtcattcccggcgtggccatcgccacggccctcatcccgcccctctgtacggcgggcttcggactggccacggggcagttccgctttttcatcggcgccttctacctcttcttcatcaattcggtgttcatcgcgctggcgacctatgccatggtgcgttttctgcaatacgagaagaaggtcttcatcgacaaggtccgcgagcgcacggtcaagcggctgatgatggtcatcacgctggtgaccttcatcccgagcgtcgtcatcgggttccacatggtccgcgtctcgttgttcgaggccgtggccgacaaatacgtgtcgcaggtcttcaactttccgcatacccgcgtgatcgagtgcaacaaacactacgcgcagggcaagaacccctcgcagatcgagctgctgctcgtgggcgagccgctgggcgaggaggtgatcgagaatgcccgtacgcagatgcgcaatttcgggctggaggaggccgaactggtcgtccggcaggccaatacggaggacaaggtcgacgtggtttcgctccagaagagctatcaggagctgctggaggagaagaaccgccggatcggcgagatgtcctcgcagctgaaacgctaccgggtgaccaacgtcgaggtgaacgacatctcgcgcgaagtgggggccatgatggacaacatcggggccatttcgctgaccaagggcatcaccttcgacgtcgagggcacgcccggcgatacgacgctcgtgtgcgtggtgacgccccgggattccgcgcttccggtcgaccgtgaaacgctgatccgctggttgagaatccgcaccaaggtcgagaacgtcaaacttttcgtggaaccctaatccgggcggcaggcatgaaacgaaccgatctgaccattttgcagcgcttctggctggagaccctttggctgggcgcacgcgtgttcgccgtgatgccttactggttcaagtactacgtcgtcgaaaacctgcttttcgtcctgctctactactgcctgcgctaccgcatgaaggtcgtcaagaccaacctgcggaactcgttccccgagaagagcgaacgcgaactggccgtcatccggcggcggttctaccgcacgctgtccgaaatcttcgtcgacacgatcaacatggcctacatgaacgaggagaaggggcggacggtgctnacggtcaaagacgtggagaaacacgtggaagcggtgcacggccgcgactggatcgccatgacggcccatttcggctgctgggagtactgctcctactgggggctttacgagcggtcgcagatgctggtcgccgtctaccatccgctgcgcagcaaggtgatggaggaactctaccggcggctgcgcaattacgaaaattcgatgaccgtctcgatgaaggagagcctgcgtttctacctgcgcaaccggaccggaggcatcgccggcaagaacctcgtgatggggcttatcgccgaccagaatcccccgcggcggcccgacagccgttggttccgcttcctcaatcaggatacgatcttcttcgacggcggcgagaaactggccctgcgctgcaacctcccggtctacttcgtgaagatganccgcctgcggcggggacgctacgaaatgtccttcgaactgatttatgacggcaaagaggaggtcgccgaatacgaaatcacgcagcgttacgttcgtaagttggagcggatgatctgcgagtgtcccgaactgtggatgtggtcgcatcgccgctggaagcacaaacgaactcatgccggtcgctaaaatnatcatactcaactggaacggngcggaccacctgcgtcgtttcctgccgtcggtcgtggccgcggctcccgccggcgtcgaggtcatcgtcgccgacaacggttcgacggacgactctctcgcggcgctcgccgccgggtttccgtcggtcacggtcctgcgcatggaccgcaactacggctttgccggaggctacaaccgcgcattggagtatatcgaggccgactattacctgctgctgaactccgatgtcgagacccccgaggggtggcttgcgccgattctcgactgtctggaccggaatcccgacgtggcggtcgccgcgccgaagctgatctcctgcgccgaccgcacggagttcgagtatgcgggggctgcgggcggtttcatcgactacctgggctatcccttctgccgggggcgcatcctgcgctgcgtggagaaggaccggggccagtacgacgacgagcgcgacgtgttctgggtgagcggcgcggctttctgctgccgggccgacgtgttccgngcgctgggcggcttcgacggcgatttcttcgcccacatggaggagatcgacctctgctggcggatgcagctggcgggttaccgggtgcggatcgtgccccggagcagggtctaccacctgggcggcggcacgctccagaccgattctccggccaaggtcttctacaatcaccggaacaatctcgccatgctttacaagtgcgcctcgcccgcacagcggctttgcgtggccgttgcgcgcccggcgctcgacctgctcgccgcgctgtcctacctcatgcagggccgccgggacaacttccgcgccgtgttccgcgcctggcgcgacttcatccgctggcacggggcgctggcccgcaaacggcgtgagatccgcgcgaaccgcaagggntccgccgcggaaaacatctaccgcggctcggtggtgctgcgctancttttcggccggcggaccttcggcggcatgatgcgctgacgcggagccgatgtcgtcgttttcgcaacgggacttgtgcgatcttcgttttttgcgtatctttctgaaaaataccctcgcttatgatacgtgcggctcttctgttgtcggcagtcgtgtgttttttgcagccttttcgcgcgtcggcgacagggcaggctgccgaacggcttgtcgtcgggcgcgatacgatgcagttgttcgcactgccgctggcgacggcggattccgccgtgctcgcccggctcgaaaaacggctggacgaactcgatgcctccggctctacggcttgctggcgtcgntgtatcggtgtctggcggctggacgacgagggcatcttgtggcttgagtgcgtgaacaccgaggacggcgacgtcgtattttccggagcggagctggttcccgaatttgcagcgggatcacgcgcccgggccggctggttcagcggagagatccgctatggcacggggaatctggtgtattaccaacacgatggatttatgcggaatctcgaacgcgaatgggtggctgcggtgtccgaggggcgcgtgagggagacgaaagcctaccggaaccggctgtatgaaagaggtgcggatgcgacggacaatgcacagcgtgtggccgcggcgttcgacagccttcatgtcggaaagtcgcccgatctgctgtcgctgtatgtggtctttgcagccgattccacagggcgggtggttcggatcgaccgggcgcgactgttgtcggaaaagggaagtcctgttgtcagcgatccggctgacccgctgttgcaggcagctctgcgggcgtttcgctcggtgtcgcgctgggatgcctggtgggtcggagngncctggaaggaacaggcgtattttattccgctgcgcagggccggganggtttggaaaccgcgaagaggataacgatgcttattgctccggcttgcagggnagcgtgaaccagaaggtcgagcctttgcccggtcgggattcgacgccgatgcggccgcccatcgtttcgacgatcgacttcgagatcgccagtccgatgccgatgccctgcctgaacgatcccg

SEQ ID NO: 1381 - DNA, 4000 bp, Escherichia coli
  misc_feature (272)..(272): n is a, c, g, or t
  misc_feature (296)..(296): n is a, c, g, or t
  misc_feature (440)..(440): n is a, c, g, or t
  misc_feature (458)..(458): n is a, c, g, or t
  misc_feature (497)..(497): n is a, c, g, or t
  misc_feature (578)..(578): n is a, c, g, or t
  misc_feature (625)..(626): n is a, c, g, or t
  misc_feature (704)..(704): n is a, c, g, or t
  misc_feature (902)..(902): n is a, c, g, or t
  misc_feature (1992)..(1992): n is a, c, g, or t
  misc_feature (2012)..(2012): n is a, c, g, or t
  misc_feature (2016)..(2016): n is a, c, g, or t
  misc_feature (2140)..(2140): n is a, c, g, or t
  misc_feature (2322)..(2322): n is a, c, g, or t
  misc_feature (2363)..(2363): n is a, c, g, or t
  misc_feature (2435)..(2435): n is a, c, g, or t
  misc_feature (2551)..(2551): n is a, c, g, or t
  misc_feature (2559)..(2559): n is a, c, g, or t
  misc_feature (2597)..(2597): n is a, c, g, or t
  misc_feature (2608)..(2608): n is a, c, g, or t
  misc_feature (2734)..(2734): n is a, c, g, or t
  misc_feature (2747)..(2747): n is a, c, g, or t
  misc_feature (2815)..(2815): n is a, c, g, or t
  misc_feature (2832)..(2832): n is a, c, g, or t
  misc_feature (2839)..(2839): n is a, c, g, or t
  misc_feature (2845)..(2845): n is a, c, g, or t
  misc_feature (2853)..(2853): n is a, c, g, or t
  misc_feature (2872)..(2872): n is a, c, g, or t
  misc_feature (2881)..(2881): n is a, c, g, or t
  misc_feature (2886)..(2886): n is a, c, g, or t
  misc_feature (2919)..(2919): n is a, c, g, or t
  misc_feature (3306)..(3306): n is a, c, g, or t
  misc_feature (3334)..(3334): n is a, c, g, or t
  misc_feature (3897)..(3898): n is a, c, g, or t
  misc_feature (3902)..(3902): n is a, c, g, or t
  misc_feature (3905)..(3905): n is a, c, g, or t
  misc_feature (3909)..(3909): n is a, c, g, or t
  misc_feature (3911)..(3912): n is a, c, g, or t
  misc_feature (3914)..(3914): n is a, c, g, or t
  misc_feature (3916)..(3916): n is a, c, g, or t
  misc_feature (3918)..(3921): n is a, c, g, or t
  misc_feature (3923)..(3923): n is a, c, g, or t
  misc_feature (3925)..(3926): n is a, c, g, or t
  misc_feature (3929)..(3929): n is a, c, g, or t
  misc_feature (3931)..(3931): n is a, c, g, or t
  misc_feature (3938)..(3938): n is a, c, g, or t
  misc_feature (3941)..(3941): n is a, c, g, or t
  misc_feature (3943)..(3943): n is a, c, g, or t
  misc_feature (3945)..(3945): n is a, c, g, or t
  misc_feature (3947)..(3947): n is a, c, g, or t
  misc_feature (3952)..(3952): n is a, c, g, or t
  misc_feature (3955)..(3956): n is a, c, g, or t
  misc_feature (3958)..(3958): n is a, c, g, or t
  misc_feature (3960)..(3960): n is a, c, g, or t
  misc_feature (3962)..(3963): n is a, c, g, or t
  misc_feature (3965)..(3965): n is a, c, g, or t
  misc_feature (3972)..(3972): n is a, c, g, or t
  misc_feature (3974)..(3976): n is a, c, g, or t
  misc_feature (3980)..(3981): n is a, c, g, or t
  misc_feature (3983)..(3983): n is a, c, g, or t
  misc_feature (3989)..(3989): n is a, c, g, or t
  misc_feature (3993)..(3994): n is a, c, g, or t
  misc_feature (3999)..(3999): n is a, c, g, or t
cggatagaacccaagaatctcaaataaagacgagtaaagctccttttctttacggaaaggaagccttactctgtcgataagattactcagcatacttcttgaaaataacacaagcgttatgtcctccaaagccaaatgtgttgcttagtgcagctcgcaccacgcgcttttgtgccttgttgaacgtgaagttgaggttataatcgatgttctcgtccacgtcgtcttcgtcgtggtttattgttggggggatgatgtcgttatgaacggcnagcaccgaggccattgcctcaacngcgccagctgctccgagcaagtgtcccgtcatcgatttggttgaactgatattaagtttataggccgcatcgccaaaaagatctttgatggcttttgcctccgaaacgtcgcctacaggtgtcgacgtgccgtgcacgttaatntagtcgatgtcttcgggnttcaatccggcatcttccaatgcgttttgcatcaccagncgtgcgcccaagccttcggggtgactagccgtgatgtggtgtgcgtcggcacttgcgccctcgcctaccatctcggcatanatcttagcaccgcgagccttggcgtgttccagttcttccagaatcanncagccagctccctcgcccataacgaatccgtcgcggctcttgctaaatggacgcgaagcgcgctcggggtcgtcgttncgggtagaaagggcgtgcatagcgttaaatccacctacgccacagccacagatggcagcctcggcaccaccgctaacaataacgttggccttacccaaacgaatgaggttgaaggcatcggccaaagcattggtcgacgatgcgcaagccgaagtggtggcatagttgggcccgtgcaggccatacataatcgagatntgtccggcagcgatgtcggcaatcatcttagggatgaagaaggggttgaacttaggctcttcaccaaggtgctggccatagtaagtaacttcctcttcaaaggttttgataccgccgatacccacaccgtaaaccacgccaatgcggttacggtcttccttttccatgtccagaccactatctttaataccctgcatagccgagataatggccaattgggtatagcggtccatcttgcgagcctccttacggtcgatatagtcggtcacgttgaggttcttcacctcgcaggcgaacttgcttttgaaattggtggtgtcgaaatgtgtgatgggtgctgcgccactcttaccggccaacaggttagcccacgtctcttcgggcgtgttgccaacgggggtaacggctccaagacccgtcactactactctttttaactccattgaaatgaaaaatattgctttaaggggcgtttcaaacaaacgcgcgggtggaatagaaaaggtcgtaaataagcaaatacacgtgtgtatctttcgctcttccaccgcctgatgcgaaagtcgaaatcggccttgttgttaatttccctaggggtaaaataagggtgatcaagagtttttggttatggctccggcagatgcaggaggccataaccaaaagcttgtcactttactttgcgttttcagcgatataggcgatagcgtcgccaacagtgccaatcttctcagctttgtcgtcggggatggagatgccaaattccttttcgaactccataatcagttctacagtgtcgagcgagtctgcaccaaggtcgttggtgaagcttgcttcgggttttacctctgcttcgtctacaccgagtttgtcaacgatgatagcttttactttcgattcaatttctgacataattgtaaaatttaatagtgtttgtaaataaatttcatccgaaaattcgggtgcaaaggaaatcatttttattcatatccacaaacatttcgcccaaaaaagcactcttcattgcacacatacccccctattgtgcattgattttagggattttaactactttttagaaataaataaggcntcttggcgcaccaacgaganaggnaaaccgagactcattttttacgacttttcacgcttgacagtagccaattccctgattttcattaagagatgtttccgcaaggcgtgtttttgaggtgccatttgggcgacaactcatctataanatacacgcatacgcgcgcgcgtagagccaacactaacgagtggataagccacataaaccaacaacacgaataccattaacggcaagttaacccgaaaaaatagggttgttttggtcaactcatagaccaccactacagcctctcggccccctcacttttaagtcccaaataaggccttattnacctttcgccttggtattgctaagctggaacaggattccanataagttggaatgatgttccatataaactggaatgacgttccatataagctggaacagagttccagcttagngataccaaggcaaaaaatgatccactggttatcagccacacattttctagtctgcaaaagcaatctacctcaacccttttctatctgctcacgcctgattggcaacccgtttctancccctctntttcgacagcacaacaaggcaacatttataaaaatgcntggggataaanacatgccagcttcggaacaaagccacatacgtatcaagtaacaataaaacgtaagaagcgtttatcatgcgtccggggtaaaacaccatgcgttttaagcaagacggaggcataagaaacacgatnacgagttcgaganaagacacggttccttttgagcaagattagataaaaacgaatggccatatcaccaactaccgcattgcngttggtctgttggtagntggcatnttgcangacattanttcctacatcttgctttcnaaccacccnaaatntaatctatatcaagtattgacgccaaaaaatanattttttggaacatttattgtgcgttttgaagcaaattattacttttgcatcgcatttcagagattggaagtcgtatgatttaaaccaaaacgcggctcgagtgattgttaattgcttgcccgcattccgaccatttacacccgcacaacatcaattagacaatcgatctcttcgaaaacaccccgactatcccccgaggacaatgactgaacgcttcgttcaacgttgacttttgggggatagtcattttttagtagataagttcacgagttgataagtgaaccagatgcaagatggggagttaacaaactaacgagtagacaagtgagcctgttgacaagtaaagcagtcaatcagtagacaagaggacaagtcaacttgttcantttccccttgtctactcgcctacttgtnagttcgtcaactgcccaaattattctttctttctcttacaaaaatgtttcatgaacgatttttgcatgcatacgaacgattattgcaagccccttacgcgcgttcgtactaaatttgcctccgcagaagatggggagaaagcgcacccgaattgacataaatcaattttagaaattgcgcaacccgatgagaaaggctacttttccctctctacaaagctacaatcttacatatttataaaacctaattacgcaacaagaaatgaagcagctacgaactcttcttatcatcgcgatggccattttcgtatgcgcccttacccatgcgcaaggcgtaaacgtgagcggtaaggttacttcggccaccgacggcgaacccatcacgggcgcatccgtcgtggaaaaaggaaccacacgcggcaccgtcaccaacatcgacggaaattttaaactcgaagtgaacagcggggcaacactggttatatcttacttggggtttaaaaccattgaagtgaaggccacgccaaccatgaacatcgcattggaagaaaatgctaagagccnnaacnaantggngnngncngnnnntncnnccnancgcaagnccnantnancgggngcnntntngnngnttaacgncnnngacnngnccaaanaaanngaaanc

SEQ ID NO: 1382 - DNA, 4000 bp, Escherichia coli
  misc_feature (2)..(2): n is a, c, g, or t
  misc_feature (4)..(4): n is a, c, g, or t
  misc_feature (6)..(6): n is a, c, g, or t
  misc_feature (8)..(9): n is a, c, g, or t
  misc_feature (11)..(11): n is a, c, g, or t
  misc_feature (14)..(14): n is a, c, g, or t
  misc_feature (16)..(18): n is a, c, g, or t
  misc_feature (23)..(23): n is a, c, g, or t
  misc_feature (30)..(30): n is a, c, g, or t
  misc_feature (33)..(34): n is a, c, g, or t
  misc_feature (38)..(38): n is a, c, g, or t
  misc_feature (43)..(44): n is a, c, g, or t
  misc_feature (47)..(48): n is a, c, g, or t
  misc_feature (50)..(50): n is a, c, g, or t
  misc_feature (52)..(52): n is a, c, g, or t
  misc_feature (56)..(56): n is a, c, g, or t
  misc_feature (62)..(62): n is a, c, g, or t
  misc_feature (64)..(65): n is a, c, g, or t
  misc_feature (71)..(74): n is a, c, g, or t
  misc_feature (77)..(77): n is a, c, g, or t
  misc_feature (79)..(81): n is a, c, g, or t
  misc_feature (83)..(87): n is a, c, g, or t
  misc_feature (91)..(91): n is a, c, g, or t
  misc_feature (93)..(99): n is a, c, g, or t
  misc_feature (103)..(103): n is a, c, g, or t
  misc_feature (107)..(108): n is a, c, g, or t
  misc_feature (110)..(110): n is a, c, g, or t
  misc_feature (113)..(114): n is a, c, g, or t
  misc_feature (117)..(117): n is a, c, g, or t
  misc_feature (119)..(119): n is a, c, g, or t
  misc_feature (128)..(128): n is a, c, g, or t
  misc_feature (131)..(133): n is a, c, g, or t
  misc_feature (135)..(136): n is a, c, g, or t
  misc_feature (138)..(139): n is a, c, g, or t
  misc_feature (143)..(143): n is a, c, g, or t
  misc_feature (145)..(147): n is a, c, g, or t
  misc_feature (149)..(151): n is a, c, g, or t
  misc_feature (153)..(154): n is a, c, g, or t
  misc_feature (156)..(158): n is a, c, g, or t
  misc_feature (161)..(161): n is a, c, g, or t
  misc_feature (163)..(165): n is a, c, g, or t
  misc_feature (167)..(167): n is a, c, g, or t
  misc_feature (170)..(171): n is a, c, g, or t
  misc_feature (173)..(176): n is a, c, g, or t
  misc_feature (178)..(181): n is a, c, g, or t
  misc_feature (186)..(186): n is a, c, g, or t
  misc_feature (189)..(192): n is a, c, g, or t
  misc_feature (195)..(195): n is a, c, g, or t
  misc_feature (197)..(197): n is a, c, g, or t
  misc_feature (200)..(201): n is a, c, g, or t
  misc_feature (205)..(206): n is a, c, g, or t
  misc_feature (208)..(208): n is a, c, g, or t
  misc_feature (211)..(212): n is a, c, g, or t
  misc_feature (214)..(216): n is a, c, g, or t
  misc_feature (220)..(220): n is a, c, g, or t
  misc_feature (222)..(223): n is a, c, g, or t
  misc_feature (226)..(226): n is a, c, g, or t
  misc_feature (231)..(234): n is a, c, g, or t
  misc_feature (236)..(236): n is a, c, g, or t
  misc_feature (241)..(241): n is a, c, g, or t
  misc_feature (243)..(243): n is a, c, g, or t
  misc_feature (247)..(247): n is a, c, g, or t
  misc_feature (251)..(251): n is a, c, g, or t
  misc_feature (260)..(263): n is a, c, g, or t
  misc_feature (266)..(269): n is a, c, g, or t
  misc_feature (273)..(274): n is a, c, g, or t
  misc_feature (276)..(276): n is a, c, g, or t
  misc_feature (278)..(280): n is a, c, g, or t
  misc_feature (285)..(285): n is a, c, g, or t
  misc_feature (287)..(287): n is a, c, g, or t
  misc_feature (290)..(290): n is a, c, g, or t
  misc_feature (292)..(292): n is a, c, g, or t
  misc_feature (294)..(294): n is a, c, g, or t
  misc_feature (296)..(296): n is a, c, g, or t
  misc_feature (299)..(300): n is a, c, g, or t
  misc_feature (303)..(304): n is a, c, g, or t
  misc_feature (306)..(306): n is a, c, g, or t
  misc_feature (309)..(309): n is a, c, g, or t
  misc_feature (312)..(312): n is a, c, g, or t
  misc_feature (314)..(314): n is a, c, g, or t
  misc_feature (321)..(321): n is a, c, g, or t
  misc_feature (325)..(325): n is a, c, g, or t
  misc_feature (328)..(328): n is a, c, g, or t
  misc_feature (330)..(333): n is a, c, g, or t
  misc_feature (336)..(336): n is a, c, g, or t
  misc_feature (345)..(346): n is a, c, g, or t
  misc_feature (348)..(352): n is a, c, g, or t
  misc_feature (354)..(354): n is a, c, g, or t
  misc_feature (356)..(358): n is a, c, g, or t
  misc_feature (360)..(361): n is a, c, g, or t
  misc_feature (364)..(364): n is a, c, g, or t
  misc_feature (366)..(366): n is a, c, g, or t
  misc_feature (370)..(371): n is a, c, g, or t
  misc_feature (374)..(376): n is a, c, g, or t
  misc_feature (378)..(379): n is a, c, g, or t
  misc_feature (384)..(385): n is a, c, g, or t
  misc_feature (387)..(387): n is a, c, g, or t
  misc_feature (389)..(391): n is a, c, g, or t
  misc_feature (395)..(397): n is a, c, g, or t
  misc_feature (401)..(401): n is a, c, g, or t
  misc_feature (403)..(403): n is a, c, g, or t
  misc_feature (405)..(407): n is a, c, g, or t
  misc_feature (409)..(410): n is a, c, g, or t
  misc_feature (417)..(417): n is a, c, g, or t
  misc_feature (420)..(421): n is a, c, g, or t
  misc_feature (424)..(425): n is a, c, g, or t
  misc_feature (427)..(430): n is a, c, g, or t
  misc_feature (434)..(434): n is a, c, g, or t
  misc_feature (437)..(439): n is a, c, g, or t
  misc_feature (447)..(447): n is a, c, g, or t
  misc_feature (450)..(452): n is a, c, g, or t
  misc_feature (458)..(459): n is a, c, g, or t
  misc_feature (464)..(465): n is a, c, g, or t
  misc_feature (468)..(468): n is a, c, g, or t
  misc_feature (470)..(471): n is a, c, g, or t
  misc_feature (473)..(473): n is a, c, g, or t
  misc_feature (475)..(475): n is a, c, g, or t
  misc_feature (479)..(480): n is a, c, g, or t
  misc_feature (485)..(485): n is a, c, g, or t
  misc_feature (488)..(488): n is a, c, g, or t
  misc_feature (490)..(490): n is a, c, g, or t
  misc_feature (492)..(492): n is a, c, g, or t
  misc_feature (494)..(495): n is a, c, g, or t
  misc_feature (497)..(497): n is a, c, g, or t
  misc_feature (504)..(504): n is a, c, g, or t
  misc_feature (507)..(507): n is a, c, g, or t
  misc_feature (509)..(509): n is a, c, g, or t
  misc_feature (511)..(511): n is a, c, g, or t
  misc_feature (513)..(515): n is a, c, g, or t
  misc_feature (517)..(517): n is a, c, g, or t
  misc_feature (520)..(521): n is a, c, g, or t
  misc_feature (523)..(523): n is a, c, g, or t
  misc_feature (526)..(526): n is a, c, g, or t
  misc_feature (532)..(532): n is a, c, g, or t
  misc_feature (534)..(534): n is a, c, g, or t
  misc_feature (537)..(537): n is a, c, g, or t
  misc_feature (540)..(540): n is a, c, g, or t
  misc_feature (544)..(544): n is a, c, g, or t
  misc_feature (548)..(554): n is a, c, g, or t
  misc_feature (578)..(578): n is a, c, g, or t
  misc_feature (584)..(584): n is a, c, g, or t
  misc_feature (586)..(587): n is a, c, g, or t
  misc_feature (590)..(591): n is a, c, g, or t
  misc_feature (597)..(598): n is a, c, g, or t
  misc_feature (602)..(603): n is a, c, g, or t
  misc_feature (605)..(605): n is a, c, g, or t
  misc_feature (607)..(607): n is a, c, g, or t
  misc_feature (609)..(610): n is a, c, g, or t
  misc_feature (613)..(613): n is a, c, g, or t
  misc_feature (615)..(616): n is a, c, g, or t
  misc_feature (620)..(622): n is a, c, g, or t
  misc_feature (624)..(624): n is a, c, g, or t
  misc_feature (629)..(630): n is a, c, g, or t
  misc_feature (632)..(636): n is a, c, g, or t
  misc_feature (638)..(642): n is a, c, g, or t
  misc_feature (645)..(647): n is a, c, g, or t
  misc_feature (658)..(658): n is a, c, g, or t
  misc_feature (661)..(661): n is a, c, g, or t
  misc_feature (663)..(663): n is a, c, g, or t
  misc_feature (666)..(669): n is a, c, g, or t
  misc_feature (673)..(673): n is a, c, g, or t
  misc_feature (675)..(675): n is a, c, g, or t
  misc_feature (677)..(681): n is a, c, g, or t
  misc_feature (683)..(684): n is a, c, g, or t
  misc_feature (686)..(687): n is a, c, g, or t
  misc_feature (689)..(689): n is a, c, g, or t
  misc_feature (693)..(693): n is a, c, g, or t
  misc_feature (695)..(696): n is a, c, g, or t
  misc_feature (699)..(699): n is a, c, g, or t
  misc_feature (701)..(701): n is a, c, g, or t
  misc_feature (703)..(703): n is a, c, g, or t
  misc_feature (709)..(709): n is a, c, g, or t
  misc_feature (715)..(715): n is a, c, g, or t
  misc_feature (721)..(721): n is a, c, g, or t
  misc_feature (724)..(729): n is a, c, g, or t
  misc_feature (751)..(751): n is a, c, g, or t
  misc_feature (762)..(764): n is a, c, g, or t
  misc_feature (766)..(767): n is a, c, g, or t
  misc_feature (770)..(770): n is a, c, g, or t
  misc_feature (772)..(775): n is a, c, g, or t
  misc_feature (792)..(792): n is a, c, g, or t
  misc_feature (795)..(795): n is a, c, g, or t
  misc_feature (801)..(801): n is a, c, g, or t
  misc_feature (815)..(815): n is a, c, g, or t
  misc_feature (818)..(818): n is a, c, g, or t
  misc_feature (820)..(820): n is a, c, g, or t
  misc_feature (915)..(915): n is a, c, g, or t
  misc_feature (1454)..(1454): n is a, c, g, or t
  misc_feature (1517)..(1517): n is a, c, g, or t
  misc_feature (3424)..(3425): n is a, c, g, or t
  misc_feature (3428)..(3428): n is a, c, g, or t
  misc_feature (3436)..(3437): n is a, c, g, or t
  misc_feature (3440)..(3440): n is a, c, g, or t
  misc_feature (3442)..(3452): n is a, c, g, or t
  misc_feature (3454)..(3457): n is a, c, g, or t
  misc_feature (3460)..(3463): n is a, c, g, or t
  misc_feature (3465)..(3467): n is a, c, g, or t
  misc_feature (3469)..(3470): n is a, c, g, or t
  misc_feature (3473)..(3474): n is a, c, g, or t
  misc_feature (3476)..(3479): n is a, c, g, or t
  misc_feature (3481)..(3481): n is a, c, g, or t
  misc_feature (3483)..(3483): n is a, c, g, or t
  misc_feature (3488)..(3488): n is a, c, g, or t
  misc_feature (3490)..(3498): n is a, c, g, or t
  misc_feature (3500)..(3503): n is a, c, g, or t
  misc_feature (3515)..(3515): n is a, c, g, or t
  misc_feature (3538)..(3539): n is a, c, g, or t
  misc_feature (3541)..(3541): n is a, c, g, or t
  misc_feature (3544)..(3545): n is a, c, g, or t
  misc_feature (3549)..(3551): n is a, c, g, or t
  misc_feature (3553)..(3554): n is a, c, g, or t
  misc_feature (3556)..(3557): n is a, c, g, or t
  misc_feature (3559)..(3559): n is a, c, g, or t
  misc_feature (3561)..(3563): n is a, c, g, or t
  misc_feature (3565)..(3566): n is a, c, g, or t
  misc_feature (3569)..(3572): n is a, c, g, or t
  misc_feature (3576)..(3581): n is a, c, g, or t
  misc_feature (3608)..(3608): n is a, c, g, or t
  misc_feature (3613)..(3616): n is a, c, g, or t
  misc_feature (3618)..(3624): n is a, c, g, or t
  misc_feature (3626)..(3626): n is a, c, g, or t
  misc_feature (3629)..(3629): n is a, c, g, or t
  misc_feature (3633)..(3644): n is a, c, g, or t
  misc_feature (3646)..(3647): n is a, c, g, or t
  misc_feature (3649)..(3655): n is a, c, g, or t
  misc_feature (3661)..(3672): n is a, c, g, or t
  misc_feature (3674)..(3682): n is a, c, g, or t
  misc_feature (3684)..(3684): n is a, c, g, or t
  misc_feature (3686)..(3687): n is a, c, g, or t
  misc_feature (3689)..(3693): n is a, c, g, or t
  misc_feature (3698)..(3699): n is a, c, g, or t
  misc_feature (3701)..(3702): n is a, c, g, or t
  misc_feature (3704)..(3704): n is a, c, g, or t
  misc_feature (3707)..(3707): n is a, c, g, or t
  misc_feature (3709)..(3710): n is a, c, g, or t
  misc_feature (3712)..(3712): n is a, c, g, or t
  misc_feature (3714)..(3716): n is a, c, g, or t
  misc_feature (3719)..(3720): n is a, c, g, or t
  misc_feature (3724)..(3726): n is a, c, g, or t
  misc_feature (3728)..(3737): n is a, c, g, or t
  misc_feature (3739)..(3740): n is a, c, g, or t
  misc_feature (3742)..(3742): n is a, c, g, or t
  misc_feature (3746)..(3747): n is a, c, g, or t
  misc_feature (3749)..(3749): n is a, c, g, or t
  misc_feature (3751)..(3751): n is a, c, g, or t
  misc_feature (3754)..(3754): n is a, c, g, or t
  misc_feature (3757)..(3758): n is a, c, g, or t
  misc_feature (3762)..(3763): n is a, c, g, or t
  misc_feature (3769)..(3769): n is a, c, g, or t
  misc_feature (3772)..(3772): n is a, c, g, or t
  misc_feature (3775)..(3775): n is a, c, g, or t
  misc_feature (3779)..(3779): n is a, c, g, or t
  misc_feature (3781)..(3781): n is a, c, g, or t
  misc_feature (3784)..(3784): n is a, c, g, or t
  misc_feature (3787)..(3788): n is a, c, g, or t
  misc_feature (3790)..(3790): n is a, c, g, or t
  misc_feature (3792)..(3792): n is a, c, g, or t
  misc_feature (3797)..(3797): n is a, c, g, or t
  misc_feature (3799)..(3801): n is a, c, g, or t
  misc_feature (3803)..(3803): n is a, c, g, or t
  misc_feature (3807)..(3807): n is a, c, g, or t
  misc_feature (3810)..(3813): n is a, c, g, or t
  misc_feature (3815)..(3815): n is a, c, g, or t
  misc_feature (3819)..(3829): n is a, c, g, or t
  misc_feature (3831)..(3831): n is a, c, g, or t
  misc_feature (3834)..(3834): n is a, c, g, or t
  misc_feature (3837)..(3843): n is a, c, g, or t
  misc_feature (3845)..(3846): n is a, c, g, or t
  misc_feature (3849)..(3857): n is a, c, g, or t
  misc_feature (3859)..(3869): n is a, c, g, or t
  misc_feature (3871)..(3875): n is a, c, g, or t
  misc_feature (3878)..(3882): n is a, c, g, or t
  misc_feature (3884)..(3884): n is a, c, g, or t
  misc_feature (3887)..(3889): n is a, c, g, or t
  misc_feature (3891)..(3891): n is a, c, g, or t
  misc_feature (3893)..(3894): n is a, c, g, or t
  misc_feature (3896)..(3900): n is a, c, g, or t
  misc_feature (3902)..(3903): n is a, c, g, or t
  misc_feature (3905)..(3906): n is a, c, g, or t
  misc_feature (3909)..(3916): n is a, c, g, or t
  misc_feature (3918)..(3923): n is a, c, g, or t
  misc_feature (3925)..(3927): n is a, c, g, or t
  misc_feature (3929)..(3931): n is a, c, g, or t
  misc_feature (3935)..(3939): n is a, c, g, or t
  misc_feature (3941)..(3942): n is a, c, g, or t
  misc_feature (3945)..(3947): n is a, c, g, or t
  misc_feature (3949)..(3951): n is a, c, g, or t
  misc_feature (3953)..(3964): n is a, c, g, or t
  misc_feature (3966)..(3972): n is a, c, g, or t
  misc_feature (3975)..(3976): n is a, c, g, or t
  misc_feature (3978)..(3979): n is a, c, g, or t
  misc_feature (3981)..(3990): n is a, c, g, or t
  misc_feature (3992)..(3994): n is a, c, g, or t
  misc_feature (3996)..(4000): n is a, c, g, or t
gntntngnnanaanannngcagnagcagcngtnnccancaacnncannancntcgntctcgntnnccaagnnnntgnannngnnnnnggtntnnnnnnngctntcgnncncgnncgngnaggacaagnatnnncnngnnagcnannncnnngnncnnncangnnncnagnncnnnntnnnnagaangannnnttnanaannaccnncngcnngnnntttntnnatntgcannnnancgcgntngaancaanacgtcttcnnnnggnnnntgtnnangnnngaaanangantncnantannganngnganaangntaaaaangtanaantnnnnatntatatatannannnnnanannngnncgngntcannccnnncnntcgcnntngnnnaagnnnttgntntnnncnnctcccgntcnntanncnnnnaccnctnnntcttcttnttnnncgaagnngaagnnttntnntnanaatnnaattnaantntntnntnaaaaaanaanancncnnncnccnncncanatacananacncanacanatannnnnnnacacacacacacacgtaaacgtancgcgcncnngannaggagnnggannancntnnacntnnatannnanaaganntnnnnntnnnnntgnnnaagaagaaganaantncannnncaanancnnnnncnncnncngcancnncancngnaacggnaaagangaagangannnnnncgacgacgacgacgacgacggnggatgatcatnnngnncancnnnntcaagaacaacagcagnagnagcagnagcagcagcaacanccncnacaacaacaacaacaacaacaaagagtctctcgtttaggcaaagcggttcaagatgcggcgacgataaaaaagaagcccaagaacaaggggcaanaccaacaccaagctaaaaaaaaatcgactgtaattccgatgatgaatcgaatggattctcgagtggacccgtctcgcatgggaaagaatcggagccgagaagggacgtcggaacggttgacgcctcgaacgcaaagtcagagtcagcagagaatgccggcgccgagaagaccgggggggatcgacgcgtcgatgttgtcttcgccgcaccgggtgacgagtccggaacgcgcggcggcggggagaatgcagtcgccggcggtggccgcgcagagagagaaggagttgcgagcgcagatgcagcagaagcgcgagagagaggagcgggagaaacgggcgatgcagcagcagcaacagcagagggagaaagcagagcaagagaagcaaaagaagttgcaaagagagagagaggcgcagatgcaaaggcaacgcgaacagcaacaacaacgcgaacagcaacagcgacaacaacgcgaacagcaacagcgacaacaacagttgttgttacagcagcagcagcagcaacaacaacaacaacancaacaacaacagcaacagcccgcacagcaacaggaaagacgcgtgccgcgacaaccgctcccncgaacgagagcgccgccggctcctgtacccagcaaagcggtgccacgacaaccagtggggagagttggtgtctcggtaccgccgcccgaacctccgcaacaagcggcacagccgagattggtagataacgtagtttttagcgaacctcaaccgacttcgatacgagatataatggtgaggaaagcgagagatgaacgaaaagcagaaatgcacgcgaggaaagagaaacgaagacgtgatcagttgttgacgctcccgtcgggtttgatgttcggcgacggcgttggatcgttggaggatggtgaaaaccagccccaggcgactggcgggacaccaaccttagtgcactttgcagaagatgcaaacaaagatcaaaacggaaccaaagaaacgccagctgcggagaacggacgaagaacgcgtctgagatcttcttcgctcggagcggcggctggtgagaaaccgagtgcgactgtcgcaccgtcggcaaaagctccgaacgtgaaaacgactggcgccgcggggcttttaaaatccgcgctaaaaaaggtctcccaagttgcaaacgccttagccttggcgaacgcgcccaccgccgccgcgcagcaacaacaagcacaaaatgtgcacacgccgagagtaaagcttgggccaaatggtcaaatcgtagccgaccaagcgacgctcacagtgcaagcctcgcacgaaaatcgaataagtgagagcgagtttacgcgaaaaacaggagacaaaatgatgattaattcgcagacgtatgggaatcggtcaaaaccgacaaagtggacgaggcaagagacggagttgttttacaaagccatggagcaattcggtactgatttcactctcattcaaagattgtttccttctcgaacgagaaggcaagtaaaggcgaaatatttgaaggagcaaaacaacaacgacgatcgcatagagtcttgcatgaacaacatggccagaaataacgagacgtatcaaaacttgatcgacgtgttacaatcggatacgaataatcgagttgaggttgctgcggggaaaggcgtcgataggatcattcctggggcgaacaacgtcgccgctcaagtgttgcacggcgacgcgcccatgcaagagaacgtgcagaatactgttcctcaagcctccatctccgccgctactcctgctgcgcattgattttgagaagcgcaaataaaaaagatttagtgcaaactaaaagtagaaagcaaaatcaaatgtgtatatgaaacaatacacctaggtattttcattactatgataacatcaagtctctctctctctctatcgctttcgcgttcctttcactactattcctcgctgccgctgcgttgccttgttctgatggtttctaacttttttgcgatcgtatttacttattttgcgctcgaatctctgctcgaatttccttcatggaagactcgatttcgagctcaaccgatatcgtctctgccatcgccaacgaaagaggagcgttcttaatcttagcaacctgacctttaatcttctccaaaatggcttcaaatccttccaagtaatttaaaacttgttcttgataagcagccgcgcgcacttcctccatcgtcgtcgtatcttcacttagtccttcttcttgatcttctttttctccatagcgttgcccttctacgctaaacttttgtaacttttctgacgctaaccgcttcagtctttcggcgctctcgtaaacctgcttcggcgtcatcgcgacggattctctatgtggcttcatcaccgtgactgcctctaacggcggcggcatcgaaccgtctcttctctgccttggcgccgccggcgtttccattaaaatatcttcttcttcttcttcttcttcttcttcttcttcttcttcttcnnccncttcttcnnctncnnnnnnnnnnncnnnngannnngnnnannaanngnnnngngngtggngnnnnnnnnntnnnngttgttgttgtngttgttgttgttgttgttgttgnngntgnngggnnntnntnntnannntnncannnncttnnnnnncttcttcttcttcttcttcttcttctncttcnnnntnnnnnnnancancaannnnnnnnnnnntnntnnnnnnntttttnnnnnnnnnnnncnnnnnnnnngncnncnnnnncgccnncnncnccncnncncnnntcnncttnnncnnnnnnnnnncnncnccannancntcntcnncatnntcatcnttnttntcancnccnccnntncncctcncnnncnccancannnncnccannnnnnnnnnnangangannnnnnngnngannnnnnnnntnnnnnnnnnnntnnnnntcnnnnntnttnnntncnncnnnnncnncnnccnnnnnnnnannnnnncnnntnnntttnnnnntnnttnnnannntnnnnnnnnnnnntnnnnnnngtnntnntnnnnnnnnnntnnnannnnn

SEQ ID NO: 1383 - DNA, 4000 bp, Escherichia coli
ttttttagccatttcccgataatattcctcacgtacgggatggtgggggctcactaaattaaagattccttccatttgaggatattttagaaattcttcaattccatttaccacatcaacttgtgagacaaaattgattcgtcctcttgggtttgggattgtttttttttgaagtgagaaaatggggttcctgtcttcacctacaagtcccccaagacgaattattagggatctttggggagcgttcaatatcattttttcacacagaaccaatgcttttgaagcttcagtttctgccgaaataggactattttctttaaagattcctgcttgttttccataaacggaagtactacttaaaaaaatgagtttacacccagggtgtaatttcatgtgttctaatagtgtagcgatcatgtcttcaaattgagatggagcatctctttttgggggtacagaaattaaaagcgtgtccaagttttcaaaaaaattaagatcaccttctatactcaaactgtttagcttaatgcggtatgaatcccatcctttagctttaagctcgcctttacctttggctgacgtccgagacaccttcacgctccatttttctgaatagagtctatttgctagatactcaccaagccatccacatcccaaaatacccaaatgatccatacacttaattttagcaatattacagctatattttaattgaccctacccttttcaatgagtgtaaaaattaaattcaattaaaaacactatatttaaaagacctaaaagctaaagatatgcctataaaaagttttcagggagaaagagccaaaaagaagagggtcactcccagcaaattaactgtatcagatatcatgacacgccaattggttatttttcttccagatcaatctatacatgatgtgatgaaagcgtttattaagaatagaatatccggaggtccagtagttgacaaagatggccgtttggttggagtaatatcagaggcagattgtatgaaagaaatatcggacagtcgttattttaaccttccaatcttggataaatccgtagctcattttatgacaaaaaaagtagatactatcgaagcaaacacaagtgtttttgatgctgcagcactcttttcaaaaagtagtagaagaagatatcctgttatagaaaataatcaacttgtaggacaggttagtagaaaagatattgtcatcgctgctctggaaatgaaaagccaaacttggcaacattaagtgtataatttaacagcttctctgtaggtatttgcgtgggcttcaactataacgttgatgtctttggagtatccccctcccatactgcattgaattggaattccatttttattgcaaaattctaaaaccatttgatcacggagtttacatccttcgatgctcagatccaatcgacccaatttatcagactctaagacgtcaacaccacatagataaaaaataaaacttgggattatttgatccagtaattttggtaggagcgttttgatctgatccaaatagtacgaatccccggtatgatcttcaaaagcaagatctaaatcgctttgctcctttttgaaagggtagtttttagcaccatgtactgagcatgtaaatacggcatcattggttttaaagatttcagctgtaccatttccttgatgtacatctaaatccagaatcaaaacctttttaaccttcgtgtgatctaataaatattgagttgcgatagcttggtcgtttaaaagacaaaacgcctcgccatgggagctgaaagcatggtgtgtgcctcctgctatattcattgctatccctgtgtttaaagcttttttggcacctgcgactgttcctcctgctatggtaaattctctttttaccaaagcttgacttaatgggaatccgatctttcgaacttcgcttttgtcgagttctaaattgcataaacggtttacatagtttgaatcgtggacacgttctactatttctctgtttagaggctgtggctcaaaaaaatcttcttttatacaggtaccttccaacagtaattgctgtgggagcaactcgtatttttccattggaaaacgatggttttctggaaggggaagtttataagtggggtgataagcaataggtatagatgaattaatactcactatctaataggggttgcggattgaacttctgaatcttctggtgaaataaaaacttgctttccattttcatcttcgcccaaaagaatcattccttggctttcaatgccttttagggttctgggtttaagattgactaataaagtcacctttttgccaatcaattcattctcactatagtcttgggctatccccgaaacaacagttcttttctcatcacccaactgaacggtaagttccattaacttctttgttttcttaatttttttagccgcaatgatttcagcaacctttagttcaagagattcaaactgatttgaagcaatttctggttttatgggagatatctttttttgcagttctttattattttcagcagcattttgaagtttagctctttgtgcgtccatttgggcatcttcaattttttgaaataaaagctccgctttgctcaaaaggtgttttgactttagaaggacatcacttttacctactttttcccaaattagtggctctaattcaagattcagcatttgcgctagtttagaggcggtaaaaggcaacaagggttcagaaagtatgctcagaccagcagaaacctgtaatgcagtgaacatgatggttttcactcgttgaggatctgtttttactattttccaaggctctgcatcagcgaggtatttattcccgagacgggctaaactcatgagcatctgacttgcttctctgaatcggtaattttcaatggaatccccaattttttttgggagttcggtcatacttgccaataccttcagatcttcatcatgaagtgttcctggttcaggcacaaaaccttcatagtatttatgggtcaaaaccatgaccctatttataaaattaccgaaaattgcaaccaattcattattgtttcttgcttgaaattcttcccaagtaaaatcgttgtcttttgtctcaggcgcattggcagttagaacatatcggagtacgtcttgttgttcagggaattgttctaaatattcgtgaagccatacggcccaattttttgaggtagaaattttttgcccttcgaggtttaaaaattcgtttgcggggacattttctggtaagataaaacgttctgaagccttgagcattacaggaaaaataatacaatgaaatacgatattgtcttttccgatgaaatgaactagctgtgtttctggatcacaccaatacggttcccaatccttccctttttcttttgcccattctttcgttgaagatatatacccgataggagcatcaaaccaaacatagagaacttttccttctgcattcgggacaggtactgaaattccccaatctaaatctcgggttacggctcttggctgaagaccattgctcacccatgattttacctgaccataaacattaggcttccagtcttctttatgtccttcaagaatccatttcgttataaaatcttcaaattgatttaaggggagataccaatgtttcgtttttttaagttctggtttagcaccgctcaaggtagattggggattaatgagttcggttgcacttaaactacttccacagctttcgcattggtcaccataagcctctggattttgacagataggacaggtacccgttacaaaacgatctgcgagaaactgatttgcttcagcatcatacaattgttctgaatctttctcttcaaaaacacctttttcatcaagaattttaaaaaactcttgagctgtttcgtgatgaattttacgtgaagttctagaataatgatcaaaagcaattccaaaggtctcaaaagattctcgaatcacctga

SEQ ID NO: 1384 - DNA, 4000 bp, Escherichia coli
  misc_feature (1208)..(1208): n is a, c, g, or t
  misc_feature (1311)..(1312): n is a, c, g, or t
  misc_feature (1409)..(1409): n is a, c, g, or t
  misc_feature (1989)..(1989): n is a, c, g, or t
  misc_feature (3850)..(3850): n is a, c, g, or t
  misc_feature (3853)..(3853): n is a, c, g, or t
  misc_feature (3862)..(3862): n is a, c, g, or t
  misc_feature (3916)..(3916): n is a, c, g, or t
cggtgccaccacacccgcggcgtcacccgccagcaccacatcgcggccgttgtcccagcgcggcaagggcttcatgggcaagggcgcgccttcgcgacgcaagacggtagcgttttgcaaaccagcagcgtcacgcaaacgaccgaccgcaccgcgcaatgaaaaacctttgtcggcgctgcccgtgcccacgctcatggtgtcgccatgggggaacacccagccgtaaaagtcgggcgacaaactgcctcggtagtacacatcgcaacgcgaggggtctgcatcggtttgcagcatgttttccggtgttttaacgatctcgtggtaggcgaaaacatacttggttttttcagcgcctggtacggcttgcttggccacctgggaacgtgcgccatcggcaccgatgatgcatttaccgcgcacactggcgggcatgtccaaaccgtcgtcggtacggatggtgaagtgcacccggctgatgccatcgtcgtcgcggctgagtttgtcaaaaatgccgcgctggcgcaccgcgccatggttttcggcgcgcacccgcagccattcgtcaaactcgtcgcggttgaccatgccgacaaaaccgccctcgataggaatgtcgaccttgttgtctttgggcgaaaccatgcgcgcagcacgcgccttggcgaccaacaactcatcgggtatatcgaagtctttgatcaggcgtggcgggatggccccaccacagggcttgatacgcccttgtctgtcgagcagcaaaacatgccgccccagtttggctaaatcatcggctgcggttgcaccggacggcccgccgccgaccactaccacgtcataggttaggttatgcatgaaataactcctgaggggattggataaaagaaacagaaacagaaaaagtggctgcatcagcagcctgtgaatgaacaagatgttggggggcattgcgccaagcaaaagcgctgaccatcatgccggcgaccaacaaaggcacgcccaaggcgctgaggcttaaggcgcggccgaccgggtcgcgcataaagcgcatcattaaaggaatttgtgcataaatcagcagcaacaccgccaccgcgtaaggcaacaaaccccagaccagcaacaaagccaccaccacaaactgcggcagcagcatgacccaacaggccgtgcctgcagcgcctttgatgcccagttgaaccggcaangaaaaaatacccatttgtcggtcaccctctatggctttgaagtcattcaaggtcatgatgccgtgagccgccaagctgtagagcagcgccaaagtgatgatgnnggcgtcgggcatggcgccgcccaacatgacggccgcgccggtgacccaagccaagccttcatagctgagggcgcaagcggcgttgcctatccagccntctttttttaatcgaaaaggcggggcgctgtaggcccaagccagcgccagcgccagtaaggtggcaccaaaagcccaggtgcccaattgccacgcccaccacatggacaacaaggtccaaacaatggcaatgacaatgccccaagccccgggcatgcgccccgagggaatgggccgctggggctcgttgatggcgtcaacatgccggtcaaaccaatcgttcacggcttggctgcaggcgcacaccatggggcctgtcaacacgatgccgctgatgagtaaaccgaccttgtctgacagaggctgccccgaagacaccgcgccgcaggcaaaggcccacatgggaggaaaccaagtcaccggtttgagaagctctaagacagctgagggttggggaagcgccatacccccattttcatttgacaaaataaaatgtcaatctaagttgacgcttttttgtgagaactagggtttactcgggttcgccttcggcaaccatgccatagcggtgcaatttcacatacaggctttggcgcgacaagcccaacatctcggcggccgaggcacggttgttttgggtnagttctatagctgcctgaatgcacatgcgctcgatcatggtgctggtctcgccgacgatttctttcatcggcatgcgccccaccaactgcgacaactgtgccaccgaatcggccataccacccgaggtggctggcatggtgtcgcgactgcgtgcgcccgaaacttcatggaagaagaagccataggtgggatccacgccattcaaagtcacggcggtgatgtctacgggtatcagcacacccactatgctgcgcaaatcggtggcgaaactgcgcagggtgcgcgactggcgcaaattggtcagcaacacgcccaaatcgacaccgccacgggccagccattcttcaaggcttttattcgccagcatggtgtgagacgccacgcccaccatgctgcaaaactcggggttgctggccagcaccgtgcccaagcggtcagccaccacaaaacccaccggcgcttgatctaaagcgtggtggaaccaatcaatcactgacgcattggataggctggtttgctgagagcttaaagcctgcaaacgcaataaaaattgaggcccaccttcttgcacgaacaccgatgcatgcaaattgcaatcgtgatccgatttgagtaagcgcatccgccccgtctccatgcgacccgagttttgcgcttcgcgcagcaagttgtccagcgcctctcttttgctggggtcgaacaactgaagcacatcggttccgggcaatttgcggttgacatctttgaacaagagctgggccgcactgttggcctccatcacgcggcgttgggccacatcggccaccaacatcgggtcggcgacagactcgaacagcaagcggtaacgcgcctccatgtggcgcagtcgcaaaaagtcacgctccatggattgatgggcttcaaccaagcggtgctgcatttgcgacaagctgcttaaatcgcggccaaagagccacacggtttggtctttttcctgagacaccaagctgacttgcaaaggcaagtcttggccggctgagggtgagaaattgacatgtcgccaggttggggcttgggctttgaccaccgagtcccacatgctggaaaatttttgttggctatcaaaactgagaaagtctttgacagagcgccccttgaaaacagagctgtccaaaccttgtaaatctttgccaaaaacagccacttccagcactgtcgactgtttgtccaacaccatcatgatgtcaaccaagcctggcagcaactgctgtaaatgagtagagtttaggtctggagtgatcaagatattaaaaagcttaagttggttaaatcaacaatcatttccttggccaagacttctggcaaaccctaggaaaatagcaccttgggttttcccctattctaagctcagtttgtctaagctgtttgacactttaaaacaactcaaccgaagattttccacgctgcttacgcacctgctcaacactttgtatcgccatcaactgcgcttgatcagcctgcaaacacgaaaaatcagcgcccaaccatgcggctaaatggtcatgtgtggccagcaaggggccgcccaccatcaccaacagaccggggttgagcgatttctttcgcaaagtggcaatgagttttttcaaatagcccaattgcctttcatcactgaccgacagacccaataaatcgatagaaccagactgcactgcaatcaccatatccggctcgcgccaagtggtgtctcccacgacctgccagccatagcgtttgaaatattgggacaggatgagcagacccaaggaatgctgtgattggggcgtattgaccagcaatgctgcatagttggacaagccgccgcattggggcccgctcaanacnaattcagcnctgagtttgtagaccaattcttgcaagcggtaactggcttgggtgaccgccacnaagtcaatttcatcttgcgcccaccactggtgaaagagtctggcggcgctgggaatggtttgcaaaaacacggtttccagcccc

SEQ ID NO: 1385 - DNA, 4000 bp, Escherichia coli
  misc_feature (871)..(871): n is a, c, g, or t
  misc_feature (1626)..(1626): n is a, c, g, or t
  misc_feature (1988)..(1988): n is a, c, g, or t
tggcgtcacccaatcgactgcttaggagcagtaatcgaagttcggcttcaaatacggcttcattgtttgggtattgatccttgatgctggctagtatctcaagtgcttctcgataactgccagtttgctccagcgccacaacctctgagagcagcccgtcatcttttgcccatgaggcaggtatcgcaacaaggcttaatagcgtcacaagcaaaaataggggcgggtagcgaaacatgcgatcgctagatacaaaaatattggttgccaccatttagcaaggtcctccctgagttgctgaaatcatcgtcagtaaaaattaaatgacccagtaccaccattgttgccattttatggtggatcagcaagctgggcttaatcaacttgagggtcaaaaatctgaacctacaggcggcacgtgcctgatctaaagcgcatgcctatggtcttagggacagtgcttaaattctaagaaaacgaacattcccgtcgcgtctcgttatacctttgccatcgaaatactcgagtaactcaatacataaatttcgcccaatgcctgcggcatctctaaattgctgtacgctaaacccattgtcaccagccagttctgtaatcaaactggtaaaggtttgaatcgattccggtaaaaacagtcggtttttaactggttgaacaagcaggccggccttaacagcaggctgtaactgctgcagaagcgattttggtggaacgcccaagcgttctgaaaggtcgtgtatcactgggggttgtaagggggtttctgccagcaaagggcgcaagcggtccaaaagtcgctgagtcgcttcaggtaacttaactatcgcccccggcaatctcgcaattgtaccgncgacaacaatggtgccggtttttttcagctggtcaatgatggcagtcttaaacaagtaatttcttggcagaacacccgataacgcgctgacattcatcccctcagcggccggattgtccttgtgaaatcggcttaggccttggataagcgccgtctgggcctggtcaaacgcctttttggtgaccaaacactgatccagcagaagcgtctgcttattgttttttagccaagcctgaattgtggctggaagccagttcaagttgcgcgcgaaatcggaaacaggaacgcccccaggcatggtatctaaacaaacttgagcgtagtcatcgaagtgggccgcattggcaagcgcattcaacaatttaagtctgcttggcttggctcgcccgcgtccctttgcaatggggtctacgacgataccgctggcaattgttcgggttgcgccttgatcccggaaaataattttgtcgccaacacaggcgcttaagggtgctttgcagactacttgcacaagacctgtttcattaggcaacattttgggggcctctaacgtggcgaggtgacccaaggtgtgttgtgcggagtggtagacatgggcgggcgtccaatgcctcaaaggttttacttcagttgattgcacgtgaagcaaaacatcgatgtgatgatggggtcgaagcgttgggttcgctgtgagccaggcgcctctgacgagttgctttaatcctgcttgagggccagttaaattcagtgcgacnctatcgccagccatagcaatgtcgctggcgctgccatgacgctggatgctacgaaccttgaaaggctgctgagccgagacttcatggatggtgtcagcgatggcgatgctgccgtcgataattgccccagttacaatggttcctgcacccttggccgtaaacacacgatctaccgccatgcgaaaataaccaacgtcggaacgcaatcgggcttcagctgaagcctcgattaaggctttttcaaggtcttgccgaccaatcccagtaacgccagaacaggctacaatctttgcgccggcataagttgtcggtgccaacaggtcttttatggattccgttactgtttggcattgctcggctgngacccgatcgctcttagtcaaaacaactataagctgcggtactgctagcgcgtgcaggatcgcgagatgctcgcgggtttggggcatgatgccatcatcggctgcgaccactagcagtgcaaggtcgacagcacttaccccggccagcatgttattaatgaagcgaatatggccgggaacgtcgacaaacccaaaagaggcgccctgaatggtggtgtgagcaaaacccagatcaatcgtcaggcctcgtgctcgctcttcttcgagctggtcagtctgaaccccggtcagcaagccgacaagagaagttttcccatgatcaacatggccagctgtcgcaatgatcatgaggccagagtatggcgaaggccagcaatgagcggatcggggttgtataaggtcctaaggtccaacaacaactggtcatcatgaatacgtccaacgattgcattggagcaagccctcagttgttctgagagattcataagcgttcgatttggtgatgtcgatcgcgcggcagtaatggcgatggcccagctcggaatgcgctcgattggcaatgcaccgctcccaatttggctctttacagggaccaaagttagatcaaactcgccggtttccgcggtagacaacgcgtgtaacaccgtctcacctaactttttgatctcattctctggcctagccaagtctcggatcgtgggaagggtttggacgagtgtttctggcgtttgatagaggcgaaggacttcgacgagtccagccacggtcatcttatctacccggagcgctcgcttcatcgggttttgtttaatcgccttaataaattgacgactaccgacaatgatgccagcctggggaccgcccagtaatttatcgccgctaaaagttacaatcgtagccccttgggcgagggcctcttggacagtaggttctctgggtaagccatactgggtgaggttaacgagcgtgccacttccaagatcaatcatgaaaggtaaattatgctggttagcaagatctgcaagcgccgattcgctggtggactctgtgaagccttgcacttcatagttactggtgtgaaccttcatcagcatcgcggtagtttcatcaatagcgttttcgaagtctgagattcgggtgcggttagtagcaccaacctctaccagctgacaacctgaacgcatcatgatttcagggattcgaaaggaaccgcctatctcaactaattcacctcgggagacgggtactgatttgccgagcgcgaaggtgtttaacacgagcatcaccgctgcggcattgttgtttacgaccgttgctgcctctgcaccggtaagcgcttttaataaagattctagttgcgcatcacgatctccccgggacccagttgcaagatcaaattctaaattcgaaggctcagatgcgacttgtgcaatcgcttggatagcggtgtctggtaaccgcgctctacccaaattggtgtgtaacactgtgccagtgagattgagtatagttttgagggcaaccgatgactgttttagctcgttttcggacgctgcaagcagatgctgttctgagaccgctggtttgccagacgcaaggatttctttgcgcgcaaggctgatttgtttagctagcacgctcgccacgggcgcccggccgaacgcggctaccaaggtttggccagcgtttgagcgcagcaggcgatcaacgctgggcaattgtccagctggatgagacaaccgttttaatccattggcccgagtggttgtaaggtcttctgaatggatcccacggttctgatccacggttcgataccgttatcgtattccgccatccaggttctttttgcgtcacttgcaacttggatatcgttgaaagtatccaagatcaagatataaagtggtcgtcgcagaggctgcgttttgagtactaaaggatcagtgagcttaatttctgtggcaaaagctcgtattcctgatagcgttttgtctgctttcaactggatagcaaaa

SEQ ID NO: 1386 - DNA, 4000 bp, Escherichia coli
  misc_feature (1)..(2): n is a, c, g, or t
  misc_feature (4)..(9): n is a, c, g, or t
  misc_feature (11)..(13): n is a, c, g, or t
  misc_feature (15)..(19): n is a, c, g, or t
  misc_feature (22)..(25): n is a, c, g, or t
  misc_feature (28)..(30): n is a, c, g, or t
  misc_feature (32)..(34): n is a, c, g, or t
  misc_feature (36)..(36): n is a, c, g, or t
  misc_feature (38)..(38): n is a, c, g, or t
  misc_feature (41)..(41): n is a, c, g, or t
  misc_feature (43)..(44): n is a, c, g, or t
  misc_feature (47)..(47): n is a, c, g, or t
  misc_feature (49)..(54): n is a, c, g, or t
  misc_feature (56)..(56): n is a, c, g, or t
  misc_feature (59)..(61): n is a, c, g, or t
  misc_feature (63)..(65): n is a, c, g, or t
  misc_feature (68)..(71): n is a, c, g, or t
  misc_feature (73)..(76): n is a, c, g, or t
  misc_feature (78)..(81): n is a, c, g, or t
  misc_feature (83)..(83): n is a, c, g, or t
  misc_feature (86)..(89): n is a, c, g, or t
  misc_feature (91)..(95): n is a, c, g, or t
  misc_feature (98)..(101): n is a, c, g, or t
  misc_feature (103)..(111): n is a, c, g, or t
  misc_feature (113)..(120): n is a, c, g, or t
  misc_feature (122)..(122): n is a, c, g, or t
  misc_feature (125)..(129): n is a, c, g, or t
  misc_feature (131)..(131): n is a, c, g, or t
  misc_feature (133)..(137): n is a, c, g, or t
  misc_feature (139)..(140): n is a, c, g, or t
  misc_feature (142)..(147): n is a, c, g, or t
  misc_feature (150)..(155): n is a, c, g, or t
  misc_feature (157)..(158): n is a, c, g, or t
  misc_feature (160)..(164): n is a, c, g, or t
  misc_feature (166)..(166): n is a, c, g, or t
  misc_feature (168)..(169): n is a, c, g, or t
  misc_feature (172)..(173): n is a, c, g, or t
  misc_feature (175)..(175): n is a, c, g, or t
  misc_feature (177)..(178): n is a, c, g, or t
  misc_feature (181)..(183): n is a, c, g, or t
  misc_feature (186)..(189): n is a, c, g, or t
  misc_feature (191)..(195): n is a, c, g, or t
  misc_feature (198)..(203): n is a, c, g, or t
  misc_feature (207)..(216): n is a, c, g, or t
  misc_feature (218)..(220): n is a, c, g, or t
  misc_feature (222)..(222): n is a, c, g, or t
  misc_feature (224)..(226): n is a, c, g, or t
  misc_feature (228)..(231): n is a, c, g, or t
  misc_feature (234)..(236): n is a, c, g, or t
  misc_feature (238)..(247): n is a, c, g, or t
  misc_feature (249)..(259): n is a, c, g, or t
  misc_feature (261)..(263): n is a, c, g, or t
  misc_feature (265)..(267): n is a, c, g, or t
  misc_feature (270)..(277): n is a, c, g, or t
  misc_feature (279)..(284): n is a, c, g, or t
  misc_feature (286)..(292): n is a, c, g, or t
  misc_feature (294)..(294): n is a, c, g, or t
  misc_feature (296)..(297): n is a, c, g, or t
  misc_feature (300)..(301): n is a, c, g, or t
  misc_feature (303)..(305): n is a, c, g, or t
  misc_feature (307)..(316): n is a, c, g, or t
  misc_feature (319)..(320): n is a, c, g, or t
  misc_feature (323)..(325): n is a, c, g, or t
  misc_feature (327)..(335): n is a, c, g, or t
  misc_feature (337)..(337): n is a, c, g, or t
  misc_feature (339)..(350): n is a, c, g, or t
  misc_feature (352)..(354): n is a, c, g, or t
  misc_feature (356)..(382): n is a, c, g, or t
  misc_feature (384)..(387): n is a, c, g, or t
  misc_feature (389)..(389): n is a, c, g, or t
  misc_feature (391)..(393): n is a, c, g, or t
  misc_feature (395)..(397): n is a, c, g, or t
  misc_feature (399)..(400): n is a, c, g, or t
  misc_feature (402)..(404): n is a, c, g, or t
  misc_feature (407)..(413): n is a, c, g, or t
  misc_feature (415)..(417): n is a, c, g, or t
  misc_feature (421)..(421): n is a, c, g, or t
  misc_feature (423)..(424): n is a, c, g, or t
  misc_feature (426)..(426): n is a, c, g, or t
  misc_feature (428)..(428): n is a, c, g, or t
  misc_feature (430)..(431): n is a, c, g, or t
  misc_feature (433)..(433): n is a, c, g, or t
  misc_feature (436)..(454): n is a, c, g, or t
  misc_feature (456)..(456): n is a, c, g, or t
  misc_feature (459)..(460): n is a, c, g, or t
  misc_feature (462)..(464): n is a, c, g, or t
  misc_feature (467)..(477): n is a, c, g, or t
  misc_feature (479)..(479): n is a, c, g, or t
  misc_feature (481)..(482): n is a, c, g, or t
  misc_feature (484)..(485): n is a, c, g, or t
  misc_feature (488)..(490): n is a, c, g, or t
  misc_feature (492)..(495): n is a, c, g, or t
  misc_feature (498)..(499): n is a, c, g, or t
  misc_feature (501)..(504): n is a, c, g, or t
  misc_feature (506)..(509): n is a, c, g, or t
  misc_feature (512)..(515): n is a, c, g, or t
  misc_feature (519)..(520): n is a, c, g, or t
  misc_feature (523)..(526): n is a, c, g, or t
  misc_feature (528)..(529): n is a, c, g, or t
  misc_feature (531)..(531): n is a, c, g, or t
  misc_feature (536)..(537): n is a, c, g, or t
  misc_feature (539)..(541): n is a, c, g, or t
  misc_feature (543)..(543): n is a, c, g, or t
  misc_feature (545)..(546): n is a, c, g, or t
  misc_feature (548)..(554): n is a, c, g, or t
  misc_feature (556)..(557): n is a, c, g, or t
  misc_feature (559)..(564): n is a, c, g, or t
  misc_feature (568)..(569): n is a, c, g, or t
  misc_feature (571)..(584): n is a, c, g, or t
  misc_feature (586)..(586): n is a, c, g, or t
  misc_feature (588)..(590): n is a, c, g, or t
  misc_feature (592)..(592): n is a, c, g, or t
  misc_feature (594)..(601): n is a, c, g, or t
  misc_feature (604)..(605): n is a, c, g, or t
  misc_feature (607)..(608): n is a, c, g, or t
  misc_feature (610)..(610): n is a, c, g, or t
  misc_feature (613)..(615): n is a, c, g, or t
  misc_feature (617)..(617): n is a, c, g, or t
  misc_feature (619)..(620): n is a, c, g, or t
  misc_feature (622)..(622): n is a, c, g, or t
  misc_feature (624)..(625): n is a, c, g, or t
  misc_feature (627)..(629): n is a, c, g, or t
  misc_feature (632)..(636): n is a, c, g, or t
  misc_feature (638)..(639): n is a, c, g, or t
  misc_feature (641)..(653): n is a, c, g, or t
  misc_feature (655)..(669): n is a, c, g, or t
  misc_feature (671)..(673): n is a, c, g, or t
  misc_feature (675)..(676): n is a, c, g, or t
  misc_feature (678)..(679): n is a, c, g, or t
  misc_feature (681)..(682): n is a, c, g, or t
  misc_feature (684)..(686): n is a, c, g, or t
  misc_feature (688)..(688): n is a, c, g, or t
  misc_feature (691)..(694): n is a, c, g, or t
  misc_feature (696)..(696): n is a, c, g, or t
  misc_feature (699)..(699): n is a, c, g, or t
  misc_feature (702)..(706): n is a, c, g, or t
  misc_feature (708)..(713): n is a, c, g, or t
  misc_feature (715)..(721): n is a, c, g, or t
  misc_feature (723)..(726): n is a, c, g, or t
  misc_feature (730)..(736): n is a, c, g, or t
  misc_feature (738)..(744): n is a, c, g, or t
  misc_feature (746)..(748): n is a, c, g, or t
  misc_feature (751)..(751): n is a, c, g, or t
  misc_feature (753)..(759): n is a, c, g, or t
  misc_feature (761)..(762): n is a, c, g, or t
  misc_feature (764)..(770): n is a, c, g, or t
  misc_feature (772)..(772): n is a, c, g, or t
  misc_feature (774)..(777): n is a, c, g, or t
  misc_feature (779)..(779): n is a, c, g, or t
  misc_feature (781)..(785): n is a, c, g, or t
  misc_feature (788)..(789): n is a, c, g, or t
  misc_feature (791)..(794): n is a, c, g, or t
  misc_feature (796)..(798): n is a, c, g, or t
  misc_feature (800)..(803): n is a, c, g, or t
  misc_feature (806)..(809): n is a, c, g, or t
  misc_feature (813)..(814): n is a, c, g, or t
  misc_feature (816)..(816): n is a, c, g, or t
  misc_feature (818)..(820): n is a, c, g, or t
  misc_feature (822)..(822): n is a, c, g, or t
  misc_feature (824)..(827): n is a, c, g, or t
  misc_feature (829)..(833): n is a, c, g, or t
  misc_feature (835)..(836): n is a, c, g, or t
  misc_feature (838)..(842): n is a, c, g, or t
  misc_feature (844)..(853): n is a, c, g, or t
  misc_feature (855)..(858): n is a, c, g, or t
  misc_feature (860)..(868): n is a, c, g, or t
  misc_feature (870)..(870): n is a, c, g, or t
  misc_feature (872)..(873): n is a, c, g, or t
  misc_feature (875)..(875): n is a, c, g, or t
  misc_feature (877)..(891): n is a, c, g, or t
  misc_feature (893)..(894): n is a, c, g, or t
  misc_feature (896)..(896): n is a, c, g, or t
  misc_feature (898)..(905): n is a, c, g, or t
  misc_feature (907)..(908): n is a, c, g, or t
  misc_feature (910)..(911): n is a, c, g, or t
  misc_feature (913)..(913): n is a, c, g, or t
  misc_feature (915)..(919): n is a, c, g, or t
  misc_feature (921)..(926): n is a, c, g, or t
  misc_feature (928)..(929): n is a, c, g, or t
  misc_feature (931)..(938): n is a, c, g, or t
  misc_feature (941)..(942): n is a, c, g, or t
  misc_feature (944)..(944): n is a, c, g, or t
  misc_feature (947)..(947): n is a, c, g, or t
  misc_feature (988)..(988): n is a, c, g, or t
  misc_feature (1128)..(1129): n is a, c, g, or t
  misc_feature (1133)..(1133): n is a, c, g, or t
  misc_feature (1139)..(1140): n is a, c, g, or t
  misc_feature (1142)..(1142): n is a, c, g, or t
  misc_feature (1185)..(1185): n is a, c, g, or t
  misc_feature (1246)..(1246): n is a, c, g, or t
  misc_feature (1250)..(1250): n is a, c, g, or t
  misc_feature (1280)..(1280): n is a, c, g, or t
  misc_feature (1282)..(1282): n is a, c, g, or t
  misc_feature (1290)..(1290): n is a, c, g, or t
  misc_feature (1292)..(1294): n is a, c, g, or t
  misc_feature (1298)..(1298): n is a, c, g, or t
  misc_feature (1304)..(1304): n is a, c, g, or t
  misc_feature (1415)..(1415): n is a, c, g, or t
  misc_feature (1454)..(1454): n is a, c, g, or t
  misc_feature (1466)..(1466): n is a, c, g, or t
  misc_feature (1511)..(1511): n is a, c, g, or t
  misc_feature (1532)..(1532): n is a, c, g, or t
  misc_feature (1534)..(1534): n is a, c, g, or t
  misc_feature (1592)..(1592): n is a, c, g, or t
  misc_feature (1669)..(1669): n is a, c, g, or t
  misc_feature (1676)..(1676): n is a, c, g, or t
  misc_feature (1921)..(1921): n is a, c, g, or t
  misc_feature (1925)..(1925): n is a, c, g, or t
  misc_feature (1987)..(1987): n is a, c, g, or t
  misc_feature (2001)..(2001): n is a, c, g, or t
  misc_feature (2012)..(2013): n is a, c, g, or t
  misc_feature (2381)..(2381): n is a, c, g, or t
  misc_feature (2432)..(2432): n is a, c, g, or t
  misc_feature (2441)..(2441): n is a, c, g, or t
  misc_feature (2456)..(2456): n is a, c, g, or t
  misc_feature (2486)..(2486): n is a, c, g, or t
  misc_feature (2948)..(2948): n is a, c, g, or t
  misc_feature (3658)..(3658): n is a, c, g, or t
nnannnnnnannnannnnnttnnnntcnnncnnncntnctncnnccngnnnnnnanccnnncnnncgnnnntnnnntnnnntncgnnnnannnnnatnnnncnnnnnnnnntnnnnnnnntntgnnnnnantnnnnncnnannnnnnccnnnnnngnntnnnnngnannaannancnntcnnncannnngnnnnnagnnnnnngttnnnnnnnnnncnnncntnnntnnnntcnnncnnnnnnnnnntnnnnnnnnnnntnnntnnnttnnnnnnnntnnnnnngnnnnnnntngnnggnngnnngnnnnnnnnnntcnntcnnncnnnnnnnnncngnnnnnnnnnnnntnnntnnnnnnnnnnnnnnnnnnnnnnnnnnnannnngncnnncnnncnncnnncgnnnnnnntnnnttgntnngncngnngnttnnnnnnnnnnnnnnnnnnntngtnngnnngannnnnnnnnnngncnncnnccnnncnnnnttnntnnnngnnnntannnnccgnncgnnnnanntngctgnntnnntngnngnnnnnnncnncnnnnnnatcnntnnnnnnnnnnnnnncngnnngnannnnnnnncgnncnncntcnnncntnncnanngnnngcnnnnnannannnnnnnnnnnnnannnnnnnnnnnnnnngnnngnncnnanngnnngnagnnnncngcncgnnnnntnnnnnncnnnnnnntnnnngccnnnnnnntnnnnnnncnnnccntnnnnnnngnngnnnnnnncngnnnntngnnnnnganngnnnngnnngnnnncgnnnngttnntntnnntngnnnntnnnnntnncnnnnngnnnnnnnnnngnnnngnnnnnnnnngncnngntnnnnnnnnnnnnnnnannangnnnnnnnntnngnngngnnnnntnnnnnngnngnnnnnnnngannanaanatagagtgaagacggggcggaaaaagttataacccccaatnggggtcggaaatatcaggaacgttgatcgtcagattcaatacgaaattcagggcgctgtcataatagggagtttccgcataatcgaaccgataatattcgatacgtgttacgttgagagcagtcgatgcattcatgagtnnctcntattcnntnggatttgttgggataagtccgttgaacataagacataccgtancaccgttttcgtcgatcagataaccatcttcgtaggttatgcccggaatatggctgtaaanatcntcgatcgtccgggcatcgggggcaatctgntngggaaggnannnttcnacgggntgtacggtagcgagatccttctggctgcggatgacagggaaatgaaagtagcgccgtccttctatgccgggcacataagctatctcgatttgccgggtctgcggctggatncccggacccgatatttcgagccggtaggtccggttggtngcaatggcgtcnaactcgtaataaccgttgacagatgtaagcgtcccgtattcgggntctccggtcgccggatcgtananccacaatgaagcgaaaggtattgcctccgtcggatcggtggcatagatgaatcccgcnatacgttgttcctgacccgtcgcatgtagcgaataaccgagcaaagcgaaaaataataaaacgaatcttttcatagncgttgantgtttcttaattaaaaataagcattttaccgggaatcagacaaataattttcggataaaatagttgcgaaatcgaagaatggtaattttatttgtgtgatattgaactttttctatatcttatttgaatatatatttacgatggacggagttgcggagcaataaaaatatcgaggtatgacgcgaaattgcattttgaccgttgttttgaacaaaatgcagactttgtaaaaatgaattaaaatngganaaagaaaaatgcctgattttttcggctgcagatttcgataggatagggtaaagacaaaggcngccgataatcgatngattatcggcnncctttccgtgatcccgctggggctcgaacccaggaccccaacattaaaagtgttgtgctctaccagctgagctacggaatcatccgcgccaatccggagttatccgttttggtggtgcaaatgtatagaaaatttttgttttgccaaaataaaacgatatttttgtacggaatattgattatcgtaaatcttaaaacaagataaattttatgtgtaaagctctgattatcggcgcaggaggcgtaggtaccgtcgtggcgcagaaaattgctgccaatccgattttttcggacgtgatgctggccagccgaacaaaagcgaagtgtgatgccattgctgcggcaatcggcggggaccgggtgaagacngcgcaggtcgatgccgacaatgtagccgatttgtgcgagttgtttcgggcnttcaagccngatatcgtggtgaangtggcgctgccgtaccaggatctgaccatnatggacgcctgcctggagtgcggggtgaactacctcgatacagccaattacgaacccaaggacgaggcgcatttcgagtattcgtggcagtgggcctatcaggagcgcttcaaggagaaggggctgacggccatcctgggctgcggcttcgatccgggagtgacagctattttcaccgcctatgccgccaaacaccatttcgacgagattcactacctcgatatcgtggattgcaacgccggtaatcacggcatggctttcgccacgaatttcaatccggaaatcaatatccgcgaagtgactcaaaaaggccgttactacgagaacggcaagtgggtggtgaccgaaccgcacgagatacacaagccgcttcattatcctgaaatcggcgagcgcgaatcttatgtgatctaccacgaggagctggagtcgctggtaaagaactatccgacgatcaagcgngcccgcttctggatgactttcggacaggagtacctgacccacctgcgcgtgattcagaatatcggcatggcccgtatcgatccgatcatttacaacggtgtggagatcgtgccgattcagttcctgaaggccgtgctgcccgatcccaagtcgctgggtgcgaactatcacggccagacttcgatcggctgccgcatccggggtatcaaggacggcaaggagcgtacgtattatatttacaacaactgcgatcacgagaaggcgttccaggagaccggtacgcaggccgtgagctttactacgggcgttccggcggcgctgggcgcttcgatgtgggccaaggggctttggcgcggtgcgggcgtgttcaacgtcgaggagttcgatcctgatccgttcctggccgaactgggaccgcagggattgccctgggtcgagaaattcgacgtcgatctggaagtctgatcgggtttcgataattggtttgaaagtccggatggtatgtaccgtccggacttttttatcggtctgtattggtgtgaaaagaggtaggtataaatacttatttattccaaatagccgggatttttgaatcccggttgggaggttttttctatttttgcgtgaatttgaaacagcatcggaaatccatgatcgattttcaaaaattaccttctccctgctttgtgctggatgagcagttgctcgancggaatttggcggtcatcgaccgcgttcgccgggagagcggtgccgaagtgatcgtcgctttgaaggcctgtgccatgtggagtattttcccggagcttgcgcaacattccgacggagccaccgcttcgtcgctggccgaggcgaggctggttttcgaggagttcggccgtccggcgcatacgtacgctccggtatataccgaccggaatatcgaagagattctcgattgcagcgatcacatcaccttcaattccgttgcgcagttcgaacggttcggacagatggccctgctgcgcggtatttcgtgcggcctgcggatcaaccccggctattcgccggta

SEQ ID NO: 1387 - DNA, 4000 bp, Escherichia coli
  misc_feature (162)..(162): n is a, c, g, or t
  misc_feature (224)..(224): n is a, c, g, or t
  misc_feature (1492)..(1492): n is a, c, g, or t
  misc_feature (2868)..(2868): n is a, c, g, or t
  misc_feature (3209)..(3209): n is a, c, g, or t
  misc_feature (3229)..(3229): n is a, c, g, or t
  misc_feature (3533)..(3533): n is a, c, g, or t
  misc_feature (3617)..(3617): n is a, c, g, or t
gtagcttcatccagaataatgaccggcgcatccttcaaaatcgcacgggcgatggaaattcgctggcgttcgccaccggaaagggtacagccgttttctccgattctgctttgatacccctccggcaagcgggagacaaattcctcacaccttgctgctttngcagcttttatcacttcctcatccgtggcgttttgccgaccaagccggatattttccattanggtattgtcaaacagggtaacatcttgaaaaacaatggagtagtttcgatacaacacctccggctctatggtcgttacatccacgccgccgagcagaacctttcccttatctgcatcccaaaagcgggctgccaatcgggatacggttgattttccactgccggaatgtcctacaagcgcagtaatttccccctgctttgctacaaaggaaacgcctttcaacacaggggtatccttataggaaaattccacattggaaaattcaatatcaaagccttgattattgcagacattcgcaccggtctgttccggagtagcctccatttcttttgtccggcggatactgaccagtgcggagaacatttcagccatcagcatgaagcaggagccaaacggctcataaatcctgcctgctatcagcagataaagcaggaacatattaacagagaggcttccctgtgtcattaaaaccccgcctacaagcaacaccgtcaccaggccgaagcgaaggacaaactgtgcaagcgtaactactgtaccgggaacaagctcattgcgaaatgcacacgcaattacattgtccagtttttttcttactccggctaaatattcctgctccgttccagaagaacgaagttcagaaactacatcaagatactcctgcacaccgtcataagcggcacgataggcatcgtaattcttttcctccgcattctgctgcatccttcttccggcaaatacaatcacaccggcaacaggaacgggaaggacaatgcaaagtcccatacgccaatcgacacagagcaggcaggcggaaaccacaaggaacatcacgattgttccaaacagccccggaactgcatttgagaatatccgttccagttttgagcagtcacccatcatcgtggacgtcaggtcggaaaggtcacgctgcccaaagaaagagagcggaagccgccgcagcttttctgccagagtaattcgccggtttgcgctttcccgataggcaaccgtataggtaagatggtactgcacccattgtgttaaaaagataattccacaaagccctattgccatcagcaaaatgacatctgaccggagggtaaaaccttcgccgccacatattttatctaaaagcgccatcgttaccatcattaaaagcgaaacgggagccataatcgctaaattggaaatcgctgtggcagcgataccccttttcagttcacgcactccgtcatcgctcaatccgagtaaattcttcagcatgntgcagcctcctgttcctgcccgcttttcagggcatcatggtgcacccctgcggtgtttcctgcgttatccatctgccagcgaattgacttctgatattctgtccacatacgggcatattcgccctgtcttgcagctaattcctcatgtctgccgtactccgctatctgtccgcccttcatcacgatgatttggtctgcatcggtaatggtagagagacggtgcgcaatcataattaccgttttgttttttgtcagttctttcaatgcctgttgaatctgtgcttcattttccgggtctgcaaaagcggtggcctcgtccaaaacgatgataggggcatccttcaatattgctctcgcaatagcgagccgctgtatttcgccaccggaaagatatacaccttttcctccaatcatcgtatggattccatcggggagtttttcgagaatatcatcacatccagctaaatgcagagcgttcaaaatatcctctgcggctgcgttctttttcccgccccggacattttcttcaatgcttgctttcagcagctttggattttgaaatacaaaggcaactctttccatcaacgccttcctgttcatggaagaaagtgctacgcctccgatggaaatgcacccctcctgaatatcataaaaccgtggaattaaagagcctatggtacttttgcctgagccggaatgtcccaccaaagcagtcacggttccgcctttcgcaaggaagctgacatcggaaatggcagggccctcgcctgtaggataagtaaaggtcacatggtcgaatcttacatcattaccctgcggcagtttgaactctcttggctctgcctgctcccttgtcagcaggatttcatcaatgcgccgcatggattccacagcctgcatcttgtagttggtcatatacatcaatttgttcagcatagctgcacaggcaggtgcaaaaatcaaatagaataaaaagttttgtgcaaatgtttccaaatctgccgcggctgccataccaatcaaggctgccgggatcaaggcaagaaacgaggagtttaccacagtattaaacgccacataccccggcttgcaggccatcgtataggctaaggcgtcatcccggtaggcatggatggcttctttgaaacggcgcagcgaatgaacggactgaccaaagattttaatgacggaaattcctctgacgtactccaccgcttcatggctcatgtcctcttgcgcatcctgatagcgtttcataaaattcatggtttcttcacccatcatagacatttgaaacgcaaaaccgatcatcataagcaccagcacaggaagtccaatccgccagtcaaccgcaagcatgagaagcgccgcagcanccatagacacctgtgcccctacgaggtcaggaagctgatgtgccagatagctttctgtctgtttactgttttcatctatgattttccgcagttttccgctgctgttttcttcaaaatatcccagaggcagccttgacagatgttccaatactgccattttcaaattctgttccgtatgaaaagcagctttgtgagacaaaagcagggcaataaaattgacaatcaagcctgccagttcaaacccaagcgcccaaagcccccaatacgccaacgcagacgcatctatgctgccgccaagcaggaaatccaaaagctcccttgcggcaaaataaacacaaagnaacggcgctaacagcaatantgcactcgctccggcaagaagctgggagagaaagagcatgggaccaaatggagccgtaaattccaacaatcttggaataccggttttttgcggttttcttatctgtgcatcttctctaaatactttccacatatagatgttccccctttcatctaatggcaggagcttttttacttctcctgcatgaatatgtaaaatatgtgtggcacagcgggcaatcagctccgggtcatgggatacgataagagagcatacggcattctcgttcgcttttcgtatgatttctacggtgcgaagcagattntccccatcctgtccgctggttggctcatcatacagcatgaccggacgtcggttacagatcgctgttgcaagagaaagccgctgntgctgtccgccggaaagagaaccggggtgtctgttttccaatcccgccaaccctaactcacggagtaccgcctgtgcctgttcctctgttaaagaaggattgtttagcgtaagctcacccattacactgtcgctaaaaagctggtgtcctgcctcctgcatgacaaggaaagctgtttccggcagtcttttgttcggaactgtttttccttctatcataatcgttccgttatgcctgagaagccccgcaaggcataaactcagcgtggacttacctgcaccgttctcgccaatgaccgcaacaatcgctccttttggaattgccaggtggcgaatatccaatacctggcgctgcccacggttaaaggtcagaccgtggatttc

SEQ ID NO: 1388 - DNA, 4000 bp, Escherichia coli
  misc_feature (422)..(422): n is a, c, g, or t
  misc_feature (1933)..(1933): n is a, c, g, or t
  misc_feature (2079)..(2079): n is a, c, g, or t
  misc_feature (2687)..(2687): n is a, c, g, or t
ttgaatggcattaaagtctcaaccaaattaaaaattcgatcgatggatccacctcgcgtcggtggaattatttcaaaactgaaaagagttttgttcgctttttctaaaaattctataactttcatagcctttaatttaccttgtcttttaactgaattaaaaatgggttttcttttaattcaaattttaatgttgtatccgagccatgtcctgaatgaactattctatcatgattaaccgaattgaatagatgaacaagtgatgattctaatgtgccccaatcaccgcctggtaaatctgtccttcccacacttccccggaataaagtatcgccaacaaataaatggttgtcaatctcaaggcatgttcctcccggtgtatgccccggcgtttgaattaactgaattttaaatgtattgatnttcagaaatggcgcattattaaaccatacatcaactttgggtgtttctcgcgggccgattccaaacattttacatgcatcttcatatgcatttaaaataagttgttccttcgagtggagataaaatggaatatcatatttgtcctttaaaggctggacagctccaatatgatctaagtgggcatgtgtatttacaattgcaatggggataatttggtgttcttcaagagattggattatcagatgcgcatcatcaccagggtctacaataaccgcatctgttgattcggcataccatgcaataaaactgttttcctgaaacgggcctgtaactaccgtttcaacatttaagttcaaatttcctcgaagaataattcattaagacactgagtcttgtcttcataagaatgaggatataaaaatcgttctgctgctgaaatactacttaaaattgaatttccatcctgaggtgtaaaacaaaacccataaatctcatgttcatttcgaacatgaagcgtttgttcaacgacaacagtttggtttaatattcggccaaaatgaccatgatcacgaccaaaggaataaacggtactggtcaaatccttcgtggtcattgctacatgatgattggcgatcaaccgatctttcacttcattcagggttgtgggttcttttgttctcaaagtgaaccagagtacatgcatatattggctattcaccttcatggccgaagaaaacatatttaaatcatatcctaaggttgtaaaaagttcatatgcatccttggcatggtgggatccaaacttttcatccccatggctacctacaacaggtgcgggtataaaactacctgactgacttgtatcgtttgcccggcgaacacatacataccgcccttcgacgagattctccggtccgaattcatttaatgccaacgtatttgtaatacatgaaatattatgcgtattgcaggaaacgatttggacaaattgattatcaccattttttaatactgaatcgttgatcccacttgcatattttacaccaaaaccatcttcactaccttgggccaaaaatccttttaccttatctgaaaatttatggtaatacttttccttatttttatgaccaataccagatggtgtgcaatcaatgacaacagaggctcgacgaatagcatcttctgtttccaattctggatccatacctaattctttaaactcattcaatcggtcgtcacttacagccaaccgggcaccgcgttttaataaggaaattacctttgatcggtcaccgcgcaggggggtatttttattgaatgttacctcatcaattccaagtttttctcgataatcacataataaaccaatgagaggttcaccaatggttcctgttcccacaacgtggacaattttgcgttccatttaaactaactccttaattcgatttttcatttttatttaacattcgcttttctgaacgaaattgaattataaaccacccaaggattgnaccaaaaacgatcaaataaactgccaaaaaatattcaaagaaattatacattactacccacattgtttttgatacgaatcacatgaattttatacgtaagcatgagtgtataaagcagagtaaaaatacccaacgataataaaaanggtgtcaatatccctgatggttgttgagccatttctacttggggatgtgactggatttccggcgtccaaaacttaacagatacgaagataataggtacatctacaaatgcaattattcccaaagcggctgcatatcgctttacccgttcaacatggcctccaaaagatcgcatcatgaaataccctatatatataagaaacaaaataagtgttgtggtcaatctgggctcccagatccagggtttcccccaaataggtgtggcccatatcggccccgtaattaacaccaacgccataaatactgtacccaattctgcggctgcaagtcccacatcatcccaatggtcgtccttttttataaaaaacataattcctgccaccatgacaacaaaataggataaaaatccaacccaggctgatggtacatgtacataaaatattttttgtgcccagtgctgttccggaaccatgggtgtgttcacaataacgttccatacattaaaaagcatcatagcaatgattagcacaaaccaagttcgattcgtcttattatttaaaaatattttcattattcttcagcaataaaatcaaataaggtgtatccaacnagcccgaaaattacaataactgtgagtacgattaataaccatatttgccaaaacgaaaatggatccccagccattatactgccggatatttttgtagctgcaatgattacaggcgaaaccaatggaaacaacaatactggcaataaaacttcacttaatctcgctcgcattgcaataccggaaaccaaacttgcaatggccattatcgcacaattaattaacatggttgtaccaatagctatccacggttgagatggaaaatcaatcatcaaaaatttaaagaatggtatgattattaatgcttccatgattgtcaaaaatataaatccacttatccatttagacagaaaaataaatcctctatcaatgggtgcactgattaacatagaaaatgcatcaaattctttttcataagaaaaagaacgatgcacgccaatgaccgcgacaaataataccattatccaaaacataccaggcgcataatttgcgatgatcgtgggagaaacattggatgagaatgcaaatgtaagtataatagataagccaaaaacgagcatagatagcgtgacttctctcgatcgaaattcgacaaataattcttttttcagtaatatgaaaaacataattattattcaattgatccattttgaatgtaaaggattcgatcaccaaattctttagctcgagactgattatgtaaaacaagaattaaagattttcctatttctttccaacgatgtaatgctgtctcaaccaacccgacaccatctgtgtccaatccggaaaatggttcatctattaataataaattccaattaaccaattcagcataagctaattttaaacgctggagcatgccctgagaatatattgatattggatcattggactgggttccgatcccaaaataatttaactgattttgaatttcagataaaccaacagtcatccctctaagtgttaatgccaattttatattttctttggcggaaagggtggtgtacatcgctggtgcatgtccaaggtataacaatttatgacgatcgcatggactcccttttaataaatctttattttggaaagagatctgtccaccatcacaggccataattcgtgccaatattcgcaatagtgttgatttcccaacaccatttttccccattagaacaatagtttcaccctggtggagagtgaatgatatatcttttagtattggacgacgatcaaaggattttgatatatttgaaacagtcaggactgcgggcattttaaagcgaattcaattttgtaatgatttcagaaacgtcctgttt

SEQ ID NO: 1389 - DNA, 4000 bp, Escherichia coli
  misc_feature (1985)..(1986): n is a, c, g, or t
  misc_feature (3532)..(3532): n is a, c, g, or t
  misc_feature (3879)..(3879): n is a, c, g, or t
  misc_feature (3996)..(3996): n is a, c, g, or t
agagatgattcaccatatttttacaaaaataccaattcaaactaagttcaaaaaaaagaaacaacatatgaaaaaatagtcccaatcatacaatccaaaaataataaaatcaggtgtaaaaaaactacttagaaagatgaataataaacaagtcaaagactaataaggtaatgtaccgtactatacagtataatgaaagcaagactaacatacgttccactagaagtggcagatcaatttgaagactttatcatagaaagagaagagcaagttttagatgcagtaaaagcaagaaccagagatttcagcacgttatctttgttaaaattattatatcaactcaaaggaaatccaatgacattttcatgtctatattcaaaatcaaaaattagaatgaaaagatcatttttgaattacctgcatctatgtgtaaattataattttattgaaaaagaaccagtaggcccaaatgtaatttatacaattacagacaaaggaagattgatgttaaatctattcatgcaaaaaggtaattagatagaatacatcgaggcaaactgtgaaaaaagaatttccagaagctgaagtgttttcaatcaaagaaataaaattaaacaatccaatagtttttgcaggatttgttggtgcaggtttagtaggtccactggcaatcaatcatatgattacagaattaaaaatgacagagatagcagtaatgagatcaaagtatcttccaccatcaacggttttcatgagaggaagattacgtcatccttttagattttacacaaacccagaaggaacaatttgtgcaataatttgtgaaataacattacgaatgaaaggattgtattcattagtagactcaattttagattgggcagaagataacggatctaaagaaattgtaattttagatggagttgcaagtactgaacatgacgataaagcatattgtgcagcagaagaagacttggttagaataatggcagataaagacatcagtttaattcctcaaggatttatcacaggaattccaggggggatattaaatgaatgtctagtaagaccaattcagggattaacattattggtaaaagcagacaaaacaaagccagattcagtagcaacaataaccctaattgaagcattaaacaggttttacgaaatggaaattgatacatcagagttagaaaaggaaaaagatagaattcattcagaatttagtgaattatctcaaaaatatgtaaaacatagagaagagatatctggaatgtacatgtgatcgaagcaataggcaaattcttttattcagaataaatgcgcaacaaattatggctttaacatacaaaaaagcaggagtagatatttcaaaaattaaacaaagccaaaaagcaattgggaaattaattgcatcaacccataaacttcaaaaaaaggcaaagatagctcacggatttgggcattatgcaggaattgtagaaattccaggtgggaaaatgttagcaacacacacagatggtgtaggaactaaagtagtaattgcaaacatgatgaaaaaatacaacaccattggaattgattgtattgcaatgaatgtaaatgacataatttgtattggtgcaacaccaatatcatttgtagattatattgcagcaaacaaaaatgacgtaccaatatttaaaaaaattgtagaaggattagttacaggtgcaaaaaaatctgcaatgccaattgtaggtggagaaactgcaatcatgccagatgtaatagaaggtaaaggatttgcatttgatttagcaggaatggtagtaggattagtagagaaaaaagaaatagttttaggaaataaaattaaaacaggagatgtaattattggtgtgaatagttcaggaattcattcaaacggatattcacttgcaagaaaagctttgttaacaaaatattcaattaaagacaaagtcaaaggagttggaaagataggnnatgcattactaacgcctacagaaatttatacaaatccagtacttgaggttaaccaaaaatgtaaagtgaatggtttagcccacataactggaggctcatttacaaaattattacgtctcaaaaacataggttatgagatagattcacttccaaaaataccaccaattatgggattaatacaagagcaaggagtaaaagcagaagaaatgtacaaaactttcaacatgggagtaggattttgtgtagttgcaccaaaatcacaggcaacaaaaataatatcaattttcaaaaaacacaagatcaaaagtcaacaaataggacagatagtttcaaaaaaaggagttacagtaaactctgtaaaaattgcttagattagtaatagcaaaataattctcaactcaatatcatcttatattacagaattttatgactttatcagagagtaatgagtgaagcacattttattgaaacaattatcggagtaggaatacttctttttgcagctaaattaatggcagaacttttccttagattaaaacttccaattgtgttaggtgaattaattgcaggaatgattgtagggccatttgcattaggaggattacaaatagttgatggaaaacaattgttgcaaattaatgatgaaatcagaatactaggagagatgggagcaattgtaattttattcatggcaggacttgaaatgacaccaaaagaatttctcaaaggagggaaagcagcatttgtagttggtacgttaggagtagtcatcccgttctttgtaggactcacagttttccaattatttggatttgatgcattacaatcaatgctcattgcaacggcactgacagcaacaagtattgcaatttcaattcaagttctaagtgaatttgggaaaattaaaactccagaagcaagactgatcataggtgcagcgattgtagatgacatactagcaattgcagttttatcagtagtaacatccattgcaggatcagatggaggagtagataacatagacattacagaaatcacaattacaattttgaaagtattagggttctttgcaataatgttagtagttgcagttgtagtaataccaaaaataatcacaccaagattatggaaagcaaaaggaagtgtagaaggaatagctactgcggcgttctttggtgcagcagcccttgcaggctccatagggttatcaccaatcgtaggagcatttgcagtcggaatggcattatcaacaactaaggtatttgataaaatagaaagttatattggaaaaattggattaatttttgcaccgctattttttgcaataattggtgcacaagtagacctaagggcagttgatttgaatattttgatattaagtggagtaatcgttgtagttgcagttgcaacaaaattatttggatgtggtcttcctgcaatgtattttttgaaaagcaagcaaaaaggaatgcgtgtaggaattggaatgatttcaagaggagaagtaggattaattgtagcaggagttggagtaacagctggagtncttacatctgaagtatactctacaatcataattatggtagtagtaacaactatcatcactccaatttggttaaaaattgaatatagaaaagagcaaaaaagtggcggcggaacatcagaaataaaatctgaacaaaaatcagaataaattttaacagtgtcagatgaataatgattatgaataagttagatcctgcattatctaaagcatgtagggagatcactcaaaatcttctaacaataaatcaaccaagtaaaaaacaagttaaagaagaaataataaaaatttgtacaaaatatgcactagaaagaattcccaaaaattatgaaattctatcaatggtaagngattcagattttgataaattaaaaaaagtattgataagaaaaccagctaaaacagcatcaggtgtatcagtagtagcattaatgccaaaaccatatgcatgtccacatgggagatgnacat

SEQ ID NO: 1390 - DNA, 4000 bp, Escherichia coli
  misc_feature (1)..(1): n is a, c, g, or t
  misc_feature (4)..(6): n is a, c, g, or t
  misc_feature (9)..(15): n is a, c, g, or t
  misc_feature (17)..(17): n is a, c, g, or t
  misc_feature (19)..(33): n is a, c, g, or t
  misc_feature (35)..(35): n is a, c, g, or t
  misc_feature (37)..(37): n is a, c, g, or t
  misc_feature (39)..(46): n is a, c, g, or t
  misc_feature (48)..(51): n is a, c, g, or t
  misc_feature (53)..(53): n is a, c, g, or t
  misc_feature (56)..(56): n is a, c, g, or t
  misc_feature (58)..(58): n is a, c, g, or t
  misc_feature (60)..(60): n is a, c, g, or t
  misc_feature (63)..(67): n is a, c, g, or t
  misc_feature (69)..(71): n is a, c, g, or t
  misc_feature (73)..(75): n is a, c, g, or t
  misc_feature (79)..(81): n is a, c, g, or t
  misc_feature (83)..(83): n is a, c, g, or t
  misc_feature (85)..(86): n is a, c, g, or t
  misc_feature (88)..(88): n is a, c, g, or t
  misc_feature (91)..(92): n is a, c, g, or t
  misc_feature (97)..(103): n is a, c, g, or t
  misc_feature (105)..(105): n is a, c, g, or t
  misc_feature (107)..(107): n is a, c, g, or t
  misc_feature (109)..(109): n is a, c, g, or t
  misc_feature (115)..(117): n is a, c, g, or t
  misc_feature (121)..(121): n is a, c, g, or t
  misc_feature (123)..(128): n is a, c, g, or t
  misc_feature (130)..(131): n is a, c, g, or t
  misc_feature (133)..(135): n is a, c, g, or t
  misc_feature (137)..(139): n is a, c, g, or t
  misc_feature (141)..(142): n is a, c, g, or t
  misc_feature (144)..(147): n is a, c, g, or t
  misc_feature (149)..(150): n is a, c, g, or t
  misc_feature (152)..(154): n is a, c, g, or t
  misc_feature (156)..(162): n is a, c, g, or t
  misc_feature (164)..(164): n is a, c, g, or t
  misc_feature (166)..(166): n is a, c, g, or t
  misc_feature (168)..(169): n is a, c, g, or t
  misc_feature (171)..(171): n is a, c, g, or t
  misc_feature (173)..(174): n is a, c, g, or t
  misc_feature (176)..(176): n is a, c, g, or t
  misc_feature (178)..(178): n is a, c, g, or t
  misc_feature (180)..(181): n is a, c, g, or t
  misc_feature (187)..(188): n is a, c, g, or t
  misc_feature (190)..(193): n is a, c, g, or t
  misc_feature (196)..(197): n is a, c, g, or t
  misc_feature (199)..(199): n is a, c, g, or t
  misc_feature (201)..(201): n is a, c, g, or t
  misc_feature (203)..(203): n is a, c, g, or t
  misc_feature (205)..(205): n is a, c, g, or t
  misc_feature (207)..(207): n is a, c, g, or t
  misc_feature (209)..(212): n is a, c, g, or t
  misc_feature (214)..(216): n is a, c, g, or t
  misc_feature (218)..(221): n is a, c, g, or t
  misc_feature (223)..(227): n is a, c, g, or t
  misc_feature (229)..(233): n is a, c, g, or t
  misc_feature (236)..(236): n is a, c, g, or t
  misc_feature (240)..(241): n is a, c, g, or t
  misc_feature (243)..(243): n is a, c, g, or t
  misc_feature (245)..(247): n is a, c, g, or t
  misc_feature (249)..(249): n is a, c, g, or t
  misc_feature (251)..(252): n is a, c, g, or t
  misc_feature (254)..(254): n is a, c, g, or t
  misc_feature (262)..(262): n is a, c, g, or t
  misc_feature (265)..(271): n is a, c, g, or t
  misc_feature (273)..(274): n is a, c, g, or t
  misc_feature (276)..(276): n is a, c, g, or t
  misc_feature (278)..(282): n is a, c, g, or t
  misc_feature (285)..(286): n is a, c, g, or t
  misc_feature (288)..(292): n is a, c, g, or t
  misc_feature (294)..(295): n is a, c, g, or t
  misc_feature (297)..(299): n is a, c, g, or t
  misc_feature (301)..(302): n is a, c, g, or t
  misc_feature (304)..(304): n is a, c, g, or t
  misc_feature (306)..(308): n is a, c, g, or t
  misc_feature (313)..(313): n is a, c, g, or t
  misc_feature (316)..(317): n is a, c, g, or t
  misc_feature (319)..(321): n is a, c, g, or t
  misc_feature (323)..(324): n is a, c, g, or t
  misc_feature (327)..(328): n is a, c, g, or t
  misc_feature (333)..(334): n is a, c, g, or t
  misc_feature (336)..(336): n is a, c, g, or t
  misc_feature (338)..(338): n is a, c, g, or t
  misc_feature (340)..(340): n is a, c, g, or t
  misc_feature (342)..(343): n is a, c, g, or t
  misc_feature (345)..(345): n is a, c, g, or t
  misc_feature (347)..(348): n is a, c, g, or t
  misc_feature (350)..(350): n is a, c, g, or t
  misc_feature (355)..(357): n is a, c, g, or t
  misc_feature (359)..(363): n is a, c, g, or t
  misc_feature (365)..(370): n is a, c, g, or t
  misc_feature (372)..(373): n is a, c, g, or t
  misc_feature (375)..(375): n is a, c, g, or t
  misc_feature (377)..(378): n is a, c, g, or t
  misc_feature (380)..(384): n is a, c, g, or t
  misc_feature (386)..(389): n is a, c, g, or t
  misc_feature (391)..(393): n is a, c, g, or t
  misc_feature (395)..(395): n is a, c, g, or t
  misc_feature (397)..(397): n is a, c, g, or t
  misc_feature (399)..(404): n is a, c, g, or t
  misc_feature (407)..(408): n is a, c, g, or t
  misc_feature (410)..(411): n is a, c, g, or t
  misc_feature (415)..(415): n is a, c, g, or t
  misc_feature (417)..(419): n is a, c, g, or t
  misc_feature (421)..(423): n is a, c, g, or t
  misc_feature (425)..(426): n is a, c, g, or t
  misc_feature (429)..(430): n is a, c, g, or t
  misc_feature (432)..(434): n is a, c, g, or t
  misc_feature (437)..(438): n is a, c, g, or t
  misc_feature (442)..(443): n is a, c, g, or t
  misc_feature (445)..(446): n is a, c, g, or t
  misc_feature (448)..(450): n is a, c, g, or t
  misc_feature (452)..(455): n is a, c, g, or t
  misc_feature (457)..(461): n is a, c, g, or t
  misc_feature (463)..(464): n is a, c, g, or t
  misc_feature (467)..(468): n is a, c, g, or t
  misc_feature (470)..(474): n is a, c, g, or t
  misc_feature (477)..(478): n is a, c, g, or t
  misc_feature (483)..(483): n is a, c, g, or t
  misc_feature (490)..(491): n is a, c, g, or t
  misc_feature (493)..(494): n is a, c, g, or t
  misc_feature (496)..(497): n is a, c, g, or t
  misc_feature (500)..(501): n is a, c, g, or t
  misc_feature (504)..(504): n is a, c, g, or t
  misc_feature (506)..(507): n is a, c, g, or t
  misc_feature (509)..(511): n is a, c, g, or t
  misc_feature (514)..(515): n is a, c, g, or t
  misc_feature (517)..(518): n is a, c, g, or t
  misc_feature (520)..(521): n is a, c, g, or t
  misc_feature (523)..(524): n is a, c, g, or t
  misc_feature (526)..(526): n is a, c, g, or t
  misc_feature (529)..(530): n is a, c, g, or t
  misc_feature (532)..(533): n is a, c, g, or t
  misc_feature (535)..(535): n is a, c, g, or t
  misc_feature (540)..(541): n is a, c, g, or t
  misc_feature (543)..(544): n is a, c, g, or t
  misc_feature (546)..(550): n is a, c, g, or t
  misc_feature (553)..(556): n is a, c, g, or t
  misc_feature (558)..(562): n is a, c, g, or t
  misc_feature (564)..(569): n is a, c, g, or t
  misc_feature (571)..(574): n is a, c, g, or t
  misc_feature (576)..(576): n is a, c, g, or t
  misc_feature (579)..(580): n is a, c, g, or t
  misc_feature (583)..(584): n is a, c, g, or t
  misc_feature (586)..(586): n is a, c, g, or t
  misc_feature (588)..(589): n is a, c, g, or t
  misc_feature (591)..(594): n is a, c, g, or t
  misc_feature (596)..(600): n is a, c, g, or t
  misc_feature (602)..(603): n is a, c, g, or t
  misc_feature (605)..(606): n is a, c, g, or t
  misc_feature (608)..(609): n is a, c, g, or t
  misc_feature (611)..(611): n is a, c, g, or t
  misc_feature (613)..(613): n is a, c, g, or t
  misc_feature (615)..(621): n is a, c, g, or t
  misc_feature (623)..(624): n is a, c, g, or t
  misc_feature (629)..(630): n is a, c, g, or t
  misc_feature (632)..(634): n is a, c, g, or t
  misc_feature (636)..(636): n is a, c, g, or t
  misc_feature (640)..(643): n is a, c, g, or t
  misc_feature (645)..(646): n is a, c, g, or t
  misc_feature (648)..(651): n is a, c, g, or t
  misc_feature (655)..(656): n is a, c, g, or t
  misc_feature (658)..(658): n is a, c, g, or t
  misc_feature (660)..(661): n is a, c, g, or t
  misc_feature (663)..(663): n is a, c, g, or t
  misc_feature (665)..(666): n is a, c, g, or t
  misc_feature (668)..(668): n is a, c, g, or t
  misc_feature (670)..(672): n is a, c, g, or t
  misc_feature (674)..(674): n is a, c, g, or t
  misc_feature (676)..(680): n is a, c, g, or t
  misc_feature (682)..(682): n is a, c, g, or t
  misc_feature (684)..(686): n is a, c, g, or t
  misc_feature (688)..(689): n is a, c, g, or t
  misc_feature (691)..(693): n is a, c, g, or t
  misc_feature (698)..(699): n is a, c, g, or t
  misc_feature (701)..(702): n is a, c, g, or t
  misc_feature (704)..(704): n is a, c, g, or t
  misc_feature (706)..(706): n is a, c, g, or t
  misc_feature (708)..(709): n is a, c, g, or t
  misc_feature (716)..(717): n is a, c, g, or t
  misc_feature (720)..(720): n is a, c, g, or t
  misc_feature (723)..(726): n is a, c, g, or t
  misc_feature (728)..(730): n is a, c, g, or t
  misc_feature (735)..(737): n is a, c, g, or t
  misc_feature (739)..(743): n is a, c, g, or t
  misc_feature (745)..(745): n is a, c, g, or t
  misc_feature (747)..(747): n is a, c, g, or t
  misc_feature (750)..(751): n is a, c, g, or t
  misc_feature (753)..(755): n is a, c, g, or t
  misc_feature (757)..(758): n is a, c, g, or t
  misc_feature (760)..(761): n is a, c, g, or t
  misc_feature (763)..(763): n is a, c, g, or t
  misc_feature (765)..(765): n is a, c, g, or t
  misc_feature (767)..(767): n is a, c, g, or t
  misc_feature (769)..(771): n is a, c, g, or t
  misc_feature (773)..(773): n is a, c, g, or t
  misc_feature (775)..(775): n is a, c, g, or t
  misc_feature (780)..(783): n is a, c, g, or t
  misc_feature (785)..(786): n is a, c, g, or t
  misc_feature (788)..(789): n is a, c, g, or t
  misc_feature (791)..(791): n is a, c, g, or t
  misc_feature (793)..(793): n is a, c, g, or t
  misc_feature (795)..(797): n is a, c, g, or t
  misc_feature (799)..(799): n is a, c, g, or t
  misc_feature (801)..(801): n is a, c, g, or t
  misc_feature (803)..(803): n is a, c, g, or t
  misc_feature (809)..(810): n is a, c, g, or t
  misc_feature (812)..(812): n is a, c, g, or t
  misc_feature (815)..(816): n is a, c, g, or t
  misc_feature (818)..(818): n is a, c, g, or t
  misc_feature (820)..(821): n is a, c, g, or t
  misc_feature (823)..(824): n is a, c, g, or t
  misc_feature (828)..(829): n is a, c, g, or t
  misc_feature (834)..(837): n is a, c, g, or t
  misc_feature (839)..(839): n is a, c, g, or t
  misc_feature (844)..(845): n is a, c, g, or t
  misc_feature (847)..(848): n is a, c, g, or t
  misc_feature (850)..(851): n is a, c, g, or t
  misc_feature (853)..(854): n is a, c, g, or t
  misc_feature (857)..(858): n is a, c, g, or t
  misc_feature (860)..(860): n is a, c, g, or t
  misc_feature (862)..(863): n is a, c, g, or t
  misc_feature (865)..(866): n is a, c, g, or t
  misc_feature (869)..(870): n is a, c, g, or t
  misc_feature (873)..(876): n is a, c, g, or t
  misc_feature (878)..(879): n is a, c, g, or t
  misc_feature (883)..(884): n is a, c, g, or t
  misc_feature (886)..(888): n is a, c, g, or t
  misc_feature (890)..(890): n is a, c, g, or t
  misc_feature (892)..(892): n is a, c, g, or t
  misc_feature (894)..(894): n is a, c, g, or t
  misc_feature (897)..(898): n is a, c, g, or t
  misc_feature (900)..(900): n is a, c, g, or t
  misc_feature (902)..(902): n is a, c, g, or t
  misc_feature (904)..(905): n is a, c, g, or t
  misc_feature (908)..(911): n is a, c, g, or t
  misc_feature (913)..(913): n is a, c, g, or t
  misc_feature (917)..(917): n is a, c, g, or t
  misc_feature (919)..(920): n is a, c, g, or t
  misc_feature (922)..(923): n is a, c, g, or t
  misc_feature (925)..(925): n is a, c, g, or t
  misc_feature (929)..(930): n is a, c, g, or t
  misc_feature (932)..(932): n is a, c, g, or t
  misc_feature (934)..(935): n is a, c, g, or t
  misc_feature (937)..(940): n is a, c, g, or t
  misc_feature (943)..(945): n is a, c, g, or t
  misc_feature (947)..(947): n is a, c, g, or t
  misc_feature (949)..(951): n is a, c, g, or t
  misc_feature (953)..(953): n is a, c, g, or t
  misc_feature (955)..(958): n is a, c, g, or t
  misc_feature (960)..(960): n is a, c, g, or t
  misc_feature (963)..(967): n is a, c, g, or t
  misc_feature (969)..(970): n is a, c, g, or t
  misc_feature (972)..(983): n is a, c, g, or t
  misc_feature (985)..(985): n is a, c, g, or t
  misc_feature (987)..(987): n is a, c, g, or t
  misc_feature (989)..(990): n is a, c, g, or t
  misc_feature (992)..(993): n is a, c, g, or t
  misc_feature (996)..(1001): n is a, c, g, or t
  misc_feature (1003)..(1003): n is a, c, g, or t
  misc_feature (1005)..(1005): n is a, c, g, or t
  misc_feature (1007)..(1007): n is a, c, g, or t
  misc_feature (1009)..(1012): n is a, c, g, or t
  misc_feature (1014)..(1015): n is a, c, g, or t
  misc_feature (1017)..(1017): n is a, c, g, or t
  misc_feature (1020)..(1022): n is a, c, g, or t
  misc_feature (1024)..(1024): n is a, c, g, or t
  misc_feature (1027)..(1033): n is a, c, g, or t
  misc_feature (1037)..(1038): n is a, c, g, or t
  misc_feature (1040)..(1041): n is a, c, g, or t
  misc_feature (1043)..(1045): n is a, c, g, or t
  misc_feature (1047)..(1048): n is a, c, g, or t
  misc_feature (1050)..(1054): n is a, c, g, or t
  misc_feature (1056)..(1056): n is a, c, g, or t
  misc_feature (1060)..(1062): n is a, c, g, or t
  misc_feature (1066)..(1068): n is a, c, g, or t
  misc_feature (1070)..(1070): n is a, c, g, or t
  misc_feature (1073)..(1075): n is a, c, g, or t
  misc_feature (1079)..(1079): n is a, c, g, or t
  misc_feature (1081)..(1082): n is a, c, g, or t
  misc_feature (1084)..(1085): n is a, c, g, or t
  misc_feature (1087)..(1089): n is a, c, g, or t
  misc_feature (1091)..(1092): n is a, c, g, or t
  misc_feature (1094)..(1094): n is a, c, g, or t
  misc_feature (1099)..(1101): n is a, c, g, or t
  misc_feature (1103)..(1105): n is a, c, g, or t
  misc_feature (1107)..(1107): n is a, c, g, or t
  misc_feature (1113)..(1113): n is a, c, g, or t
  misc_feature (1118)..(1121): n is a, c, g, or t
  misc_feature (1123)..(1126): n is a, c, g, or t
  misc_feature (1128)..(1128): n is a, c, g, or t
  misc_feature (1130)..(1130): n is a, c, g, or t
  misc_feature (1132)..(1132): n is a, c, g, or t
  misc_feature (1137)..(1137): n is a, c, g, or t
  misc_feature (1139)..(1139): n is a, c, g, or t
  misc_feature (1144)..(1146): n is a, c, g, or t
  misc_feature (1149)..(1150): n is a, c, g, or t
  misc_feature (1152)..(1152): n is a, c, g, or t
  misc_feature (1154)..(1155): n is a, c, g, or t
  misc_feature (1157)..(1158): n is a, c, g, or t
  misc_feature (1161)..(1165): n is a, c, g, or t
  misc_feature (1167)..(1167): n is a, c, g, or t
  misc_feature (1171)..(1172): n is a, c, g, or t
  misc_feature (1174)..(1175): n is a, c, g, or t
  misc_feature (1177)..(1181): n is a, c, g, or t
  misc_feature (1183)..(1183): n is a, c, g, or t
  misc_feature (1186)..(1188): n is a, c, g, or t
  misc_feature (1190)..(1194): n is a, c, g, or t
  misc_feature (1196)..(1196): n is a, c, g, or t
  misc_feature (1198)..(1202): n is a, c, g, or t
  misc_feature (1204)..(1204): n is a, c, g, or t
  misc_feature (1206)..(1207): n is a, c, g, or t
  misc_feature (1209)..(1209): n is a, c, g, or t
  misc_feature (1217)..(1217): n is a, c, g, or t
  misc_feature (1219)..(1219): n is a, c, g, or t
  misc_feature (1221)..(1222): n is a, c, g, or t
  misc_feature (1228)..(1228): n is a, c, g, or t
  misc_feature (1232)..(1233): n is a, c, g, or t
  misc_feature (1235)..(1235): n is a, c, g, or t
  misc_feature (1237)..(1237): n is a, c, g, or t
  misc_feature (1241)..(1241): n is a, c, g, or t
  misc_feature (1243)..(1244): n is a, c, g, or t
  misc_feature (1246)..(1246): n is a, c, g, or t
  misc_feature (1248)..(1248): n is a, c, g, or t
  misc_feature (1250)..(1250): n is a, c, g, or t
  misc_feature (1253)..(1254): n is a, c, g, or t
  misc_feature (1256)..(1256): n is a, c, g, or t
  misc_feature (1260)..(1262): n is a, c, g, or t
  misc_feature (1266)..(1266): n is a, c, g, or t
  misc_feature (1268)..(1268): n is a, c, g, or t
  misc_feature (1270)..(1270): n is a, c, g, or t
  misc_feature (1274)..(1274): n is a, c, g, or t
  misc_feature (1276)..(1277): n is a, c, g, or t
  misc_feature (1279)..(1279): n is a, c, g, or t
  misc_feature (1281)..(1282): n is a, c, g, or t
  misc_feature (1284)..(1285): n is a, c, g, or t
  misc_feature (1287)..(1288): n is a, c, g, or t
  misc_feature (1290)..(1290): n is a, c, g, or t
  misc_feature (1292)..(1294): n is a, c, g, or t
  misc_feature (1296)..(1297): n is a, c, g, or t
  misc_feature (1299)..(1301): n is a, c, g, or t
  misc_feature (1303)..(1307): n is a, c, g, or t
  misc_feature (1309)..(1309): n is a, c, g, or t
  misc_feature (1312)..(1314): n is a, c, g, or t
  misc_feature (1316)..(1320): n is a, c, g, or t
  misc_feature (1323)..(1324): n is a, c, g, or t
  misc_feature (1326)..(1326): n is a, c, g, or t
  misc_feature (1328)..(1328): n is a, c, g, or t
  misc_feature (1330)..(1331): n is a, c, g, or t
  misc_feature (1333)..(1333): n is a, c, g, or t
  misc_feature (1336)..(1339): n is a, c, g, or t
  misc_feature (1341)..(1343): n is a, c, g, or t
  misc_feature (1345)..(1345): n is a, c, g, or t
  misc_feature (1347)..(1348): n is a, c, g, or t
  misc_feature (1353)..(1353): n is a, c, g, or t
  misc_feature (1355)..(1361): n is a, c, g, or t
  misc_feature (1366)..(1366): n is a, c, g, or t
  misc_feature (1368)..(1368): n is a, c, g, or t
  misc_feature (1370)..(1371): n is a, c, g, or t
  misc_feature (1373)..(1373): n is a, c, g, or t
  misc_feature (1375)..(1378): n is a, c, g, or t
  misc_feature (1380)..(1381): n is a, c, g, or t
  misc_feature (1383)..(1383): n is a, c, g, or t
  misc_feature (1385)..(1386): n is a, c, g, or t
  misc_feature (1388)..(1389): n is a, c, g, or t
  misc_feature (1391)..(1395): n is a, c, g, or t
  misc_feature (1397)..(1398): n is a, c, g, or t
  misc_feature (1400)..(1401): n is a, c, g, or t
  misc_feature (1403)..(1405): n is a, c, g, or t
  misc_feature (1409)..(1412): n is a, c, g, or t
  misc_feature (1414)..(1415): n is a, c, g, or t
  misc_feature (1417)..(1419): n is a, c, g, or t
  misc_feature (1421)..(1421): n is a, c, g, or t
  misc_feature (1428)..(1429): n is a, c, g, or t
  misc_feature (1431)..(1434): n is a, c, g, or t
  misc_feature (1436)..(1438): n is a, c, g, or t
  misc_feature (1440)..(1440): n is a, c, g, or t
  misc_feature (1442)..(1442): n is a, c, g, or t
  misc_feature (1448)..(1450): n is a, c, g, or t
  misc_feature (1453)..(1455): n is a, c, g, or t
  misc_feature (1457)..(1458): n is a, c, g, or t
  misc_feature (1460)..(1461): n is a, c, g, or t
  misc_feature (1463)..(1463): n is a, c, g, or t
  misc_feature (1466)..(1467): n is a, c, g, or t
  misc_feature (1469)..(1472): n is a, c, g, or t
  misc_feature (1475)..(1475): n is a, c, g, or t
  misc_feature (1477)..(1482): n is a, c, g, or t
  misc_feature (1484)..(1487): n is a, c, g, or t
  misc_feature (1489)..(1490): n is a, c, g, or t
  misc_feature (1492)..(1495): n is a, c, g, or t
  misc_feature (1497)..(1497): n is a, c, g, or t
  misc_feature (1499)..(1499): n is a, c, g, or t
  misc_feature (1501)..(1503): n is a, c, g, or t
  misc_feature (1505)..(1506): n is a, c, g, or t
  misc_feature (1508)..(1508): n is a, c, g, or t
  misc_feature (1511)..(1512): n is a, c, g, or t
  misc_feature (1514)..(1514): n is a, c, g, or t
  misc_feature (1517)..(1518): n is a, c, g, or t
  misc_feature (1521)..(1523): n is a, c, g, or t
  misc_feature (1525)..(1526): n is a, c, g, or t
  misc_feature (1528)..(1529): n is a, c, g, or t
  misc_feature (1531)..(1531): n is a, c, g, or t
  misc_feature (1534)..(1536): n is a, c, g, or t
  misc_feature (1538)..(1538): n is a, c, g, or t
  misc_feature (1542)..(1544): n is a, c, g, or t
  misc_feature (1546)..(1549): n is a, c, g, or t
  misc_feature (1552)..(1553): n is a, c, g, or t
  misc_feature (1555)..(1557): n is a, c, g, or t
  misc_feature (1559)..(1559): n is a, c, g, or t
  misc_feature (1561)..(1561): n is a, c, g, or t
  misc_feature (1564)..(1564): n is a, c, g, or t
  misc_feature (1566)..(1568): n is a, c, g, or t
  misc_feature (1570)..(1571): n is a, c, g, or t
  misc_feature (1574)..(1576): n is a, c, g, or t
  misc_feature (1578)..(1579): n is a, c, g, or t
  misc_feature (1581)..(1581): n is a, c, g, or t
  misc_feature (1585)..(1586): n is a, c, g, or t
  misc_feature (1588)..(1591): n is a, c, g, or t
  misc_feature (1594)..(1595): n is a, c, g, or t
  misc_feature (1598)..(1600): n is a, c, g, or t
  misc_feature (1602)..(1602): n is a, c, g, or t
  misc_feature (1604)..(1607): n is a, c, g, or t
  misc_feature (1609)..(1611): n is a, c, g, or t
  misc_feature (1613)..(1614): n is a, c, g, or t
  misc_feature (1616)..(1620): n is a, c, g, or t
  misc_feature (1622)..(1623): n is a, c, g, or t
  misc_feature (1626)..(1627): n is a, c, g, or t
  misc_feature (1630)..(1631): n is a, c, g, or t
  misc_feature (1633)..(1633): n is a, c, g, or t
  misc_feature (1638)..(1639): n is a, c, g, or t
  misc_feature (1643)..(1644): n is a, c, g, or t
  misc_feature (1649)..(1650): n is a, c, g, or t
  misc_feature (1652)..(1652): n is a, c, g, or t
  misc_feature (1654)..(1657): n is a, c, g, or t
  misc_feature (1659)..(1662): n is a, c, g, or t
  misc_feature (1665)..(1666): n is a, c, g, or t
  misc_feature (1668)..(1670): n is a, c, g, or t
  misc_feature (1674)..(1680): n is a, c, g, or t
  misc_feature (1682)..(1686): n is a, c, g, or t
  misc_feature (1688)..(1688): n is a, c, g, or t
  misc_feature (1690)..(1693): n is a, c, g, or t
  misc_feature (1695)..(1697): n is a, c, g, or t
  misc_feature (1699)..(1699): n is a, c, g, or t
  misc_feature (1701)..(1706): n is a, c, g, or t
  misc_feature (1708)..(1713): n is a, c, g, or t
  misc_feature (1715)..(1731): n is a, c, g, or t
  misc_feature (1733)..(1734): n is a, c, g, or t
  misc_feature (1737)..(1744): n is a, c, g, or t
  misc_feature (1749)..(1753): n is a, c, g, or t
  misc_feature (1755)..(1755): n is a, c, g, or t
  misc_feature (1757)..(1757): n is a, c, g, or t
  misc_feature (1760)..(1765): n is a, c, g, or t
  misc_feature (1767)..(1767): n is a, c, g, or t
  misc_feature (1769)..(1773): n is a, c, g, or t
  misc_feature (1775)..(1781): n is a, c, g, or t
  misc_feature (1783)..(1788): n is a, c, g, or t
  misc_feature (1790)..(1793): n is a, c, g, or t
  misc_feature (1795)..(1799): n is a, c, g, or t
  misc_feature (1803)..(1803): n is a, c, g, or t
  misc_feature (1806)..(1807): n is a, c, g, or t
  misc_feature (1986)..(1986): n is a, c, g, or t
  misc_feature (1989)..(1989): n is a, c, g, or t
  misc_feature (1992)..(1992): n is a, c, g, or t
  misc_feature (2024)..(2025): n is a, c, g, or t
  misc_feature (2028)..(2028): n is a, c, g, or t
  misc_feature (2031)..(2031): n is a, c, g, or t
  misc_feature (2379)..(2379): n is a, c, g, or t
  misc_feature (2383)..(2383): n is a, c, g, or t
  misc_feature (2421)..(2421): n is a, c, g, or t
  misc_feature (2533)..(2533): n is a, c, g, or t
  misc_feature (2556)..(2556): n is a, c, g, or t
  misc_feature (2574)..(2574): n is a, c, g, or t
  misc_feature (2586)..(2586): n is a, c, g, or t
  misc_feature (3557)..(3557): n is a, c, g, or t
  misc_feature (3941)..(3941): n is a, c, g, or t
nggnnnttnnnnnnngnannnnnnnnnnnnnnntngncnnnnnnnngnnnncnggntngnttnnnnnannnannntttnnncngnngngcnnttttnnnnnnnantntntttgcnnngggnannnnnncnnannntnnngnntnnnntnntnnncnnnnnnngngngnngntnntncncnntttganncnnnncannangnangncnannnngnnnannnnannnnncnnnnnacncccnntntnnnantnntngtttgggnttnnnnnnntnntncnnnnntgnngnnnnngnngnnnanngncnnnttttncgnngnnncnncgnncccgnngntncngnncncnncnttttnnncnnnnncnnnnnngnngncnncnnnnncnnnngnnncngncnnnnnntgnngnngggngnnntnnncnncgnncnnngtnngggnnanngnnngnnnntnnnnntnntcnncnnnnntgnngcccntttcccnnannanntgnngtncnntnnnggnngnnanngnngnttnngnnantttgnngnngnnnnngcnnnngnnnnngnnnnnncnnnngncgnngtnntngnngnnnnannnnncnngnntnntncngnnnnnnncnncaagnntnnngngggnnnncnncnnnngggnngntnntncnncnannntncnnnnnanannnanntnnngggtnntnntncngnnattttcnnctnctnnnntnnngcccnnncnnnnntngnganncnnntnngnnancngngnnncngntgggnnnngnngnntngncnnnancntngccccnncnacnncntnnanntttnngtatnnnncnttttnntnntnntnntcnncntnntnnacnncgnnnncnntttnnannncnangnagnngncnannatnnnnanaaanannanngntttnntncnngnnnncgnnncngnnnancnnnngngcnnnnncnnannnnnnnnnnnnancngnncnncannnnnngntntntnnnncnngntgnnntngcnnnnnnncccnncnntnnngnngnnnnnangggnnngggnnncnctnnncccntnngnngnnncnncnttttnnntnnngngggtgngggtnnnnannnngntnangaaantnactcnnnacnncnannannacnnnnngngggnntnntnnnnngngtnnncnnnnngntnnnnntngnncncccggggncngnnagggcncccnngncncccntnntngngngcnncnaaannncccngntntttncnncngnnanntnntncnnnannannntnnnnnangcnnngnnnnnggnnangncnncnagnnnnannntnannagggngnnnnnnnccccnangnngncnnnnanngncnngnncnnnnncnncnncnnngggnnnncnncnnngngggtttnntnnnngnnngntncccgcnnnctnnngnncnngntgnngnnnntgngnnnnnncnnnncnncnnnngncngnnncnngntgnngncgnngannncnncnncnacnnngnagannntnnnnagnntnnncntnagngnnncnncgnnnannancgcnncnnnnacnncgnnncngnnnntnnncnncnnnnngnngtnnacnncncccanncccnnccccnngntnnnntnnnncgnnannngggnnnnnnngnnnnngntnnnngnnntngnnnnnntnnnnnngnnnnnnnnnnnnnnnnngnngcnnnnnnnnaaaannnnngncnccnnnnnngnannnnncnnnnnnncnnnnnngnnnngnnnnngggnggnngggggggttttttgtgctcatatggccccagccgctgctgtctagagtagaaaagaggcgcgcgcatgtttggccgcgacaagattcaaattaaaactcccgcccagattcgtcatatgcgtcaagctggcctggttgtggctgacattcatgacgccctcaaagccgctattgccccnggngtnaccactgcgcagctagacgaggtcagcgcccnngcnatngaaaagggcaaagctaagtcaaacttcctgggctactacggctacccggccacggtgtgcacctcggtgaacgaggagattgtgcatggcatccccggccagcgggtgctgcaagacggtgacctgcttagctgcgactgtggtgcctatgtggaggccgacggcgtgcagtggcatggggacgcggcctttaccgccgtcgtcggcaactacgctagcgaaacggacaagtacctggaccgcaccaccgagcgggcgctgtgggccgccattgccgccctggctgaggcgggggctagcggctggaaggatgcgcgtatcaacctgatcggtgacgccgttgagtcngtanttttcgacgccgcccaagaaaccggtcacgagctgggnatcgtggaggagtatgtgggccacgggatcggcaccaagatgcacatggcccccgacgtactgaactactcggtcagctctaaaggcgtgaagctacaaccgggcatggtgntggcgattgaacccatgatcacngccgggcgcgctagcaangagaccctggangatgagtggactgtggtcacccgtgacggctcacgcgcagctcactgggagcacactgtggcgcttacccctaagggagtgtgggtgctgaccgcacgtgatgggggagcggctgggctggagcctttcggctttgctcccaccccactgtctgcgtgagcactaccaccagtttttcgctggcgcaaggctagctttgtatcacttttgaacggtaaactaaccctctggattcacctatttatgcccttttcggggcgctaccaacagtaagggtggtcccggcgtcgtcaaatcgcggcgctgcgtaacatctagccgacggaggaacatggctaagaaggatggagtcatcgaggtcgagggttcggtcgtcgaggcccttccaaatgcgatgttccgggtggaattggataacggtcacgtcgtgcttgctcacatctcgggcaagatgcgccagcactacatccgtatcctccccgaagaccgcgtggttgtagagctgagcccctatgaccttacccgcggacgcatcgtctaccggtacaagtgacaacccgctcctagttttaggagcggcggaggaagatcatgaaggtcaagccgagcgtcaagaagatctgtgacaactgcaaggtgattcgtcgccacggccgtgtcatggttatctgcgagaaccctcgacacaagcagcgtcagggctgaacctgcgctcagaccgctaagcggtccgtacagcacctatcccacgcgtaatagcgcacccccggttctcggaggccggggcacccgcaaaggggtggaggaataggtgacgacctccgggaaaacacaggagaaccacaaaagtggcacgcatttccggtgttgacctcccgcgcgagaagcgcgtagaggttgcacttacctacatttttgggatcggccgtacccgcgccgatgagactctcaaggccaccggtgtcaacccngacacccgcgtcaaggacctaactgaggaagacctcgtcaagctgcgctctcacatcgacgccaactaccaggttgagggtgacctgcgtcgtgagatccaggctgacattcgccgcaaggtcgagatcggctgctaccagggtctgcgtcaccgccgtcacctgcccgtgcacggccagcgcaccaagaccaacgcgcgcacccgcaagggccccaagcgcaccgttgctggtaagaagaagtaatcagcccccagttaaacctcacgcgaagaaggaattatgcctcccaagagccgcactgctgtgcgtaagccgcgtcgcaaggaccggaagaacattacccacggtcacgcttacattaagtcgaccttcaacaacacnattgtttccctaactgacaccaccggtgcagttattgcctgggcctcctctggccaggt

SEQ ID NO: 1391 - DNA, 4000 bp, Escherichia coli
  misc_feature (1)..(1): n is a, c, g, or t
  misc_feature (3)..(3): n is a, c, g, or t
  misc_feature (8)..(10): n is a, c, g, or t
  misc_feature (13)..(14): n is a, c, g, or t
  misc_feature (20)..(21): n is a, c, g, or t
  misc_feature (27)..(32): n is a, c, g, or t
  misc_feature (41)..(41): n is a, c, g, or t
  misc_feature (43)..(43): n is a, c, g, or t
  misc_feature (46)..(47): n is a, c, g, or t
  misc_feature (49)..(50): n is a, c, g, or t
  misc_feature (56)..(56): n is a, c, g, or t
  misc_feature (70)..(70): n is a, c, g, or t
  misc_feature (92)..(92): n is a, c, g, or t
  misc_feature (106)..(106): n is a, c, g, or t
  misc_feature (115)..(115): n is a, c, g, or t
  misc_feature (205)..(205): n is a, c, g, or t
  misc_feature (211)..(211): n is a, c, g, or t
  misc_feature (268)..(268): n is a, c, g, or t
  misc_feature (331)..(331): n is a, c, g, or t
  misc_feature (385)..(385): n is a, c, g, or t
  misc_feature (400)..(400): n is a, c, g, or t
  misc_feature (415)..(415): n is a, c, g, or t
  misc_feature (424)..(424): n is a, c, g, or t
  misc_feature (445)..(445): n is a, c, g, or t
  misc_feature (451)..(451): n is a, c, g, or t
  misc_feature (509)..(509): n is a, c, g, or t
  misc_feature (511)..(511): n is a, c, g, or t
  misc_feature (514)..(514): n is a, c, g, or t
  misc_feature (613)..(613): n is a, c, g, or t
  misc_feature (622)..(622): n is a, c, g, or t
  misc_feature (631)..(631): n is a, c, g, or t
  misc_feature (703)..(703): n is a, c, g, or t
  misc_feature (730)..(730): n is a, c, g, or t
  misc_feature (775)..(775): n is a, c, g, or t
  misc_feature (808)..(808): n is a, c, g, or t
  misc_feature (811)..(811): n is a, c, g, or t
  misc_feature (877)..(877): n is a, c, g, or t
  misc_feature (940)..(940): n is a, c, g, or t
  misc_feature (952)..(952): n is a, c, g, or t
  misc_feature (958)..(958): n is a, c, g, or t
  misc_feature (967)..(967): n is a, c, g, or t
  misc_feature (994)..(994): n is a, c, g, or t
  misc_feature (1063)..(1063): n is a, c, g, or t
  misc_feature (1068)..(1068): n is a, c, g, or t
  misc_feature (1096)..(1096): n is a, c, g, or t
  misc_feature (1135)..(1135): n is a, c, g, or t
  misc_feature (1140)..(1140): n is a, c, g, or t
  misc_feature (1183)..(1183): n is a, c, g, or t
  misc_feature (1240)..(1240): n is a, c, g, or t
  misc_feature (1988)..(1988): n is a, c, g, or t
  misc_feature (2004)..(2004): n is a, c, g, or t
  misc_feature (2464)..(2464): n is a, c, g, or t
  misc_feature (2613)..(2613): n is a, c, g, or t
  misc_feature (2967)..(2967): n is a, c, g, or t
  misc_feature (2973)..(2973): n is a, c, g, or t
  misc_feature (3000)..(3000): n is a, c, g, or t
  misc_feature (3035)..(3035): n is a, c, g, or t
  misc_feature (3043)..(3043): n is a, c, g, or t
  misc_feature (3085)..(3085): n is a, c, g, or t
  misc_feature (3094)..(3094): n is a, c, g, or t
  misc_feature (3130)..(3130): n is a, c, g, or t
  misc_feature (3142)..(3142): n is a, c, g, or t
  misc_feature (3147)..(3147): n is a, c, g, or t
  misc_feature (3178)..(3178): n is a, c, g, or t
  misc_feature (3202)..(3202): n is a, c, g, or t
  misc_feature (3231)..(3231): n is a, c, g, or t
  misc_feature (3265)..(3265): n is a, c, g, or t
  misc_feature (3277)..(3277): n is a, c, g, or t
  misc_feature (3286)..(3286): n is a, c, g, or t
  misc_feature (3342)..(3342): n is a, c, g, or t
  misc_feature (3347)..(3348): n is a, c, g, or t
  misc_feature (3373)..(3373): n is a, c, g, or t
  misc_feature (3393)..(3393): n is a, c, g, or t
  misc_feature (3395)..(3396): n is a, c, g, or t
  misc_feature (3415)..(3415): n is a, c, g, or t
  misc_feature (3422)..(3423): n is a, c, g, or t
  misc_feature (3425)..(3429): n is a, c, g, or t
  misc_feature (3431)..(3435): n is a, c, g, or t
  misc_feature (3437)..(3438): n is a, c, g, or t
  misc_feature (3440)..(3440): n is a, c, g, or t
  misc_feature (3443)..(3447): n is a, c, g, or t
  misc_feature (3454)..(3459): n is a, c, g, or t
  misc_feature (3462)..(3466): n is a, c, g, or t
  misc_feature (3477)..(3477): n is a, c, g, or t
  misc_feature (3523)..(3523): n is a, c, g, or t
  misc_feature (3541)..(3541): n is a, c, g, or t
  misc_feature (3550)..(3550): n is a, c, g, or t
  misc_feature (3552)..(3552): n is a, c, g, or t
  misc_feature (3872)..(3872): n is a, c, g, or t
  misc_feature (3881)..(3881): n is a, c, g, or t
  misc_feature (3911)..(3911): n is a, c, g, or t
  misc_feature (3944)..(3944): n is a, c, g, or t
  misc_feature (3953)..(3953): n is a, c, g, or t
  misc_feature (3957)..(3957): n is a, c, g, or t
  misc_feature (3980)..(3980): n is a, c, g, or t
ntnaaaannntannaattannaaatannnnnnataataaantngannannaaaaangggcgtatagcccnttctttacaacatccaaaaaantctagaacggaacncgtttatantcacgatattctggtttccagaagttctgttcaatactttctagcaattgctcatcactgatcatcggtgctacaccatcttgaatagcngctttngcaactttaaacgcgataattttagatacttgctgcaattcatttaaatcaggcaanaaatctgcgtggatatcttgcaacttcggtgaacaatcggccaaagctgaacttgaagccatnaacatattgtctgtaacacgggttgcttgaactgctaccacacccaaaccaatnccagggaagatatangagttattgcactgngaaatctgntaggtttcaccatgataattnacaggngtaaatgggctgcctgtcgcaatcaatgctttaccatctgtccattgaataatatcancnggnacggcttcaactcgtgaagttgggttggataaaggcaatacaatcggatattcacagttttcagccagcgttttaatgatttcttctgtaaataaaccnggttgaccngataccccnatcaatacggttggtttggcatttttcacaacatcaagcagtgaaatgatttcctcagcattgccccaatgngcaacatcttcaggtttctgcgcaagnttacgttggaaatctaataagtttggctgattttcagtgattaanccaaaacgatccaccataaatactttggcacgngcntcagcatccgtcagcccttcagcaaccatctgtgcaataatttgttctgcaataccacaacctgcngaaccagcccctaagaaggtaattttctggtctttgagctgtttacctgcggctctactcgcngcaattaaagtnccgacncaaactgcngctgttccttgaatatcgtcattaaancaacaaatcttatcacggtatttttcaagtaaaggcatggcatttttttgcgcaaaatcttcgaattgnatcantgcttttggccaacgacgtttaaccgcngcaatcacttcatcgacaaattcatagtattcatccccnctganacgaggttgcgaccatcccatataaatcgggtcattcaataantgttgattattggttcccacatcaatggtaatcggcaatgtataggctggactaatnccaccacatgcggtgtaaagagacagttttccaattggaatgcccataccgccaataccttggtcgcctaaaccaagaatacgctcaccatctgtgatcacaatcactttgacatttttacggtttacgttgtgaatgatttcatcaatgtatttacggtcaggataggaaagaaatactccacgatgacggcgataaatatcggagaaacgctgacatgcttcacccactgtcggtgtatagataatcggcatcatctcacttaagtggttttcaatcaggtggtaaaacagcgtttcattggtgtcttgaatatttcgtaaataaatatgcttattgatcgcttcactgaaagaacagaactgttggtatgaacgttgactttgttcctcgatactttcgatcacatgaggaattaaaccgtgtaagttaaattgagttcgttcttcttctgtgaaggctgaacctttatttaataaaggcagctctaataaggcattacctgcataatgaatatatagaggatattttttcagggtttccgttggcatttccattctcattgaagcagactgcctgcttctatcttttgctaagctacgactttggtctgatacaagcttaagcctatttttgactaaatgggtatttagatacgtgataatgatattcaaagtattttacagaatgataaattattctcagttttactgatcaaattctcgtttttatgcaatttaatattttnccataaaataatgagncatgatcccgccattaaaactgcatatttgtacgcaattttgaccaatcattgattttttttctgtttagatttattttgtttaaaatacgatgaagctaaaccaataacaatgaacacaaagatctctctactccttcttagcacagtcattgcatgtactggctgccaaactgcaaaaaaagtctcttctggtgtttctaaaaccactgaaaaagtcaaaagtatggtgggcttaggcgaagccaaagttccagaagttgatcaacaaggtgtggttgatgtcagtaaagccaccctcgaaaaactagaacaaatgaagatcaatatgcccactggacaatgggtctatattgaaaatgatcttcaaggtatttacaccttacaaaacaaatccagtgatggaaacgtcctatatttgcgtttgaattgtaagattccttcgcagaagtctggttttncgattgaagataaagatggtaaagagctgcttaaagcacatgatgcgcaaaccggtcaggttcaattcttaatcgacaataaaaactatggcaatccatttgacttagtcaatgcgaaaaaaatgccgacatttaaaacggcactgagnaaagccaaagtgattaaaatctttaacaattccaaactttatacctttacaaatggccatgctgaattgcttagcaagcctgtcacatgtaaagagtagatccattatttaggcatatccacaaatacggcggttaaacgtcgtactaagggtaaaacaatcagaaccacaggatatgccacagcccatgataccatccatgcagcaagccatttgacccaaaatccgttaatcaaacccacattgatcaacatattaatcaatgacaccatgccactcattaaacaagataagaacaacggcataatccatgctgcaaattttgcagggagttttgggatattgccaataatngtgggnggagtatttgacatatatcgctctaantttaccaacaggacacattttattcttttaatggncctgaaanaattaatccttccacataacatcggccacattttgccatttnatttgattngacaaatttaaaggctgatcatagagctcagatatnacattgattgcntcatngagtgaaataattgaatttaaagggagccangtgtcatcaccaacatcaaataangctaagttcagatcttcattgcaagacanccacgactcaccttgttggacagtagggatattnttatcgtaacgnaaaatcaantgagtcgtatctacccaccaaaacaataaaatgatctgaccttgttttggcatatntagcnnaagataacctgaatttgaatattcnaagtctgtggcctgaatctncnnaaacaactgtataacttgntcttttnnannnnntnnnnntnnanttnnnnnaaaaaannnnnnaannnnnttttttatccngtgattaaagcagtgtaatccgtcaagtccatttgaaatctaaacnccaatacacagtgaaatngagcatacngncatttttcttatcgaataagttttattctatacaaatgcattcacctaaaaggcgcaaaatttgctatatttagcgtttttctgcgacatttatttctctatagattatgaatacggccatacaagcagctcttgatcatgcagtgcaatccctacaagctgaagggactcttccatctgactggaaaaacacgagtgttttaacgcgaactaaagaccgaagccacggtgatttcgcatcaaacattgccatgatgggcgctaaagttgctggtatgaaaccacgtgatcttgcagagaaaattttggcaaatttaccngaagtggtngatattgccaaagctgaaattgcgggtccnggttttatcaacttctttttaaatgccgatcancgctttacngtgntggatcagatccaagcacaaaangaacaatttggtaaaaccca

SEQ ID NO: 1392 - DNA, 4000 bp, Escherichia coli
  misc_feature (1)..(3): n is a, c, g, or t
  misc_feature (5)..(10): n is a, c, g, or t
  misc_feature (12)..(13): n is a, c, g, or t
  misc_feature (15)..(16): n is a, c, g, or t
  misc_feature (18)..(18): n is a, c, g, or t
  misc_feature (21)..(22): n is a, c, g, or t
  misc_feature (24)..(25): n is a, c, g, or t
  misc_feature (27)..(30): n is a, c, g, or t
  misc_feature (33)..(35): n is a, c, g, or t
  misc_feature (37)..(42): n is a, c, g, or t
  misc_feature (44)..(47): n is a, c, g, or t
  misc_feature (49)..(54): n is a, c, g, or t
  misc_feature (58)..(61): n is a, c, g, or t
  misc_feature (63)..(70): n is a, c, g, or t
  misc_feature (72)..(78): n is a, c, g, or t
  misc_feature (80)..(81): n is a, c, g, or t
  misc_feature (83)..(94): n is a, c, g, or t
  misc_feature (96)..(107): n is a, c, g, or t
  misc_feature (109)..(111): n is a, c, g, or t
  misc_feature (113)..(113): n is a, c, g, or t
  misc_feature (115)..(117): n is a, c, g, or t
  misc_feature (120)..(123): n is a, c, g, or t
  misc_feature (125)..(135): n is a, c, g, or t
  misc_feature (137)..(137): n is a, c, g, or t
  misc_feature (139)..(141): n is a, c, g, or t
  misc_feature (143)..(144): n is a, c, g, or t
  misc_feature (146)..(147): n is a, c, g, or t
  misc_feature (149)..(154): n is a, c, g, or t
  misc_feature (156)..(165): n is a, c, g, or t
  misc_feature (167)..(169): n is a, c, g, or t
  misc_feature (171)..(174): n is a, c, g, or t
  misc_feature (176)..(177): n is a, c, g, or t
  misc_feature (179)..(179): n is a, c, g, or t
  misc_feature (181)..(187): n is a, c, g, or t
  misc_feature (189)..(192): n is a, c, g, or t
  misc_feature (196)..(196): n is a, c, g, or t
  misc_feature (198)..(198): n is a, c, g, or t
  misc_feature (200)..(202): n is a, c, g, or t
  misc_feature (204)..(204): n is a, c, g, or t
  misc_feature (207)..(209): n is a, c, g, or t
  misc_feature (213)..(215): n is a, c, g, or t
  misc_feature (217)..(217): n is a, c, g, or t
  misc_feature (219)..(219): n is a, c, g, or t
  misc_feature (226)..(230): n is a, c, g, or t
  misc_feature (232)..(232): n is a, c, g, or t
  misc_feature (234)..(234): n is a, c, g, or t
  misc_feature (237)..(237): n is a, c, g, or t
  misc_feature (242)..(243): n is a, c, g, or t
  misc_feature (246)..(248): n is a, c, g, or t
  misc_feature (252)..(253): n is a, c, g, or t
  misc_feature (255)..(258): n is a, c, g, or t
  misc_feature (261)..(262): n is a, c, g, or t
  misc_feature (264)..(267): n is a, c, g, or t
  misc_feature (269)..(269): n is a, c, g, or t
  misc_feature (271)..(271): n is a, c, g, or t
  misc_feature (273)..(275): n is a, c, g, or t
  misc_feature (277)..(279): n is a, c, g, or t
  misc_feature (281)..(281): n is a, c, g, or t
  misc_feature (284)..(284): n is a, c, g, or t
  misc_feature (286)..(287): n is a, c, g, or t
  misc_feature (289)..(291): n is a, c, g, or t
  misc_feature (294)..(294): n is a, c, g, or t
  misc_feature (299)..(303): n is a, c, g, or t
  misc_feature (307)..(310): n is a, c, g, or t
  misc_feature (313)..(320): n is a, c, g, or t
  misc_feature (322)..(322): n is a, c, g, or t
  misc_feature (325)..(325): n is a, c, g, or t
  misc_feature (327)..(329): n is a, c, g, or t
  misc_feature (336)..(337): n is a, c, g, or t
  misc_feature (339)..(339): n is a, c, g, or t
  misc_feature (344)..(356): n is a, c, g, or t
  misc_feature (359)..(362): n is a, c, g, or t
  misc_feature (364)..(365): n is a, c, g, or t
  misc_feature (367)..(368): n is a, c, g, or t
  misc_feature (370)..(371): n is a, c, g, or t
  misc_feature (373)..(376): n is a, c, g, or t
  misc_feature (378)..(378): n is a, c, g, or t
  misc_feature (381)..(386): n is a, c, g, or t
  misc_feature (388)..(394): n is a, c, g, or t
  misc_feature (396)..(397): n is a, c, g, or t
  misc_feature (400)..(406): n is a, c, g, or t
  misc_feature (408)..(409): n is a, c, g, or t
  misc_feature (411)..(412): n is a, c, g, or t
  misc_feature (415)..(419): n is a, c, g, or t
  misc_feature (422)..(427): n is a, c, g, or t
  misc_feature (430)..(432): n is a, c, g, or t
  misc_feature (435)..(435): n is a, c, g, or t
  misc_feature (438)..(439): n is a, c, g, or t
  misc_feature (442)..(442): n is a, c, g, or t
  misc_feature (444)..(447): n is a, c, g, or t
  misc_feature (449)..(449): n is a, c, g, or t
  misc_feature (451)..(451): n is a, c, g, or t
  misc_feature (454)..(457): n is a, c, g, or t
  misc_feature (461)..(470): n is a, c, g, or t
  misc_feature (472)..(476): n is a, c, g, or t
  misc_feature (478)..(486): n is a, c, g, or t
  misc_feature (488)..(490): n is a, c, g, or t
  misc_feature (492)..(494): n is a, c, g, or t
  misc_feature (496)..(497): n is a, c, g, or t
  misc_feature (500)..(500): n is a, c, g, or t
  misc_feature (502)..(504): n is a, c, g, or t
  misc_feature (506)..(511): n is a, c, g, or t
  misc_feature (514)..(514): n is a, c, g, or t
  misc_feature (517)..(517): n is a, c, g, or t
  misc_feature (520)..(525): n is a, c, g, or t
  misc_feature (527)..(539): n is a, c, g, or t
  misc_feature (542)..(542): n is a, c, g, or t
  misc_feature (546)..(547): n is a, c, g, or t
  misc_feature (552)..(552): n is a, c, g, or t
  misc_feature (555)..(559): n is a, c, g, or t
  misc_feature (561)..(562): n is a, c, g, or t
  misc_feature (564)..(575): n is a, c, g, or t
  misc_feature (577)..(577): n is a, c, g, or t
  misc_feature (579)..(579): n is a, c, g, or t
  misc_feature (583)..(583): n is a, c, g, or t
  misc_feature (585)..(586): n is a, c, g, or t
  misc_feature (588)..(591): n is a, c, g, or t
  misc_feature (593)..(595): n is a, c, g, or t
  misc_feature (597)..(597): n is a, c, g, or t
  misc_feature (599)..(602): n is a, c, g, or t
  misc_feature (606)..(608): n is a, c, g, or t
  misc_feature (610)..(611): n is a, c, g, or t
  misc_feature (613)..(620): n is a, c, g, or t
  misc_feature (622)..(626): n is a, c, g, or t
  misc_feature (632)..(634): n is a, c, g, or t
  misc_feature (636)..(636): n is a, c, g, or t
  misc_feature (638)..(638): n is a, c, g, or t
  misc_feature (640)..(641): n is a, c, g, or t
  misc_feature (643)..(644): n is a, c, g, or t
  misc_feature (646)..(651): n is a, c, g, or t
  misc_feature (653)..(655): n is a, c, g, or t
  misc_feature (658)..(661): n is a, c, g, or t
  misc_feature (665)..(666): n is a, c, g, or t
  misc_feature (669)..(671): n is a, c, g, or t
  misc_feature (674)..(674): n is a, c, g, or t
  misc_feature (679)..(680): n is a, c, g, or t
  misc_feature (682)..(683): n is a, c, g, or t
  misc_feature (687)..(693): n is a, c, g, or t
  misc_feature (695)..(704): n is a, c, g, or t
  misc_feature (706)..(709): n is a, c, g, or t
  misc_feature (711)..(711): n is a, c, g, or t
  misc_feature (714)..(714): n is a, c, g, or t
  misc_feature (716)..(721): n is a, c, g, or t
  misc_feature (723)..(723): n is a, c, g, or t
  misc_feature (725)..(725): n is a, c, g, or t
  misc_feature (727)..(727): n is a, c, g, or t
  misc_feature (729)..(737): n is a, c, g, or t
  misc_feature (739)..(739): n is a, c, g, or t
  misc_feature (741)..(746): n is a, c, g, or t
  misc_feature (749)..(764): n is a, c, g, or t
  misc_feature (767)..(767): n is a, c, g, or t
  misc_feature (769)..(769): n is a, c, g, or t
  misc_feature (771)..(772): n is a, c, g, or t
  misc_feature (774)..(775): n is a, c, g, or t
  misc_feature (777)..(777): n is a, c, g, or t
  misc_feature (779)..(779): n is a, c, g, or t
  misc_feature (781)..(781): n is a, c, g, or t
  misc_feature (783)..(783): n is a, c, g, or t
  misc_feature (785)..(785): n is a, c, g, or t
  misc_feature (787)..(788): n is a, c, g, or t
  misc_feature (790)..(790): n is a, c, g, or t
  misc_feature (792)..(793): n is a, c, g, or t
  misc_feature (796)..(796): n is a, c, g, or t
  misc_feature (798)..(801): n is a, c, g, or t
  misc_feature (808)..(813): n is a, c, g, or t
  misc_feature (817)..(818): n is a, c, g, or t
  misc_feature (820)..(820): n is a, c, g, or t
  misc_feature (822)..(823): n is a, c, g, or t
  misc_feature (829)..(829): n is a, c, g, or t
  misc_feature (835)..(837): n is a, c, g, or t
  misc_feature (839)..(839): n is a, c, g, or t
  misc_feature (841)..(843): n is a, c, g, or t
  misc_feature (845)..(845): n is a, c, g, or t
  misc_feature (847)..(847): n is a, c, g, or t
  misc_feature (849)..(851): n is a, c, g, or t
  misc_feature (855)..(856): n is a, c, g, or t
  misc_feature (858)..(859): n is a, c, g, or t
  misc_feature (861)..(863): n is a, c, g, or t
  misc_feature (865)..(865): n is a, c, g, or t
  misc_feature (869)..(869): n is a, c, g, or t
  misc_feature (872)..(872): n is a, c, g, or t
  misc_feature (875)..(875): n is a, c, g, or t
  misc_feature (878)..(878): n is a, c, g, or t
  misc_feature (880)..(882): n is a, c, g, or t
  misc_feature (884)..(890): n is a, c, g, or t
  misc_feature (892)..(895): n is a, c, g, or t
  misc_feature (897)..(897): n is a, c, g, or t
  misc_feature (899)..(902): n is a, c, g, or t
  misc_feature (1019)..(1019): n is a, c, g, or t
  misc_feature (1028)..(1028): n is a, c, g, or t
  misc_feature (1052)..(1052): n is a, c, g, or t
  misc_feature (1397)..(1397): n is a, c, g, or t
  misc_feature (1409)..(1409): n is a, c, g, or t
  misc_feature (1803)..(1803): n is a, c, g, or t
  misc_feature (1865)..(1865): n is a, c, g, or t
nnntnnnnnncnncnncnccnncnncnnnnccnnnannnnnncnnnngnnnnnncaannnntnnnnnnnncnnnnnnncnncnnnnnnnnnnnncnnnnnnnnnnnncnnngnannnccnnnngnnnnnnnnnnnanannncnncnnannnnnntnnnnnnnnnnannncnnnnannangnnnnnnngnnnnaaanantnnnanaannntttnnnananatttttnnnnnantnttnttttnnttnnntttnntnnnnttnntnnnntntntnnntnnntnttntnnannnccnttttnnnnntctnnnnttnnnnnnnntnttntnnnttttttnnanttttnnnnnnnnnnnnncannnntnntnntnntnnnntnatnnnnnncnnnnnnncnncannnnnnncnnannaannnnngannnnnnatnnnatnatnntantnnnnanangannnnccannnnnnnnnncnnnnntnnnnnnnnncnnnannntnncgncnnnannnnnnttnttnttnnnnnngnnnnnnnnnnnnngangacnnctccnccnnnnntnntnnnnnnnnnnnncnantagnannannnnannntntnnnntatnnnanntnnnnnnnntnnnnnaataannnantnannanntnnnnnncnnngtnnnnacannacnnnttnttatnntnntggnnnnnnngnnnnnnnnnnannnntnctncnnnnnntngntnannnnnnnnncntnnnnnnagnnnnnnnnnnnnnnnnttntnannannantntnananannanannaangnnnntcttgtnnnnnncagnncnanntgttcnaattgnnnanannncntnannnccannanntnnnanaaanatnaanaangnnnannnnnnncnnnntntnnnnccggtcaacccggtcaacaacgacggcaacgacggcgacggtgtacaagtccccatccatcacgcacaagctgtgcagggtgctgatggcggcatcagcctcaaagtcgaacaaacnaaactaccngagttttggggacagaaggaaaangactccattaccgccaatgcgtttatccaaagagtcgacaacatgatggccgccaacaattggtccgaccatgtcacattccgcaacttcgccttggttctaagaggctccgccgacatctggctgaagtcccaagaaattctggaggacatcacgggtgatcgccggctctggactattgtcagacccctttttaaggcagaatttgctattgaatcagacgacaaacgcatcttggacggtttggctcacctggcgatgaaaccttctgaaaatgtcagggactactttgggcgcctcagcatcgttaatcaaatcatcatggaggcctacgactcctacacngtgttgcccgangaacctgtgctaaccggcaacgtccagaacgacaccgtgtctatgagggcccatgtcagagccagcaacctaaacttggctaaattctttctcctcaaccatttccgggcaggtcttccaacagagctacggagagtcctcaatctccagaacgaggacgaactaaagctaaacgccgccgtcaagctggccaccatcgaggccagatcacgtgaagagtccaaatgccaaaccaaaatttacgccacggaggtttcggagaaccacgaaccacagatcgaggccgttcgtcaaaaccagaattggaggtcgtccaaccaaaaccaataccggcctcagaatcgcaatcaaaatcaacaacaaaaatcgaataaccaatcctggaggcaaggtncaggcaacaattctaacaagaacgggcagacgtgcattttctgcaagagacaaggtcaccgncaagaagagtgccgcaagcgtcaaaaagccaacaagccttgtctggactccaacggtcgtgcgttctggcccaaggtcaacaccacggaggccaacccgactaacaacgtggacgtcccctctttctcgttccaggattttcagtgaagagcttgatggaacccctacgtcaagctcctcaagtcattcctcagctgattttgagtttgtgtgccatctctgtcgtgacattcaataaactttcagaagtaatgacgcctttttatgggggaaacaaaaatcgacctagaattaacgtaaccacgggtgagaaaacttttaactggctatttgatactggggctgcagtcacttgcatgaatgcaaacagttttaaagaagctttttcgggaaaacgacctaagctattacataaaggaacaagctgtgttgccgctaacggatcaaaaatgaactctttgggtgtgtttgagctaccaatgacaataaggggcagaagttttttgcatccagtgactgttgttgaaaacatcaatgacaacatcattggcattgacttcatgcatgcaaacagaatgaattacgatgctgcttccaagcaaatcacatttgctcacatgcttaccaatgccctttactcactcaaagagaccacaattccggccctatcaaccatgattattcaagctaaatttaagggtaacatctgcaacactgctagccctatagccacaatccatgcacccacaaatcctacaatctcagggatgcccgctttggttacactagataagtatcggaactgcaaattggtcatcgacaattgtgctccttatgaagttactcttgccagaaatgaggtactaggagtattggagttcgaaccagacaaatgcattcccttaaacgaaaaaacaatctctgcgttggtttcagacattgctggtcaattacctaaagtgccaaaaagaaagtttacccgtcaagaaatcgaacaaaaagctaatctcaaagtgcctgaacaatttaaagcaaaatacttggacattctctataaacaccaagacgccattagcatcaacaagttcgatctgggtagagctaaaaatttcacacacaaaatttttctcaaggatgataatccggtctacagaaaacagtttaaaataccggaagctcaccaaactttcatagaagcaacactcgatgaatggttgaaacttggagtggtaaaacgaaccaactcactttacaactctccagttttctgtgtacctaaaaaacaaggtcaaggactcagaattgttcaagattttagagagcttaacaaccattctcacattgacaaatacagcatgaaagagatcacggagtgtatcggagacattggcagagcaaattcgaccattttttcaaccctggacttaacttctggtttttggcaaatgaagttagaagaaaaatcgcagccactcactgcttttacaattccgggtaaaggtcaatttgcatgggtcacttcgccaatgggcttactaggatgtccagcaagctttcaacgacttatggaagcggtgctgagaaacattaaaaatgtccttgtttacattgacgatctcctgatacatacagccacgcatgaggagcatttaaaagttttggaacaagtgtttgaaagattacatcaaaaccatttgaaaatcaatctcgacaaatgtgtatttggcaacaaagaagtctcctatttaggttttaccttgacacctgaaggtatcaaacctggtcgcaacaagcttcaagcgatcaaggacgccaaaccaccgacaacaatcaaaatggttagatcttttgttggactctgcaatttttttagaacacacataaaagattttgcaattattgctgctccacttttccaagtcactagaaaggattctgggtacaagtctggccctttaccaccagcagccttacaatctttcaaaatcctacaacagcagcttacctctgatcctgtcatggctttcccacgaatggaccggcaatatgctctcatcacagatgctgccacagggacggctgacactcctggaggcatgggagcaattctcacccaaattgacaaggatggtaat

SEQ ID NO: 1393 - DNA, 4000 bp, Escherichia coli
  misc_feature (3)..(3): n is a, c, g, or t
  misc_feature (6)..(6): n is a, c, g, or t
  misc_feature (9)..(10): n is a, c, g, or t
  misc_feature (12)..(12): n is a, c, g, or t
  misc_feature (14)..(14): n is a, c, g, or t
  misc_feature (16)..(17): n is a, c, g, or t
  misc_feature (19)..(20): n is a, c, g, or t
  misc_feature (22)..(27): n is a, c, g, or t
  misc_feature (29)..(31): n is a, c, g, or t
  misc_feature (35)..(35): n is a, c, g, or t
  misc_feature (39)..(39): n is a, c, g, or t
  misc_feature (41)..(42): n is a, c, g, or t
  misc_feature (45)..(45): n is a, c, g, or t
  misc_feature (49)..(49): n is a, c, g, or t
  misc_feature (57)..(58): n is a, c, g, or t
  misc_feature (63)..(64): n is a, c, g, or t
  misc_feature (66)..(66): n is a, c, g, or t
  misc_feature (69)..(71): n is a, c, g, or t
  misc_feature (73)..(73): n is a, c, g, or t
  misc_feature (75)..(75): n is a, c, g, or t
  misc_feature (77)..(77): n is a, c, g, or t
  misc_feature (79)..(80): n is a, c, g, or t
  misc_feature (83)..(83): n is a, c, g, or t
  misc_feature (85)..(85): n is a, c, g, or t
  misc_feature (88)..(88): n is a, c, g, or t
  misc_feature (90)..(90): n is a, c, g, or t
  misc_feature (92)..(92): n is a, c, g, or t
  misc_feature (95)..(98): n is a, c, g, or t
  misc_feature (100)..(106): n is a, c, g, or t
  misc_feature (108)..(110): n is a, c, g, or t
  misc_feature (116)..(116): n is a, c, g, or t
  misc_feature (118)..(121): n is a, c, g, or t
  misc_feature (124)..(126): n is a, c, g, or t
  misc_feature (128)..(128): n is a, c, g, or t
  misc_feature (130)..(132): n is a, c, g, or t
  misc_feature (135)..(135): n is a, c, g, or t
  misc_feature (143)..(143): n is a, c, g, or t
  misc_feature (145)..(146): n is a, c, g, or t
  misc_feature (151)..(151): n is a, c, g, or t
  misc_feature (153)..(156): n is a, c, g, or t
  misc_feature (158)..(158): n is a, c, g, or t
  misc_feature (163)..(163): n is a, c, g, or t
  misc_feature (167)..(167): n is a, c, g, or t
  misc_feature (173)..(174): n is a, c, g, or t
  misc_feature (176)..(176): n is a, c, g, or t
  misc_feature (183)..(183): n is a, c, g, or t
  misc_feature (186)..(186): n is a, c, g, or t
  misc_feature (188)..(189): n is a, c, g, or t
  misc_feature (191)..(191): n is a, c, g, or t
  misc_feature (194)..(194): n is a, c, g, or t
  misc_feature (199)..(199): n is a, c, g, or t
  misc_feature (201)..(202): n is a, c, g, or t
  misc_feature (204)..(204): n is a, c, g, or t
  misc_feature (208)..(208): n is a, c, g, or t
  misc_feature (210)..(211): n is a, c, g, or t
  misc_feature (214)..(214): n is a, c, g, or t
  misc_feature (216)..(216): n is a, c, g, or t
  misc_feature (218)..(218): n is a, c, g, or t
  misc_feature (220)..(224): n is a, c, g, or t
  misc_feature (226)..(227): n is a, c, g, or t
  misc_feature (230)..(230): n is a, c, g, or t
  misc_feature (232)..(233): n is a, c, g, or t
  misc_feature (236)..(237): n is a, c, g, or t
  misc_feature (239)..(239): n is a, c, g, or t
  misc_feature (241)..(241): n is a, c, g, or t
  misc_feature (245)..(245): n is a, c, g, or t
  misc_feature (247)..(255): n is a, c, g, or t
  misc_feature (257)..(257): n is a, c, g, or t
  misc_feature (260)..(261): n is a, c, g, or t
  misc_feature (263)..(264): n is a, c, g, or t
  misc_feature (268)..(271): n is a, c, g, or t
  misc_feature (275)..(275): n is a, c, g, or t
  misc_feature (278)..(278): n is a, c, g, or t
  misc_feature (281)..(281): n is a, c, g, or t
  misc_feature (283)..(286): n is a, c, g, or t
  misc_feature (290)..(290): n is a, c, g, or t
  misc_feature (292)..(294): n is a, c, g, or t
  misc_feature (296)..(298): n is a, c, g, or t
  misc_feature (301)..(310): n is a, c, g, or t
  misc_feature (315)..(316): n is a, c, g, or t
  misc_feature (318)..(319): n is a, c, g, or t
  misc_feature (321)..(321): n is a, c, g, or t
  misc_feature (325)..(325): n is a, c, g, or t
  misc_feature (327)..(327): n is a, c, g, or t
  misc_feature (329)..(331): n is a, c, g, or t
  misc_feature (333)..(336): n is a, c, g, or t
  misc_feature (338)..(338): n is a, c, g, or t
  misc_feature (342)..(343): n is a, c, g, or t
  misc_feature (345)..(345): n is a, c, g, or t
  misc_feature (347)..(347): n is a, c, g, or t
  misc_feature (350)..(352): n is a, c, g, or t
  misc_feature (355)..(355): n is a, c, g, or t
  misc_feature (357)..(357): n is a, c, g, or t
  misc_feature (359)..(360): n is a, c, g, or t
  misc_feature (363)..(365): n is a, c, g, or t
  misc_feature (367)..(367): n is a, c, g, or t
  misc_feature (370)..(370): n is a, c, g, or t
  misc_feature (375)..(376): n is a, c, g, or t
  misc_feature (379)..(379): n is a, c, g, or t
  misc_feature (384)..(385): n is a, c, g, or t
  misc_feature (389)..(390): n is a, c, g, or t
  misc_feature (392)..(393): n is a, c, g, or t
  misc_feature (395)..(395): n is a, c, g, or t
  misc_feature (397)..(397): n is a, c, g, or t
  misc_feature (399)..(405): n is a, c, g, or t
  misc_feature (407)..(409): n is a, c, g, or t
  misc_feature (411)..(412): n is a, c, g, or t
  misc_feature (414)..(416): n is a, c, g, or t
  misc_feature (418)..(418): n is a, c, g, or t
  misc_feature (421)..(422): n is a, c, g, or t
  misc_feature (425)..(427): n is a, c, g, or t
  misc_feature (430)..(431): n is a, c, g, or t
  misc_feature (437)..(437): n is a, c, g, or t
  misc_feature (439)..(439): n is a, c, g, or t
  misc_feature (441)..(441): n is a, c, g, or t
  misc_feature (443)..(443): n is a, c, g, or t
  misc_feature (445)..(447): n is a, c, g, or t
  misc_feature (449)..(450): n is a, c, g, or t
  misc_feature (454)..(455): n is a, c, g, or t
  misc_feature (458)..(463): n is a, c, g, or t
  misc_feature (465)..(467): n is a, c, g, or t
  misc_feature (469)..(469): n is a, c, g, or t
  misc_feature (472)..(476): n is a, c, g, or t
  misc_feature (481)..(482): n is a, c, g, or t
  misc_feature (484)..(487): n is a, c, g, or t
  misc_feature (491)..(494): n is a, c, g, or t
  misc_feature (496)..(498): n is a, c, g, or t
  misc_feature (504)..(505): n is a, c, g, or t
  misc_feature (509)..(509): n is a, c, g, or t
  misc_feature (511)..(511): n is a, c, g, or t
  misc_feature (515)..(520): n is a, c, g, or t
  misc_feature (527)..(530): n is a, c, g, or t
  misc_feature (532)..(532): n is a, c, g, or t
  misc_feature (536)..(536): n is a, c, g, or t
  misc_feature (538)..(538): n is a, c, g, or t
  misc_feature (541)..(542): n is a, c, g, or t
  misc_feature (544)..(544): n is a, c, g, or t
  misc_feature (546)..(547): n is a, c, g, or t
  misc_feature (550)..(552): n is a, c, g, or t
  misc_feature (554)..(554): n is a, c, g, or t
  misc_feature (556)..(558): n is a, c, g, or t
  misc_feature (561)..(562): n is a, c, g, or t
  misc_feature (564)..(568): n is a, c, g, or t
  misc_feature (570)..(572): n is a, c, g, or t
  misc_feature (574)..(578): n is a, c, g, or t
  misc_feature (581)..(582): n is a, c, g, or t
  misc_feature (584)..(584): n is a, c, g, or t
  misc_feature (588)..(596): n is a, c, g, or t
  misc_feature (599)..(601): n is a, c, g, or t
  misc_feature (604)..(605): n is a, c, g, or t
  misc_feature (608)..(611): n is a, c, g, or t
  misc_feature (614)..(617): n is a, c, g, or t
  misc_feature (619)..(620): n is a, c, g, or t
  misc_feature (622)..(629): n is a, c, g, or t
  misc_feature (632)..(632): n is a, c, g, or t
  misc_feature (636)..(636): n is a, c, g, or t
  misc_feature (639)..(640): n is a, c, g, or t
  misc_feature (644)..(644): n is a, c, g, or t
  misc_feature (649)..(649): n is a, c, g, or t
  misc_feature (651)..(651): n is a, c, g, or t
  misc_feature (653)..(653): n is a, c, g, or t
  misc_feature (657)..(663): n is a, c, g, or t
  misc_feature (666)..(666): n is a, c, g, or t
  misc_feature (669)..(672): n is a, c, g, or t
  misc_feature (674)..(679): n is a, c, g, or t
  misc_feature (681)..(682): n is a, c, g, or t
  misc_feature (685)..(688): n is a, c, g, or t
  misc_feature (690)..(693): n is a, c, g, or t
  misc_feature (696)..(697): n is a, c, g, or t
  misc_feature (700)..(701): n is a, c, g, or t
  misc_feature (705)..(705): n is a, c, g, or t
  misc_feature (709)..(713): n is a, c, g, or t
  misc_feature (716)..(716): n is a, c, g, or t
  misc_feature (719)..(719): n is a, c, g, or t
  misc_feature (722)..(723): n is a, c, g, or t
  misc_feature (725)..(729): n is a, c, g, or t
  misc_feature (731)..(731): n is a, c, g, or t
  misc_feature (733)..(739): n is a, c, g, or t
  misc_feature (742)..(747): n is a, c, g, or t
  misc_feature (750)..(750): n is a, c, g, or t
  misc_feature (752)..(752): n is a, c, g, or t
  misc_feature (754)..(755): n is a, c, g, or t
  misc_feature (758)..(760): n is a, c, g, or t
  misc_feature (762)..(762): n is a, c, g, or t
  misc_feature (764)..(766): n is a, c, g, or t
  misc_feature (768)..(768): n is a, c, g, or t
  misc_feature (771)..(775): n is a, c, g, or t
  misc_feature (777)..(780): n is a, c, g, or t
  misc_feature (782)..(786): n is a, c, g, or t
  misc_feature (789)..(789): n is a, c, g, or t
  misc_feature (792)..(793): n is a, c, g, or t
  misc_feature (795)..(797): n is a, c, g, or t
  misc_feature (802)..(803): n is a, c, g, or t
  misc_feature (807)..(810): n is a, c, g, or t
  misc_feature (812)..(813): n is a, c, g, or t
  misc_feature (815)..(817): n is a, c, g, or t
  misc_feature (820)..(822): n is a, c, g, or t
  misc_feature (825)..(828): n is a, c, g, or t
  misc_feature (830)..(832): n is a, c, g, or t
  misc_feature (834)..(834): n is a, c, g, or t
  misc_feature (837)..(838): n is a, c, g, or t
  misc_feature (841)..(841): n is a, c, g, or t
  misc_feature (843)..(843): n is a, c, g, or t
  misc_feature (845)..(845): n is a, c, g, or t
  misc_feature (849)..(850): n is a, c, g, or t
  misc_feature (852)..(852): n is a, c, g, or t
  misc_feature (856)..(856): n is a, c, g, or t
  misc_feature (858)..(858): n is a, c, g, or t
  misc_feature (860)..(860): n is a, c, g, or t
  misc_feature (862)..(862): n is a, c, g, or t
  misc_feature (864)..(864): n is a, c, g, or t
  misc_feature (867)..(867): n is a, c, g, or t
  misc_feature (869)..(871): n is a, c, g, or t
  misc_feature (876)..(877): n is a, c, g, or t
  misc_feature (879)..(879): n is a, c, g, or t
  misc_feature (882)..(884): n is a, c, g, or t
  misc_feature (891)..(891): n is a, c, g, or t
  misc_feature (893)..(894): n is a, c, g, or t
  misc_feature (897)..(899): n is a, c, g, or t
  misc_feature (901)..(909): n is a, c, g, or t
  misc_feature (912)..(912): n is a, c, g, or t
  misc_feature (914)..(916): n is a, c, g, or t
  misc_feature (918)..(924): n is a, c, g, or t
  misc_feature (930)..(931): n is a, c, g, or t
  misc_feature (933)..(934): n is a, c, g, or t
  misc_feature (936)..(938): n is a, c, g, or t
  misc_feature (940)..(940): n is a, c, g, or t
  misc_feature (942)..(942): n is a, c, g, or t
  misc_feature (946)..(951): n is a, c, g, or t
  misc_feature (953)..(955): n is a, c, g, or t
  misc_feature (957)..(959): n is a, c, g, or t
  misc_feature (961)..(962): n is a, c, g, or t
  misc_feature (964)..(964): n is a, c, g, or t
  misc_feature (968)..(969): n is a, c, g, or t
  misc_feature (972)..(972): n is a, c, g, or t
  misc_feature (977)..(978): n is a, c, g, or t
  misc_feature (980)..(981): n is a, c, g, or t
  misc_feature (983)..(984): n is a, c, g, or t
  misc_feature (989)..(989): n is a, c, g, or t
  misc_feature (992)..(993): n is a, c, g, or t
  misc_feature (997)..(997): n is a, c, g, or t
  misc_feature (999)..(999): n is a, c, g, or t
  misc_feature (1001)..(1003): n is a, c, g, or t
  misc_feature (1005)..(1006): n is a, c, g, or t
  misc_feature (1009)..(1011): n is a, c, g, or t
  misc_feature (1014)..(1015): n is a, c, g, or t
  misc_feature (1017)..(1018): n is a, c, g, or t
  misc_feature (1023)..(1023): n is a, c, g, or t
  misc_feature (1025)..(1025): n is a, c, g, or t
  misc_feature (1028)..(1034): n is a, c, g, or t
  misc_feature (1038)..(1041): n is a, c, g, or t
  misc_feature (1043)..(1044): n is a, c, g, or t
  misc_feature (1047)..(1048): n is a, c, g, or t
  misc_feature (1050)..(1050): n is a, c, g, or t
  misc_feature (1054)..(1055): n is a, c, g, or t
  misc_feature (1058)..(1058): n is a, c, g, or t
  misc_feature (1062)..(1064): n is a, c, g, or t
  misc_feature (1066)..(1067): n is a, c, g, or t
  misc_feature (1071)..(1073): n is a, c, g, or t
  misc_feature (1075)..(1076): n is a, c, g, or t
  misc_feature (1079)..(1079): n is a, c, g, or t
  misc_feature (1085)..(1088): n is a, c, g, or t
  misc_feature (1090)..(1091): n is a, c, g, or t
  misc_feature (1093)..(1093): n is a, c, g, or t
  misc_feature (1095)..(1096): n is a, c, g, or t
  misc_feature (1098)..(1098): n is a, c, g, or t
  misc_feature (1100)..(1100): n is a, c, g, or t
  misc_feature (1103)..(1104): n is a, c, g, or t
  misc_feature (1106)..(1107): n is a, c, g, or t
  misc_feature (1109)..(1111): n is a, c, g, or t
  misc_feature (1114)..(1115): n is a, c, g, or t
  misc_feature (1117)..(1117): n is a, c, g, or t
  misc_feature (1119)..(1122): n is a, c, g, or t
  misc_feature (1124)..(1124): n is a, c, g, or t
  misc_feature (1126)..(1127): n is a, c, g, or t
  misc_feature (1129)..(1129): n is a, c, g, or t
  misc_feature (1131)..(1131): n is a, c, g, or t
  misc_feature (1135)..(1135): n is a, c, g, or t
  misc_feature (1137)..(1137): n is a, c, g, or t
  misc_feature (1139)..(1139): n is a, c, g, or t
  misc_feature (1142)..(1144): n is a, c, g, or t
  misc_feature (1147)..(1147): n is a, c, g, or t
  misc_feature (1150)..(1154): n is a, c, g, or t
  misc_feature (1156)..(1158): n is a, c, g, or t
  misc_feature (1160)..(1160): n is a, c, g, or t
  misc_feature (1162)..(1167): n is a, c, g, or t
  misc_feature (1169)..(1171): n is a, c, g, or t
  misc_feature (1173)..(1173): n is a, c, g, or t
  misc_feature (1176)..(1177): n is a, c, g, or t
  misc_feature (1179)..(1179): n is a, c, g, or t
  misc_feature (1184)..(1186): n is a, c, g, or t
  misc_feature (1188)..(1188): n is a, c, g, or t
  misc_feature (1191)..(1192): n is a, c, g, or t
  misc_feature (1194)..(1194): n is a, c, g, or t
  misc_feature (1200)..(1200): n is a, c, g, or t
  misc_feature (1203)..(1205): n is a, c, g, or t
  misc_feature (1208)..(1210): n is a, c, g, or t
  misc_feature (1212)..(1213): n is a, c, g, or t
  misc_feature (1216)..(1217): n is a, c, g, or t
  misc_feature (1219)..(1220): n is a, c, g, or t
  misc_feature (1222)..(1222): n is a, c, g, or t
  misc_feature (1225)..(1225): n is a, c, g, or t
  misc_feature (1230)..(1230): n is a, c, g, or t
  misc_feature (1233)..(1237): n is a, c, g, or t
  misc_feature (1239)..(1241): n is a, c, g, or t
  misc_feature (1244)..(1246): n is a, c, g, or t
  misc_feature (1248)..(1250): n is a, c, g, or t
  misc_feature (1252)..(1252): n is a, c, g, or t
  misc_feature (1255)..(1257): n is a, c, g, or t
  misc_feature (1259)..(1260): n is a, c, g, or t
  misc_feature (1262)..(1264): n is a, c, g, or t
  misc_feature (1266)..(1266): n is a, c, g, or t
  misc_feature (1268)..(1268): n is a, c, g, or t
  misc_feature (1270)..(1270): n is a, c, g, or t
  misc_feature (1272)..(1272): n is a, c, g, or t
  misc_feature (1275)..(1279): n is a, c, g, or t
  misc_feature (1281)..(1283): n is a, c, g, or t
  misc_feature (1285)..(1286): n is a, c, g, or t
  misc_feature (1290)..(1294): n is a, c, g, or t
  misc_feature (1297)..(1300): n is a, c, g, or t
  misc_feature (1302)..(1302): n is a, c, g, or t
  misc_feature (1304)..(1304): n is a, c, g, or t
  misc_feature (1306)..(1309): n is a, c, g, or t
  misc_feature (1311)..(1316): n is a, c, g, or t
  misc_feature (1318)..(1318): n is a, c, g, or t
  misc_feature (1321)..(1323): n is a, c, g, or t
  misc_feature (1327)..(1327): n is a, c, g, or t
  misc_feature (1332)..(1336): n is a, c, g, or t
  misc_feature (1340)..(1341): n is a, c, g, or t
  misc_feature (1343)..(1345): n is a, c, g, or t
  misc_feature (1347)..(1349): n is a, c, g, or t
  misc_feature (1351)..(1366): n is a, c, g, or t
  misc_feature (1369)..(1369): n is a, c, g, or t
  misc_feature (1372)..(1377): n is a, c, g, or t
  misc_feature (1380)..(1381): n is a, c, g, or t
  misc_feature (1383)..(1383): n is a, c, g, or t
  misc_feature (1385)..(1387): n is a, c, g, or t
  misc_feature (1389)..(1391): n is a, c, g, or t
  misc_feature (1393)..(1396): n is a, c, g, or t
  misc_feature (1399)..(1399): n is a, c, g, or t
  misc_feature (1403)..(1403): n is a, c, g, or t
  misc_feature (1405)..(1405): n is a, c, g, or t
  misc_feature (1407)..(1410): n is a, c, g, or t
  misc_feature (1413)..(1415): n is a, c, g, or t
  misc_feature (1419)..(1419): n is a, c, g, or t
  misc_feature (1421)..(1422): n is a, c, g, or t
  misc_feature (1424)..(1424): n is a, c, g, or t
  misc_feature (1426)..(1428): n is a, c, g, or t
  misc_feature (1431)..(1431): n is a, c, g, or t
  misc_feature (1434)..(1436): n is a, c, g, or t
  misc_feature (1438)..(1438): n is a, c, g, or t
  misc_feature (1440)..(1440): n is a, c, g, or t
  misc_feature (1443)..(1443): n is a, c, g, or t
  misc_feature (1446)..(1448): n is a, c, g, or t
  misc_feature (1450)..(1452): n is a, c, g, or t
  misc_feature (1454)..(1455): n is a, c, g, or t
  misc_feature (1457)..(1458): n is a, c, g, or t
  misc_feature (1460)..(1460): n is a, c, g, or t
  misc_feature (1463)..(1469): n is a, c, g, or t
  misc_feature (1472)..(1472): n is a, c, g, or t
  misc_feature (1474)..(1477): n is a, c, g, or t
  misc_feature (1480)..(1480): n is a, c, g, or t
  misc_feature (1483)..(1484): n is a, c, g, or t
  misc_feature (1487)..(1488): n is a, c, g, or t
  misc_feature (1490)..(1491): n is a, c, g, or t
  misc_feature (1495)..(1496): n is a, c, g, or t
  misc_feature (1498)..(1498): n is a, c, g, or t
  misc_feature (1500)..(1506): n is a, c, g, or t
  misc_feature (1508)..(1510): n is a, c, g, or t
  misc_feature (1512)..(1515): n is a, c, g, or t
  misc_feature (1518)..(1520): n is a, c, g, or t
  misc_feature (1523)..(1529): n is a, c, g, or t
  misc_feature (1531)..(1543): n is a, c, g, or t
  misc_feature (1545)..(1545): n is a, c, g, or t
  misc_feature (1547)..(1548): n is a, c, g, or t
  misc_feature (1551)..(1551): n is a, c, g, or t
  misc_feature (1556)..(1557): n is a, c, g, or t
  misc_feature (1563)..(1570): n is a, c, g, or t
  misc_feature (1572)..(1572): n is a, c, g, or t
  misc_feature (1574)..(1575): n is a, c, g, or t
  misc_feature (1578)..(1578): n is a, c, g, or t
  misc_feature (1580)..(1582): n is a, c, g, or t
  misc_feature (1584)..(1586): n is a, c, g, or t
  misc_feature (1589)..(1591): n is a, c, g, or t
  misc_feature (1593)..(1594): n is a, c, g, or t
  misc_feature (1596)..(1596): n is a, c, g, or t
  misc_feature (1600)..(1601): n is a, c, g, or t
  misc_feature (1603)..(1603): n is a, c, g, or t
  misc_feature (1611)..(1613): n is a, c, g, or t
  misc_feature (1615)..(1616): n is a, c, g, or t
  misc_feature (1619)..(1622): n is a, c, g, or t
  misc_feature (1624)..(1628): n is a, c, g, or t
  misc_feature (1630)..(1631): n is a, c, g, or t
  misc_feature (1633)..(1633): n is a, c, g, or t
  misc_feature (1637)..(1638): n is a, c, g, or t
  misc_feature (1640)..(1640): n is a, c, g, or t
  misc_feature (1644)..(1645): n is a, c, g, or t
  misc_feature (1648)..(1650): n is a, c, g, or t
  misc_feature (1652)..(1655): n is a, c, g, or t
  misc_feature (1672)..(1672): n is a, c, g, or t
  misc_feature (1711)..(1711): n is a, c, g, or t
  misc_feature (2019)..(2019): n is a, c, g, or t
  misc_feature (2988)..(2988): n is a, c, g, or t
  misc_feature (3184)..(3184): n is a, c, g, or t
  misc_feature (3340)..(3340): n is a, c, g, or t
  misc_feature (3586)..(3586): n is a, c, g, or t
  misc_feature (3707)..(3707): n is a, c, g, or t
  misc_feature (3758)..(3758): n is a, c, g, or t
  misc_feature (3792)..(3792): n is a, c, g, or t
  misc_feature (3957)..(3957): n is a, c, g, or t
aanaanatnntntntnncnncnnnnnnannnaagnctangnnagnaagnaatgtagnntgganntnatnnntnangngnnagnanctnancnaannnnannnnnnnannnaaaacnannnngannngncnnnccnaaacaaananngaggncnnnncngcccnggcncgggcnngncaggaantcnanncngcngcccnanngnaacncnnccnancnannnnncnngcngnngannananaaancnnnnnnnnnanganngnnagcnnnncaangcncancnnnngcancnnnannnaannnnnnnnnnggaanngnngnggcngngnnngnnnngnttgnntncnggnnnggngntnnggnnntnggntgcgnnccnggccnnggcnncnntncntnnnnnnntnnngnntnnngnggnngtnnnggnncgtgangnananannnanncccnngcnnnnnngnnngncgnnnnngtggnngnnnnggcnnnncnnnccggcnngggngnggannnnnnggcccgnnnnangggnanggnnangnnacnnncnannnatnngnnnnngnnngnnnnncanncngatnnnnnnnnncgnnngcnngcnnnncgnnnngnngnnnnnnnngcngatnggnngagnccagncnancggnnnnnnncgnacnnnncnnnnnntnnggnnnngnnnnaannaannaaanaagnnnnngcncgnctnntnnnnntntnnnnnnnacnnnnnntcncntnnctnnncngnnncnaannnnntnnnntnnnnnganagnnannnttttnntttnnnntnntnnnttnnnttnnnntnnntntcnnccngncnggannanatananantntnttntnnnttcanntnaannnaattatntnnatnnntnnnnnnnnngantnnntnnnnnnngaatgnnannannncnanacannnnnnannnannnannanacannaancaacnnanncnnctcanatnngatncncnnnanncannnaannannaaacnanacnnnnnnnatannnngnnatnncntgtnntgnattnnntnnattnnntnnttntctatnnnnanngnanngnantgnngnntnnnttnntntnnnngntnncnanttcntntntcnnnccnacnnnnnannnangnnnnnnannnantanntntagtnnngnatnnantaattnatnnntannngnnagnngnntngcntggcncgnnnnnannnaannnannnanatnnngnntnnnangncnanccnnnnnannnannagannnnnatnnnntncngnnnngnnnnnncngannnagcnatgtnnnnnatgnntnnnannngnnnnnnnnnnnnnnnngcnatnnnnnngtnnantnnntnnntnnnnccngccngnannnnatnnntgcncnncncnnnccnaannnanantanaannnannngnngnncnggnnnnnnnccnannnnganganntgnngnngcgnngngnnnnnnncnnncnnnnaannnaannnnnnntnnnnnnnnnnnnnanannaantaatnnatcgannnnnnnntnanntanannnannnaannnanntnattnntnaagtaaannnanncannnntnnnnngnncnggcnngnttgnntgnnngnnnncttgatgtcctggtgcnttggtgccggtgggtcctgtgatgcgcccttgcccgcancgccttacagtacgccctgtttccgggctgccgccaccgccgatgtccgcgaccgcacccctaatttgtcgtaaatgtgcaccaggtggcttttcaccgtggcctccgataataataaggtccgaccaatctctcggttggacgaccccgacgccaccagctttaaaacctccaactcccggggagtgagcgaagtccggggagtacgcacccgggtcatgagccggttggccaccgtgggcgacagggtggagtctccctcggcggcggaacgcaccgctgctaagagctcctccggtggggcgtcnttgagtagatagccgagtgccccggcctcgatggcgcccagaatatcggcgtcggtgtcatagttggtgacgaccaacacatgcggcggtttctccatggtgcgtttgatttccgcggtggcgtcggcgccggtggcaagccgggtgccttcaaccccggggccaaatcgcaggtccatgaggatgacatctatgccaccggcctgggcggcggcgatagccgcttccgcggtggcgacctcaccgatcacttcgatgtcgtcggcgctttctagtactgcccgtagtcccagacgcacgatctcatggtcgtcggcaagcaaaacgcgaatcataacagggtccttactattggatacatcaaagccaaactaacatagctcatgcttactcggtactctcaaccggcaatgccaccgtcaccgcagtaccctcacctggttgcgactctacctccagtgtgccacctaattccgccgctcgctgccgcatagcgttaattccgatatgtcccaggccagccggccgatccgcaacatcctgtggcacaaaaccgtcgccgtcatccaccacgtccaggcggatttcgtcggcggaataggtgagcgtgacggcacaccgggtagcattcgcatgctttgcgacgtttcccatcgccccctgcccaatccgcaacaaggcggcctcagtcttcatgggcaactggcgttcatcgccatccacctgaatgctccagtccacccccacgaagctttccgccacccggtgcagcgccccctccagggaggttttactgagcgccgccggctgcagcgccgcaatcatggcgcgggcctcggagagattatccgccgcggtgttccgcgccaactccatgtatttgagcaccttggttttctccgccgcggcgagggcggactgttctatctcctgctcccccacccgcagcagcatttggatggaggacangccctgggctagggtgtcgtggatttcgtgggcgatccgctggcgttcggcaacaatgccggcggcccgttcggttgccgccaattgggatcgggtttcgatcagctcatcaatgagttcttcccgctccctggcccctttccacagggcttggaatgccaggtgaataccaatgaccaccagggccgatgcggtnggccccatcaccgccccataggtgaggtgggctctaaagttgaggattgccacgcaggtcgccccgacgacggcgatcatgccccgatagtccgggaggacccgcaggtagaggaagaagagcgggaaaacgcagtacacgctgacgggaatgatnggcagcataatcacccagacggcggtcagcccggccagccacatgattttcagcatgagccggtcccggatgcgggtcaccgccatggtgtagaagaaggcgaagagaatacagagaatgaccgccacaatggcggcctgcacatcttgagtgcgcaccgccgcccccagcgccccaatgagaagcgccacggttaatatgttcatggcacgccggtagttggcggcccccggctgtgaatcgtangttgacacatctcccgcagcaatattgcttttcgatgcttctagctggttcgatttcatacccgaactatactcactctaggctatagaccatgaatcgcactgcacgttccggcatggtnctcctcgcctgcctcacctgttttgttggtcttaccggactcaccggttgnagcagctcaggtgatataggtaatggtactgtgnccgcctcggcttccgcggcccctacggccccggtgttggacagtaatctcccggttgatgccctcccggtgatacctgccggtaagtccgaaatggttccctgcccctacctggatacccaatgggtggcgaacaccaatgggcagcgcatgatcggccagggtntcgacgcccggtttaacaccccggcctgcgtgttttggtcctt

SEQ ID NO: 1394 - DNA, 4000 bp, Escherichia coli
actgggcgacgttctccgggctgagcatctcgatcggtgacgtcgcgacgcccgacaacaaggcggagatcctcgaggagtacgagggccgtgcggcgaagatccaggctcagtacgacaagggcctgatcaccgacgacgagcggcgtcaggagctcatcgaggtctggacgcaggcgaccgacgtcgtcgccaagtccatgcaggaggcgttcgacccgaggaacccgctgttccgcatggtcagctccggtgctcgaggcaactggatgcaggtccggcagatcgccggcatgcgtggcctggtggcgaaccccaagggcgagatcatcccgcggccgatcaagtccaactaccgcgagggtctgtccgtcctggagtacttcatcgccagccacggtgcccgcaagggtcttgccgacaccgccctgcggaccgccgactcgggttacctgacccggcgtctggtggacgtgtcgcaggacgtgatcgtgcgtgaggacgactgcggcaccgaccgtgggctcgtcatgccggtggcgcagacgggttccgacggcaaggtgcgccggcacgaccgggtcgagaccagcgtctacgcaaggacgctggccagcgacgtggtcgccgccgacggcacggtcgtcggccacgccggcgaggacgtcggggacctgatcatcgaccgggtgatcgcggccgggatcaccgagctgaagatccggtccgtgctcacctgcgagtcgcgggtcggcacgtgcgcccggtgctacggccgttcccttgccaccggcaagctggtggacatcggcgaggccgtcggcatcatcgcggcgcagtccatcggtgagccgggcacgcagctgacgatgcggaccttccacaccggtggtgtggcatccgcggacgacatcacgcagggtctgccgcgcgtccaggagctgttcgaggctcgcacccccaagggcgaggcgccgatcgcggagtactcgggtcgggtcaccatcgacgactccgagcggctgcggcggatcgtgctcgcaccggacgacggcgcggaggagatcgcctacccgatcagcaagcggtcgcgtctactgatctccgacggccagcacgtcgaggtcggcacccagctggtgcagggcaaggtggaccccaagaaggtcctccggatcctcgggccgcgtgcggcgcagaagcacctggtggacgaggtccaggaggcctactcctcgcagggcgtcgacatccacgacaagcacatcgaggtcatcgtccggcagatgctgcgccgggtgacggtgctcgactccggcgacaccgacctgctgcccggcgagctcgccgagcggggtcgcttcgaggacgccaaccgacgcgcgatcgccgagggcgtccagccggcgtcgggccgtccggagctgatgggcatcaccaaggcctcgctcgcgacggactcgtggttgtccgcggcctccttccaggagaccacaagggtgctcaccgaggccgccatgagcggacgcagcgacccgctgctcggcctcaaggagaacgtcatcatcggcaagctcatcccggcgggtaccggtctgccccggtacggcaacgtcacggtcgagccgaccgaagaggcgaaggccgagctgtaccccagcttcgggtacgacgagatcgacttcccgccgttgggcatgggctccggagaggccatcccgctcgacgagatcgacttcggcgacctgcgctgacccgcgcgcgccacgtcccttgcccggactggtcgggacgccgtgcgcgccggcaacgacgaggggcccactgcaccggtgggcccctcgcccatgtccgtcggctgcccgggggaccggaacaacggcgtgcccggtcgtgttggcatgagcaggccacggtggcgggatgctgcgcgccgtacggggaggatccgctttgacggtgtgtcgccaggccaggtaacgtaagcccttgtgcccgcgccgtcgggccctcgcgcgtgctccgcgtcctggcgatcgtcctgatggacggcgtcggcgctggcgccgggtggtgaaccacctaccgcgcggtcccaccgaccagatgttcttggcggtcggcgccgcgttcgagtaggccgacacacccgggtgcgggggtcggcgcgacatgaaagacccaggtccggcgacgggcctcatgaccgggcatggcccggttcgaccatacgaccagcagaagacggagacgcagtgcccacgatccagcagctcgtgcgcaagggacggacgtcgaaggtgacgaactccaagacgccagccctcaagggcagccctcagcggcgcggtgtgtgcacccgcgtctacacgacgacgcccaagaagccgaactcggcgctccgcaaggtcgctcgcgtgaagctctccagccagatggaagtcaccgcgtacatccccggtgtcggccacaacctgcaggagcactcgatcgtgctcgtccgcggcggtcgtgtgaaggacctgccaggtgtgcgctacaagatcgtgcgcggcgccctcgacacccagggggtcaagggccgcaagcaggctcgcagccgctacggtgccaagaaggagaagcgctgatgcctcgcaagggaccggccccgaagcggccgctgatcatcgacccggtctacgggtcacccctggtcacccagctgatcaacaaggtgctcctcgacggcaagcgctcggttgcggaagccatcgtctacggcgccctcgagggtgcccgggagaagaccggcaacgacccggtcgtcatcctcaagcgcgcactggagaacgtgcggccggccctcgaggtgcggtcccgtcgagtcggtggcgccacctaccaggtgccggtcgaggtgcgccccgtccgggccaccacgctggcgctgcgctggctggtcgacttctcgcgcgctcgtcgcgagaagaccatgaccgagcgcctgatgaacgagctcctcgacgcaagcaacggccttggtgccgcggtgaagcgtcgcgaggacatgcacaagatggccgagtcgaacagggcgttcgcgcactaccgctggtgagaccagccgcctgacggctccccccgatcgcagtagaagggcttcacacgtggcactggacgtgctcaccgacctcaagagggtccgcaacatcggcatcatggcgcacatcgatgccggcaagaccactgtgaccgagcgggtcctcttctacaccggggtcaactacaagatgggcgagacgcacgacggcgcctcgaccatggactggatggagcaggagcaggagcgcgggatcacgatcacgtccgccgcgacgacctgctactggcagggccaccagatcaacatcatcgacaccccgggtcacgtcgacttcaccgtcgaggtggagcgctcgcttcgcgtgctcgacggtgccgttgccgttttcgacggcaaggagggtgtcgagccccagtccgagacggtgtggcgccaggcggacaagtacaacgtcccgcgcatctgcttcgtcaacaagatggacaagctcggcgcggacttctacttcaccatcgacacgatcatcaaccggctcaaggccaagccgctgccgctgcagctgccgatcgggtccgagcacagcttcgtcggcgtcgttgacctgatctaccgtcgtgcgctcacctggcgcgacaacgtgggcaagggcgaggactacgcgatcgaggacgtaccggccgagatggtcgagcaggtcgagctgtaccgcagccggctcgtcgaggccgtggccgagagggacgacaagctgctcgagaagtacctcggcggcgaggagctgaccccggaggagatcaagagcggcatccgtgccctcaccatctccggtcaggcctatcccgtgctgtgcgggtcggcggtcaagaacaagggcgtgcagcccgtgctcgacgccgtcatcgactacctgccctc

SEQ ID NO: 1395 - DNA, 4000 bp, Escherichia coli
  misc_feature (1)..(469): n is a, c, g, or t
  misc_feature (476)..(476): n is a, c, g, or t
  misc_feature (1985)..(1986): n is a, c, g, or t
  misc_feature (2457)..(2457): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacaangcgatagtcgccggcaaccgtaatgcagccgaagcagcacttaaggttgctataaagaacctggacagagccgccgagaaaggcatcatccacaagaacaacgccgccaacaaaaagtcacgcttgacgaaaaagctcaacaaagtcggcgtttaggcgcattaataagctagagtatagcaggctctcacgccgttcgagcctgcatttaaaaaccaaccgagtccaagtggttggttttggctttcttattggttcagactattgttagaggtacttaaggaagctcttggatcttatagttatcaaactgaacgtccatgaaatctgtgcgaataccggcatattgcttgtctagaaatggtttgccgccgtacttcttcccatcatccgtcgcttcacagataagcttccagttgcctttccagttttcatccatgaaaagctttatactgacggttttatctttgttcgtggtcacaatgcttctcaaaccgatccattttttctttggtagcagattcgggttactcttccggtcatactcagttccaggaaatatctgcttcaaagccatggtgtaatacacacctttgattttcttctttacgaccgcataaccatcgacccgtattcccgtatagtaaagattgtagccatcttgatacctattaaagaggagtaacccatttgacgcttggcgatgctcatcaccgctgagattatcggcagtgattttaaagtaggcatcttgctgaagattccgccacttacttcttgtcacaagcctgaatatgttttgtgggtgatatccattatctgtttccgcagggttgcttgaaccgtatttctgacgccataaggccgattctgcaagccttccttggatggtctggccgactccattctttacgacgaaaagtccccccgaattcaaccaccaattagtgctcaggcttttatacattttgcccgcttcttgtaacacataggtcttgccgaaagtatctttaaatgagggcaattttggggtcgcaacttttttactctgcgccataacttgagggctcttatcgcgattcgtaattatcgcgaaagaaatccctaggcttgctattaatattacgataacgaaaatgagcacttttttcatgtttcctcttattgggcacagcaatctcgcgaaaatttatctaatgtttttattacatatagtttagcgcatagttctaagatgacaaagggcttaaaaccttcgaagctatcggccgaactttattatggaaagcactatagcaaggataaaggctttaactttatcaagtaaccccagaaagccctttctcttaacgtctattgtagcagttagctgcgcaggtttatatttagtaatcttaagtttgagctccggcacatggttcagacgatcaagctcactaaaggtgaccacttttatcttttgatcggcgatgtctttgacaaccgcctcgaatttgccaagatcgtagnntatatacgtcttctgtttggttgtgtaagttcccgaccatattctatgaaaaacaagaattaacgtcagcttgtgcagttttgcgtcagctacggcgttatgaacctcgctgagttttgttgtgtcaaagacttcaaatatctttactgcataagggtcgccgaatggataaacctcgggctgcttgctgactgaacgagcaaatctatagtacttgctcacaatctgcttaacggatggattggtcgcaccatttgggtaaacgtaccagttaggcgcagagttgatcccattctcctcaagatattctgcaccatcaacaatatcttgttcaaaccctgccagatcgcctttttcataataatacgtaagcgcgtttctgtggtgcgcagagtgactaacaatatcccaaccgttaatgttctgcattctcttaagctgggtaagcgttaagtaccctctaatttggcnatcaggacgttctgcggtaactgccacgttccctttgatgccatatctattcatcaccggtaatgcatccagaacagactccgaaccatcgtcaaagcagataaccgtccgcccttcatcttgccctggcactgttgcaagcgagtcgagattaagcgttacttttttacctttgactgctgaaaggctaaagcctatcctatcgatcttggaccaatcaaagcctgaaccgaaaaatcgccactgcccttgaatatttcttaatgatcctttccctagagatattgtcatccaattgttatcgtcagcaactgcataagcctctcgcagatcgcacgaagcgtaaccctgccaattatgcgacgataggtctatggtgagattgtcacactggcttatgttcgaagctttcatcctaaccagaagattcttattagaaaggtcaaggttggtgcgcttggttatggaaagtcttgaaccgtcttcagatgaaactagacgtaagttctttttgccttgataaccttgataacaatcgatctctatcgaaccaccacgactatcgcgccgcttccaatctttttcattctcgaacttttcaattgcggtccacttaggtagcgattcttgctgtttttgtttgactatggttatattggtatctttgcccggcaactcgctagtcgcaatagagtactttacatcactcgtagaaatcgtcagggttttatctttctttgtgctggctaatacttttgctgaaagagttttatcctgcttgccaatttcaagcagtgttataaagtctgcttctttcccgcgcttttcgtatgatatcgaatagtttggaatagctttttcgtattcaaacgaacaaaaaccatcatatggttttgtttgcccttttacggctttaacggaaaggccatctgtgtttagctggcgtatggtaaccgcttgttctgggctcgccccgataccgcttaaagtcattccacttttcttgagcttagcctccgggaacaagtgaaacatttgttcatacttgtgctccttctttgaggttagctcatctatgatgacaacgaattttttacctaaaagtataacggccctcttgtgctttacgcccgtgtataaatcagattcagctgattggagagcatatccatcgccttccacaagggggtttgcgctaggtgcccctttatcctggtccttgccatcgacgactactgtattatgtgcgcgtgtgccatgaaaatagtctttcagcggcaagtgttcgtaggtataaagacccgaatcaggcatgagcggaattcccgccccaaaaagattgaaactaagcgcgtccatatcgctgtgctgtgtcctaaagggccctacgtcaagtattagttgcgtttgattcttatagtccttcccttgttcccaacctgaacgcatgattgtttgccccgcagtcggaaagtaaacgttaagcttcggaggcatatcgccttccttgccggcagtcagcgtataacgtaaataaggatcg

SEQ ID NO: 1396 - DNA, 4000 bp, Escherichia coli
  misc_feature (39)..(39): n is a, c, g, or t
  misc_feature (55)..(56): n is a, c, g, or t
  misc_feature (1990)..(1990): n is a, c, g, or t
  misc_feature (2435)..(2435): n is a, c, g, or t
  misc_feature (2494)..(2494): n is a, c, g, or t
  misc_feature (3323)..(3323): n is a, c, g, or t
aggttgatctggcccggggtgtcctgccagtcgggcagnccccgctcccagctgnncagccagtcggcccccagggcctccagccgagcctgctccaggcgcccctggatcggcggcaacagggccccggcctccggcagcagcgccacggcctgcatgtgccggtccaggtcctccgctcgggcagctcccacgctgatggtgtgcacccctggagccgtgaggcagaacaggtcgttgaacagaatcgggtgcaggggcgtgcacagctccagcaggcgggccgaggggctgtgcagatggccgcccttgtcggtggggctgatcacgaacacccccatgtcgtgggccgtggccgcctcgacggccggccggttgtcctggcggatgtaataccaatgcagattcacataatcgaaggcgtcgctctcgatcgcttcgaggatcaggggcaggggcccatgggtggagaaacccaccgaccccacccggccctccgcctgccaacggcgcaccacctccaggcagccgccggggcgcagggtgtgctccaggtgctccggcaggttgaggccgtggatcgccagcaggtcgacccgatccacccccaggcgctccaggctggtggccagctccgcctcgaacgccgccgcatccgcctgggggggcaccttggtctgcaggatgcgctggggatcgcgcacctgctgcagcagggccccgagctgccgttcggagctgccgtagtggcgggccgtttccacgtggtggaaccccagcgccacggcgtgctcaaggatgcggcgcaggttggcctggctctcggcgctgatgcgatccgccggcagatcactccagctctgctggaaacgcatgccccccagggagagcacgggcatgggcagttcggtgcggccgaagcgccgcacgggcacgggcgccatcagggggtggcggcgccgccggcgctgcggggcagggtgcggcgcggccgggccgggctcggcagccccaggggcagcaactcctgctcacggctctgctgctccagctccggcagctgctcgtagctcacccaatggatgcaatccacggggcaggtgtcgatcgcctcctggatccgttcggtgctgtcgccgtcctggcggatggcccgggagcggccccagtcgggctccaccacaaaggtgttggcggccacgttggcgcaatagcgacaaccgatgcacaccgcctcatccacccacaccgcctgttggcgcagggcaccccccagtaccggttcacggccactgggctcagggccggtggcggccggagcccggaaggcgaccgacggatccatcaccatggccgcagccgggggatcagccgtcccagcggctcaccaccagttcgatcgagccgtcggtggcctggcgctgctcggtcacctggaagccctcctccaaggaggccgccaggatgctgcgcagggcgtactgctgggtgagcttggccaggaaacgctccacggggatgggctgcttccagaggtcgaggtcggtcaccagctcatagctgccgctcgtggggttccagcggaagccgagctcgctgccctccggggaggccaccgccaggtcggcgagtaccgtctgaccgcggtagccgcgcaccggttgctcgccatcgctggggttgtggcccaggtcgcgcagggccgccacgagggcttcgcgatcacgcaattccgtcttgacggtgctgaagtgcgacatcaggtgaccggggtggagagggtctgctcggggttcaccgtggcggcctggccctggtaggcctcggcggtgggctggcgctgttgaacgttgccgagccgggcttcgatccgctcggtgagctgctcacagccagcgccgctgatgccgctcaccagctcctccacgcggccatccggacggatccgaaagctgatggtgtgctggggcatcccggcagtggacgggtngctggatgctaaccgcgccgcgcggaggttggcggttcaggccagcaggccctcgtccaccagggtctgcaggcgctccagcaccaggggatcctccagttgttccagggccaggcgcgcctcatcccgcaccgccaggtcgccgtcctgcagcatcgccgccagcagcgcctccaccacctcccgctggcggggctccaccaggtcgccgtagaggcgcccgagcgaccaggcgctgttgctgcgcaccgccgcctcgctgtcgatgcgcagggcgagcagcagctgcccggccgcctggtccgccttagccaggcccgtggagccggcatccgccagggcgctggcggcccagaggcgcacggcggcgatgtcggtttccagggcgcggatcagggggttcatcaccggcgcgtccgggtagctgctcaggctccaggccacngccttgcgcacgtagccgttgctgtcgttctggagcagggccaacagtggggtgatggnctgcagatcggggttgcgccccagggcatacacggcgctcatgcgcaggatcgggcagctggcctccagcaggggcagcagcagggccggagcgcgggggtcgcggtgctcacagaagatgcgcagcccctgcatgcactcctcatggttgccctgcagcagctgcaaaccgagatcgcattccgccgccacatccgcggcggccgcctccgccccctccagctcgtcgagggggtcccccagcagctcctgggccagctcccgggcgagcatctccggatcgagcgccaactcggccgggctctgggaaaactctgggtacgggccagtcatcggccgatcgtaaaagccggcagcggattcaaccccgaatcagcgggctgggtctgaatcaggagatcggtgccggggccgccatgtcccccggcagccagatgcgggcgctcacggcgaacagggccaggccgaacagcagcacgatggcggccggcaacagggtggagcggaaaaactgcacgggcctcagcggcggaatccccagtttgacgcgcctagcctgcggccgttcctgaatcgcccccgcggcgccgcgcccatggctccaccgcagcgccccgccgggcaccaggcccggaaccgttggcggcgcctgggggccatcagcgccgagggtttcgccagcggcgcccccaacagcggcctgggggaggtgctgccgatctggctggccacccatggggtgccggtggagctgatcggactgctgcccctggcggggttgccctatgccatcaaggtgctgtgggcgccgctgctggaccgctggccnatcccctggcccgaccggcggcggggctggatcgccctgctgcagctgctgctggggctgagcatcgccagcctggccctgctgcgccccagcaccgacccccacaccctgacggccatcggcctggtggccctgctggtggcggtgctcagcgccacccaggacatcgtgatcgacgcctaccgcaccgacctgctgccccagggggaacggggggccggggcagccgccaactccctgggattccggggcggcaccctgatcctgggctccggtgccctgctgatcgccggcagcgccggctatcccctggccttcgccttcgccggggggctgatgctgctgatgattccctgcaccctggcggcgccgcgcctgccgcccctggcccagcccgtgggcaacctgcgccaggcggtggtggggcccatccgcgaatttctggcccgcaccggcggccgccggggcctgcagatcctggccctggtgctgctgtatcgcctgcccgatggcctgctggcccccatgggggggccattcctggtggccgccgggctgagcgaagggcagatcggcctgctgaaatccgccctaggggtgctggccaccatggccggtgtggtgctggggggtgtgctgttcggccggctgggcatgaaccgcagcctgtggctgtt

SEQ ID NO: 1397 - DNA, 4000 bp, Escherichia coli
  misc_feature (1985)..(1985): n is a, c, g, or t
  misc_feature (1991)..(1991): n is a, c, g, or t
  misc_feature (2045)..(2045): n is a, c, g, or t
acttcttcaactcagagcaaagctctttagccaacaacctcaaactaatagacagccatcccagatagtacgccaaatagatgctatgctttctcgcatagaccttgcccagctcaaaactctacaatcttcagagagtgaatctgcaacaaaaagtgctcagcgcgagtgggttatcgagattccatttatggtagatgataaaccacacaatattgaactctacctccaacgccaatcgatacaagatgatgcgcaagaagatagttggcacattaagttaactctctctcctcccaatatgggagagatacatataagtgcaaaaatggggagcaaggagcttgacataaactttctaactgaggaccggcagagctctgccactatatctaataatttagataagctagaggcgacactctcatcctctggaattgagacaggcactctctttagtagacaactcactcctaatgatatagtgcagacagatatcctaaaaccaacaggtagtggtggcatcagtgccagagcgtaatctaagagttaaaaatgaagagtaaattagatatagctgttgcgctccgttatgaagagggagtaggagcaccaaaagtaactgcaaagggaaaaggcattattgctgaacaaatcatggagattgcacgggagaatgatatcccactatatgaggagcctgaactagtagagttactctctgccgttgaactagatcaggagattccagagacactatatatagcagttgcagagattattgcttttgtctatagaatagcagatgagaagagtagataagactactatttgtaactgttcatattgcctctaaaattcatcagatcaaggtacaaaatttgagcatatatttatatatgataattttgcaacgcagagatggtgaattttaggggtgagctgaatagttacgactattttttatgagtaaataacgacataaagaaaagtgtaactgcgctaaccacaatcgaagggcctgttggagtgtttaaccacatagatagattcaatccagcaaccacagatactcctcccaccataactgcaactgcagccatccgctctggagtattactaaattgacgcgcggttactgcagggattatcaatagagcagtcactagcaacattccaatcatcttcattgctaaagccactaccacagctatcaacaccataaatatcagctccacccttactactggcactccttcagcctgcgctaactctctatccacagttagagcaagtagaggacgccatattataaagagaattgaaagtactatagcaccgccgccatatatccagagtagatcttctactcctatagcgagtagatcaccaaatagataactcataagatcaatctgcaaccaacttatcatacttataactaatactccaagcgctaaggaggcgtgagagagggttcccaatacagcgtcactagtcaactctctacgcttctggagtagaaacaggaggagtgcgatagatattgccaccatcaatactcctaaagtaatattgactcctagtagaaaacctagcgccactccgagcagagctgagtgtgacattgtgtccccaagatatgacatcctcttccagaccacgaaacagccgagaggtccgctgactataattaagcctaccccacctaaaattgcccgccagaagaaatcatctaacatttgccatcaccgcattgctggattgtgccagatagatcatggcgatgatcatggttatgctgatagagagcaagctcatctccctgcccaaagaggcgcatatactctgggtctgcactcactgttgatgggtgcccttgacaacagatgtgttgatctatacatatcactctatccgtagatgccatcaccacatgtagatcatgtgataccataagtattgcgcagttatgtctatccctnattttnctaatcaacttatacatctcactctcaccaagatagtcgaccccttggacaggntcatccaacaccagaagctctggactacagagcagagttcgcgccaacattactcgctgaaattccccaccagagagattagagactgcagcatctataagataggcaactccactctcagccagtgcggagatcaccttcttctcactgtaatttgcagttagactcattatgcgccgcacggtaagtggtaaaactggatctatatcgaacttctgaggcagatacccaatccgtaacttttttctcctcttaacttgaccagaggttggggagattaaaccaagcaataggcggagcagtgtgctcttgccagccccatttggccctataatggtaactatctctccttgctggagcgtcaaagagacatcactaagcagaattttattattaaaactaagcgatatcccaacagcctctaaaagtggatcctcattaatattcataaaagttcaaatctattataatttgtaagatatatataagcataaagcatctattataacaaaaaaatatggggtaccgcttcgaaaggtacacccatatttaggaatgctcaatatctatacttctaagagtagagccatttaatcataaacgataacgattgtcaacactatttacaccctccctcttaaactcagcagcgcaaggataatcacgcttacgagctgtagatcatataccgctccctcttaatcatgtatcatgcatattatggatagattaaaattaatattaattacacttaactcacttgctttatgggtcatctcactctctgtaagttatgctctaccgccatctgtagtggtatcaagcaaaccattccactctctagttgctggggttatgagtgggatagcagaaccaaagctaattgttgatggactctactctccccacaactacactcttaaacctaaaaatgcagtagagatacagagtgcagatttgatcttttggggaggaagagagattgagccattcttgataagatcccttcaaaacttatccaagacaactactatatctataagtgagcttgataacctagagaagctaccactacgcaacataaaacaacatcagcatcataccgaaagcggtattgatccgcacctctggcttgaccctattaatgctattcacattattaaggggacagtaacagagttaagcagtatagatcccgataacagttcactctatcaacgcaatggcaaagatataatagttaaactagagctcctccatacacagttaacaggtatgagtgaagagattagagacatcccatttatggtgtaccatgatagctaccaatattttgaacaccgctatcaattaaagtctcttggagtaatggtgcaaaatataaaccatgcatcaagtgctggtagattagctttgatacgcaaacaactcgtaaagaataaagttcgttgtctctttagcgaaccacaattttcagaccgcctcgtaaaagttgcaactgatggaattacaacacaaataggctcattagatcctattggtgctagacttattcctggaccagaactatactttaacttaatggataatcttattaataacttgagcagctgcctaaaaaagtagacaaagagttgacgctttaatctggcacgaggattgcatctacgccttacatagatacactttgcatagatatagtgtgcatggatataattcgtatagatatagattttgcatagatgcaaatatttaatctcaatagaggataaagatatggctgatgaagataagaaggaagatgaggcaggagaagagaaagagtctggtggcagtatgctgcctctcatcataggtggagtatctctactactgaatattgctattttagtctatcttattctatttccatctggcggtggcaatggtgaggtgatcgccaaaatggcaactga

SEQ ID NO: 1398 - DNA, 4000 bp, Escherichia coli
  misc_feature (376)..(376): n is a, c, g, or t
  misc_feature (2332)..(2332): n is a, c, g, or t
  misc_feature (2394)..(2394): n is a, c, g, or t
  misc_feature (2576)..(2576): n is a, c, g, or t
  misc_feature (2988)..(2988): n is a, c, g, or t
  misc_feature (2994)..(2994): n is a, c, g, or t
  misc_feature (3718)..(3718): n is a, c, g, or t
  misc_feature (3721)..(3721): n is a, c, g, or t
ctgttcctgataaaccttcacccccaaaaggttgtgatccaaccacagctccaatttgattccgattgatatatatattgccagcattcactctcgatgaaacctccctgaccttcttatcaattcttgaatgaattccaaaagttagcccaaatccctttgaattgagtcggtcaatggttttctccaggccaccattcttatatgaaactacatgcaggattgggccaaaaaactcctcattaatgtcctcaattgaattcagttggatcaagataggtgaaacaaagtggccattttttggtacaaaatcgagctcttcaatgacttgatctttttgtcttgctttctcgatatactgttgcagtttaatttnagcagctgaattgatgaccggaccgcagtcaacatcaaggtgttttggatttcccaaacttagctctctcatcgcccccctaatcatactgatagcttcatcataacaatcatcctgaagcaatagtattctcagtgctgagcagcgttgaccagcgctcttaaatgcaccatcaataacgtcccttgtgacttgttcgcataatgcagtagagtcaaccaccatggcatttaaacctccagtttcagcaataactcttgcttctgagtttccacagtccattaaactttgttttatttttttagctacggctgttgaaccagtgaaagcaaccccagcaactagagcgctgctcgatagataagaacctatctgagaccccttacccaaacacaactgaaatagtccgataggaatgccggcctcgattaataactcactagccctataggcgataagtgaagtgctctctgctggcttagcaatgacggaatttcctgcggcaagagccgcagctatttgaccagtaaaaattgccaacgggaagttccatggactgatgcaaacaaaaacccccttagcttttctttggccaggcatcactattcttgataaatttgcataatacctcaagaaatcaactgcttctcgcacttcatccgttgcatcctggtaggttttcccagcctctcgcattgctagagtcattaactcgtattgatttttctcataaaggtctgccgccttctctagaccttgaagaatcatttcgtgttcgatcacattggagtcgaatgcaatttttgcagatacaagggttttctctaattgagactcattggcataaagaacatgtccaacgatgtcattcttttcagctggattggtgacctcttgatccagctcaccctcgacattgattccagcaatgattgattttgcttcccacttattactaagccatgagctttgattttcatagagttgatcgatagcatcctgttcagtcagaatgacgctgcgtgaattgtgacgattatttttaaagatgtcctttggtagttgaatcttggaatgagacctttctgaatcctgctctaccattgtaaagatatcacttgctaaactttcaggactgatactttcatcaaacaaatgattgataaaagaactgtttgcgccgttttccagtaagcgcctcattaaatatgctaacaactctttatggcttccgattggggcgtagacccttgagtgaaccctgtatttatttgaaatgacatggtgcaaagactcccccattccgtgaagcctctgaacttcatagccttcgttatcgcctgccatttcgcagacactgacgagtgagtgggcattgtgactggcaaattgagggaaaatgttgcccctcatcgctaatagtttttgagagcagactaaaaaagaataatcagtatttatttttttggtaaagaccggaaaatcaacatccccaagaatttgagacttcttaatttcgctatcccagtaggcccctttaactagcctcaccattattttcaaattgttctttttacaattgcgatacagccaatctatcacaaaggacgctcgcttttggtatgcctgaacaacaacgccgaagccctcccaagaagaattcctaattgtgttcatcactttgtcaataacatctaacgatatgtctagacgatcagcctcttcagcatcaatgttgattcctatgttatatttttgagcaatttgaactaactcaaggaccctaggtaataattctgacatcactctctctcgatgcataaagtcatactttgggtggagtgcagagagtttcactgaaatgccatttgccccagcgactgttttagatttgttgcgtttaccaatttcaatcaatgcatgtttataggcttgaaaatacttatcagcatcctncatagtccaagcggcctcaccaagcatatcaaacgaatagagaccattttttacatcgcgantcttaatagcactgttaatggattctgcaaaaacaaactgtttagcaaaaaattgcatgacgttgttagcgctaaaacgtatccctggcctagagagaatctctaaagcttttttaattctgctctttatttctttgttacttccatgcgcaatcattttgtcagcgatattaagcgctagngttgcaatgttaaccatagaagatttgctggtaccgatatgctgagaccaccccttctttgcaactttatcaataaataatttatccctagtcttattatcaggaacccttaaaaatgcttccactagggtcatgagagagagaccttcatcactcgtcagattgtattcagagacgaacaatgacagcagatcaggctgactagaggatctcagttgttgaattaagatagaagtgtttgtttgaaagtcaatccgttgatctgagctagtaagttcaaataattggagatgctttattgcatcgacctcactcatgacccttgcatctctcacattgcatcttacggaagagtaatcaactttaaatttgaggtgtgcttgactttccataaccaaaaaaattgctttanatattnatattttattttataagtgatagtgataatgactattaaattcaatattaaaagttttttgttatattatttttataatataattaacttaataactaatatattataaataataggaattatgactactatcgataactttgatcatagaatacttgagcttttgcagagcgacggacgaatgactatcaccgatctatctgatcagattgggttgtctaaaacgccctgcttgaagcgtgttcaaaagctagaggctgcaggatatattaaggggtatcaagcaatcattaatcatgatttaatcgaaaataatcacattgcctttgttcagataaagctcaacgatacaaaaacaaaagctctcaatgctttcaataaagccattaaagaagttcctgaggttgagcagtgccatatgattgcttcaaattttgattatttattgaaggtgagaactgaaaatatggagagctatagaaaagttctaggggaaaaaatttcggcactaccacatgttcaaaatagctccacttttgtcgtcatggaggaagtagttactagtcgatatgcctaattaagagagtttcgatttaatgagctgtgagacttgacccatatcagctttaccatccagctgactttttagaatacccatgagttttcccatatctttcatagagtccgctcctgtatcagaaatcgccttaacgacagctgcttnganctcatcttcaccaagctgcttaggcatgtaattattaataattaacaactctgcctcttcaacctcaactaggtcggttcggcctgcgtctgagaattgagagatagagtctttgcgctgcttaaccattttttgaatcacagccatgacttgattgtcatctaaatcaatacgttcatctatctctttttgtttgattgccccgaggatcatacgaatcgctttgagggcaggtttgtcttgggccttcatagccaacttcatgtcatcagtaatgag

SEQ ID NO: 1399 - DNA, 4000 bp, Escherichia coli
  misc_feature (596)..(596): n is a, c, g, or t
  misc_feature (720)..(720): n is a, c, g, or t
  misc_feature (1428)..(1428): n is a, c, g, or t
  misc_feature (1431)..(1431): n is a, c, g, or t
  misc_feature (1739)..(1739): n is a, c, g, or t
  misc_feature (1742)..(1742): n is a, c, g, or t
  misc_feature (2195)..(2195): n is a, c, g, or t
  misc_feature (2597)..(2597): n is a, c, g, or t
  misc_feature (2599)..(2599): n is a, c, g, or t
  misc_feature (2705)..(2705): n is a, c, g, or t
  misc_feature (3576)..(3576): n is a, c, g, or t
ggtgttccttttcgtggggctcttagtggttactttgtggtctcttatttataaactatatggaggactcttatgtctggaaattataaaggtaagtttgatgttgttgttaatacggtaaataaagtggtacttaaagagaatgcttcaggactctggtctaatgaaggtgaacttgttgatggtaaattaaagtatgatgttaaggcttgttatcaatggatgcttgatgtggctaaatcacagaaggctgagtttaaaccattcacaccgaatgcttcagcctctgacttagagccaacggttaagagtggtcgtggtgataaaccatacatggctatgttgagtgcatcagataactttggtgcttcaaacaaacgtactgttactgtatttgcaccacagtaatatcacagtaatatcatgggtggtctacacgacaccctttttatttgttttataactattaaaggagttaaatatgaaggttaaagatattattactggattagaagaagagtttaatcttgatgatgagttaattattgtatttgtatcccataaagagatgcaagaactaacagatggttggtggntaaaggtggttaatgcctatgataatgagccttatccgatagatgttaagactagtaacaaacatacactgcataggtcagtgattaaccacgttataacaactgcgaatactattaggggggntaactgatgactttaagagagtattactttgagactattggtcagtacagcgacaacatcgaccataactggatacactatcttgacagggggtatgatataacgacaggtgaactgttgtcgttgtatgaacttatgtacagccttaagcatccagaggactgcggtgcagtagagtcttcagcgactcgtatgatggttcttagggtaggtaaagcactcggtatatatagactatatatgcggtgggtagactaccttgaaaggagggctaactgatggctgaggatatcaagggttacaccatacacaagacatctaacagagatgcaaacattcacactaccaagagagagtcgtttgatggtagcaataccttcgggagatggagacatagggacttgtgggatacgagtgatgagttgtatatagtgtatagttatggtgagcatgagcctatgtatatttatagtacactgcttggtgagtggtttgagaatggtgacaagtatgactcgaactcaaccaagaggcactacacacaacttaagcctaggaacactgctactaccatcaagagccacttgtatatgaagaaggtggaacggcatggggtggttggggctaccagagagagggtagcacctaagggtacaaccagtacaagggctgagtcatgggttaatgggacatggaggtagtatgaancanttaaagttattctgcctcagatggggcaaaggtggacagatggtgtgtgatgtagagggtaatcccacatacttcggtgataagacggtggctaaacagcaccgagatgagagcatggtggtgtcatatggcattgaccataagaaatataactacgttaaaggagatgtaagatgagagcaacattgatgaaagaaacagtgaaggcgttattcccacagcagaggacgctgtgtatagagggtagtccaggtggtggcaagacgaccatagtgcatgaggttgctgatgaccttggggttgagtgnagngagttgcatatgccgactatgttggtggaggacttcgggatactataccccgacaaagaggacagtgacaacttaacataccgcttaccagagtggttcccgcaagagggtaaagcaccagataaagggatactgttgttcgatgacaggaaccaagcaggtgctgacttgcagaaggtactggctaacatctgtcaagcgaggactctacatggacacaagttaccagatggttggcaggttatctcaacgggtaacaggcagaaggatagagcaggggctaaccgtgtcctatcacaccttaggaatagggagacagtcgttgaccttgatacacaccttgatgactggagtgcttgggcaatagagcatggggttaagactgaggtggtgtcgttcatacggtttagacctaacttactgcatgacttcgacccacagagagagcagaangctacgccgaggagttgggtagatggtgtgagtgatgtgcttgggactgtgccaccagaggcagagtatgagtgctttaaaggggcagttggtgagggtgcagcagcagagttcgtagggttcataaggatatatcggaaactacctaacccagatgcaatcttgcttaacccaactactgctagtgtgccatcagaccctgcaacgctgtatgcattgagtggtgcgatagcagagagggcaacagaggacaacttcaacagggtgtgtacttatgcagagcgtatgccaccagagttcagtgtgttaagcatcagttatgcagcgaggaagaagccagagttggcaagtaccaaggcgtttacagactgggcagttaaacaccaagacatcttattttangnggaatgtatgaaacttacagataaagcactgctagtgcaacttaacatcagccagtggtcagcgaggaagtatgaccgcaaggttactaaagacatactgacacancatggtgcatcgatgggtgcagggaggttcaacaagagcctactgcctatgagtggacaccttgacagtgtgcataagaaagcgactgcgattaggcagaagtattacaccaacaccctaccatggggcattgagggaactcagatgttacctagtgcgaactacttggagtttatgacagcgtttcgcaaggagaaaggggaatgggagtcgcttgttgcagagttcataagtaattatagtagactaaaggaggacgccaagaggttactacctaatggactgtacaatgaaagcgactacccatgtgacgacagtatacacgagaaatttcgtatggatatggcagtattccctgtacctagtgatgactttagggttgagataggtgatgatgaactcaacagcatacagcaagatgttgagaggcgtgttgctgaggcgagtgaaattgctatggcagacatctggaaaagactgtatgatagagtgaaacatatgagtgagaagttagcagacccgaaggcagtctttagagatactatggtggagaacacacgagagttgtgtgctttgttgccacgccttaactttgctgatgaccctaaccttgaggacttacgacaacaagttgagggttctctgctgttacaccctgatgcactgaggaacaacccagtagtgcgacaggataaggcacgagaggctaaggatatcatggataagatgagtgcatttatggggtaactccataacacagtgagtgtatcactgccacactgcctgccccataattcatacgaggtggtgtgggttatagaacggtatggttgcaaccgtatacacagcaaccccctatttatcaattatngaggagattatgatggcactaccaccacgaataagagcatatacaccaagaccttgggagtacgaggactaccttggtgcaacaaggcgtaagagcaacgcagtcagtcagaaaagatggcttgaagttgttgcattactgaacactgagtacaaagatgagatggacgacgctgtgtactcaattattaaagagatagacaaggaggttggtgatgactgatgcaccacgaatgagatactttgttattgattcgacaacaggtctaacattccacaacttctttgatgaaggtgctgcaatggaggcatgtatgcgaatgaagggtgattatcatataggtagagagttagttgatgagaagaacgcatctctaccatttaaagaggaggaatatcatggttgataaagttggataccatac

SEQ ID NO: 1400 - DNA, 4000 bp, Escherichia coli
  misc_feature (847)..(847): n is a, c, g, or t
  misc_feature (1276)..(1276): n is a, c, g, or t
  misc_feature (1429)..(1429): n is a, c, g, or t
  misc_feature (1979)..(1979): n is a, c, g, or t
  misc_feature (2120)..(2120): n is a, c, g, or t
  misc_feature (2216)..(2216): n is a, c, g, or t
  misc_feature (2219)..(2219): n is a, c, g, or t
  misc_feature (2222)..(2222): n is a, c, g, or t
  misc_feature (2252)..(2252): n is a, c, g, or t
  misc_feature (2267)..(2267): n is a, c, g, or t
  misc_feature (2276)..(2276): n is a, c, g, or t
  misc_feature (2279)..(2279): n is a, c, g, or t
  misc_feature (2286)..(2286): n is a, c, g, or t
  misc_feature (2288)..(2291): n is a, c, g, or t
  misc_feature (2313)..(2313): n is a, c, g, or t
  misc_feature (2315)..(2315): n is a, c, g, or t
  misc_feature (2318)..(2318): n is a, c, g, or t
  misc_feature (2320)..(2320): n is a, c, g, or t
  misc_feature (2322)..(2323): n is a, c, g, or t
  misc_feature (2330)..(2330): n is a, c, g, or t
  misc_feature (2334)..(2336): n is a, c, g, or t
  misc_feature (2384)..(2384): n is a, c, g, or t
  misc_feature (2390)..(2390): n is a, c, g, or t
  misc_feature (2396)..(2396): n is a, c, g, or t
  misc_feature (2399)..(2399): n is a, c, g, or t
  misc_feature (2506)..(2506): n is a, c, g, or t
  misc_feature (2564)..(2564): n is a, c, g, or t
  misc_feature (2606)..(2606): n is a, c, g, or t
  misc_feature (2612)..(2612): n is a, c, g, or t
  misc_feature (2687)..(2687): n is a, c, g, or t
  misc_feature (2725)..(2725): n is a, c, g, or t
  misc_feature (2779)..(2779): n is a, c, g, or t
  misc_feature (2784)..(2785): n is a, c, g, or t
  misc_feature (2787)..(2790): n is a, c, g, or t
  misc_feature (2792)..(2792): n is a, c, g, or t
  misc_feature (2795)..(2797): n is a, c, g, or t
  misc_feature (2799)..(2799): n is a, c, g, or t
  misc_feature (2801)..(2805): n is a, c, g, or t
  misc_feature (2807)..(2807): n is a, c, g, or t
  misc_feature (2812)..(2814): n is a, c, g, or t
  misc_feature (2816)..(2817): n is a, c, g, or t
  misc_feature (2819)..(2819): n is a, c, g, or t
  misc_feature (2821)..(2822): n is a, c, g, or t
  misc_feature (2824)..(2835): n is a, c, g, or t
  misc_feature (2837)..(2841): n is a, c, g, or t
  misc_feature (2843)..(2843): n is a, c, g, or t
  misc_feature (2846)..(2846): n is a, c, g, or t
  misc_feature (2848)..(2851): n is a, c, g, or t
  misc_feature (2853)..(2856): n is a, c, g, or t
  misc_feature (2858)..(2859): n is a, c, g, or t
  misc_feature (2861)..(2861): n is a, c, g, or t
  misc_feature (2863)..(2863): n is a, c, g, or t
  misc_feature (2866)..(2870): n is a, c, g, or t
  misc_feature (2873)..(2873): n is a, c, g, or t
  misc_feature (2875)..(2882): n is a, c, g, or t
  misc_feature (2885)..(2886): n is a, c, g, or t
  misc_feature (2888)..(2888): n is a, c, g, or t
  misc_feature (2890)..(2890): n is a, c, g, or t
  misc_feature (2892)..(2892): n is a, c, g, or t
  misc_feature (2894)..(2897): n is a, c, g, or t
  misc_feature (2899)..(2899): n is a, c, g, or t
  misc_feature (2902)..(2902): n is a, c, g, or t
  misc_feature (2905)..(2910): n is a, c, g, or t
  misc_feature (2914)..(2914): n is a, c, g, or t
  misc_feature (2918)..(2919): n is a, c, g, or t
  misc_feature (2921)..(2922): n is a, c, g, or t
  misc_feature (2925)..(2927): n is a, c, g, or t
  misc_feature (2929)..(2929): n is a, c, g, or t
  misc_feature (2931)..(2931): n is a, c, g, or t
  misc_feature (2933)..(2933): n is a, c, g, or t
  misc_feature (2935)..(2939): n is a, c, g, or t
  misc_feature (2942)..(2943): n is a, c, g, or t
  misc_feature (2945)..(2954): n is a, c, g, or t
  misc_feature (2957)..(2958): n is a, c, g, or t
  misc_feature (2960)..(2963): n is a, c, g, or t
  misc_feature (2966)..(2966): n is a, c, g, or t
  misc_feature (2968)..(2968): n is a, c, g, or t
  misc_feature (2970)..(2979): n is a, c, g, or t
  misc_feature (2981)..(2981): n is a, c, g, or t
  misc_feature (2983)..(2984): n is a, c, g, or t
  misc_feature (2986)..(2986): n is a, c, g, or t
  misc_feature (2988)..(2989): n is a, c, g, or t
  misc_feature (2991)..(2992): n is a, c, g, or t
  misc_feature (2995)..(2997): n is a, c, g, or t
  misc_feature (2999)..(2999): n is a, c, g, or t
  misc_feature (3001)..(3001): n is a, c, g, or t
  misc_feature (3003)..(3003): n is a, c, g, or t
  misc_feature (3005)..(3006): n is a, c, g, or t
  misc_feature (3008)..(3010): n is a, c, g, or t
  misc_feature (3012)..(3016): n is a, c, g, or t
  misc_feature (3018)..(3021): n is a, c, g, or t
  misc_feature (3025)..(3026): n is a, c, g, or t
  misc_feature (3030)..(3034): n is a, c, g, or t
  misc_feature (3036)..(3037): n is a, c, g, or t
  misc_feature (3039)..(3041): n is a, c, g, or t
  misc_feature (3043)..(3043): n is a, c, g, or t
  misc_feature (3045)..(3046): n is a, c, g, or t
  misc_feature (3048)..(3050): n is a, c, g, or t
  misc_feature (3052)..(3053): n is a, c, g, or t
  misc_feature (3056)..(3056): n is a, c, g, or t
  misc_feature (3058)..(3058): n is a, c, g, or t
  misc_feature (3060)..(3064): n is a, c, g, or t
  misc_feature (3066)..(3066): n is a, c, g, or t
  misc_feature (3068)..(3069): n is a, c, g, or t
  misc_feature (3071)..(3072): n is a, c, g, or t
  misc_feature (3074)..(3074): n is a, c, g, or t
  misc_feature (3076)..(3077): n is a, c, g, or t
  misc_feature (3080)..(3084): n is a, c, g, or t
  misc_feature (3086)..(3087): n is a, c, g, or t
  misc_feature (3090)..(3092): n is a, c, g, or t
  misc_feature (3094)..(3099): n is a, c, g, or t
  misc_feature (3101)..(3101): n is a, c, g, or t
  misc_feature (3103)..(3105): n is a, c, g, or t
  misc_feature (3109)..(3110): n is a, c, g, or t
  misc_feature (3112)..(3112): n is a, c, g, or t
  misc_feature (3114)..(3116): n is a, c, g, or t
  misc_feature (3119)..(3119): n is a, c, g, or t
  misc_feature (3121)..(3121): n is a, c, g, or t
  misc_feature (3123)..(3123): n is a, c, g, or t
  misc_feature (3125)..(3126): n is a, c, g, or t
  misc_feature (3128)..(3128): n is a, c, g, or t
  misc_feature (3130)..(3131): n is a, c, g, or t
  misc_feature (3133)..(3133): n is a, c, g, or t
  misc_feature (3136)..(3137): n is a, c, g, or t
  misc_feature (3139)..(3139): n is a, c, g, or t
  misc_feature (3141)..(3143): n is a, c, g, or t
  misc_feature (3146)..(3146): n is a, c, g, or t
  misc_feature (3148)..(3149): n is a, c, g, or t
  misc_feature (3151)..(3155): n is a, c, g, or t
  misc_feature (3157)..(3157): n is a, c, g, or t
  misc_feature (3159)..(3159): n is a, c, g, or t
  misc_feature (3161)..(3164): n is a, c, g, or t
  misc_feature (3166)..(3167): n is a, c, g, or t
  misc_feature (3169)..(3171): n is a, c, g, or t
  misc_feature (3173)..(3174): n is a, c, g, or t
  misc_feature (3177)..(3177): n is a, c, g, or t
  misc_feature (3179)..(3179): n is a, c, g, or t
  misc_feature (3181)..(3181): n is a, c, g, or t
  misc_feature (3184)..(3185): n is a, c, g, or t
  misc_feature (3187)..(3192): n is a, c, g, or t
  misc_feature (3194)..(3194): n is a, c, g, or t
  misc_feature (3196)..(3198): n is a, c, g, or t
  misc_feature (3201)..(3201): n is a, c, g, or t
  misc_feature (3203)..(3204): n is a, c, g, or t
  misc_feature (3206)..(3206): n is a, c, g, or t
  misc_feature (3208)..(3211): n is a, c, g, or t
  misc_feature (3213)..(3213): n is a, c, g, or t
  misc_feature (3215)..(3218): n is a, c, g, or t
  misc_feature (3220)..(3220): n is a, c, g, or t
  misc_feature (3222)..(3230): n is a, c, g, or t
  misc_feature (3232)..(3234): n is a, c, g, or t
  misc_feature (3237)..(3237): n is a, c, g, or t
  misc_feature (3239)..(3240): n is a, c, g, or t
  misc_feature (3242)..(3242): n is a, c, g, or t
  misc_feature (3246)..(3246): n is a, c, g, or t
  misc_feature (3250)..(3251): n is a, c, g, or t
  misc_feature (3253)..(3254): n is a, c, g, or t
  misc_feature (3256)..(3257): n is a, c, g, or t
  misc_feature (3260)..(3260): n is a, c, g, or t
  misc_feature (3262)..(3262): n is a, c, g, or t
  misc_feature (3265)..(3267): n is a, c, g, or t
  misc_feature (3270)..(3272): n is a, c, g, or t
  misc_feature (3274)..(3275): n is a, c, g, or t
  misc_feature (3277)..(3281): n is a, c, g, or t
  misc_feature (3284)..(3287): n is a, c, g, or t
  misc_feature (3289)..(3290): n is a, c, g, or t
  misc_feature (3292)..(3294): n is a, c, g, or t
  misc_feature (3296)..(3297): n is a, c, g, or t
  misc_feature (3299)..(3300): n is a, c, g, or t
  misc_feature (3302)..(3302): n is a, c, g, or t
  misc_feature (3305)..(3308): n is a, c, g, or t
  misc_feature (3311)..(3311): n is a, c, g, or t
  misc_feature (3313)..(3316): n is a, c, g, or t
  misc_feature (3319)..(3321): n is a, c, g, or t
  misc_feature (3323)..(3323): n is a, c, g, or t
  misc_feature (3325)..(3326): n is a, c, g, or t
  misc_feature (3332)..(3333): n is a, c, g, or t
  misc_feature (3335)..(3338): n is a, c, g, or t
  misc_feature (3340)..(3343): n is a, c, g, or t
  misc_feature (3346)..(3347): n is a, c, g, or t
  misc_feature (3349)..(3352): n is a, c, g, or t
  misc_feature (3355)..(3356): n is a, c, g, or t
  misc_feature (3358)..(3363): n is a, c, g, or t
  misc_feature (3366)..(3367): n is a, c, g, or t
  misc_feature (3369)..(3369): n is a, c, g, or t
  misc_feature (3372)..(3372): n is a, c, g, or t
  misc_feature (3374)..(3374): n is a, c, g, or t
  misc_feature (3376)..(3377): n is a, c, g, or t
  misc_feature (3379)..(3380): n is a, c, g, or t
  misc_feature (3382)..(3383): n is a, c, g, or t
  misc_feature (3386)..(3386): n is a, c, g, or t
  misc_feature (3388)..(3390): n is a, c, g, or t
  misc_feature (3392)..(3392): n is a, c, g, or t
  misc_feature (3394)..(3395): n is a, c, g, or t
  misc_feature (3398)..(3399): n is a, c, g, or t
  misc_feature (3401)..(3404): n is a, c, g, or t
  misc_feature (3406)..(3416): n is a, c, g, or t
  misc_feature (3421)..(3422): n is a, c, g, or t
  misc_feature (3424)..(3426): n is a, c, g, or t
  misc_feature (3428)..(3429): n is a, c, g, or t
  misc_feature (3431)..(3437): n is a, c, g, or t
  misc_feature (3439)..(3441): n is a, c, g, or t
  misc_feature (3443)..(3447): n is a, c, g, or t
  misc_feature (3449)..(3449): n is a, c, g, or t
  misc_feature (3451)..(3452): n is a, c, g, or t
  misc_feature (3455)..(3456): n is a, c, g, or t
  misc_feature (3458)..(3458): n is a, c, g, or t
  misc_feature (3460)..(3460): n is a, c, g, or t
  misc_feature (3462)..(3472): n is a, c, g, or t
  misc_feature (3474)..(3474): n is a, c, g, or t
  misc_feature (3477)..(3477): n is a, c, g, or t
  misc_feature (3480)..(3480): n is a, c, g, or t
  misc_feature (3482)..(3482): n is a, c, g, or t
  misc_feature (3485)..(3487): n is a, c, g, or t
  misc_feature (3490)..(3495): n is a, c, g, or t
  misc_feature (3497)..(3497): n is a, c, g, or t
  misc_feature (3499)..(3502): n is a, c, g, or t
  misc_feature (3505)..(3512): n is a, c, g, or t
  misc_feature (3514)..(3514): n is a, c, g, or t
  misc_feature (3516)..(3517): n is a, c, g, or t
  misc_feature (3519)..(3522): n is a, c, g, or t
  misc_feature (3524)..(3524): n is a, c, g, or t
  misc_feature (3528)..(3528): n is a, c, g, or t
  misc_feature (3530)..(3534): n is a, c, g, or t
  misc_feature (3536)..(3538): n is a, c, g, or t
  misc_feature (3540)..(3540): n is a, c, g, or t
  misc_feature (3542)..(3545): n is a, c, g, or t
  misc_feature (3547)..(3547): n is a, c, g, or t
  misc_feature (3551)..(3551): n is a, c, g, or t
  misc_feature (3553)..(3554): n is a, c, g, or t
  misc_feature (3558)..(3558): n is a, c, g, or t
  misc_feature (3560)..(3560): n is a, c, g, or t
  misc_feature (3562)..(3562): n is a, c, g, or t
  misc_feature (3564)..(3566): n is a, c, g, or t
  misc_feature (3569)..(3569): n is a, c, g, or t
  misc_feature (3571)..(3571): n is a, c, g, or t
  misc_feature (3573)..(3575): n is a, c, g, or t
  misc_feature (3577)..(3579): n is a, c, g, or t
  misc_feature (3581)..(3581): n is a, c, g, or t
  misc_feature (3583)..(3586): n is a, c, g, or t
  misc_feature (3588)..(3595): n is a, c, g, or t
  misc_feature (3597)..(3602): n is a, c, g, or t
  misc_feature (3604)..(3606): n is a, c, g, or t
  misc_feature (3609)..(3609): n is a, c, g, or t
  misc_feature (3613)..(3616): n is a, c, g, or t
  misc_feature (3618)..(3618): n is a, c, g, or t
  misc_feature (3620)..(3623): n is a, c, g, or t
  misc_feature (3625)..(3631): n is a, c, g, or t
  misc_feature (3634)..(3644): n is a, c, g, or t
  misc_feature (3646)..(3646): n is a, c, g, or t
  misc_feature (3648)..(3648): n is a, c, g, or t
  misc_feature (3650)..(3652): n is a, c, g, or t
  misc_feature (3654)..(3654): n is a, c, g, or t
  misc_feature (3657)..(3657): n is a, c, g, or t
  misc_feature (3659)..(3659): n is a, c, g, or t
  misc_feature (3661)..(3665): n is a, c, g, or t
  misc_feature (3668)..(3672): n is a, c, g, or t
  misc_feature (3674)..(3675): n is a, c, g, or t
  misc_feature (3677)..(3681): n is a, c, g, or t
  misc_feature (3683)..(3686): n is a, c, g, or t
  misc_feature (3688)..(3690): n is a, c, g, or t
  misc_feature (3692)..(3696): n is a, c, g, or t
  misc_feature (3698)..(3699): n is a, c, g, or t
  misc_feature (3701)..(3704): n is a, c, g, or t
  misc_feature (3706)..(3708): n is a, c, g, or t
  misc_feature (3710)..(3711): n is a, c, g, or t
  misc_feature (3715)..(3716): n is a, c, g, or t
  misc_feature (3718)..(3719): n is a, c, g, or t
  misc_feature (3721)..(3722): n is a, c, g, or t
  misc_feature (3725)..(3727): n is a, c, g, or t
  misc_feature (3730)..(3732): n is a, c, g, or t
  misc_feature (3734)..(3736): n is a, c, g, or t
  misc_feature (3738)..(3747): n is a, c, g, or t
  misc_feature (3749)..(3750): n is a, c, g, or t
  misc_feature (3753)..(3754): n is a, c, g, or t
  misc_feature (3756)..(3760): n is a, c, g, or t
  misc_feature (3762)..(3762): n is a, c, g, or t
  misc_feature (3767)..(3767): n is a, c, g, or t
  misc_feature (3770)..(3772): n is a, c, g, or t
  misc_feature (3777)..(3777): n is a, c, g, or t
  misc_feature (3779)..(3786): n is a, c, g, or t
  misc_feature (3791)..(3792): n is a, c, g, or t
  misc_feature (3800)..(3800): n is a, c, g, or t
  misc_feature (3802)..(3803): n is a, c, g, or t
  misc_feature (3806)..(3807): n is a, c, g, or t
  misc_feature (3810)..(3811): n is a, c, g, or t
  misc_feature (3814)..(3817): n is a, c, g, or t
  misc_feature (3820)..(3829): n is a, c, g, or t
  misc_feature (3834)..(3835): n is a, c, g, or t
  misc_feature (3838)..(3838): n is a, c, g, or t
  misc_feature (3844)..(3849): n is a, c, g, or t
  misc_feature (3851)..(3854): n is a, c, g, or t
  misc_feature (3857)..(3859): n is a, c, g, or t
  misc_feature (3861)..(3861): n is a, c, g, or t
  misc_feature (3865)..(3865): n is a, c, g, or t
  misc_feature (3867)..(3869): n is a, c, g, or t
  misc_feature (3871)..(3871): n is a, c, g, or t
  misc_feature (3873)..(3874): n is a, c, g, or t
  misc_feature (3876)..(3878): n is a, c, g, or t
  misc_feature (3883)..(3898): n is a, c, g, or t
  misc_feature (3900)..(3901): n is a, c, g, or t
  misc_feature (3904)..(3904): n is a, c, g, or t
  misc_feature (3907)..(3908): n is a, c, g, or t
  misc_feature (3911)..(3911): n is a, c, g, or t
  misc_feature (3914)..(3916): n is a, c, g, or t
  misc_feature (3918)..(3918): n is a, c, g, or t
  misc_feature (3920)..(3920): n is a, c, g, or t
  misc_feature (3923)..(3925): n is a, c, g, or t
  misc_feature (3927)..(3927): n is a, c, g, or t
  misc_feature (3929)..(3929): n is a, c, g, or t
  misc_feature (3931)..(3933): n is a, c, g, or t
  misc_feature (3935)..(3935): n is a, c, g, or t
  misc_feature (3940)..(3940): n is a, c, g, or t
  misc_feature (3942)..(3944): n is a, c, g, or t
  misc_feature (3948)..(3948): n is a, c, g, or t
  misc_feature (3951)..(3953): n is a, c, g, or t
  misc_feature (3956)..(3957): n is a, c, g, or t
  misc_feature (3959)..(3959): n is a, c, g, or t
  misc_feature (3963)..(3964): n is a, c, g, or t
  misc_feature (3968)..(3968): n is a, c, g, or t
  misc_feature (3970)..(3977): n is a, c, g, or t
  misc_feature (3980)..(3980): n is a, c, g, or t
  misc_feature (3982)..(3983): n is a, c, g, or t
  misc_feature (3985)..(3985): n is a, c, g, or t
  misc_feature (3987)..(3987): n is a, c, g, or t
  misc_feature (3989)..(3990): n is a, c, g, or t
  misc_feature (3995)..(3999): n is a, c, g, or t
cttaacattcgtgatagggtcgtataagcggtctgcttttggcaagaaatcgaaaccccaaccgttttctttggtggctttatcaccatagaacgttttcatcatactcacgaagaatttcgaggtattacgataatagtttacttggtttggtacgatatctttcggtgtaatcgcattgatatactgctcataagaggtatctttgtcgtttggtaaacgcatataacccggtaaagacatcggcaataagcccatatccgttgtaccttgtacgttggagtgtccacgtaatgcattaataccaccacccggcatacccatattacctaggagcaattggatcatcgccatagaacgaatattttgcgtaccgattgtgtgctcggtaaagcctaacgcatataagtgcgtcatggttttattcggtgcagaggttttaccaatttcttcacagatttgtaagaaggttttttgtttcacaccggtaatacgttcaaccatttccggcgtatagcgagaaacgtgatctttcaagatattaatcacacagcgtggatcttgtaaggtcatatcacgtttagcatggccattttcgtcgaattggtagttccatttagatttatcgtaagcgtgtttttcttcatcgaagcccacaaataaaccatcttcaaatttgaaaccttcatccactaagaaggacgcattggtgtagtgtttaacgtattcgtgttgaatttgattggtttccaataagtaacggatcacacccattaagaatgcaatatcagaaccggaacgaattggtgcatgaaagtcagcaacagaagccgtacggttaaagcgngggtcaactacgatgattttcgcaccgtttttcttcgcttcaattgcccaacggaagccaacagggtgggcttcagcagggttacccccttgaacaagaataagattggcgtttttgatgtcaacccagttatttgtcatggcaccgcgaccaaatgatggagcaagacttgctaccgttggtccgtgtcaagtattcgcttggttacacatcggcaccatgcccaacatccgcacccatttatgagtcagtagtgcggcctcgttgctcatggcggaggcggtcataatccctgtggttgtccaacggttaaccgttttgccactcgcatctttttcaacgaagttggcatcacggtcatctttcattagacgggcaatgcgtttaattgcatcttgccaagaaatgcgttcccatttatcggaaccnggtgcacgatattcagggtataacgcacggctttcactattgatatagtctaatgcaccggcacccttcggacataatgccccacggctgaccggatgatcagggtcaccttcgatatggaacaatttagagcgggtattggttgaggtatgnccgcttaatgtattagatggaatacctgtactatacatcaacataccgcagcttacggcacaatatgtacaggtttgacgcgattctttcgcacgcaatagtttgtattcgcgtggtgcagctaaggctgtggacggtgcaaaacctaacatcgcaacggatgttccggccataccgccagcacagaccttgaagaattttcttcttgagatctgcataaatactccccacaatcaacaaaacttgttgttgatctttgtttaatgtttaatagttataaatcacatttgagtagataacttagtcatcgattttgttaaaatagtattacaattaaacgccaccgagactaaacctaacgtaacaagagatacgacctatctattcgttagcgtgcgctagaatacctatttttcaaacataaatctataatcactaataattaaaaggacaaaaaaaattgagttggatcacaaaaagaacaattaattttatcaaaaatttaacaaatccggcgacatcggacagtgacatcatcgtcaccgaaagncaggataccttggcgaaagaagtgcctgttgccctcgtgtataacgacatcgcccataccgtcatgatgtgttcaccacgagatttagaggattttgccatgggcttttccctcacagaaggcattatcgacaagccggcngatatttatggcattgatatcgaggaagtgtgtaacggtatggaagccagaattgaactggcgacccgttgctttgtggcattgaaagatcaccgncgnacnttaaccggacgcaccggttgtggcatttgnggtgcagaacaaatncaacaggtntanaaaaacntnnnnaaattagaccgcactttaacgntnaangncnnccaattngatnnntgcttgcaacaattatatgaggcacaagaacttggcaagcaaaccggntccacncatgcngcngcatttttttctgcagaagggaaactactcgccattcgtgaagatgtcggtcgccatgtggcattagataaattattgggatggcacgctaaagctgacaagccacngggttttatcgttgtcaccagtcgcgccagttatgaaatggtgcaaaaaaccgtttcntgtggtattgaaatgcttgttgcgatttctgccgcaacgganctcgcngtacaaatggcggaacaatataatctaacccttgttggtttcgcccgagaaggtcgagcaacgatctatagtggnaaagaaagattgctgacgccccttccctcctctgttcncgcataaaatttatcaaaaaaatcccccgcacttttcagcttgggggatgtttnttttnnannnnantannnantnnnnnanttttnnncnnantnnannnnnnnnnnnnannnnngnaanannnncnnnnanncntnttnnnnnaangnnnnnnnnttnncnantngnnnnanttnttnnnnnncttntttnncnnaannnancngntnnnnnaannannnnnnnnnnttnncnnnnccntncnnnnnnnnnnantnnancnncnnttnnncntntnanncnnngnnnnncnnnnttgnnaaannnnncnncnnntngnncnnngnnaangntnnnnnancnncnncngnnttnnnnntnnccnnntnnnnnncngnnntttnnanannnttngntnanngntnnanttnntncnnnttncnntnnnnntntngnnnntnngnnnannaangnanaanngnnnnnncngnnngtncnncnannnncngnnnngntnnnnnnnnnannnttnanncntttnattnngnnannaangnttnnnaannnannannnnnaannnngnnannncnnannanttnnnnttntnnnnaannncngnntttttnnannnntnnnncgnnannnncanngnnnnnnttnncnggntngnnannannccnannnangnnttnngnnnngnnnnnnnnnnnttttnnannnanntnnnnnnnannncnnnnntnannttnnananannnnnnnnnnncnttnccngnttnnnggnnnnnncngnnnnaannnnnnnnananncnnnncntttnannnnngnnntngnnnntncccngnnaaancntncnnnttnancnnngnnngnannnngnnnnnnnncnnnnnnannnccngggnnnncngnnnnannnnnnnaannnnnnnnnnngnancnnncngcnantnnnnnttnnnnnannannnnnannnntnnncnnnnncnncnnnngnnncnnaaanngnnannttnnnttnnntnnncnnnnnnnnnnannaanngnnnnntnaaaanttnnnaaaantnnnnnnnnccctnnttttaaantnnaannggnnaannnnaannnnnnnnnnaattnnaantttttnnnnnnannnnaannngnaaancnnntnannannnttttnnnnnnnnnnnnnnnncnnttnccnnaancannncnanttnnncntnannntnatttncnnncctnttnnngtnngnaaannaaantnnnnnnnnttnanntntngnnggaannnnnt

SEQ ID NO: 1401 - DNA, 4000 bp, Escherichia coli
  misc_feature (4)..(4): n is a, c, g, or t
  misc_feature (462)..(462): n is a, c, g, or t
  misc_feature (1336)..(1336): n is a, c, g, or t
  misc_feature (1983)..(1984): n is a, c, g, or t
  misc_feature (1986)..(1987): n is a, c, g, or t
  misc_feature (1989)..(1990): n is a, c, g, or t
  misc_feature (1994)..(1995): n is a, c, g, or t
  misc_feature (1998)..(2008): n is a, c, g, or t
  misc_feature (2010)..(2011): n is a, c, g, or t
  misc_feature (2048)..(2050): n is a, c, g, or t
  misc_feature (2052)..(2058): n is a, c, g, or t
  misc_feature (2060)..(2067): n is a, c, g, or t
  misc_feature (2070)..(2072): n is a, c, g, or t
  misc_feature (2074)..(2077): n is a, c, g, or t
  misc_feature (2115)..(2117): n is a, c, g, or t
  misc_feature (2119)..(2125): n is a, c, g, or t
  misc_feature (2127)..(2127): n is a, c, g, or t
  misc_feature (2129)..(2130): n is a, c, g, or t
  misc_feature (2132)..(2132): n is a, c, g, or t
  misc_feature (2134)..(2136): n is a, c, g, or t
  misc_feature (2138)..(2140): n is a, c, g, or t
  misc_feature (2142)..(2142): n is a, c, g, or t
  misc_feature (2181)..(2188): n is a, c, g, or t
  misc_feature (2190)..(2190): n is a, c, g, or t
  misc_feature (2192)..(2193): n is a, c, g, or t
  misc_feature (2195)..(2195): n is a, c, g, or t
  misc_feature (2197)..(2209): n is a, c, g, or t
  misc_feature (2246)..(2246): n is a, c, g, or t
  misc_feature (2248)..(2254): n is a, c, g, or t
  misc_feature (2256)..(2275): n is a, c, g, or t
  misc_feature (2312)..(2314): n is a, c, g, or t
  misc_feature (2316)..(2320): n is a, c, g, or t
  misc_feature (2322)..(2330): n is a, c, g, or t
  misc_feature (2332)..(2333): n is a, c, g, or t
  misc_feature (2335)..(2341): n is a, c, g, or t
  misc_feature (2380)..(2381): n is a, c, g, or t
  misc_feature (2383)..(2383): n is a, c, g, or t
  misc_feature (2385)..(2391): n is a, c, g, or t
  misc_feature (2394)..(2394): n is a, c, g, or t
  misc_feature (2399)..(2401): n is a, c, g, or t
  misc_feature (2403)..(2403): n is a, c, g, or t
  misc_feature (2405)..(2407): n is a, c, g, or t
  misc_feature (2444)..(2445): n is a, c, g, or t
  misc_feature (2448)..(2454): n is a, c, g, or t
  misc_feature (2456)..(2463): n is a, c, g, or t
  misc_feature (2465)..(2465): n is a, c, g, or t
  misc_feature (2467)..(2473): n is a, c, g, or t
  misc_feature (2510)..(2511): n is a, c, g, or t
  misc_feature (2514)..(2521): n is a, c, g, or t
  misc_feature (2523)..(2532): n is a, c, g, or t
  misc_feature (2534)..(2537): n is a, c, g, or t
  misc_feature (2539)..(2539): n is a, c, g, or t
  misc_feature (2576)..(2588): n is a, c, g, or t
  misc_feature (2590)..(2590): n is a, c, g, or t
  misc_feature (2592)..(2600): n is a, c, g, or t
  misc_feature (2602)..(2605): n is a, c, g, or t
  misc_feature (2642)..(2671): n is a, c, g, or t
  misc_feature (2708)..(2712): n is a, c, g, or t
  misc_feature (2715)..(2715): n is a, c, g, or t
  misc_feature (2717)..(2719): n is a, c, g, or t
  misc_feature (2721)..(2725): n is a, c, g, or t
  misc_feature (2727)..(2727): n is a, c, g, or t
  misc_feature (2729)..(2732): n is a, c, g, or t
  misc_feature (2735)..(2737): n is a, c, g, or t
  misc_feature (2774)..(2786): n is a, c, g, or t
  misc_feature (2788)..(2798): n is a, c, g, or t
  misc_feature (2800)..(2803): n is a, c, g, or t
  misc_feature (2840)..(2842): n is a, c, g, or t
  misc_feature (2844)..(2853): n is a, c, g, or t
  misc_feature (2855)..(2858): n is a, c, g, or t
  misc_feature (2861)..(2862): n is a, c, g, or t
  misc_feature (2864)..(2869): n is a, c, g, or t
  misc_feature (2907)..(2927): n is a, c, g, or t
  misc_feature (2930)..(2930): n is a, c, g, or t
  misc_feature (2932)..(2935): n is a, c, g, or t
  misc_feature (2972)..(2978): n is a, c, g, or t
  misc_feature (2980)..(2988): n is a, c, g, or t
  misc_feature (2990)..(3000): n is a, c, g, or t
  misc_feature (3040)..(3059): n is a, c, g, or t
  misc_feature (3062)..(3063): n is a, c, g, or t
  misc_feature (3065)..(3067): n is a, c, g, or t
  misc_feature (3075)..(3075): n is a, c, g, or t
  misc_feature (3077)..(3077): n is a, c, g, or t
  misc_feature (3088)..(3088): n is a, c, g, or t
  misc_feature (3104)..(3106): n is a, c, g, or t
  misc_feature (3109)..(3110): n is a, c, g, or t
  misc_feature (3112)..(3112): n is a, c, g, or t
  misc_feature (3114)..(3114): n is a, c, g, or t
  misc_feature (3116)..(3119): n is a, c, g, or t
  misc_feature (3121)..(3121): n is a, c, g, or t
  misc_feature (3123)..(3125): n is a, c, g, or t
  misc_feature (3129)..(3131): n is a, c, g, or t
  misc_feature (3133)..(3133): n is a, c, g, or t
  misc_feature (3141)..(3141): n is a, c, g, or t
  misc_feature (3143)..(3143): n is a, c, g, or t
  misc_feature (3170)..(3171): n is a, c, g, or t
  misc_feature (3174)..(3176): n is a, c, g, or t
  misc_feature (3178)..(3179): n is a, c, g, or t
  misc_feature (3182)..(3184): n is a, c, g, or t
  misc_feature (3186)..(3189): n is a, c, g, or t
  misc_feature (3191)..(3195): n is a, c, g, or t
  misc_feature (3197)..(3199): n is a, c, g, or t
  misc_feature (3207)..(3207): n is a, c, g, or t
  misc_feature (3209)..(3209): n is a, c, g, or t
  misc_feature (3220)..(3220): n is a, c, g, or t
  misc_feature (3236)..(3238): n is a, c, g, or t
  misc_feature (3240)..(3243): n is a, c, g, or t
  misc_feature (3245)..(3250): n is a, c, g, or t
  misc_feature (3252)..(3258): n is a, c, g, or t
  misc_feature (3261)..(3265): n is a, c, g, or t
  misc_feature (3273)..(3273): n is a, c, g, or t
  misc_feature (3275)..(3275): n is a, c, g, or t
  misc_feature (3286)..(3286): n is a, c, g, or t
  misc_feature (3302)..(3303): n is a, c, g, or t
  misc_feature (3306)..(3306): n is a, c, g, or t
  misc_feature (3308)..(3316): n is a, c, g, or t
  misc_feature (3318)..(3318): n is a, c, g, or t
  misc_feature (3320)..(3331): n is a, c, g, or t
  misc_feature (3341)..(3341): n is a, c, g, or t
  misc_feature (3352)..(3352): n is a, c, g, or t
  misc_feature (3368)..(3379): n is a, c, g, or t
  misc_feature (3381)..(3383): n is a, c, g, or t
  misc_feature (3387)..(3389): n is a, c, g, or t
  misc_feature (3391)..(3395): n is a, c, g, or t
  misc_feature (3397)..(3397): n is a, c, g, or t
  misc_feature (3405)..(3405): n is a, c, g, or t
  misc_feature (3407)..(3407): n is a, c, g, or t
  misc_feature (3418)..(3418): n is a, c, g, or t
  misc_feature (3435)..(3441): n is a, c, g, or t
  misc_feature (3445)..(3449): n is a, c, g, or t
  misc_feature (3452)..(3455): n is a, c, g, or t
  misc_feature (3457)..(3457): n is a, c, g, or t
  misc_feature (3459)..(3460): n is a, c, g, or t
  misc_feature (3462)..(3463): n is a, c, g, or t
  misc_feature (3471)..(3471): n is a, c, g, or t
  misc_feature (3473)..(3473): n is a, c, g, or t
  misc_feature (3500)..(3505): n is a, c, g, or t
  misc_feature (3507)..(3509): n is a, c, g, or t
  misc_feature (3513)..(3514): n is a, c, g, or t
  misc_feature (3516)..(3516): n is a, c, g, or t
  misc_feature (3518)..(3521): n is a, c, g, or t
  misc_feature (3523)..(3525): n is a, c, g, or t
  misc_feature (3527)..(3527): n is a, c, g, or t
  misc_feature (3529)..(3530): n is a, c, g, or t
  misc_feature (3534)..(3535): n is a, c, g, or t
  misc_feature (3541)..(3544): n is a, c, g, or t
  misc_feature (3548)..(3548): n is a, c, g, or t
  misc_feature (3555)..(3555): n is a, c, g, or t
  misc_feature (3557)..(3560): n is a, c, g, or t
  misc_feature (3564)..(3565): n is a, c, g, or t
  misc_feature (3567)..(3570): n is a, c, g, or t
  misc_feature (3573)..(3576): n is a, c, g, or t
  misc_feature (3578)..(3578): n is a, c, g, or t
  misc_feature (3580)..(3581): n is a, c, g, or t
  misc_feature (3584)..(3587): n is a, c, g, or t
  misc_feature (3589)..(3591): n is a, c, g, or t
  misc_feature (3593)..(3596): n is a, c, g, or t
  misc_feature (3599)..(3603): n is a, c, g, or t
  misc_feature (3607)..(3608): n is a, c, g, or t
  misc_feature (3611)..(3611): n is a, c, g, or t
  misc_feature (3614)..(3615): n is a, c, g, or t
  misc_feature (3619)..(3619): n is a, c, g, or t
  misc_feature (3624)..(3627): n is a, c, g, or t
  misc_feature (3630)..(3632): n is a, c, g, or t
  misc_feature (3637)..(3638): n is a, c, g, or t
  misc_feature (3640)..(3651): n is a, c, g, or t
  misc_feature (3653)..(3654): n is a, c, g, or t
  misc_feature (3656)..(3663): n is a, c, g, or t
  misc_feature (3665)..(3666): n is a, c, g, or t
  misc_feature (3668)..(3670): n is a, c, g, or t
  misc_feature (3673)..(3673): n is a, c, g, or t
  misc_feature (3681)..(3681): n is a, c, g, or t
  misc_feature (3685)..(3685): n is a, c, g, or t
  misc_feature (3689)..(3691): n is a, c, g, or t
  misc_feature (3696)..(3704): n is a, c, g, or t
  misc_feature (3707)..(3707): n is a, c, g, or t
  misc_feature (3709)..(3715): n is a, c, g, or t
  misc_feature (3717)..(3718): n is a, c, g, or t
  misc_feature (3720)..(3721): n is a, c, g, or t
  misc_feature (3723)..(3725): n is a, c, g, or t
  misc_feature (3727)..(3728): n is a, c, g, or t
  misc_feature (3731)..(3736): n is a, c, g, or t
  misc_feature (3739)..(3740): n is a, c, g, or t
  misc_feature (3742)..(3743): n is a, c, g, or t
  misc_feature (3746)..(3747): n is a, c, g, or t
  misc_feature (3751)..(3751): n is a, c, g, or t
  misc_feature (3755)..(3759): n is a, c, g, or t
  misc_feature (3762)..(3763): n is a, c, g, or t
  misc_feature (3766)..(3767): n is a, c, g, or t
  misc_feature (3769)..(3769): n is a, c, g, or t
  misc_feature (3772)..(3774): n is a, c, g, or t
  misc_feature (3777)..(3779): n is a, c, g, or t
  misc_feature (3781)..(3782): n is a, c, g, or t
  misc_feature (3786)..(3786): n is a, c, g, or t
  misc_feature (3791)..(3791): n is a, c, g, or t
  misc_feature (3813)..(3813): n is a, c, g, or t
  misc_feature (3830)..(3831): n is a, c, g, or t
  misc_feature (3833)..(3833): n is a, c, g, or t
  misc_feature (3835)..(3835): n is a, c, g, or t
  misc_feature (3839)..(3839): n is a, c, g, or t
  misc_feature (3845)..(3846): n is a, c, g, or t
  misc_feature (3848)..(3848): n is a, c, g, or t
  misc_feature (3850)..(3851): n is a, c, g, or t
  misc_feature (3854)..(3854): n is a, c, g, or t
  misc_feature (3856)..(3857): n is a, c, g, or t
  misc_feature (3866)..(3866): n is a, c, g, or t
  misc_feature (3879)..(3879): n is a, c, g, or t
  misc_feature (3896)..(3896): n is a, c, g, or t
  misc_feature (3898)..(3898): n is a, c, g, or t
  misc_feature (3901)..(3901): n is a, c, g, or t
  misc_feature (3904)..(3906): n is a, c, g, or t
  misc_feature (3908)..(3908): n is a, c, g, or t
  misc_feature (3911)..(3911): n is a, c, g, or t
  misc_feature (3920)..(3920): n is a, c, g, or t
  misc_feature (3922)..(3922): n is a, c, g, or t
  misc_feature (3932)..(3932): n is a, c, g, or t
  misc_feature (3945)..(3945): n is a, c, g, or t
  misc_feature (3963)..(3964): n is a, c, g, or t
  misc_feature (3966)..(3966): n is a, c, g, or t
  misc_feature (3968)..(3969): n is a, c, g, or t
  misc_feature (3972)..(3972): n is a, c, g, or t
  misc_feature (3976)..(3976): n is a, c, g, or t
  misc_feature (3978)..(3978): n is a, c, g, or t
  misc_feature (3985)..(3985): n is a, c, g, or t
  misc_feature (3988)..(3988): n is a, c, g, or t
  misc_feature (3998)..(3998): n is a, c, g, or t
aatnattaaagagcaaattaactgaaagatagaaactaagcgagaattatgagcaaaaattgttaaacaaaaaattgaaagtcaactagaaattttagaagagaacaataaaagtgcaattaaagtagaaatgttaagaggatatattaaagaggttcaaccaggtgatgttagtaaccgggaaggacatgcggcaaaagtgtatttcaacgaactatttggtaacgaatttgctcgcagtcaagacaatattattaatgcagctctaaactttggttatacagtgattcgttcagcatttagtcgaacaattgtatctaaaggtttacacccatcaattagtctatttcactccaatcagtacgatgcttttgccttggctgatgatttaatggaacctttccgtccggtgattgatgattttgtttataagaattaccaagaatgagagtactttggtanggaacaaaaacaagcgttagtgaatttattaaatgtgcaaattaactttgatggtaaggatgtatttctgacatcggcaattaatcgatatgttgataatgtgattaattatatggaatctggtgaaatggattatttagtttttccttacttagaacatattcagtattatgagttatagatatatgcgtttattagtaatgtatgatttgccaatgacttcgaagcattatgtgaaagaatataccaagttcagaaagtatttattaaaagaaggttatgtgatggtgcaacaatcaatttatagtaagttgtgcctgaatcaagatgtggttgataacaccattagaaggttagagaaaaatttaccagcacttggtaatgtacgtgcattacaagtgacagaaaaacagtatgccaaaatcaaaattatggttgggcataagagtttacaagaacaagatcaaaacgatagaaggatggtgattttgtagtgattattaaaaactataaacgcttaaattatgttaagtttaacttaacaaaaactaagatcattctcaataaagattatttagaacgtaaagatttattagaagtattaaacttaacctttaataataaaaaaatacctgaggatgctgtggtcaagtgagaagaaaatgatttgatttacaaccttaaaaatttgaaagtaattaatattcccaacttaattgattttgaaaaagacttctttgatggttcaaaatcaattgtaaaaactttaattcaagaagttttacaagccttggaatatcaaaacaaaaacttaattgaactagaaagtcttctattctcttttaaattagaaaatgaattagaatcattaaanaacctttttaaagaaattaaaagtgattaccacttgtctttaaaaactaatttaattggttcaattgcacaagtattgagtgattatttagaattggaaatgctaaaccaaaatgatgaaagactaaccgaagataacattacttttgaacttttaaataacctctatttcaaattattaaacttcatcattgcttgcatggataaccaagctttagtgatttttgacaatccttttactggaattaaatatcaagatttaccaaagataatgagcttgattaataaaattgattataagattttagtacttagtgaaatgccgttaattgatgataaaaacttaagtgatgtttttatctttggtgagcaatttctgcttgatttttcagaattctataataatttagaagatattcaaaaattcattgatcaagatgttgaaccaattttaaacaaagtttctcaaaatattgttcaacaatttaacgtttatgactaccaatacgaaaagatgcttttatttaacgataaaagcgaagaaattttatttactgcaattaaaaactatcaaatagtttaaaaaattacctaaaatacttgatttgacgtttcggccccctgtaaaatttttgtgtagtaaaactnnannannttgnnttnnnnnnnnnnntnngtttcggccccctgtaaaatttttgtgtagtaaaacnnntnnnnnnnannnnnnnntannnannnngtttcggccccctgtaaaatttttgtgtagtaaaacannncnnnnnnnantnnanannntnnnanagtttcggccccctgtaaaatttttgtgtagtaaaactnnnnnnnnananngnannnnnnnnnnnnngtttcggccccctgtaaaatttttgtgtagtaaaacntnnnnnnnannnnnnnnnnnnnnnnnnnngtttcggccccctgtaaaatttttgtgtagtaaaacnnnannnnnannnnnnnnntnntnnnnnnngtttcggccccctgtaaaatttttgtgtagtaaaacaanngnannnnnnnaanaaatnnncnannngtttcggccccctgtaaaatttttgtgtagtaaaacnntannnnnnntnnnnnnnnantnnnnnnngtttcggccccctgtaaaatttttgtgtagtaaaacnnaannnnnnnnannnnnnnnnncnnnntngtttcggccccctgtaaaatttttgtgtagtaaaacnnnnnnnnnnnnntnannnnnnnnntnnnngtttcggccccctgtaaaatttttgtgtagtaaaacnnnnnnnnnnnnnnnnnnnnnnnnnnnnnngtttcggccccctgtaaaatttttgtgtagtaaaacnnnnnaantnnnannnnnantnnnnttnnngtttcggccccctgtaaaatttttgtgtagtaaaacnnnnnnnnnnnnnannnnnnnnnnnannnngtttcggccccctgtaaaatttttgtgtagtaaaacnnnannnnnnnnnntnnnntannannnnnngtttcggccccctgtaaaatttttgtgtagtaaaacannnnnnnnnnnnnnnnnnnnnaantnnnngtttcggccccctgtaaaatttttgtgtagtaaaacnnnnnnntnnnnnnnnncnnnnnnnnnnnagtttcggccccctgtaaaatttttgtgtagtaaaactgnnnnnnnnnnnnnnnnnnnngannannngtttcggncncctgtaaaatntttgtgtagtaaaacnnnttnnantnannnnantnnngtannngngtttcggncncctgtaaaatttttgtgtagtaaaacnnaannngnnggnnntnnnntnnnnntnnngtttcggncncctgtaaaatntttgtgtagtaaaacnnnannnncnnnnnntnnnnnnnaannnnngtttcggncncctgtaaaatntttgtgtagtaaaacnnaanannnnnnnnnanannnnnnnnnnnngtttcggccncctgtaaaatntttgtgtagtaaaacnnnnnnnnnnnntnnnggannnannnnntngtttcggncncctgtaaaatntttgtgtagtaaaactnnnnnnnattnnnnngannnntnanntnngtttcggncncctgtaaaatttttgtgtagtaaaacnnnnnntnnnattnnanannnnannntnanntttnngccccnnnnaaanttttttntnnnnaaannannnnatnnnntnannttnnnnannnannnnttnnnnncccnntanaanntttntgtannnnaannnttaanngnnnnnnnnnnnntnnannnnnnnntnngnnnccngtaaaatntttntgtnnnaaaannnnnnnnnagntnnnnnnntnnannannntnnttnnnnnnccnntnnaanntttntgtnnnnnaannctnntncannnatnnntnntaanattcntgtttcggccccctgtaaaatntttgtgtagtaaaacanntncntttnttaaannananncangnnagtttcggncccctgtaaaatntttgtgtagtaaaacantnagntcnnnanccncttatgttnantagtttcggncccctgtaaaatntttgtgtagtaaaacacnnantnntgntttncntaaatcnganacgtttcggncc

SEQ ID NO: 1402 - DNA, 4000 bp, Escherichia coli
  misc_feature (307)..(307): n is a, c, g, or t
atcagcttttgcttcttcagtttcagcaagttcttctgcaggactttcaacctcagcagcagtttcactttctgcttcgtcattattttcagtcagctcagcagaagcttcaaggctgttttcaataatatctttagtttttgctaattctttttccaactgttcatcaatggaaagttcctccacctcgttgccaacgatgttgattttgtagccgattaatttagaagcaagccgaacgttctgtcctttgtgaccaattgccagagaaagttgattctgagcgacaatcacatctatttgattngcttcctcgtcaatttcaaggctctctatttccgcaggtgcaagagcattggcggtatattgatcaaggtcttcactccagcgtacaatatcaattttttcaccatttaaatcattgacaattgtctgcacacgactacctcgcatgccaacacatgaaccaactggatctacatcttcatctgtggaataaactgatatttttgctctgcgaccaggttctctggctgcattcacgattttgacaatgccgtcaaaaatttcaggaacttccatttcaaacatcttgatcagtaaacctggatgtgttcttgaaatcgttagttgagaatctttatgtggattgtcatttacgtccagtaaaagtacgcggacatgatctccgaatgtaaaattttcaccgtaaatctgctcacgtctgaataaatatgcttctactttattttgaaaactgaaagctatccggccgtttggttccacacgtattacgtttccggttaaaacttcgccaatcttgtcagtaaatgtggaaacgaccatttgccgctctgcttcttttaaactgccaaaaatgattggacgcgtagaatgtgcaattcgtaaaaattcacgatcacttatttcatactcaacttcatcaccaagacctgcttccggatcaatttgttctacatcttctaccgaaatttcgttgttcgaatcttctactatttcaacaacttccttaaaatgtgataagtttattttaccggttttttcatcaatctgaccttcaatttcgttatacggaagtttgcgttgagctgcctgtatcagtgactcttcaaccaacttaattactacttcgtggtccaaacctttctctttagaaaagtccttgatgatttcaaataagttctctttcaaaatttaccttttttgttgtacgttttcgttcaaaaattctatcagacagtcaaaaatccaagattggttctaggttcgcttttgtaatttgcgaaagcggaattactaattctgagccgtctgtttccagaattaagcatatttcctcttcagaacactcttcaagcataccgactgcgttcttgactccctgtatcttttgctgcagtcgcaccttaatacgctgccccttgaaagccttaaagtgttcaggtgtttttaatttgcggaaaattccgggtgatgaaacttccagtgcatttgtttcaaaaataggatcatcactacccaaaacctccatagccacctgattaacagtgacacagtcatccatcccgattccatgcggaccgtcaataaataactgtattgtctgctctgaaccatgccggttaaattcgacatctatcagctcataacctttagttttaatcggtacagccagtaaattaaacaaattttcttcagttctggccatgtgatccgcattgttttgagcaagctgtaaaatttacagattaaaagctaactcccatttttatcagttttatgttgataagtcgattctttttttagtcttgcttaagcttttcggtctattgtcaaatagtcaacaagttctccaagcaatgctttggcgggatgttcgggaagttttctcaaagctgatgaagcgagccctgcctgtttttgacagtaaaccgccgctgcatccaaagcacctgtactttcagcgctggctatacaccagtctatatcagcctctgagacttgttctcgttctgctaataaaatattgcgtacacgttccgcatctgtttcagcaagacgttccagcagttcgatagtgattaaggtacgctttccttcggctatgtctccaccgcgctcttttccataaccaccggcaccagcacttggagcttcattttcacttttttctgttaagttcaacaaatcatcacgaacctgaaaaccgataccaatcgcttctccaaaactaccgactgcttccagttctgactccgcagcaccagcaatcaatgctccgcactgacagggacctcttccggaataccaacctgttttcctgccaatcatttcacggtattctgcacggtcaggaaaagttctttttgcgacccagccgatatcgagagcctgtccttcaaaagtagcccgcatgaccttgttcaaatgccggtgaatctgcaaagaaagtgcgcttgacaatcttgtgtggttattcagtagagtctcatgtaccagacccagcaaagcatctccggaattaagcgcaagtgcaattccgtgttggagatgtaaagtcggttttccacggcgtagcaaagattcgtcctcgatgtcatcatgcaccagtgcaaaattatgaaataactcaagggcaactgcagaagtcagagcgtcttccggatcaccgccgaataattcgcaacagagcaagagcaatgcaggtcggaagcgttttcctccacgttgtggatagtcacgcattagatcatagagatactcttttggttctccgtccggaaagcagcgtagagtttcttcaccaatccactgactggcggctttcagataagtatttaactgcttatgatcacgggcaagaattttcattgtattttaatttctgaactaaagagcaaatattaaagaagaatgatttttattgcttagtatgattgaagtttcggaatacggaaattgttttttatccgttgatttgactgcttgagacctgcaacaggtaaaataacactcagacgatcggaacccggcagaaaatcaatgcggtgaaattctgtttcaggattcaaaaaagcttcgccaacatccttcagccgtcgtatctcctgtccgttaatccgcaggacaatggcatttgaaagtttttggtaaccaatgttaatctcatcagggataacctgcgttaccagaacgacacgtggagcagactcagtatttttggatgcggacttagcttttacgtttttataattatcatccatcaacacagtcttattttgttctaaaaataaacgtaaacgtactggcgcacgtgatctccagtttgctccccacatggagaggtaatttaaactcaattcctgaaataaaaatccgccctgaatcgcataacgtggaggatgtcctactcttttcaaaggtactgtacgtccatcttcttcataggcagaaactctcgtttgtaaaactatagcttttccattacgtatcagttcaagttccaaagaatctccgaccttaagctgatccaaaaaaagcagatcaaaaagcgaaagtccccattccggatgttttattttaccttcatgtgaaagttgccatttgcctatttttgtcaaataatccccgcgctgtaaaacatcggaacctgtaccgtaaggcaatattcgactgatccatatgcccggaagttccggtggaatttgaaaataatctgctgtgctgcgttgcggaagtctacgccagctaaaaccacgatgtgctaaactcttgtaggaaccactgcctgcatgtgctaaaaactcaagcagcatttgcgagggaattgctttcgcttctcctttaccggcctcaagaatcatccctacagtttcgttatcctgtaacagcggaaatccctgtccgctttttgaaacaccactcagtttcagcagcgctaaccacgcatcgctgactccgcggtgtcctacagccatgc

SEQ ID NO: 1403 - DNA, 4000 bp, Escherichia coli
  misc_feature (2)..(2): n is a, c, g, or t
  misc_feature (4)..(5): n is a, c, g, or t
  misc_feature (9)..(10): n is a, c, g, or t
  misc_feature (13)..(16): n is a, c, g, or t
  misc_feature (18)..(22): n is a, c, g, or t
  misc_feature (24)..(24): n is a, c, g, or t
  misc_feature (42)..(43): n is a, c, g, or t
  misc_feature (47)..(47): n is a, c, g, or t
  misc_feature (49)..(49): n is a, c, g, or t
  misc_feature (64)..(64): n is a, c, g, or t
  misc_feature (72)..(74): n is a, c, g, or t
  misc_feature (78)..(78): n is a, c, g, or t
  misc_feature (84)..(84): n is a, c, g, or t
  misc_feature (103)..(103): n is a, c, g, or t
  misc_feature (108)..(108): n is a, c, g, or t
  misc_feature (111)..(111): n is a, c, g, or t
  misc_feature (114)..(114): n is a, c, g, or t
  misc_feature (119)..(119): n is a, c, g, or t
  misc_feature (123)..(123): n is a, c, g, or t
  misc_feature (174)..(174): n is a, c, g, or t
  misc_feature (180)..(180): n is a, c, g, or t
  misc_feature (186)..(186): n is a, c, g, or t
  misc_feature (191)..(191): n is a, c, g, or t
  misc_feature (215)..(215): n is a, c, g, or t
  misc_feature (301)..(301): n is a, c, g, or t
  misc_feature (354)..(354): n is a, c, g, or t
  misc_feature (395)..(395): n is a, c, g, or t
  misc_feature (462)..(462): n is a, c, g, or t
  misc_feature (582)..(582): n is a, c, g, or t
  misc_feature (615)..(615): n is a, c, g, or t
  misc_feature (625)..(625): n is a, c, g, or t
  misc_feature (757)..(757): n is a, c, g, or t
  misc_feature (962)..(962): n is a, c, g, or t
  misc_feature (965)..(965): n is a, c, g, or t
  misc_feature (992)..(992): n is a, c, g, or t
  misc_feature (1023)..(1023): n is a, c, g, or t
  misc_feature (1036)..(1036): n is a, c, g, or t
  misc_feature (1044)..(1044): n is a, c, g, or t
  misc_feature (1050)..(1051): n is a, c, g, or t
antnnaagnnacnnnnannnnnanttcttaagtgactttcannaaanantatatgaattttggnaggaatannnaganggaaancatgcattaatgaatgganaatanccnttnaagcnaaanataatacgaaaattaaattggagtgttgctaaaagggaatgggaaaatgtnaaattnaagaancctanggaaccagctattttgtataaaantgtattttgggaaaacaggttatgggaatggaaagtctttcttggaaatttaaagaaatggttttgtgcttttatttatattgcantttttgttacggtaatgaaaaaagaggcagaatttgagaaaatttttaatggnaatgaaattgttttgaaactatacacgataataggaaaacnatgtggaaattggattgttggaataattactgtagttatcgcaggaattatatcgtctttgctcctnaaaaatttaaaaataccggatatacttgaaagtatacagacaattgcacaggtgattatggatttctttagtaaattacgattccgaataataaagagatttttatgatatgcgtattgnatttgcagaacggaaaataagaaaggtagggtnaatatttgcnaaaataggaactgattaaaaagaagtgatgatgtatatgaaaaacaatacaccatcacttttttaaataattgattccgttaacaatttgataagaactgtaacgatgagattatttcgggtgtttgggatncaagaaactgcttgatggagaaaaataaataggttatcataaagacaggaaaagattgcagagggaaaaacgaaaaggaaagagggatgcgaatatgtgtgatgcgttaagagaactgatgaaggatgatctggaagatgccagaaaaatgggagaggctaaaggaaaagccgaaggaaagatcatgggagaagcaaaaatcatnctnaaaatgaatcacagcggaatgtccccngaaaacattgcatccatcacaggtaaggatntggatgaaattcntgcaatantggaannaaaagtaccggtggcactataaaaagcggttaaaaaataaaaaattaaaattgggactaaagtatttcagtcctcgtccgatatatataacaagtaagcaaggaaatcccgttgcttactccacgagacagacctttgaccggagcgtacggccgcaaaaaggaaaatcttacaatcaaatatcatatcaattgcagcatggacgctgcaacttaattcaaggaggaaattattatggcaatggtagtacagcataatatgcaggcgatgaatgcaaatcgtcagttaggtgtcacatcaggagcacaggctaaatcagcagagaagttatcatcaggttacagaatcaatcgcgcaggcgatgatgctgcaggattaaaaatttctgaaaagatgagaagccagatccgtggtcttaacaaagcttcagataacgcttcagatggcgtatctcttattcagacagcagaaggtgcgttaaatgagacacacagcatcttacagcgtatgaatgaacttgcagttcagggcgcaaatgataccaaccagtctatcgaccgcgatgctatcaatcaggaactttctgcattgactgatgaaattgatcgtatttctgaaactactcagttcaacaaacagaatctgttagatggatcctttacaggaaagaaccttcaggttggtgcaaatacagatcagaagatcaccattaacattgcacagatgaatgcagaagctattggatttaaaaaggttactgccgctggtcaggacagctactatacaacaaatgaagtagttgataagacaaaggctaaaacttctgcaacaatgagacagagtgttggtaagagagctgcatgcaatgcaacaattacaaaaaatacagcatctacaggctttaaagcaaatggaaaggcatatgctacttcagcagatgctcgtaatgccgtaagcaaagctgctatgtgcgctgcacagatctttaaggttgctggctataattctgcagccgtaagtaaaccgaatgttgataattaccagcaggcacagggaacaattacaatgattcagaacgcaatcaataatgtttccagccagagatctgctcttggtgctttacagaacagactggagcacacaattgcaaacttggataatgtatcagaaaatacacagtccgcagagtctcgtattcgtgataccgatatggctgaagaaatggttagctacagcaagaataatattcttgcacaggcaggacagtcaatgcttgcacaggctaatcagtctactcagggtgtattatcattattacagtaatcaagtgattttgaagagagagttggctatagccagctcttttttcaaatataaaaattcccttaaattaaaagcagaataggaaaagatatggtagaactcacggacaaattatgtcaggaaaaagtgaagataggtgtcattgtacagaaaatagaaataggggaagactatatgtcctatgtgaggacaatacttcctaagttgaatcagattatgacagaaatttttcgattaatgcagagatcggagctacagatagagctgaatatagattttgtagtacaagtattgcaagatattgtatatggaattgaacaggaagataaagtattcctacttgatgtgttgaaatacgggttagaagaaatctttgattatttaatagagatgctggcgggagaaaaaaatgaataaagaaatctacaagcaaaatataaccgcattgcggaataaatatcctgcatgggcaaatattataaaaaacagacataaaaagaaaaacatagatgtaatagttgaaaaaagcgttaccggagatactatattaaaggtaaagaaaaatggtaaaattctatatttaaatgggaaatatgcaccagacgaagtgggaaaacaatggattaaaaaacaggggaagattgatgcgtatgcgacaattgttattttaggtatttcaaatggtgtacatattaaacaaattatggaatctgcacccaaaacatgcaatatattaatctatgaaccttcttttgagttgtttcggagggaaatggaagaagttgatctatcgtttctgtttgcaatggatattccggtaggcattgttatagaaggattgaatgaaaatgaattgtccgcatatatcaatataatgattacatatgataatatgacgctgatgaagttttatttatcaggaaattatgatgttttatttccagaacaggtaaaaaaattggttaaagagttaaaagatcacatagaagaggaatcgattcgatggaataccttggttcgttatacagatgtgaaagcaaaaaatacgttttataatttgccatatctgtatgagggatatagtatagaagagctggaaggaattttgccgtctgaggtgcctacgattgtcgtgtcggcgggaccttctttaaataaaaatataatggatttaaaaaaagcagtggggaaagcctgtattattgcgacagacacagcaatgaaaccgttgttaaatgctggaattatcccgaatttgtttgtaattatagatggattaaagccgggacttctgtttgaacataaagatttgtcaaaagtaccaatggtgacaatgacaggagtatcagtagaaccgatgcaatatcataaggggaaaaaatttttctactatagttgtgctccattggaacatcaaatattgacagatttgggagaaaaagagcatcggagcagaaccttgccagatttagtaacaggaggttcagttgcaacttctgcatattctctgggggtatatatgggatctaagacggtcattttgataggacaggatcttgctatgacgggaaatcatacacatgcagatggaacatttaaagataagatggacgaaatagatatcaa

SEQ ID NO: 1404 - DNA, 4000 bp, Escherichia coli
  misc_feature (3344)..(3344): n is a, c, g, or t
  misc_feature (3351)..(3351): n is a, c, g, or t
  misc_feature (3527)..(3527): n is a, c, g, or t
  misc_feature (3698)..(3698): n is a, c, g, or t
  misc_feature (3754)..(3754): n is a, c, g, or t
gtattgatacaagcttcatcatccaagatagaccactccacacctcttttattaagggcgctacagatagatttggtaaaggtgttatccccagcatcaattaaaaagtttgtcatcttcgtcctccaccgcagtgatgcacgtctcatgccaaataaaatataatattaaaaaacaattaattaaataaattttttgtaggaaaatataatgacgcagtgcaacattcataattttgacacttagctaacataaaataaaatacgtcgttaaggtttatgaaggagaaaatatcatgaatgcaaaagccgctataaacaaatatactgcgataaaaacacaaacactttctagtcaagacatcgggtacaatgtagttagcaccgctctaattaagcttgagacaagtttgcaatcgctcttgacgtcgacgaatccagaaaaatctgcaaaagccttcgaagcagctttactcacaatctactttttacaaaaaagcttagattttaaagaccaggggaatttagcaataaatttatatcgcttatatgaattctgtcgggtcaagctaatcgaaataggtattcaagacagctttggtaatcacgaaatacgaaaatgtcattcctttgtgaatgaaatccggttaagctgggatagcgtaaaaaataaataaccggttaggcagcgcaatgtatgcaccagaatttgtattcggaatagcttcagcagagctggcttcccgttacataacctcaagtctggaaattgaaacaatcgcatacaaaatatcgatgcttctacaatctaactatagcggtgaaaattcagaaaatattaaaagtacagctgagtcgtttatgcatagtatgcttgaagcaggcatcgaaaattccgatgctattctattgaattatcaatacgaaaagtttctgtataagggcaacggcaaaattagaaattggtcaccgatgtttggggaccctatgcagggcatcaaaaaaaagctctatacaccaacaatagtaaatcgagatttcaaagcctttgtttacagaacgaagcaaagtggagcttacaattgcccaccaggatggtctctaagcagccaaacaacaaatgcttttctcaacaaattaggaaacttagaggtaagtgcttttgatataattaagtcaagcgattaaattggtgtgtaagtgtggcctaagtttaggtgtggtagatatattgaagtacttggtggccgctatattctgttggtaggcaggcgatacagcaccctgcgctaactgtctattctctgtaaggatagcagacggagtaagataaggactaaataatcgagacgtataatctgcagtaccttgggatctatccgtgcgatgtacaggtgttatagtttgccctgcagggccaaaagaacttgagttaagaacaccagaaactatcggttgatctggaaatttaacagccggaaggttaggagttttcaagtctacagctagcataactaaaccatagacacatttacgaagctacttcaagattttgctaaaaaggaaacataatgaagcgaaaatgcgctttttgcgaaaagtctcgtttagcgtttatctgggttattgcttcggtgattataataaatgccgtttttaatcttgtgtactctaatgatgccctcactacattccaaatattaaagcttccactggggctttgcatagtggcgtttttaattaagctgttacttaaaagagattaatcaccttaatctcaaaatcagtctacgccgcggatgtgacaactgaactcagcagagatggctcaatagactgttctttatttaaattaacaactaaatccgccttgtgtgtacattcatctttgccattataataggaacaagaaattacaaatttcatgtctcggtgcgagcggttatttttttcatttagcgtcataaatggtcctccttacaggcaaagccgcaattttcgtgccaaaaattagattatgttgtaatttattatatagacataatgaatgtctggattgtagccgtttttaactaagtaatcgtttagtccatccattattctgtcagtaattactttgcgcccctcaatggttgttaactctgcgctggtagtatccacagcgagggtagaaatttcagaaacgaggtcggcttcaatttcatagattgcttttataaaaaaatcagctgtgacgttagtctgaaatgtggctaccgcaacctcgaaactgaacagttctttggtatcgagcagacgtccctggaaaacgttttcaatttttaaatagttgtatttgtcaacaagtacagggttaccgtcgcctggcacaccctctgaactcaattccgtatctgttgacccctgcaaactttcggatcctatcaaagcatcaacctgctctgtgtagtacacacccgaataatcagttttcactaataaatgcccgaagctaaatagcaacagaactagtccagccggtaaaaatatctgcaaataaaacatattgctcccccggtgttgcgcccagcaaaaaacatgccatgaactttatgttagctaagttaattgattgtgaggtctttccctcacttcaacgctcacacccaagcggtcctcaccctcacgaagcaactgagaacttgagagttccgtcaaaccatcgagatcagttattgtaaacgacacctcagcctttgaactagaaattggtgttatgatctcatttttgacgtacttatgacgtagctgctcataacttttgaaaaattcaatccattcctcaaattcaccattcgaaatatttacggttgcaatcacgtccatttggtagtgagccctcttggataatcagttacatcattgatctctaatctatcttattccaagctagattttatgcaaaacatttctccaaaaattaaatagttttggcataaaaattgcgctctctacctgctcggctaacttggagaacccatttaatgcttttctatcaaagtcaaaaccgtcttgtaacattgattgttgtagccatgcctataattgctgaagccaagtcggcatgcattaacactccagaaaatatacaggtttgcgaggatgcagttaatgaccaacggtcattaaaaccaaaaaatagctcaaatttagataccatacagctctattactctggaagcatatcatacaatggtccatttctggacgaaaatagcaaaattaaattttcaccgaattcagaaattcctgaagatccccaaaatgtgccgtcaacaaacaaaaacgaacctgccaccgaaaaangtttagnagacttatatgctgcaactagttcgaaatttcgaagtttgtccaaagatgaaagaaaaaatgtacaaagatgtttgcggcacggttcttattccggaaaaattgatggcctgtggggaaagcaaaccttcgaagcagttctaaacattcaaaagaataggcattataacagtgatnatactgacgaggttaatataattgcaaagattaaaaatgcattttcaaaaaaagacgcctgttatgagttgattagtgaaactttctcaatgtaacttttcctcaatgtaacttttcgctttaaaatatatttcaaggaatataacctgttaaggtgaacctgtattcccncgctcaaccgcagctaggaggtcaaagtgtctgatcagaaacaaacagacgaggcnaagataactgttgacgttctacgagtcaaagaggacgaaaatacatatatcaatagttcaaaagagcgaatgtttgacgtagtaagtttattcgtaactaatgcagagggttccgtttcgttaagtgatttctcacaaatctttaagactgtaaccgtttggattaaattcagaccccgcaaactgggaacttatgttgaagttatgaaagaacggaatacggatacaacaatcagcgtccgttat

SEQ ID NO: 1405 - DNA, 4000 bp, Escherichia coli
  misc_feature (35)..(35): n is a, c, g, or t
  misc_feature (50)..(50): n is a, c, g, or t
  misc_feature (68)..(68): n is a, c, g, or t
  misc_feature (322)..(322): n is a, c, g, or t
  misc_feature (803)..(803): n is a, c, g, or t
  misc_feature (917)..(917): n is a, c, g, or t
  misc_feature (983)..(983): n is a, c, g, or t
  misc_feature (1173)..(1173): n is a, c, g, or t
  misc_feature (1355)..(1355): n is a, c, g, or t
  misc_feature (1367)..(1367): n is a, c, g, or t
  misc_feature (1604)..(1604): n is a, c, g, or t
  misc_feature (1619)..(1619): n is a, c, g, or t
  misc_feature (1649)..(1649): n is a, c, g, or t
  misc_feature (1673)..(1673): n is a, c, g, or t
  misc_feature (1688)..(1688): n is a, c, g, or t
  misc_feature (1769)..(1769): n is a, c, g, or t
  misc_feature (1985)..(1985): n is a, c, g, or t
  misc_feature (2006)..(2007): n is a, c, g, or t
  misc_feature (2042)..(2042): n is a, c, g, or t
caccattgctacgctccttaccaagcagcaggctnaaaatcaagcttccntcaccgtgtaaaagtgtnactgaatcagcgtgacgttccttagtccactcttccagtttctcaggcggagacaataagcggaatctttcatgatgatcaggattgttagtcaccagatcacctagacgtatttgtgacagattgagcagtaaatcctgaattggctgtgtgtctgcttcgtaactcaatgactgctcctgccaacctccaccttgtaactgcagcaaggacaaggcaatgccttcaacctgaatattgatcttgttcaaggnttttgtgtcaagcttctctaataatttctgtcctccaactgctgaaattggcgaattcaggtagtttgtctgatctttaagatagtaaagtcctgtgcctgtgatgaatataactaaggtgattaataatagaggtttaaacataattatcttaaatttaagctttgaagacagttaaaataaaaattattgaactagttattatcactcatttctatgaagtcttcaaggtactaggcgtcatttttaatctttcagcatctgttttcagccggcagagcgtctaagctgaaatcataaaaacttgagcttttagcagaagctctgtaaattcgtagatgagtttttacttatattacaaaaagctttcagagttaatgttgattcaatgaggctttttggagttatctttttttgaggaaccatgtcagataatcagtttggatgccgtgtagattttgaaagtggtgaaggtaaatcngcactttatagtttggaaaagttgcagaaagatggaataggaccagtagacagcctccctttttccatccggatcctacttgagcaagcgttgcgtaatgttgatgattttcangtacgtccggaagacgtgactgcacttgccaactggaatgcaaatgaaaaatctaaacaagaaatnccttttaaaccaaccagagtaatcttacaggattttacaggagtacctgcagtggttgatcttgcatctctgcgttctgcgatggtggcgatgaacggagatccaagtgtgattaatccgcgtgttccggttgatctggtgattgaccactcgatacaggttgatttttttggaagttcaggtgcgctcnaaaaaaacatggaaatcgaattcaggcgcaaccgtgaacgttacgaatttctaaaatggggtaagcaggcttttgataattttaatgtctatcctccaggtgtaggaattgtgcatcaggttaatcttgaaactgcagcaagtgtagttcagtcacgggacggtgtttgttttccggacacngttgtcggaacngattcacacaccactatgattaacggacttggtgttatgggctggggagtcggtggtattgaagcagaatcggtcatgctcggccaaccgatttatatgctgattccggaagtaataggattccgcctgcagggtaaacttcaggaaaacgcaaccgcgacggatttggttttacgggttgttgaaatgctgcggcaaaaaggtgtggtagaaaaatttgttgaattttttggcacnggtttgaataatctnactctggctgaccgtgcaactctggctaanatggctccggaatatggagcaacnatgggatttgttccngttgatgatgagacattaaattatttacgcggtacaggacgtccggaagccttggttcagcgcattgaaagatattctaangcacaaggacttttccgcagaaatgacactccagatccaatatttacggatacattggaactcgatctttcaacggttgaaccagcgttggccggacctaaacgtccgcaggatcgggttaatctttcgcaaatgcagccaaaatggcaaaaaactttgcaggcatccaccaaagaacgtggatttgagttgagcggagatgaactggaaacttcngtgccagtaaagggtattgannccggtgaactaaaacacggttcggtggtgattgcngccatcacttcctgcacaaatacaagtaatccatcggtgatgctggcagctggtctgcttgctaaaaaagcagttgaaaaagggctgaaacgtcaaccgtgggtgaagacttctctggggcccggttcacgtgttgtcacggattacctgcaggcaacaggtttgaacgaagcgctagacgccttgggtttccacacagtaggctatggttgtacaacctgtatcggcaactcaggacctttgcctgaaaacattgtcagcgcgatcaacgaaggtgatttggtcgttacatctgttttgtctggtaatcgaaattttgaaggcaggataagttcgcacataaaggcaaattatttagcaagtccaccgttggttgtagcttatgcaattgcgggaacggttaatcaggatttgaacaatgatccgcttggaaacgataaagacggaaagccggtttttctaaaagacatttggccaactaaagcggaaattgcagaggtagaaaaaaagataagcagcgaaatgtatgagaaagaatacaaagacgttggtgaaagctctcctatgtggaatgctgtagagtctcgtaccggtgaggtttatgagtgggacgacagttcgacctacatccaaaatcctccttttttccaaaacatgggtctggataccaaaacattagcggacatcaccggagccagagttttagttaagcttggagactccatcacgacggatcatatttctcccgccggctcttttgctgaggaaactccggcaggtgcatttttgctggcaagtggtacagataaagtcgacttcaattcctatggttcacgacgtggtaatgacagagtcatgacacgcggaacttttgggaatgtgcgtttacgaaatgaattggcacccggaacagaaggtggttttaccaaaatgatgcctgacggggaagtgactactatttatgaagcttcgttaaaatataaagaatcagcaacaccgcttgtcgttttagcaggtgcagaatatggtactggttcatcgcgggattgggctgcaaaaggaacactgttactcggcgttaaggcagttgcggctacaagttttgagcgaattcaccgctccaatctcgtaggaatgggtgttctgccgttgcagttcaaagacggtgaaacacataaatcactcggtttaaacggtgatgaagagtacgcggttttgggtttaagtgatgatttaaaacctggtcaggatttaatcctgcaggcaggagatcgaaagatcacagtaacttgccgtttagatacgcaagttgaaattgaatattacaaaaacggtggtattttacatacagttctacgtaattttatgcgtgaaaatcagtaagaactgtagtgaggccgcaactttattgtgtccacatgaaagatgttctattactaaatcaggacggcaaccccttgacgctgtggcccttgagtactatcacctggcaacaggcgataaaggcgctctatcttgacaaggtgactgttttacgttcctatgatgactggatatgtcattcacaacacttggctttagctgtgccgagtgttgtgatgatggccaattatcattatcaaaaaggtacagtcaattttacccgccgtaacattttcctacgcgaccgttttcactgccaatactgtcaacgtcatttctccgctgatcaccttactatagatcatgttattccgaaaagcagaggtggcggaatgcgctggaaaaatgttgtcacagcctgccaaaaatgtaacctgactaaaggtgcaaatatagttaaaccttctcaaccgccatttgaacctgattattggcaaatggtaaatattgccaaaactctacatattcaaattcctgatcgaagttggcaggaatatctgcagtggcccaaacatctggtgaagatcaatcaggcc

SEQ ID NO: 1406 - DNA, 4000 bp, Escherichia coli
  misc_feature (258)..(258): n is a, c, g, or t
  misc_feature (260)..(260): n is a, c, g, or t
  misc_feature (326)..(326): n is a, c, g, or t
  misc_feature (812)..(812): n is a, c, g, or t
  misc_feature (816)..(816): n is a, c, g, or t
  misc_feature (1329)..(1329): n is a, c, g, or t
  misc_feature (1985)..(1986): n is a, c, g, or t
  misc_feature (2255)..(2255): n is a, c, g, or t
  misc_feature (3843)..(3843): n is a, c, g, or t
atcgaccaaagggtgctaaatctttctctcgcggtagcagtaagagagttgagcgctctgcagttgcccgccctgaaaaaagagataaccgtcgagatgacaaatcagatgctcgtaaaggctttcgcaaacccgttaaatcaaatgatcgagaggtaaaaagggaggaccgtagacccgatcgtcctgaaaaaagatttgatcgaagaggatctacgcaagatgctgttgctggtaagaactctgttgtagaagctntncgagcgaaggttccagccaaagagctagtagttgcaataaaggttgagctagatgaaaaaatctcngaggcaattagattagctaaaaatgccgatcttccaataaaagaagtaccacgccgagcacttgatgatttaaccggtttttcaaaccaccaaggtattgccttagttataaagccctttaattacacagatttttcaaagttaatagcaaatgctaaaaaaccaatgatgttaattggtttagattcaattactgatccgcataatttaggggcggtggttagatcagctgcagcctttggtgcagatggtgtggttattcctgagcggcgaaatgctgcaatgactggatctgcttggaaggcctcagcaggggcagcagctcggatgccaatctctcaggttacaaatctagttagatcaattgaggatgccaaaaaagcaggttgttttgtaattggcttagatgcagatggtgataccacgctagccaaaatgaacttggcaactgaatcaatctttatcgttgttggcagtgaaggaaanggantatctagattagttagagaaaaatgtgatcttgtggtttcaatcccaatgcaatcttccgttgaatccttaaatgccagtgtggcaacagcaattgtgatgtatcaggttgcggcagaaagaagtaagtaatttgatttataaccgctttatcgccctaggtgactctatgactgaggggatgagtgatgaggtagtaaatggtaattaccgaggttgggctgatcgagttgccgatgttttagcaaagagtaatcctgattttacttatatgaatttagcaattagaggtaaattattaaagcaggttgtcgatgatcaaataccggctgcagttaaatatattgagggaaagcaaactctagtctcatttcatgctggtgctaatgatgtactaaggccaaattacaaaccagaggtttctcttcctgagtatgaaaaaggagtaaagcagctaacagatgcaggggcgacagtaatagttttcacagttgtggataaggtggagggaaanggaaagacagcaactctttggcaccagcgctttagtgcctttaatgagaatgtaagaatggttgcggctaagtatccaacaattttatttgaagcaagaaatgctgaatttttaaatgatcgtagatttttagcatttgatcgattgcatatgaactcagagggacatagaagattagcaaatgctgttttagaaggattaggttatgagtttgatagaaattggaaagcgccactgccggaggcaaaagagaaaaataagattgtaaaaatttttataaacatcgcgtgggttggcatctttttgatcccttgggcttggcgacgaattaggggtaaatcatccggtgatggccgaattgctaagtattccaagccagtgaaatggttatcacgctgagttagccttctgattaccacccgttcacctttataaagcaaaatacccatgtgactcaacatttgatatcggttaacccacgtgagcgattaattgatagagagttaagttggttagcatttaatgagcgggtgcttgagttagctgagaatcaaagtaatcccctacttgagcgatgccgctttctggcaatattttcttcaaacttagatgatttttacatgatccgagttgcctcagttaagcgaaaattaganngcggcgtgacaaagaaaaacagcgccggctactcaccctttgaactattagctgagatatctaagaagacgcaggagttgatctcccgtcaaactaagttatttcatcaagagttaatgccacaattaaagcaaaatggaattgaaattgttgattgggacaagcttactcaaactgagattgagtacatcaacaggatatttactaagcgaatctttccagtcttaaccccacttgcagtagatccgtcacacccatttccatatatntcagggttgtcacttaacctggcggttttagttaaacaaccagatactaatgaggagttgtttgcccgagttaaggtgccggcctcgcttcctagatttattgaaacagctgagtttgtcggttcaagattcatccctcttgagaatgtaattatcgccaacctacatcaattgtttccaggtatgcagatcgaggattactacacatttcgaatcactcgaaatgctgatctggaattagaggaggaggaatctgaaaacctccttgaatcgatggagcaggagttgttaagaagaaagtttggtccaccggtaagacttgaggtagctagggagatcgactctgatctgttaaatagattaaagatcgagctatcaattcgagatgaggatatttcccactacaaggagccacttgatttgactggcctaaataaaattgctgacttagacagaccagatttaaagtttgcaccatttagaaatcaaatagtgcaggagttgcgcgaagttgacttggattcaaatgaagagtacttcgcagcgattaggcgcaatgagatacttcttcaccatccatatgattcatttaattcctccgtcgttagatttttagaggcagcagcaacagatccacaagtattggcaataaaacagaccctctatcgaacttcaggtgattcaccaatcgtaaatgccttgattgaggcggcagaggctggaaagcaggtactggcggtaattgaaattagagcccgttttgatgagcaggcaaatgttaaatgggctagaaagctagaagatgtgggcgttcatgtggtttatggcttagtaggttttaaaactcatgcaaagttatctttaattgtcaggcaggaggcagatacagtccggcgctatagccatgttggaactggtaattacaatccaaagactgcaaggatgtatgaagatctaggcgtgcttagtgctgatgatgcattaggtgaggatctcaacaaattgtttaatcaactatcaggctttgcgccgcaatactcatataaccgattattggttgcgccaagaagtatcaggcccggcttacttgagaagattgatcgggagattaaaaataaacaatctggcaagcatgcattcattagattgaaactaaactctttgctagatgaggagtttgttgaagccctttataaagcatcatgtgctggcgtggagattgatctagtaattagaggaatttgcgcattggtgcctggaatttctgggctctcggaaaatatcagagtgcgctcagttttgggcagatttttggagcactctcggatattccactttgccaacggcggacaggatgagatctatatcggtagtgctgatttaatggatagaaatttaaatcgaagagttgaatcactagtgaaaataactaaagatgaacataagaagtcattgatgcagatctttaatcaatacaccgcatcaacaacggctgcctggcatctacttccaactggaaaatggttactggtagataaggattcaaatggtgagcagttatctgacttacaggccatgattatccagncttatcgagctaaggtatgagtcaggtaattttggcagccggtgcaattgtttggcgcaaacataaagataaattcacagaggtagcagtaattcatcggcctaaatatgatgattggagttttccaaaaggaaagtgtgagattggtgaagagttg

SEQ ID NO: 1407 - DNA, 4000 bp, Escherichia coli
  misc_feature (1)..(490): n is a, c, g, or t
  misc_feature (775)..(779): n is a, c, g, or t
  misc_feature (781)..(782): n is a, c, g, or t
  misc_feature (784)..(789): n is a, c, g, or t
  misc_feature (791)..(797): n is a, c, g, or t
  misc_feature (800)..(800): n is a, c, g, or t
  misc_feature (802)..(809): n is a, c, g, or t
  misc_feature (811)..(813): n is a, c, g, or t
  misc_feature (815)..(815): n is a, c, g, or t
  misc_feature (817)..(819): n is a, c, g, or t
  misc_feature (822)..(822): n is a, c, g, or t
  misc_feature (824)..(829): n is a, c, g, or t
  misc_feature (831)..(837): n is a, c, g, or t
  misc_feature (839)..(840): n is a, c, g, or t
  misc_feature (842)..(842): n is a, c, g, or t
  misc_feature (844)..(846): n is a, c, g, or t
  misc_feature (848)..(848): n is a, c, g, or t
  misc_feature (851)..(851): n is a, c, g, or t
  misc_feature (853)..(853): n is a, c, g, or t
  misc_feature (855)..(856): n is a, c, g, or t
  misc_feature (858)..(860): n is a, c, g, or t
  misc_feature (862)..(865): n is a, c, g, or t
  misc_feature (867)..(867): n is a, c, g, or t
  misc_feature (869)..(870): n is a, c, g, or t
  misc_feature (872)..(874): n is a, c, g, or t
  misc_feature (876)..(876): n is a, c, g, or t
  misc_feature (880)..(885): n is a, c, g, or t
  misc_feature (887)..(887): n is a, c, g, or t
  misc_feature (890)..(890): n is a, c, g, or t
  misc_feature (892)..(893): n is a, c, g, or t
  misc_feature (895)..(898): n is a, c, g, or t
  misc_feature (900)..(901): n is a, c, g, or t
  misc_feature (904)..(904): n is a, c, g, or t
  misc_feature (906)..(914): n is a, c, g, or t
  misc_feature (916)..(918): n is a, c, g, or t
  misc_feature (920)..(921): n is a, c, g, or t
  misc_feature (924)..(930): n is a, c, g, or t
  misc_feature (932)..(938): n is a, c, g, or t
  misc_feature (940)..(942): n is a, c, g, or t
  misc_feature (945)..(947): n is a, c, g, or t
  misc_feature (949)..(949): n is a, c, g, or t
  misc_feature (951)..(952): n is a, c, g, or t
  misc_feature (954)..(958): n is a, c, g, or t
  misc_feature (960)..(960): n is a, c, g, or t
  misc_feature (962)..(965): n is a, c, g, or t
  misc_feature (970)..(971): n is a, c, g, or t
  misc_feature (975)..(977): n is a, c, g, or t
  misc_feature (982)..(985): n is a, c, g, or t
  misc_feature (987)..(989): n is a, c, g, or t
  misc_feature (991)..(991): n is a, c, g, or t
  misc_feature (996)..(997): n is a, c, g, or t
  misc_feature (999)..(999): n is a, c, g, or t
  misc_feature (1001)..(1002): n is a, c, g, or t
  misc_feature (1006)..(1006): n is a, c, g, or t
  misc_feature (1008)..(1011): n is a, c, g, or t
  misc_feature (1017)..(1020): n is a, c, g, or t
  misc_feature (1022)..(1025): n is a, c, g, or t
  misc_feature (1029)..(1033): n is a, c, g, or t
  misc_feature (1037)..(1038): n is a, c, g, or t
  misc_feature (1041)..(1041): n is a, c, g, or t
  misc_feature (1044)..(1044): n is a, c, g, or t
  misc_feature (1046)..(1046): n is a, c, g, or t
  misc_feature (1049)..(1049): n is a, c, g, or t
  misc_feature (1051)..(1051): n is a, c, g, or t
  misc_feature (1053)..(1054): n is a, c, g, or t
  misc_feature (1056)..(1056): n is a, c, g, or t
  misc_feature (1061)..(1062): n is a, c, g, or t
  misc_feature (1064)..(1064): n is a, c, g, or t
  misc_feature (1067)..(1067): n is a, c, g, or t
  misc_feature (1071)..(1072): n is a, c, g, or t
  misc_feature (1079)..(1080): n is a, c, g, or t
  misc_feature (1084)..(1084): n is a, c, g, or t
  misc_feature (1092)..(1092): n is a, c, g, or t
  misc_feature (1094)..(1094): n is a, c, g, or t
  misc_feature (1096)..(1096): n is a, c, g, or t
  misc_feature (1099)..(1099): n is a, c, g, or t
  misc_feature (1102)..(1102): n is a, c, g, or t
  misc_feature (1105)..(1105): n is a, c, g, or t
  misc_feature (1130)..(1130): n is a, c, g, or t
  misc_feature (1137)..(1137): n is a, c, g, or t
  misc_feature (1291)..(1291): n is a, c, g, or t
  misc_feature (1311)..(1311): n is a, c, g, or t
  misc_feature (1314)..(1314): n is a, c, g, or t
  misc_feature (1319)..(1322): n is a, c, g, or t
  misc_feature (1325)..(1326): n is a, c, g, or t
  misc_feature (1331)..(1333): n is a, c, g, or t
  misc_feature (1336)..(1338): n is a, c, g, or t
  misc_feature (1341)..(1341): n is a, c, g, or t
  misc_feature (1343)..(1343): n is a, c, g, or t
  misc_feature (1345)..(1345): n is a, c, g, or t
  misc_feature (1347)..(1347): n is a, c, g, or t
  misc_feature (1350)..(1350): n is a, c, g, or t
  misc_feature (1352)..(1355): n is a, c, g, or t
  misc_feature (1357)..(1360): n is a, c, g, or t
  misc_feature (1362)..(1362): n is a, c, g, or t
  misc_feature (1364)..(1364): n is a, c, g, or t
  misc_feature (1366)..(1366): n is a, c, g, or t
  misc_feature (1369)..(1369): n is a, c, g, or t
  misc_feature (1373)..(1374): n is a, c, g, or t
  misc_feature (1376)..(1379): n is a, c, g, or t
  misc_feature (1381)..(1381): n is a, c, g, or t
  misc_feature (1383)..(1383): n is a, c, g, or t
  misc_feature (1385)..(1385): n is a, c, g, or t
  misc_feature (1388)..(1388): n is a, c, g, or t
  misc_feature (1392)..(1393): n is a, c, g, or t
  misc_feature (1395)..(1397): n is a, c, g, or t
  misc_feature (1399)..(1399): n is a, c, g, or t
  misc_feature (1401)..(1401): n is a, c, g, or t
  misc_feature (1404)..(1405): n is a, c, g, or t
  misc_feature (1409)..(1409): n is a, c, g, or t
  misc_feature (1411)..(1411): n is a, c, g, or t
  misc_feature (1415)..(1416): n is a, c, g, or t
  misc_feature (1418)..(1419): n is a, c, g, or t
  misc_feature (1422)..(1422): n is a, c, g, or t
  misc_feature (1425)..(1426): n is a, c, g, or t
  misc_feature (1430)..(1430): n is a, c, g, or t
  misc_feature (1432)..(1432): n is a, c, g, or t
  misc_feature (1434)..(1439): n is a, c, g, or t
  misc_feature (1443)..(1444): n is a, c, g, or t
  misc_feature (1447)..(1449): n is a, c, g, or t
  misc_feature (1453)..(1455): n is a, c, g, or t
  misc_feature (1457)..(1458): n is a, c, g, or t
  misc_feature (1460)..(1462): n is a, c, g, or t
  misc_feature (1464)..(1464): n is a, c, g, or t
  misc_feature (1466)..(1478): n is a, c, g, or t
  misc_feature (1480)..(1482): n is a, c, g, or t
  misc_feature (1485)..(1486): n is a, c, g, or t
  misc_feature (1488)..(1488): n is a, c, g, or t
  misc_feature (1490)..(1496): n is a, c, g, or t
  misc_feature (1498)..(1503): n is a, c, g, or t
  misc_feature (1505)..(1509): n is a, c, g, or t
  misc_feature (1511)..(1511): n is a, c, g, or t
  misc_feature (1513)..(1517): n is a, c, g, or t
  misc_feature (1519)..(1537): n is a, c, g, or t
  misc_feature (1539)..(1540): n is a, c, g, or t
  misc_feature (1542)..(1543): n is a, c, g, or t
  misc_feature (1545)..(1551): n is a, c, g, or t
  misc_feature (1554)..(1558): n is a, c, g, or t
  misc_feature (1560)..(1564): n is a, c, g, or t
  misc_feature (1568)..(1573): n is a, c, g, or t
  misc_feature (1577)..(1579): n is a, c, g, or t
  misc_feature (1581)..(1582): n is a, c, g, or t
  misc_feature (1584)..(1587): n is a, c, g, or t
  misc_feature (1592)..(1600): n is a, c, g, or t
  misc_feature (1603)..(1604): n is a, c, g, or t
  misc_feature (1606)..(1606): n is a, c, g, or t
  misc_feature (1611)..(1611): n is a, c, g, or t
  misc_feature (1618)..(1618): n is a, c, g, or t
  misc_feature (1620)..(1620): n is a, c, g, or t
  misc_feature (1622)..(1622): n is a, c, g, or t
  misc_feature (1624)..(1625): n is a, c, g, or t
  misc_feature (2530)..(2530): n is a, c, g, or t
  misc_feature (3600)..(3600): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttccgccctcaatttgtccgaaggcgggaatgaaaggccggatgcgctccgaccgggcgggggggcttacacccccgactccgcgcgtttcaatccgcgccccggtcacgcgaccggggcgaccgggcggggggggcttacatccccatcgccgcgcgggtctgggccgcgcggtccatcgccgcgcgagcctcgcggatgagcgcctcgatgccgccttccgcgagcacccgctcgtaaaagacggagggcaggtcgtctccgacgaccggcttcacctgnnnnntnngnnnnnngnnnnnnnctncnnnnnnnntnnngngnnngtntnnnnnngnnnnnnnanncncnnntnttngntnncnnncnnnnancnntnnntntttnnnnnnantcncnnannnntnnttncnnnnnnnnnannntnnttnnnnnnngnnnnnnntnnnttnnntncnntnnnnntntnnnncattnntttnnnttttnnnncnnntnttttnntntnntttntnnnntttttnnnncnnnntttnnnnntttnntcncangnttngncnnanaatcnnanagnatgnntaggagnnatanagagaganananagnganaangagagaaaagcgatggaaagcgagngaaagancaccaccttctctcgcaaattctttccaagaactttcatatatatgaaaaatgtttgaatctattttagatataaactctataacgtgcttatcgttatacgcatatatctattctatactattctatactattctattctattctatactatnctattctattctattctatncantcctnnnntannatatnnnttnnnttnantnanatnannnnannnnantnanatnatannannnnantnanatnatannannncnancanntaanancttnngnnaanaannatangnannnnnngagnnggnnnaggnnngnngnnnangnnnnnnnnnnnnngnnnatnnantnnnnnnnannnnnnannnnncncnnnnnannnnnnnnnnnnnnnnnnntnntnntnnnnnnnttnnnnnannnnnattnnnnnntttnnntnngnnnntttannnnnnnnntannanatagnatatagnananannataaataaggaaatgaataagaaagaaagaaaagaacttaggagtgaagcgatgaaagcgatgaaagcggggaggaattctttcttagaagggtttttagtaagcgaggagttaaaaaagttaatgcaacaacaagatttgaatccctttcaaaagttggagatgtgggcaatgccccttacgaaaaatgggggagaacttttgaaggtttgaagaaataagaaataagaaataagaaataagatgagcgacgaatacacagaaagtgcgcaggacgtccttcaggggttaatgggggagactcacgccgcctctattacttttacttccactaattctttgcctttgtctttgcctttgtctttgtctttgcctttgcctttgtcggaatctcaaatagatttaaaccctgagaaaaaagaagaaccccttttcggccaagactcccgtggggcttatgaaaatcaaaaggaaacctacgcccaccgtctcattgctactttactcgcccagggattaacaaataaagaaatcgccgaactcaccggacgcacgcaagccaatataaattatcttgcaaagcaaccttttgtaatgcagcaagcattaaaggttgttcacggaagtagcgacgccgctatggcacttttgcaaaaagaaagtcttgctgccgctgaacgtcttatcgtaattgcaaagaacgctaagaatgaagaagtcaaacgcaaggcaaataacgacattcttgatagaaaatacggcaagcctaatcaaccttattccgttcgccaagcaactgcgaaagaaatgaacgacgatgagcttgctaaaatcgcttttgggaatagttagaaatagaaataaactcctctatcctctatcctctatgcccttatctccacaanaagccgctcaagaacttcttcttcgtcgctccgcacgaaaagactttcgttcttggtgtcttcttcgtggctggcaacctgcgaaacatcacgatttaatcatcgcaaaactccaacaactcgttgacgacttccctgatcctacaaccaagaagtttaaacacaaacgtaaggtgatgcttctcatgcctcctgggtctgcaaaatcaacctatacttcaaaagaattcattccttggtttttgggtcattgcccaggtagttgcatattagcatcatcttactcgaaggatttaatcaactccttcggtcgcgctggccgcaatatcgtagagcaaaactccaacatccttggctatgaactcgaaaaagacacgcgtgcatcggacgagtgggaaacaactaatggagggcgttacttctgcgcaggcactggcgcaggcattgcaggacataggttcgacttcggccttattgacgaccccattggtacggaggaacaggctaattcaaaaactcatcgtgaaaagttggggcagtggtatttaaacgacttcacccctagggcaaaacccgatgctgttatctttatcatagccaaccgcaggcatgaacaagacctttgtgggcaattactaaataaaaccgaggactttcccaatggtctcgcaggggattctgatgaatgggatgtcatttccattccctttcgcgcggagtttgacaacgacccccttggccgtcaaaagggagagactctctggcctgaatactttaatgaagcgttcatccgcgcggttgatggaaagcccgcaaagactcgcgcgggactctaccaacagcgtccttgtcccgagacaggaaatttcttcgactcttccacttttgaaggctatcgagcaaatgaacttcctccccttaacgagttaaaaatatacataacttccgaccacgctatttctaaaaaggaagaagccaataagagttgttttggtgtgtggggagttgactcgaaagacaacctctggcttcttcctgaaattttttggcgtcgggctgacgcctccgancaagttgaagcgatgattaaactcgcgaagaaatattctcctatttgttggtacgcggaaaaggtacatataactcaagcaatcggcccatttttatcgaagcgcaaacgtgaaacgaaagtctattttaacgtcaaagaaattacttccaagaaggacaaacgttcacgtgcgtcttcaattgaaggtcgtatgtccatgcacaaggttttctttccgaaattcgcaagttggtgggacgatgccgaatacgaactgcttaccttcgacggaggtaaggatgatgattttgtagacatgtgtgggttgattggcaaggcgttgaattcactttcttccggggaagaagcggaagttgacgacactcctaaagatatcaatgtcaatcaaactccttgtt

SEQ ID NO: 1408 - DNA, 4000 bp, Escherichia coli
acatggtgataatgttcggccagatcagcagggttgaaagtgccaacagttgcaaacagatgaacggcaagaaaccgcggaagatatctgtcagcgaaatctcgggcggcgcaacagactttagatagaaagccgcggggccaaagggtggtgacaaaaagctgacttgcatgttcatacagaatacaacgccgaaccagatcggaatgtagcgtgcttctatgctgccgaagagcccgatttcctcaactggaagtcgtactacgatgggtaggaataccggcataatcaagagcacgataccgacccaatccatgaacatgcccatgatcaaaaacacaagcatcatcatcaatatgatacccatcgttggcagctctgctccaatgatcatgttagctacataggttggtccaccaacaagcgtgtaggcagcagccaaagctgctgcaccgattgtgacccagataatcgtgcctgtcgacttaagcgtacggatcaagctgtcccaaacgatatcaaacgtcatttcgcggcggatgataccgatggcgaatacggcgatcacacccatgccggcagcttcagtgatacctgtaatgccaccataaatggaccctaagaccacaccaatgacaacaattggggctatgagtcctttacccattttccaaccacgttgggtacgttcgcgtccaacgaccacgaacacaattaaagcaaagatcacaaacgcgccaactatccaagggatgtcagcgaccatacccaacgtgatcgggtcttcattttcgcggattgtattgtcacctgtcacggtaaaaaagaccgcgcgaaggaacaaaacacccgacacccacatcgcaaagcgtgagataaagccgaggaacatcaaacccttttctgagccttcgggctcgcccgggattggatctggcaagggggctaatgatgtgttcgctcgcgtgcggatcaaaatatatagaatgaagaacgatgctagcataaaacctggcaaaaaagatgcggtgaacaacgccttgatagatgtctctgttacaagaccgtaaaaaattaaaactatcgatggtggtatcatggttcccagtgaaccggacgcacagatcgtaccaatagcaagattgcgatcatagccaagtcgtaacatctggggcaaagcgattaagccaagcagcacaacttcaccgccgataataccagacatcgcggccattattaccgccatgatagacgtagctatggcgatgccgccacgcatccggctcatccaaacgttgagcgacgaatacatatcccgcgcaataccagaccgctccagcattgcagccatgaatataaataacggaaccgatatgagcacataattcgtcatttgccgatagaccgcctgccccaggacagacagcgggccacgcccaaaatcaccccataaaagatcaggtgggaactttaaagagagggtgacaacagccaagaacgccgaggcaaacccaagaggcataccaatggccaacagggcgaacatacccagaagaacgataagagatagtgtgccaatatcgaccattagttcttttcctcaagagtacggcggatgttttcgatttctatttcatcgatctcgtcggccggtgtgtgcgactgcggtgccttattccaatcggcgaacaagttagaaacagcttgaatgcagaccaagacaacaatgattagtagtgcgggtttgacaataccagggataggcggatcccaagccgtgccaaaggtctccatccgcatgaagcggttctcggcatcggtatagccaccccaaacaagggcgaaggtgaaggcaacgatcaacaggacggagatacagtcagatgttttttgcatccaccaaggcattgtgtcgtaaatgatgtaaattcggatatggctacgttgttgcatggcgtaaagtcctgcaaacaaaaaaacgaaacatccgatccacagggacagttcattggcccaaagtgttggccgcgagaatacgtagcgcgaaacgacctcgtagaacattactagcacaataaaagctgtcataatcatcgcaaggcgccccaaaaccacggacacaagatcaaaaaaaccgtcaggaggcgtttcaattgcgcctttagtgtcggacaaaaagattgatgcaaagattaatgatattgctaaacaagtgagtgttacctgtaccagcggctttcccgcaggacgtatcatctcaaacataccgtagggttctactgcgaacattcgctgcccaacaagaaacagataaagcaaaagtgtgaggccacaaaagacgatcattcccgtcttgatcggcgctctcatgcgccctaaaaaaagcgattctatctgcattttttgcttcctaatctttctgtgattggacatcaaattcgggtcaaaaaaggcgggcacggactgcacccgccttgatcattaagtgttaggggcggtcatccaatactacttgacgagacccagctggcgaaggtaatccttgtggctttcaactagcgctgctgcctccggactacgtgtggcccaatcgtcccaagcggcctgcgctgcaacgcggaatgcagctttatcttcagttgaccaatcatatagggtgactccctgctcttggagcatagcagccgcctcagtatttgccttctcattcaacattgctatttggaacgataacttttgccaggccgtctccatgatgcggcgctgttgttcggtcaggccttcccacacagcttgattacaagcgaggtggtctgatggcatagaatggaaaccaggatagttcgcgtgcttcacgatgtcgtaaagacctagtcccacgttgttggccaagccagatgcatccgcaccgtcgatgatacccgtttcaagcgcagtaaagatctcagtaaagtccatcacgattggtgacgcacccattttttcgaatatctctgtctccatgcctggaggtgaacggaatttccaacctacaagatctgcagggccagcaattggcttagaagacgcaaacgactcctgaccataaaccgcccacccaatcaactgcatgccctgagcgttgtagagctcctgagccgcttcgtagccgtcgccatagtatagccagctatactgctgccacggggtgtcgtacccgcccatgatgtcgccaacgaattggaacgcggggtttttaccagtttggtaagcgccgcctgttgcatcacaatcaagaatgccattgattgcagcatcgaatgtttcaacagtagcaacaacagacgatgaatagaacatctcaatagagatctcgcctccagacatagtttggacgtcatctacccattgagccaacatcttacctgtcggatgctcagtagcatagtgtgtttggatgcgtaaggttacgtcctgtgcgaatgccgcgctagccaatgtagcaccggcgacggcggtcataagtaatggtttaagcttcatattcgtttctctccctttgaggcactttacgcctaattattctcactaaactttggagttagtgatttaagatggtataccatctcaggagataccctactcatttccaaatcggcacgcaacagatttcactcatttctaaatcgacacgcaacaaatttcggtatacaactttcgaaatttcaacttatcagaaaatatgctgggaataatgcaagggccccaaatgtcggatcaaactttgccagaaaaacttgcaaatcagctgcgccgcgacatcttgcgaggtaatctcactcctggagattctgtaaaagagcgcaccagagctaatgatcttggcgttagccgaacaccaatgcgcgaagcaatccgtatcgtagcgcgcgaaggtctgatcaccttacgaccttcgcgtagtcccataattgcaatcccggatatcaaagccgttaccgacgatgtcgaggttttgata

SEQ ID NO: 1409 - DNA, 4000 bp, Escherichia coli
  misc_feature (1990)..(1991): n is a, c, g, or t
  misc_feature (2312)..(2312): n is a, c, g, or t
gcttcttttggaggtttggatagaacgtgcgtttcgttctccgcttggagtgcgatacgttatttccgaccataaccttttttccggtgagttgacaaatgcggctcatagcttcacttttagagagcgcaaagaaacgaaagaaaagccactcatccaacctttaccgtcaatcgacagcgcttttatattccttcaatttcctcaagagccacgcttgtccttccaaacgcgttttttcgatgttgcgaatccgattttgtccaaaatgcagcaagcgagcctccacgccatttggccctgctatggcaatccaaatcgtcccaaccggaatgtgttcactgcctcctcccggacctgcaattccggatgttgccaaggcaaaatcagctccagtagtacgcaacgctccttccgccatttccttcacgacagactcacttaccgcaccatgcgcttccaacgtatccggagaaactcccaataggttgatttttacctgattgacgtaagacacgaccccacccacaaaacaagcactggaacctggaacggcggtaatacttgccgctatcgcccccccagtacacgattcggcaacagcaaaggtcatcccttcatccgtaaacgtccgaaccacggcttctgcgagtgactctccctccacgtccgtaataatccaatcaccacattgcaatttgaaatctgagagctcctgctcaaccaagcggaccccttcgtctcgattttcagatacggcactcaaccggacccgaacttgtcccggggcgggtaaatacgcgatcgaaacaccgcggttcactaaaccgacctcccatgaggccacatgttgactcaaaaaactctctcctattccctgcgttaaaacggttcgatgataccgggtaggcaatgaaaaccgagcaacaagtcttggaatcacctcatccaccatgattcctttcatttcatacggcaccccgggcatgctcacgaccacttgatccgtaccctccactgtaaaccacattccttgggctgtcccctgtgggttcggcaaaacttcgcacgtatcagggagcagtgcctgatcaacatttgatggcaacatcggaaaacctcgactggaaaaccaatgtgtgatgtccgctagtacctcgtcattttgaaccaaaggcgccttaaagtaggttgaaagaacttgtttcgtcctgtcatcaaccgtggggccaagccctcctgtaatcagcaccaagcctttggattcaagcgccagatccaacgctgcaaccaaagccgcgggctcgtccgacagtgtcgtaatccgttcaaccgcaatgcctgcaagcgccaacttctctcccatccaagccgaattggtatcaatcgtttgacccaataacaattcatctccgaccgtaatgatttcagcaagcatggcacaaaattaatacggagcgcactcctctcaactcgcacaaaaaagaaaacggcccacccaaaaagggcaggccgttattctctatatgaaatcgtacttactgcacagccaaacgcacaactgtgctctggtcgccttgggctacgttcacaaaataaattccaggagcccatgtgctcacatcaagacgctccaaaatggccgcagtctgaaaggcatgaacaacctgccccgtagcactcatcaccgtgatttggtgagaacctggacgatcaatgatcaactccacttggtccgatgctgggttgggatacatcatgatatcctgggcttccattggttcagcaaatccgacccaatcctcaaaatcgatatcaccgcaatctcccaaatcgtcagcaggaacgcgcaggtgaacgatgtcattgatatcgatcggatccaaatctcctcgaacgtgcaatccaggttcgaaatcacgctgatagataatctctaacgtgccattcactacgtccggagcaatgcttccaaatacagcttcgtagnnatcgtagtcgacatcaggtgtcaagtcacaagcctcttcagtattccacgtcataccgccgtccatcgaatgaataacgtattggtgacggtagttctggactcccgtgctgaagttctccatgatggcagaatatgtgatgtacatgtttccagaggcatctgaagccatggaagggaatgcagcacacccaacaaaataagcggcaatctcatcttcgaagtcgagggttccactctcatcaatgtcgtatgaataggctacgatttgcgcactatcaggtcccatcgtctcattccaataagccagtccatttgtgcntgggaaatagctcgttgtgccatcaatggtatcagcatccatgtaatacatcgatccataggatacgtgcacttgaccatacgtgtctacatgcacatcacccgcaccgtccgcattgaagaactcctgaaacaagccatcttcgttgtagtcctctccaatctcaggaaggcccatatcgacttcatagagatcaacagggaagtcaactaacaattgctgctcccacgtatcgccattgtcctgactgatcatcacaaacgaatctgcaaaatcattgaacgcggcgaaggccactgtgttgccacgtgcgtggatggcataggtgtcaccactgaatgagaaaaatgctgaactatcgagctcagaaaaaatcatatctgtaatgtcccacgtgtctcctccgtcctgagaacggtagtacaacaaggctccatcttgaccgttcaaaacagctccaccgttggcttcaggtgtggaaacacaaatcacgtgtaagctgttgccgtcctcacctccagcggccattcgaggccacagtttaccaacttccaaatcactttcaatggaagtctcagaccacgctcccgatccggcatctcgccaagccatgtgcaatggagtgtcgataccggcatggctcatgaccacctcgcggccattcgcggtgtgcacaatagaaggccagccgattcgcgttgattctatccgctcgtatggaatttcattccaaacactaccattatgaaaattgtatcccgtcccgcgatcatcaaatggagtcaattccaaactcatcgtccacgccgctgagacagcgtctgctcctccagccatgcggtcatcaatggcagcattggactgcaagtcgtattgcgtatagccaatcacttgacgctctacaaccaattctcttgacatgtaatgctcaacatccgtggacgactgcccctccatcggttgctgtggtcgatctgaaaaatcggaaatggccatggtgggcataggcgcggcagtccgaagagctggggccatttgcggtacaccgtctaagagttgactccctgtggcaacaggggattgagcaactgctgaaaagcctaggcatatcgccatggctgcaagagtaaaatgcttcatgaaatagggttttgcgatgaaaaagtaccgcaaaacaagcaattaatcacggtcttgtgattagaatttatccactcaatctggcaattgagccaatggggtctcccgtccgacaaccacatcacccaatttcacctgtacagtcgcgtcaagtggaagaaaaacatccacgcgagagccgaatttgatgaaccccatttcctgtcccggtccgacctgatcaccctctttaagataccagcaaattcttcttgccacagcacctgctatttgtcgaaacataaccacaccgtgctttccctcgatcacatgcgtcgttcgttcattctccgtgctgctcttcggatgccacgcgaccaaaaatttgcccggatggtagcgggataacaacaccttacccgcaatgggcgcccattgggcatgcacattcaacgggctcatgaaaatactcacctgaatcctccggttcttgaaccattccgtctcctcaacttcctcaatcaccaccacttttccatcactgggacagaccacttgccggtctgaca

SEQ ID NO: 1410 - DNA, 4000 bp, Escherichia coli
  misc_feature (195)..(195): n is a, c, g, or t
  misc_feature (274)..(274): n is a, c, g, or t
  misc_feature (363)..(363): n is a, c, g, or t
  misc_feature (497)..(497): n is a, c, g, or t
  misc_feature (984)..(984): n is a, c, g, or t
  misc_feature (987)..(987): n is a, c, g, or t
  misc_feature (1437)..(1437): n is a, c, g, or t
  misc_feature (1590)..(1590): n is a, c, g, or t
  misc_feature (2193)..(2193): n is a, c, g, or t
  misc_feature (2235)..(2235): n is a, c, g, or t
  misc_feature (2340)..(2340): n is a, c, g, or t
  misc_feature (2343)..(2343): n is a, c, g, or t
  misc_feature (2376)..(2376): n is a, c, g, or t
  misc_feature (2388)..(2388): n is a, c, g, or t
  misc_feature (2448)..(2448): n is a, c, g, or t
  misc_feature (2498)..(2498): n is a, c, g, or t
  misc_feature (2526)..(2526): n is a, c, g, or t
  misc_feature (2529)..(2529): n is a, c, g, or t
  misc_feature (2571)..(2571): n is a, c, g, or t
  misc_feature (2574)..(2574): n is a, c, g, or t
  misc_feature (2589)..(2589): n is a, c, g, or t
  misc_feature (2622)..(2622): n is a, c, g, or t
  misc_feature (2625)..(2625): n is a, c, g, or t
  misc_feature (2633)..(2634): n is a, c, g, or t
  misc_feature (2636)..(2638): n is a, c, g, or t
  misc_feature (2641)..(2641): n is a, c, g, or t
  misc_feature (2643)..(2643): n is a, c, g, or t
  misc_feature (2645)..(2645): n is a, c, g, or t
  misc_feature (2647)..(2648): n is a, c, g, or t
  misc_feature (2650)..(2650): n is a, c, g, or t
  misc_feature (2653)..(2653): n is a, c, g, or t
  misc_feature (2656)..(2656): n is a, c, g, or t
  misc_feature (2658)..(2662): n is a, c, g, or t
  misc_feature (2664)..(2669): n is a, c, g, or t
  misc_feature (2671)..(2672): n is a, c, g, or t
  misc_feature (2674)..(2675): n is a, c, g, or t
  misc_feature (2677)..(2682): n is a, c, g, or t
  misc_feature (2685)..(2685): n is a, c, g, or t
  misc_feature (2687)..(2690): n is a, c, g, or t
  misc_feature (2692)..(2692): n is a, c, g, or t
  misc_feature (2694)..(2695): n is a, c, g, or t
  misc_feature (2697)..(2703): n is a, c, g, or t
  misc_feature (2705)..(2705): n is a, c, g, or t
  misc_feature (2707)..(2709): n is a, c, g, or t
  misc_feature (2711)..(2712): n is a, c, g, or t
  misc_feature (2714)..(2714): n is a, c, g, or t
  misc_feature (2716)..(2716): n is a, c, g, or t
  misc_feature (2718)..(2718): n is a, c, g, or t
  misc_feature (2720)..(2723): n is a, c, g, or t
  misc_feature (2725)..(2726): n is a, c, g, or t
  misc_feature (2728)..(2730): n is a, c, g, or t
  misc_feature (2732)..(2732): n is a, c, g, or t
  misc_feature (2734)..(2736): n is a, c, g, or t
  misc_feature (2738)..(2739): n is a, c, g, or t
  misc_feature (2741)..(2744): n is a, c, g, or t
  misc_feature (2747)..(2754): n is a, c, g, or t
  misc_feature (2757)..(2758): n is a, c, g, or t
  misc_feature (2760)..(2763): n is a, c, g, or t
  misc_feature (2767)..(2769): n is a, c, g, or t
  misc_feature (2772)..(2772): n is a, c, g, or t
  misc_feature (2774)..(2775): n is a, c, g, or t
  misc_feature (2779)..(2785): n is a, c, g, or t
  misc_feature (2787)..(2793): n is a, c, g, or t
  misc_feature (2795)..(2799): n is a, c, g, or t
  misc_feature (2801)..(2802): n is a, c, g, or t
  misc_feature (2804)..(2806): n is a, c, g, or t
  misc_feature (2808)..(2819): n is a, c, g, or t
  misc_feature (2821)..(2822): n is a, c, g, or t
  misc_feature (2824)..(2824): n is a, c, g, or t
  misc_feature (2826)..(2827): n is a, c, g, or t
  misc_feature (2829)..(2829): n is a, c, g, or t
  misc_feature (2831)..(2831): n is a, c, g, or t
  misc_feature (2833)..(2836): n is a, c, g, or t
  misc_feature (2839)..(2839): n is a, c, g, or t
  misc_feature (2841)..(2844): n is a, c, g, or t
  misc_feature (2846)..(2850): n is a, c, g, or t
  misc_feature (2853)..(2858): n is a, c, g, or t
  misc_feature (2863)..(2871): n is a, c, g, or t
  misc_feature (2873)..(2874): n is a, c, g, or t
  misc_feature (2877)..(2877): n is a, c, g, or t
  misc_feature (2879)..(2881): n is a, c, g, or t
  misc_feature (2883)..(2883): n is a, c, g, or t
  misc_feature (2885)..(2894): n is a, c, g, or t
  misc_feature (2899)..(2899): n is a, c, g, or t
  misc_feature (2901)..(2904): n is a, c, g, or t
  misc_feature (2906)..(2908): n is a, c, g, or t
  misc_feature (2911)..(2915): n is a, c, g, or t
  misc_feature (2919)..(2922): n is a, c, g, or t
  misc_feature (2925)..(2927): n is a, c, g, or t
  misc_feature (2929)..(2934): n is a, c, g, or t
  misc_feature (2939)..(2940): n is a, c, g, or t
  misc_feature (2943)..(2956): n is a, c, g, or t
  misc_feature (2958)..(2959): n is a, c, g, or t
  misc_feature (2961)..(2970): n is a, c, g, or t
  misc_feature (2972)..(2974): n is a, c, g, or t
  misc_feature (2977)..(2985): n is a, c, g, or t
  misc_feature (2989)..(2995): n is a, c, g, or t
  misc_feature (2998)..(3005): n is a, c, g, or t
  misc_feature (3007)..(3009): n is a, c, g, or t
  misc_feature (3011)..(3011): n is a, c, g, or t
  misc_feature (3013)..(3017): n is a, c, g, or t
  misc_feature (3019)..(3025): n is a, c, g, or t
  misc_feature (3027)..(3027): n is a, c, g, or t
  misc_feature (3029)..(3040): n is a, c, g, or t
  misc_feature (3043)..(3048): n is a, c, g, or t
  misc_feature (3051)..(3056): n is a, c, g, or t
  misc_feature (3058)..(3058): n is a, c, g, or t
  misc_feature (3060)..(3061): n is a, c, g, or t
  misc_feature (3063)..(3064): n is a, c, g, or t
  misc_feature (3066)..(3078): n is a, c, g, or t
  misc_feature (3080)..(3080): n is a, c, g, or t
  misc_feature (3082)..(3091): n is a, c, g, or t
  misc_feature (3093)..(3099): n is a, c, g, or t
  misc_feature (3101)..(3111): n is a, c, g, or t
  misc_feature (3113)..(3114): n is a, c, g, or t
  misc_feature (3116)..(3123): n is a, c, g, or t
  misc_feature (3125)..(3133): n is a, c, g, or t
  misc_feature (3139)..(3140): n is a, c, g, or t
  misc_feature (3143)..(3143): n is a, c, g, or t
  misc_feature (3145)..(3145): n is a, c, g, or t
  misc_feature (3149)..(3149): n is a, c, g, or t
  misc_feature (3151)..(3152): n is a, c, g, or t
  misc_feature (3154)..(3159): n is a, c, g, or t
  misc_feature (3161)..(3162): n is a, c, g, or t
  misc_feature (3164)..(3172): n is a, c, g, or t
  misc_feature (3174)..(3177): n is a, c, g, or t
  misc_feature (3179)..(3181): n is a, c, g, or t
  misc_feature (3183)..(3186): n is a, c, g, or t
  misc_feature (3188)..(3189): n is a, c, g, or t
  misc_feature (3192)..(3194): n is a, c, g, or t
  misc_feature (3196)..(3214): n is a, c, g, or t
  misc_feature (3216)..(3216): n is a, c, g, or t
  misc_feature (3218)..(3221): n is a, c, g, or t
  misc_feature (3223)..(3230): n is a, c, g, or t
  misc_feature (3232)..(3242): n is a, c, g, or t
  misc_feature (3245)..(3248): n is a, c, g, or t
  misc_feature (3250)..(3263): n is a, c, g, or t
  misc_feature (3266)..(3276): n is a, c, g, or t
  misc_feature (3279)..(3282): n is a, c, g, or t
  misc_feature (3287)..(3298): n is a, c, g, or t
  misc_feature (3300)..(3304): n is a, c, g, or t
  misc_feature (3306)..(3316): n is a, c, g, or t
  misc_feature (3318)..(3318): n is a, c, g, or t
  misc_feature (3320)..(3323): n is a, c, g, or t
  misc_feature (3326)..(3329): n is a, c, g, or t
  misc_feature (3331)..(3333): n is a, c, g, or t
  misc_feature (3335)..(3339): n is a, c, g, or t
  misc_feature (3341)..(3347): n is a, c, g, or t
  misc_feature (3349)..(3353): n is a, c, g, or t
  misc_feature (3355)..(3372): n is a, c, g, or t
  misc_feature (3375)..(3378): n is a, c, g, or t
  misc_feature (3380)..(3393): n is a, c, g, or t
  misc_feature (3395)..(3395): n is a, c, g, or t
  misc_feature (3397)..(3398): n is a, c, g, or t
  misc_feature (3400)..(3410): n is a, c, g, or t
  misc_feature (3412)..(3422): n is a, c, g, or t
  misc_feature (3425)..(3428): n is a, c, g, or t
  misc_feature (3430)..(3437): n is a, c, g, or t
  misc_feature (3439)..(3441): n is a, c, g, or t
  misc_feature (3443)..(3443): n is a, c, g, or t
  misc_feature (3445)..(3446): n is a, c, g, or t
  misc_feature (3448)..(3451): n is a, c, g, or t
  misc_feature (3453)..(3462): n is a, c, g, or t
  misc_feature (3464)..(3465): n is a, c, g, or t
  misc_feature (3467)..(3467): n is a, c, g, or t
  misc_feature (3469)..(3475): n is a, c, g, or t
  misc_feature (3477)..(3484): n is a, c, g, or t
  misc_feature (3486)..(3486): n is a, c, g, or t
  misc_feature (3488)..(3488): n is a, c, g, or t
  misc_feature (3490)..(3490): n is a, c, g, or t
  misc_feature (3493)..(3518): n is a, c, g, or t
  misc_feature (3521)..(3533): n is a, c, g, or t
  misc_feature (3537)..(3537): n is a, c, g, or t
  misc_feature (3539)..(3544): n is a, c, g, or t
  misc_feature (3546)..(3568): n is a, c, g, or t
  misc_feature (3570)..(3572): n is a, c, g, or t
  misc_feature (3574)..(3587): n is a, c, g, or t
  misc_feature (3589)..(3593): n is a, c, g, or t
  misc_feature (3595)..(3596): n is a, c, g, or t
  misc_feature (3598)..(3603): n is a, c, g, or t
  misc_feature (3605)..(3609): n is a, c, g, or t
  misc_feature (3612)..(3617): n is a, c, g, or t
  misc_feature (3619)..(3622): n is a, c, g, or t
  misc_feature (3624)..(3663): n is a, c, g, or t
  misc_feature (3665)..(3676): n is a, c, g, or t
  misc_feature (3678)..(3679): n is a, c, g, or t
  misc_feature (3681)..(3683): n is a, c, g, or t
  misc_feature (3685)..(3692): n is a, c, g, or t
  misc_feature (3694)..(3716): n is a, c, g, or t
  misc_feature (3718)..(3740): n is a, c, g, or t
  misc_feature (3742)..(3749): n is a, c, g, or t
  misc_feature (3751)..(3751): n is a, c, g, or t
  misc_feature (3753)..(3757): n is a, c, g, or t
  misc_feature (3759)..(3769): n is a, c, g, or t
  misc_feature (3773)..(3782): n is a, c, g, or t
  misc_feature (3784)..(3787): n is a, c, g, or t
  misc_feature (3789)..(3799): n is a, c, g, or t
  misc_feature (3801)..(3807): n is a, c, g, or t
  misc_feature (3809)..(3809): n is a, c, g, or t
  misc_feature (3811)..(3811): n is a, c, g, or t
  misc_feature (3813)..(3815): n is a, c, g, or t
  misc_feature (3817)..(3829): n is a, c, g, or t
  misc_feature (3831)..(3832): n is a, c, g, or t
  misc_feature (3834)..(3834): n is a, c, g, or t
  misc_feature (3836)..(3844): n is a, c, g, or t
  misc_feature (3846)..(3869): n is a, c, g, or t
  misc_feature (3871)..(3874): n is a, c, g, or t
  misc_feature (3877)..(3878): n is a, c, g, or t
  misc_feature (3880)..(3880): n is a, c, g, or t
  misc_feature (3883)..(3906): n is a, c, g, or t
  misc_feature (3908)..(3908): n is a, c, g, or t
  misc_feature (3910)..(3920): n is a, c, g, or t
  misc_feature (3922)..(3924): n is a, c, g, or t
  misc_feature (3926)..(3933): n is a, c, g, or t
  misc_feature (3935)..(3935): n is a, c, g, or t
  misc_feature (3939)..(3939): n is a, c, g, or t
  misc_feature (3941)..(3941): n is a, c, g, or t
  misc_feature (3943)..(3943): n is a, c, g, or t
  misc_feature (3945)..(3951): n is a, c, g, or t
  misc_feature (3953)..(3953): n is a, c, g, or t
  misc_feature (3955)..(3960): n is a, c, g, or t
  misc_feature (3962)..(3962): n is a, c, g, or t
  misc_feature (3965)..(3965): n is a, c, g, or t
  misc_feature (3967)..(3969): n is a, c, g, or t
  misc_feature (3971)..(3975): n is a, c, g, or t
  misc_feature (3977)..(3985): n is a, c, g, or t
  misc_feature (3988)..(3989): n is a, c, g, or t
  misc_feature (3992)..(3993): n is a, c, g, or t
  misc_feature (3995)..(3995): n is a, c, g, or t
  misc_feature (3997)..(3997): n is a, c, g, or t
  misc_feature (3999)..(3999): n is a, c, g, or t
cggataaagttgggtgctttgttgatagattttcaattagttcagatttagtcatcgtcaactctcctttaaatttatacttaaacttgttattaagacttacaggtaatgcattagttcataataaattaccgctaaatccttgttaattatagctggtagtaataaggctgagtcaatgacccagccttattnatgtgaattaattattcacctttagctgctttgaaagcttcagccattgcgtttggaatagcaacatcttcttgtttgntattcacgtttgcaactgcagctgcttcttcagcttgatctttcgcttttacagataagtgaacgatacgtgctttacgatcaacaccngtgtatttcgcttcaactacatcacctgctgcaacttcgtttgttaagtctgctgcacggatataaccttcaacgccacctgctaattcaactttagcacctttagcgtcagcttcaacaacagttgcagaaantactgcaccttttttgttgattgctacgaagttgttgaatggatcatcttcaagttgtttgatacctaaagaaatacgttctttcactgcatctactgctaatactactgcagaaacttcgtcaccttttttgtagttacgaactgcttcttcacctgcaacattccaagaaatgtcagataagtgaactaaaccgtcgataccaccttcaagaccgatgaagataccgaaatcagtgattgatttgattttaccagtaactttgtcgcctttgttgtgagtttcagcgaattgagtccatgggttaggtttgcattgttttaaacctaaagaaatacgacgacgttcttcgtcaacttctaacaccattacttcaactgtatcgccaaggcttacaactttagatgggtggatgtttttgttagtccaatccatttcagaaacgtgaactaaaccttcaacaccatctaagatttcaacgaaacanccntagtcagttaagttagttactttaccagttaatttgctgtttactgggtggttttcagcgatagcaacccaaggatcttgacctaattgttttaagcctaaagatacgcgagtacgatctttgtcaaattttaatactttaacagttacttcgtcgcctacattcacgatttcgcttgggtgtttaacacgtttccaagccatatcagtgatgtgtaataaaccgtcaacgccacctaaatctacgaatgcaccgtagtcagttaagtttttaacgatacctttaacttctgaaccttcagctaggttctcaaggatttgttcacgttcttggctgttttcagattcgatcactgcacgacgagaaacaacaacgttgttacgtttttgatctaatttgattactttgaattctaattctttaccaagtaggtgatcagcttcacgtgcnggacgtgtatcaactaatgaacctggtaagaatgcacgaacaccgtttaactcaactgtgaaaccgcctttcactttaccgttgattaaaccgataacggtcgctttttcttcgtaagctttttctaattcaatccaagattcgtgacgaacngctttctcacgagaaagtttagtttcgccgtaaccatcttcaactgcatctaaagctacgtttactgtgtcgccaactttaacttcaagttcaccttgagcgttttggaattcagcaacaggaattgcagattcagattttaagcctgcatcaacaagtacaaagcctttttgaatagcaacaacagtaccgctaacgattgaaccttgacgggtttcaaggccttttaatgattcttcaaagagttgagcaaaagattctgacatataaataatcttcttaatttaagttaataacatccacattaagatccataaaatgcggggttgaggataaatgtctattcttccttgaataaacagttaaatcgaaattgacgctttttgttgaatataagctaacgcttgagcaatgacttcatcaatactcaatgttgtactatctaacaataaagcatcatcagccggtttcaatggcgcaacctcacgatttctatcgcgaaaatcgcgttcttgtatctcggctaaaatctgtgcaaagttaccattaattcccttattttgcaactgtttatagcgtctttttgcacgttcttccgcactngcatctaaaaacagtttaacttgtgcatttgggaaaaccacngttcccatatctcgcccatccgcaatcaggccatcatttttaccaaaatcctgctgaagttgcagtaaagctgaccgcacttttgggaaaaccgccacttttgangcngcttccgccacttcttgcgtacggattaaatgnctcacatccatnccaccaagaagcacattgacttctccattctttggaatgaactgaatatctaaatgacgngctaactccgctaatccttcttcatcggttaagtctgcatgacgtttcancgcagccaatgccgtcacgcgataaatngcnccactatctaataaggtaaaacctaacttttctgccaatgcntancaaagtgttcctttncctgccccacttgggccatcaacggtgataatnatncccataanntnnntcntntnanntntcnatnannnnnannnnnnanncnnannnnnnttntnnnncnanngnnnnnnntncnnnanntnananannnncnncnnnancnnntnnannnnaannnnnnnnaannannnnaaannntangnnaaannnnnnncnnnnnnncnnnnncnntnnngnnnnnnnnnnnncnncngnnanantnnnnaantnnnntnnnnnttnnnnnnttttnnnnnnnnnannaanannncnannnnnnnnnnaaatnannnnannnttnnnnntttnnnnttnnnannnnnnaattnnatnnnnnnnnnnnnnnanntnnnnnnnnnnannnaannnnnnnnnattnnnnnnnaannnnnnnntnnnanannnnnannnnnnnanannnnnnnnnnnntannnnnnttnnnnnnanannannannnnnnnnnnnnntnannnnnnnnnnannnnnnntnnnnnnnnnnnanntnnnnnnnnannnnnnnnngccaanngtnanaaancnntnnnnnnannannnnnnnnnannnnannnannnnannttnnnannnnnnnnnnnnnnnnnnntnannnntnnnnnnnnannnnnnnnnnnttnnnncnnnnnnnnnnnnnntannnnnnnnnnnttnnnntaaannnnnnnnnnnntnnnnnannnnnnnnnnnancnnnnttnnnntnnntnnnnncnnnnnnntnnnnntnnnnnnnnnnnnnnnnnnaannnngnnnnnnnnnnnnnntngnnannnnnnnnnnncnnnnnnnnnnnatnnnntnnnnnnnnannnanannannnnannnnnnnnnncnntntnnnnnnntnnnnnnnntngngntannnnnnnnnnnnnnnnnnnnnnnnnnatnnnnnnnnnnnnnaaantnnnnnntnnnnnnnnnnnnnnnnnnnnnnnannnannnnnnnnnnnnnntnnnnntnntnnnnnntnnnnngcnnnnnnannnntnnnnnnnnnnnnnnnnnnnnnnnnnnnnnnnnnnnnnnnncnnnnnnnnnnnnannannntnnnnnnnnannnnnnnnnnnnnnnnnnnnnnntnnnnnnnnnnnnnnnnnnnnnnnannnnnnnnantnnnnntnnnnnnnnnnnaaannnnnnnnnntnnnnannnnnnnnnnnannnnnnntnanannnannnnnnnnnnnnntnntncnnnnnnnnntnnnnnnnnnnnnnnnnnnnnnnnnannnnaannanaannnnnnnnnnnnnnnnnnnnnnnnanannnnnnnnnnntnnntnnnnnnnntntttngnanannnnnnntntnnnnnnanttnannnannnnnannnnnnnnncanncannantntna

SEQ ID NO: 1411 - DNA, 4000 bp, Escherichia coli
  misc_feature (1967)..(1967): n is a, c, g, or t
  misc_feature (1992)..(1992): n is a, c, g, or t
  misc_feature (1995)..(1995): n is a, c, g, or t
  misc_feature (2029)..(2029): n is a, c, g, or t
  misc_feature (2063)..(2063): n is a, c, g, or t
  misc_feature (2328)..(2328): n is a, c, g, or t
  misc_feature (2391)..(2391): n is a, c, g, or t
  misc_feature (2413)..(2413): n is a, c, g, or t
  misc_feature (2418)..(2418): n is a, c, g, or t
  misc_feature (2420)..(2420): n is a, c, g, or t
  misc_feature (2427)..(2427): n is a, c, g, or t
  misc_feature (2433)..(2433): n is a, c, g, or t
  misc_feature (2436)..(2436): n is a, c, g, or t
  misc_feature (2487)..(2487): n is a, c, g, or t
tctagtctatctttttttaaatttaattttctttactacttcatcgaattgacttaacggaactattttgactatactcgttgatgcaattcccacatctatacacagtttttctatatcatgtgcatgtattgcatcaataattatgatccattgatgttctaaaactgacatgtaaaattcaacaattttgtttatgttgtattttttcatttccacatctagtttatttttaagttcaagaaatgtttctttacttgattcattgttcattggacaagattctggactatgtgttgcaaaaaccccaaataacataattatctaattttttactaatatttaatttattttttttaaaatatactgttgagttgatgactaattttctaaaatttaatatttacatctagtatgaaaataattgaatacattatgagtgaaaaatcttttgcaacttcattatcttgtatagatggtagagttcaacttcctatgattaactggattaagaaaaaatatcttgtagattatgttgatactattactgcgcctggaattgataaggtgatttctgataatgatgttgaatcaattaaaaaaagtgtaatgatatctgtatttaatcacaagtcatctcatattgtaatttctggtcattttggttgtgctggaaatcctgtttctgatgaaaaacattttattcaaattaaaaaaagtgttgaaattgtaaattcttggaatttgaacgttgatgtagttggtatttggattgatgagaattttgttcctaatttattataattttcttttttatatctaaccgtaaatcatacaatgttcacattcacatgtggtttgttcttttgatttttttaaacattttttgtgttgacctgcttgacattgaacgcatacttcttccatatcttcaacttttgtatactttttagattgatcaaatccaaaacctccatcttgtggtcctaccatgtatttccctaatttatgtagtatttttagttcactaatttagtgcactttttatggtatcttgtaattcaactttattttcttcgataattcctctaatctcaaatgtatctacatatccacctgcagatgcacgtgttgctttaagtaaaaagtgcaatgatccttcttcaatttttccaacataatgcccatacagaaaatctatctcatcattacatttccaaatttttttaatatttggaaaagtttgtttaatttctgtgggtatttctttgattcttctttttatgtactggtctaatgattttctaattgtattgtcttgaagcaattctattacaagttatcagttgttactttttagttctttttttctcatcatctttattgtcccacatgtgcatggttcctctgatcataaatgagcctacaataattgctactagtcctcctattatgaagagaaataatttaccaacatctttgatacttgccaattctatttctatactatcattgtaattataactgtctgaaattattcaattagattcaatagtgagtttgatatttttttaatatgagtaagaaaaagcaagctattgcatggattgtaatggctgcaagtgtagttggatttttcttcttttcaattgaaatggctgaaatcatgcgttaatacttaaaattaattacactcaatttctttgaaatattattgcccctcattacttctgaaattaagaactttttagatactcaaaaattaggttatgttgcaactgtttctccaaatggtaaacctaacatttctccaaaaggcactattattgcatggtcctctaaccttcttgcttttgcagatatacgttcccctgatactatggcaaatttacaaaataacccctttgtagaaattaatgtaattgatcctttatctcgtaaaggatatctattttcaggaactgctnaaataattaaaaatactccattatntgntgaaattctcactcattaccaaaataatggtatnaaaagtccaattaattctattgtgatggtatctntttcatctatttctgcagtaacttctcctctttatgatttaggtaaaactcaagatgaaataaaattaaaatggaaaaaatatttcaatgatttgtaatttaaatttattctgttgatgatttaatttttattaattcttgccttgtttttttatgtgcttctctttcttcttctaataatctttgaattccctctaactctttttgtgttgtattaagttttgattttaatgatcctacaactacgcttgctgcttcaataatncctgcattacttttttcattaatattatctgggattatatcttttttctcttttggagttganacatttgtattttgagtattanttttntnatctaantcttgnttngttttaattaatttagaatttgtttcatctaattctttacctacttctatntgctgttttcttattccttgcaatgttgattgtccttttacaatttgttctttcacctctttgtgttcttttatcattttttctaattcttcttttgtttttttaaaatctttttcagtttgactaagttcgttaattaattttgtatctttaatttgctgtgcatttttgtttttctctcttgtttctctatactctctttgtactatgtctaactccatctttttttgattgaattctttttttattgacattaaattactgactgtagtgtcgtattcttctttgacactttgaattttttctgtaatttttgttatctcttcttgttttactctaaattccttttggagaccttcaacttctgtttctaattcttcttttagaatggattcatcatttttttcaattttcacttctttctttttgccaaaaaatcccattatttctcactatttctctccaaaagatgaacctttctttattggcgttttcccttatttctgataaattttagataaaatccgatacctccaattattatgcctccaatccatacaattacgcttatactttttggaataattgcttcttgcggtcctacaattagcattagtgctcctaaaattatcagtgcgaatcctccactgtttctacttttattatgttctccgtgaaccatgattatagatactctgaaagtgttttagcaacttgctttcttccaatatctgtgatgaatgggcctatttttggtcctcttgaagttccaagaattatttgatataatattttaaagaaatcttttggttgtacatcatttgcttttgcaatttgatatattgtattttgaatatcttcaggttcctcttctgcttgtaatgctttaaccagtttatctagtgcttttttagatatatcatctaactctactgctattttttcttgttcatcaaattcatcagaataatttcctgcaatctcaattaatttttcaacttctgtttctggatttttaatcactccatagtctatcaattttttcatcactcgttcatttctgtcttctttgaaaatttttgttaattcaattaataatctgtaattgatatgaatgcttgattgttttggaggattaagtaaattgacatattcatacagtccttttaatttagttaactttgcttgattgtccactttaatccttccaaaataagtatcttcaatttcgttatactcattcatcaatgatgggatatcatcaaaccctaattctctagctcctgtaattcttttgtacagtaataataaaattgattttgaattaccgtactctaaccatttttgtgctgtaatcacatttcctaatgattttgaaatcttttttcctcctttatccaaaaacatttcatattttacgtgatgaggatgtggtacttttaaaatttcatctgatacccagtcatttactttaactgaatccattatgtcttttccatatgcctcaaatcta

SEQ ID NO: 1412 - DNA, 4000 bp, Escherichia coli
  misc_feature (132)..(132): n is a, c, g, or t
  misc_feature (279)..(279): n is a, c, g, or t
  misc_feature (500)..(500): n is a, c, g, or t
  misc_feature (626)..(626): n is a, c, g, or t
  misc_feature (770)..(770): n is a, c, g, or t
  misc_feature (1233)..(1233): n is a, c, g, or t
  misc_feature (1766)..(1766): n is a, c, g, or t
  misc_feature (1944)..(1944): n is a, c, g, or t
  misc_feature (1992)..(1992): n is a, c, g, or t
  misc_feature (2010)..(2010): n is a, c, g, or t
  misc_feature (2076)..(2076): n is a, c, g, or t
  misc_feature (2301)..(2301): n is a, c, g, or t
  misc_feature (3232)..(3232): n is a, c, g, or t
  misc_feature (3479)..(3479): n is a, c, g, or t
  misc_feature (3725)..(3725): n is a, c, g, or t
  misc_feature (3789)..(3789): n is a, c, g, or t
  misc_feature (3798)..(3798): n is a, c, g, or t
  misc_feature (3808)..(3809): n is a, c, g, or t
  misc_feature (3825)..(3825): n is a, c, g, or t
  misc_feature (3828)..(3834): n is a, c, g, or t
  misc_feature (3837)..(3838): n is a, c, g, or t
  misc_feature (3841)..(3842): n is a, c, g, or t
  misc_feature (3844)..(3848): n is a, c, g, or t
  misc_feature (3852)..(3859): n is a, c, g, or t
  misc_feature (3861)..(3870): n is a, c, g, or t
  misc_feature (3872)..(3887): n is a, c, g, or t
  misc_feature (3890)..(3891): n is a, c, g, or t
  misc_feature (3900)..(3909): n is a, c, g, or t
  misc_feature (3912)..(3912): n is a, c, g, or t
  misc_feature (3915)..(3915): n is a, c, g, or t
  misc_feature (3920)..(3921): n is a, c, g, or t
  misc_feature (3924)..(3929): n is a, c, g, or t
  misc_feature (3932)..(3932): n is a, c, g, or t
  misc_feature (3935)..(3936): n is a, c, g, or t
  misc_feature (3939)..(3953): n is a, c, g, or t
  misc_feature (3957)..(3959): n is a, c, g, or t
  misc_feature (3961)..(3961): n is a, c, g, or t
  misc_feature (3965)..(3968): n is a, c, g, or t
  misc_feature (3971)..(3973): n is a, c, g, or t
  misc_feature (3976)..(3978): n is a, c, g, or t
  misc_feature (3983)..(3989): n is a, c, g, or t
  misc_feature (3991)..(3992): n is a, c, g, or t
  misc_feature (3994)..(4000): n is a, c, g, or t
gagcctaaagcgacaaatccctcaggaatcgtggcacccgccggaaaacatgctaaaagcccgtggtcctcgccaccgcccagaacgcattcacgggccaggctgaccgcagaatcaccatgatcgttatgnggctgatgctcaagaataagacttgccactggtaccagctcacgtgccagctcggtaatcgcagaatcattgaacacgatatcgacgccggatgcttcggcaattcgacgcgcgtctttaacgagtccgtctgaaaggtctagcatngcgttggcaccgtatgctgcagcgcgtcgccctgcgggtatgggcgatacgggccttagctgatgggtaacagcgcgttcgatacgttctttctgcgtggaaggcagctgctctatcgagtcgagagagcctgtggttgtcagtagccgcagcccggcatcagcccacccggtacagcccgccaaagctacggtatctcccggttgcgccccagacctcancacagggttttcgcatcgtccaacagccgttatggtaacgctggcatcacgtgcgctgcctagatcaccgccgcctaccgtacagactgtagcgccgcatgcatgcagcgagtcgaggataccgcnggcaaagtcttcaacccaaccatagggggtttcgggcggcagacttagagatacaaaaaggctaacgggttcagcacccatagccgcaatatcggcaaggttctgggtggtggctttccaccctacctcgtaaccgccgctacncggaccggcaggccagatatcgagaaaatcttgcccatgtaccagagtatctgtggtgataaccgtgcgtcgattatcgcccgtgagcactgcgcagtcgtcaccgggacctacttcaagcaccggttcctgcccatgtgcggaggcaacctggattacggagcggttatgctcatccagcatgggcataaacaattgcaaaacacgggactcccccagctgagccaatgtgctcttccggagtgaactttcccgtgctttatgctttttggtccgagggttcattccccaataatcgcccataccctgttacctggcacggataaagtaccgaatcgccacaatggtaatcgcaagaattagcagggagaagaacgccaacggcacgaaacctgagagtccagggccacgagaatccgttgaacgttcctgaacactcttagggctatcgccgttccgttgngcttgcgaaccagcggacgttgcgggcggacgagcaaccgggttcacagcagatggaacagaataagaaccgtttctagactcctgtgggttcgccattctcaaagttggcgagccattccgggcgttctctccacgggacaaatatccctgtacccagtccgcggcgccggggaacgcattggggaaccctgaatttgttgcaaaacgccccaacgtcgcgatgctattggggaagggttcagcagatgtagacggcgcgggtgctggagagacattgctcgacggcgttgccgaagggctggcatctggagctggcgaatcgtcagaccccgggtttccatgccccgaagggctcgggctaggagttggagctgccgattcggaagcacttgggctcgggaacggaacaggctggctagtaggctgctccgaaggcgcaggggtccacccaggatcctgagacggtgcgggtgcggggtctgcaggagtaggtgttacgggcgacggggtcggagagaccgggaccggtgngggggtcacgggtgttggcttagccggagccggtgttacgggagtgggggtaggatacaccggtgtcgggttggcctgtgtaggcgtagggttcaccgggaccggtgtgggattcaccggagcagggttaaccggagtcagatccggactaggcacaatggtcggtaccggatcaggngcagggttaactggtgttgggttggcctgtgtaggcgtagggttcacngggaccggtgtggggttnaccggagtaggggttaccggtgtgggattcaccggagtctgatctgtaggagccggagtaggcgtnacaggagtagggttggcaggcacaggctccgggttcaccggggtcggattaaccggtgtgggcgtaggggttactggtgcgggattcaccggagtctgatctgtaggagccggagtaggcgtcacaggagtagccgctggttcttctccgagatccggggaagctgcctcagcgtcctcagcaggaaggttctgaacgggagcagcaggagttggagttacagcntctgtttcagaatcctcagtaggaacttcggcatcataaggctgcgcctgtggactctcatattcgggggtaacaggctgaacttccgcttcatcttcatcagttttctgagccggggtagctcgttgcgcaggggtctcggtagcctcaggaatctcgtcgtcctgctggtcatagtcaagcggaggtgcagcggcaaactcggcacctgcaatgggagattccgattgcagggcaacggcgggttgagcagcataggtcacgttgcccgaggccatgccgtacatagtcaaggtagcggttgcagacggcatgggcataggagtcacggcatttttctgacctaaagctgcaaaggtagctggtacggcaggctgcgtgatagcttgaccgggcgcggcagcctcagaggtcgcaggatggtttgcgaccttcccggaagcgccacgtgcctcctgtgtcagcgttgcggcgatcggcacactaccgaatgcaatcaatgcagtcgctaggctagccgacgctactttgcattgtctgtttcccaaaaagtgtccttataccgaatagctaccgaacaatatgcgtgcttgggtgagtctacaccctaaataacaaggatgtgcttctctcaaaagtttatcgaattttaagaatcttttcacgatcaactattaactgttactttcatggtacctggactatgggcaaattgtcgtgactttgagctttaaattggtattcaaatttttgctttcctctgatctgccgcgctatgtttctgcgacacgccagtgaatataccgtacgttagaatgagagagtgacttttacgtcttttaactttttcgtcatgtccccagcgaagcgagcaggcttgggtcttgcgctcaccggggtgctgtcgctcagcgcgtgtggagcgggcaangtcaatcttgatccggctccagatgccgccaaccctgtatgcgcttatgcgatggttgctatgccagaaaaactcgttggcctacagcagcgtgaaactacggcgcaaggaacgaccgcttggggcgaaccagcctccgtgattctcaaatgcggtgttaccgttcaggaacccgtatcggacccatgcgctgaggtcaatgggattgattgggtgctgcgtcccaaggatgcgccagagaactcancaccgccagtctcagcgtcttcctccgccgctgcaggccctgaaaaccgtgcgacgggaacgtggacggcaaccacgtacggacgaacgcccgccattgaagtaaccttcgacgcagataaggtttcatcatcaactcttcttgctgagctcaactcggcggtcaaacaaattccgtctcagaagaaatgcacgaacatcaacgatactctcaacggtgtcaaaaccggaaaatagaggattcaanacctctggatccttaccttcagttcgcttcacgcaaacgcaaattttagagcccccaaaacctnaggtcttgngggctctaannctggaatttccttctnttnnnnnnnccnnaanngnnnnncccnnnnnnnngnnnnnnnnnnannnnnnnnnnnnnnnnaannaattccggnnnnnnnnnnccnggnttttnncannnnnnttnggnnaannnnnnnnnnnnnnntccnnncnttgnnnnccnnncgnnnatccnnnnnnnannannnnnnn

SEQ ID NO: 1413 - DNA, 4000 bp, Escherichia coli
  misc_feature (633)..(633): n is a, c, g, or t
  misc_feature (785)..(785): n is a, c, g, or t
  misc_feature (797)..(797): n is a, c, g, or t
  misc_feature (815)..(815): n is a, c, g, or t
  misc_feature (1136)..(1136): n is a, c, g, or t
tattttttccttctacttttactgtgattggaaagtgtgcaaaaacaactttcattttaattgtataacctgtaatcaaaccttcacaaatatttctaataattgatcttgcagtatgtaaaattgcataatctctttttttgaaatcaattgtttttagtaaaattttattctctacaatttcaatttttactgggattaaacgaaaacttttgtgtgttttacctagtggacctacaaatgttaacatgtgtttttgttgtgtaactgtaattccttctggaatgactacttcgtctttgaatttttcgagttgactagtagacatatcccaccaaaaatcctccaattcctttatcgactgcctcgtgatgagacattacgccttgattagttgtgactatgagcattcctctatcataagatggtagatattgttgttcccaactgttgtattcatcactttttactttgaatcttggtgaaattgcaccacattttgtaatttttgccaataatttaattttgaatttgcctcctcgtttatcgtctatatgctcaaattctccgatatatccatctttttgaagtgtttttagaacttcaaccccaatttttgatgttggtagaatnatacaatcagatttccttcttgtttcgttattgtaaagtgtaacgaacaaatttgctaaaatattagttgctggcatctatatcaccgatttttcctgaaccctaaagatgttgctacttctctaaagcatcgtctacataacattaagtcntatttttgaatnacagcagtataatctccncatcttttacaccatcttgaacctctgccaaaatcatgtttttttcttccagtggcttcgtaggatctatctttaggcattatactattgtgactccatattcttttgcaagataatcctttgcttcttgattagtaataatgtgtgttttgccaacacttgctttgtgtttacttcttttacgaattgaatatcctggtctagttaatgtaactgatattccaagacctaaaattccaatctgtggatcatattttacatctggaatgtctatgtgttcgttaataccaaatgagtaattaccaaaattgtcaaatgctntaccgttgacactgtttcctttagcttctagtaatcttttcaataatgttactgcatcatcacctctaattgttactgcaactcctattggttcgccttttctaactccccactctctttgagtttcttttgcattacgtgttgatggttttttacctgaaatttgttctaatgcttttcttgcaatgtctatgacatctcctgatttaccaatacccatgtttagtactactttctctaaagatatttttttcattggggattctgttacttgagacatattatcactttaattgaattacaggctcctctttacctattggcatgatgatgtctgccggaatttcgatttttttatcacctaaaattagaataactctttttggaaggatgaatgttccttcttctacactttcaactttacctatttgtcctgcattgattcctcttgttactaatccttgacatcctgcttctaatttgatgatgtctaaaattttctgatcaggaatttgcattacacatgtatctcctactttagctttaacttctgcaagtgttgaacgtccatcatgaaatcctgtttgaattattcctttgttaattgatgttttagttacaactcttacaagtttcttagatttttcagattcattaattttaattggtttgagaatttttccttcagttggaactaagcgataaacatctgaaacattttctaattctactacgtccatcaatccaattgcatgatgaagtgattttctaacaactccatcaattttgactttacctgaatagattgatgctttagcttcccttagacttgtaactatctttaatgtgtctcttaggaatactgctgttggtattgcaaaattctttttgtgtggacctggttttgttgtaattacaaatcgtttatcttttctagtaatgccccaaaactgtggtgccatttgtcgtttgagttttttacttcctgcaatacttaccattatttctcattttcctttttttcaacttctttttctacctttggttctgttttgttttctttagtggttgtttcttttggttgttttcttggatctttgccttctaattttgccattctccatttgtcattactgttaagtgaagttattactaaattggatgtatggatatagacgtcaaatttgtctcctttggttttttctttctttacaccgtcaattgcaacacttgatttttgagtggatatatttgaaattttaccgtcaactcctttgaattctcctcttagaattgttacactatcaccttctactactcttgcactttttttaccgtattttttttgcaagtcttttgataatgcacttcccatttgtttacttctagtttgaagagttgcttggaaaagcattcgattacgcattttagttggttttaccattttatcatatcaccgttgatgccaagttagctactcttggccatttttctgaagcttctgctgcaactggacctttgatgtctgttccttttgtttcaccttctggtgtgattaaaactgctgcattatcttcaaaacaaactctgactccatttaatctacgaactgcatatttttgtctaacaataactgcaccatacacttgttttcttaattctgctggtcctttctttactacaacattacaaaagtctccaacaccacctgctgctagtcttgatgctcttgttttgattcttggaacgttaattacttctaaaatttttgcacctgaattatctgcacatactatgttggctcctacaggtattgatcttgttacgtatggtcggaattcttctactccttttcctgcttgttttgccattatgcttttacctcaattactacatatgaaactgattttgaaattggtctacattctgcagttaacacatgatctccagatgttacatcaatacatcctggtacgtgtgcatggattgtacttttacctctggcatatcttttgaatttactaaagtagattggttcgtcttttgtcaatgtaatggtctgttttgctttatcacctgtaactttaccatcaaataattttcctcttattgataaacctccatggaatggacaattcttgtcgtcacattctttttttggttcgtttactttgattcctatatttttagtcatgcttttgctcctattctttcatatggtcttttagtaattgttgtaccttttactatcaagtttttacctttaattgaaaatccccaatcgtttgttagttttggaatcattttcgtacctttttctgtatttaatgtaaacatcgattttgtttcattaatgattgttccatttaatcctattacttgaggattagatgaattaatgatttttgtctctaaacctatgaattcatgtcttgaaattgtatctacagtaatcatttctctttctccatttcatttaatctagttaacattcttgcaatattgtgacgtattggttttagtttaccactctcttttcttaatgttccttttgatgaatctactcgaagttttgccaaatctgttctattgtctaacattttacttctaagatctttttcatttagatttctaattgttttcatactgattttggtcatttcatacttgcctcatcttcttctagtgtttcaattgttttcattttttctgcttcgattgcaatttgttctgattctgattttgctttatttgcatctccttcaactttaacaacttcaactttaacatctccttcaactttaacttcttcaacttttttaactggtgcttctttttctactttcttctttttggtttctttt

SEQ ID NO: 1414 - DNA, 4000 bp, Escherichia coli
  misc_feature (95)..(95): n is a, c, g, or t
  misc_feature (648)..(648): n is a, c, g, or t
  misc_feature (888)..(888): n is a, c, g, or t
  misc_feature (1991)..(1991): n is a, c, g, or t
  misc_feature (2634)..(2634): n is a, c, g, or t
  misc_feature (2655)..(2655): n is a, c, g, or t
  misc_feature (2736)..(2736): n is a, c, g, or t
  misc_feature (2742)..(2742): n is a, c, g, or t
  misc_feature (2932)..(2932): n is a, c, g, or t
  misc_feature (3044)..(3044): n is a, c, g, or t
  misc_feature (3297)..(3297): n is a, c, g, or t
  misc_feature (3327)..(3327): n is a, c, g, or t
  misc_feature (3332)..(3332): n is a, c, g, or t
  misc_feature (3423)..(3423): n is a, c, g, or t
  misc_feature (3897)..(3897): n is a, c, g, or t
ttggggtgaagcaagatgctgttccaggcagaattgcagagctatggttcaatgttgatgagggacaagaaggaatttactttggtcagtgttcngaattgtgcggaaaagaccacgcctacatgcctattactgtcagagcggttaccatggcagaatatgagaaatggcttgacgaggctataatagagtatgcaggtaagccacgtaatttggatatagcttcaaattagcagataagatcaagttgtttagtttgataaaggacaaaatatgacagatgcgtcgataacatcttctagctatagcacttacaatcaaccagagtttgatgattactttgagttgctaaagccaagagttatgtcattggtaatatttacagcatcagttgggttatttgtggcgccaaatggagttcatccaattttggcatttgcatcaatcctattcatcgcgattggagcgggagcctctggtgcattaaatatgtggtgggatgcagacatagattctgtaatgaaacgtacgtctgaaagaccaatacctgggggtagagtgtccccatctgaggcacggaacttagggctctggttgtctgtattctccgttggcatgttggctataacagctaattttttgtcagcngctttattggcttttactatttttttctatgcggttgtttatacgatgtggttgaaaagatggaccccccaaaatatcgtgattggtggggcagctggtgcatttcctccaatgatcgggtgggttgcagcgacaggtggggtatcagttgaaagtgtgttaatgttcgctctcatatttatgtggacaccaccacatttctgggcgcttgcgctgttcatgaatgatgattactcaaangcaggtgttccaatgttgaccgttactcatggtaaaaagtcaactagattacatattttgatctattcagtgttgttagctcccttagccatgagtttagcatttactgaaataggaggacctatttactttttaactgctttaggtctaaatggttggtttttgctaggggcatatcggttgtttaatagtagcgaaataaatgcggcacttcaaaaatatagtcgagagaaaactttctttttcttctctattttctatctttttgctcatttcatggctttactaattgaagccttcgtcgattttaaagttatcaattggccggtgtttttttagttatggctttgagtagattacacccacagcacaaaaaaagattaaggtccaatattataattggaggcttacttctaggatttgttgcacttgtttttggtataaccgtggtgaaaatgagcaatggcgcgatgcttgaagcttttgaccatagttacagaattagtgtaactccagccaaagatgagtaaaaattcaaatagaaaaaccgtgataggagcgatttctcttgtagttttcatgggtactttgtcatttgccgcggtacctttttatgattggttttgtagagtaactggatttggaggtactactcaattagctcaatctgataattctgaaattcttgataaaactattataattaaatttgatgctaatactgaacgtggcatgccgtgggattttaaaccagttgaacatgaattagagttaaagattggtgaaactgggttggcgttttatcaggcttataatccaacgtctaaaccggtggccgggacagcaagttttaatgtgtttccttactctgctggaggttattttacgaaaatagcatgtttttgtttcgaagagcaggtgcttcagcctggagaaaaaattgatatgccagtcagcttttacattgatcctgatatcgtgaaagataaagaagcaaaatttgctaaatcgattactctatcgtacacgttccatcgaaccgaattgccgcaggatcaagcatcgctatttcaatcatcagacaaatagtatagttttggtanatatataaggaaggtcaacatggcacacgaaaaaaatcatgattatcatattcttgacccaagtatattaccatttttaggtgcagttggcgcatttattttactcttcggtgcagtattatggatgcaaagcgtcacaatttttgtattcttgattgggcttgcactggtactttatgttatgtgggcatggtgggcgcaggttgtggtggagagtcatattggtgatcatacaccagttgtgcgtatcggcttaagatatggttttataatgtttataatttctgaagtaatgtttttcgtagcttggttttggacattttttaaacatgctttatatccaatgggaccagacagccctaaaattgacggtgtatggcctcctgcaggaattgaaacatttgatccatggcatttgccattgattaatacattaattctcttgtgttcggggtgtgctgcgacatgggctcaccacgcccttgttcacgaaaataatcggaaagacttagttaacggactgataatcgctgttgcattgggagcattattcacgttttttcaggggtatgaatatggccatgccgcatttgggttctctggaaacatttatggagctacctttttcatggcaactgggttncatgggtttcatgtattaatnggatctatttttctattggtatgtctttttagaacaatgaaaggtcactttaatccttctcaacatgttggatttgaagcngcagcntggtactggcactttgttgatgttgtatggttatttttatttgcggccatttacatttggggtggctgataaaatatcattgcataataattcttctttaaatattttgctttggcgcagatctcaatctgcgccttttgaatatggattactagcatgaagcaatttacagttcctgtgttatttggcntaattggtgcatcaattctaatttatttgggagtttggcaaacacaacgtttacagtggaaagaagccaaattacaaactatagaaagcatgatttcagctaatccaagtgntttgccggatttaccaaatatagaactgcaccaatatttgcccgtaagtttaaagggagaatttgtaaaagatgaggttcatattttaacaagtagacctccaattggtccggggtatcgggtgatctccaagtttaaaacaaataatatagttattcttgttgatagagggttcgttcgggaaattgataaaaacaatgatagaacttccggggttgccaaagtaattggtaatctactatggccaaatgangttgatagctctttcacaccaaatccaganttagntaagaatgtatggtttgcaagggatttatcgatgctctctacgcatctaaatactgaacctatattggttgtagcaaggcagattaaaccnaacttaaacgaggttatgccttggccaattgatacgattggaattccaaataatcatttccaatacgcagtaacatggttttcattaagtattatttggatggggatgacagtgtactggatatggcgtatcagaagccgacaggatatttaggttaatgaggtgtgttagatgaaatatgtttcaacacgaggtgaggctcaagagttagactttgaagatgtgatgctgactggtcttgcacgagatgggggcctttatttaccaaaagaatggcctaaattcactgataaagacttaagtaatatggcaggctcttcttatgaagagattgcgtttacagtaatgaagccatttatcggttctactttcagtgatgaagaatttaaaaaaataattaaaaatgcttaccataattttgagacagaagttcgctgcccacttctgaggctaagtgataatacttttttattngagctttattatgggccaactttggcatttaaagatgtcgcgatgcaacttattggccaaatgtttgaattgtccttaaaaagaaaatcacaaaaaattgtta

SEQ ID NO: 1415 - DNA, 4000 bp, Escherichia coli
  misc_feature (74)..(74): n is a, c, g, or t
  misc_feature (248)..(248): n is a, c, g, or t
  misc_feature (380)..(380): n is a, c, g, or t
  misc_feature (428)..(428): n is a, c, g, or t
  misc_feature (500)..(500): n is a, c, g, or t
  misc_feature (626)..(626): n is a, c, g, or t
  misc_feature (680)..(680): n is a, c, g, or t
  misc_feature (749)..(749): n is a, c, g, or t
  misc_feature (1013)..(1013): n is a, c, g, or t
  misc_feature (1946)..(1946): n is a, c, g, or t
  misc_feature (1954)..(1954): n is a, c, g, or t
  misc_feature (1969)..(1969): n is a, c, g, or t
  misc_feature (2024)..(2024): n is a, c, g, or t
  misc_feature (2027)..(2027): n is a, c, g, or t
  misc_feature (2141)..(2141): n is a, c, g, or t
  misc_feature (2239)..(2239): n is a, c, g, or t
  misc_feature (2258)..(2258): n is a, c, g, or t
  misc_feature (2285)..(2285): n is a, c, g, or t
  misc_feature (2316)..(2316): n is a, c, g, or t
  misc_feature (2327)..(2327): n is a, c, g, or t
  misc_feature (2354)..(2354): n is a, c, g, or t
  misc_feature (2387)..(2387): n is a, c, g, or t
  misc_feature (2405)..(2405): n is a, c, g, or t
  misc_feature (2423)..(2423): n is a, c, g, or t
  misc_feature (2426)..(2426): n is a, c, g, or t
  misc_feature (2450)..(2450): n is a, c, g, or t
  misc_feature (2459)..(2459): n is a, c, g, or t
  misc_feature (2527)..(2527): n is a, c, g, or t
  misc_feature (2531)..(2531): n is a, c, g, or t
  misc_feature (2537)..(2537): n is a, c, g, or t
  misc_feature (2546)..(2546): n is a, c, g, or t
  misc_feature (2561)..(2561): n is a, c, g, or t
  misc_feature (2576)..(2576): n is a, c, g, or t
  misc_feature (2594)..(2594): n is a, c, g, or t
  misc_feature (2600)..(2600): n is a, c, g, or t
  misc_feature (2615)..(2615): n is a, c, g, or t
  misc_feature (2636)..(2636): n is a, c, g, or t
  misc_feature (2648)..(2648): n is a, c, g, or t
  misc_feature (2672)..(2672): n is a, c, g, or t
  misc_feature (2684)..(2684): n is a, c, g, or t
  misc_feature (2686)..(2687): n is a, c, g, or t
  misc_feature (2725)..(2725): n is a, c, g, or t
  misc_feature (2728)..(2728): n is a, c, g, or t
  misc_feature (2743)..(2743): n is a, c, g, or t
  misc_feature (2776)..(2776): n is a, c, g, or t
  misc_feature (2782)..(2782): n is a, c, g, or t
  misc_feature (2833)..(2833): n is a, c, g, or t
  misc_feature (2836)..(2836): n is a, c, g, or t
  misc_feature (2839)..(2839): n is a, c, g, or t
  misc_feature (2845)..(2845): n is a, c, g, or t
  misc_feature (2851)..(2851): n is a, c, g, or t
  misc_feature (2857)..(2857): n is a, c, g, or t
  misc_feature (2875)..(2875): n is a, c, g, or t
  misc_feature (2932)..(2932): n is a, c, g, or t
  misc_feature (2938)..(2938): n is a, c, g, or t
  misc_feature (2944)..(2944): n is a, c, g, or t
  misc_feature (2953)..(2953): n is a, c, g, or t
  misc_feature (2959)..(2959): n is a, c, g, or t
  misc_feature (3007)..(3007): n is a, c, g, or t
  misc_feature (3019)..(3019): n is a, c, g, or t
  misc_feature (3232)..(3232): n is a, c, g, or t
  misc_feature (3325)..(3325): n is a, c, g, or t
  misc_feature (3424)..(3424): n is a, c, g, or t
  misc_feature (3454)..(3454): n is a, c, g, or t
  misc_feature (3460)..(3460): n is a, c, g, or t
  misc_feature (3481)..(3481): n is a, c, g, or t
  misc_feature (3484)..(3484): n is a, c, g, or t
  misc_feature (3514)..(3514): n is a, c, g, or t
  misc_feature (3535)..(3535): n is a, c, g, or t
  misc_feature (3544)..(3544): n is a, c, g, or t
  misc_feature (3727)..(3727): n is a, c, g, or t
  misc_feature (3730)..(3730): n is a, c, g, or t
  misc_feature (3877)..(3877): n is a, c, g, or t
  misc_feature (3946)..(3946): n is a, c, g, or t
  misc_feature (3949)..(3949): n is a, c, g, or t
  misc_feature (3964)..(3964): n is a, c, g, or t
  misc_feature (3979)..(3979): n is a, c, g, or t
ggatatcggtaagaacaacagtcttgccgttctcctggataagacccattgcaacaccagaaacaggacgcttnagaggaacgcctgcatccataagggaaagcgtagaaccgcaggtagaagccatggaagaagaaccattggactccattacctcagagacaacgcggatggtgtaagggaactcttcctcggaaggaatgacaggcagaagtgcgcgctctgcaagagctccgtgaccaatctcncggcgctttggactgcccatacggccagtctcaccggtgcagaatggtgggaagttgtagtggtgaatgtagcgcttgccatccattggctcaatggtgtcaagacgctgccactcgttgagcatgccaagngtacaaatggagagaacctgagtctgaccacgctggaaaagaccaganccgtgaacaagtggcaggtaatcaggcttgaccatgattggacgaatctcgtctgcaacacggccgtcaacncgctcgccggtctcaacaaccatgacgcgcatagcgtgcttctcaagacccttgagctcaacggcaatagcgcggctccaaagctcctgctcctcctcggtgaactgagccttaatctcgtccatnaggtcagcaaccttctgcatacgggactgcttgtcagcgtccttaagagcagcnctcatctggtcatagtaagcaaagatgcggtcatggacctcagcgattggctcgtcaaggatgtactcncgcttgacgatagggccgttaacctcttcccacttagcaataaacttcttctgctcctcgcagaaggctgcaattgcctcctgaccaaatgccatagcggagagcatatcctcttcggaaatctcatctgcaccagcctcaagcatggaaataaaggtggaagaaccgccaagctcaaggtcaaggtcagagtgatcgcgctcttcataggttgggttaaccaggaactcgccggtatcagcgttgcggccaatacggacgcangcaagtggtccctcaaaaggaacgccaccaacggccagggcagcagatgcgcccatgacagagatggtatcaacagcgtttacctgatcagcaacaagagaagttgcaacaatctgaacctcattgcggaagccatctgggaaggatgggcgcagaggacggtcaatcatacgagcagtaagggttgccttctcggatggacgagcctcacgcttgaggtatccaccaggaacacgaccaactgcgtacattttctcaataaaatcaacagtcagtgggaagaagtcgtaatctttacgctccttggaaaccactgcagtgagaagtacggtggaatcgccgcacttaacgatacaggcacctgttgcctgctttgcgagctcaccagcctcaagggtgtagtgcttaccatagaggtcaaattcgtgagttactttagtcatttctttcctcttctatctccgtttgccccattgcaaacgggcctcaaacataaagggcgccagacggcgccctaaaaagccaacttactggatgttgtcgcggatacccagggaagcaataagagtacggtactcttcaatgtcgttcgacttgatgtaagaaagaagacgacgacgcttaccaacgagcatcagaagaccacgacgagtgtggaagtccttctggtgggacttcatgtggtcggtgagctgacgaatacgctcagtaagaagagcaacctgaacctgtgcggaaccggagtccttctcgtccttgccgtactgcttgatgagctcagccttacgatccttagttactgccataataaaccgcctttcgcgttgaatactccttgtactgagaaggtagccggcagtgactagcccctaagaacaaggaaataacctacaagaggataccagttactggtgaactttgctagtaaaaatncacttcanctagatactgagcanaaattcaaatgccttgaggcgcgcttcaaggtgtgtagccgcccaaatatgcgcnctngtgagcaaaaagagcgcagtttctggagcaatctcggcaacaacaagctggtcaaaggtaagttttagaagcgacgacaaccacgagagctcaagtggagttacctcaatggcnccctcaatctcatgcgcacaacttccacacaatgcaccaccagcagctggcgagaagtacgtcagagcttcatctccacaggcaatgcacgattccanctcagggcgccagccttcntgtgccaaaaccttaaacacataagcngcaacaacaagatctaagtgtttctcgtcanctacttcttcncaggctctgagagcgcgagaaagcagnggatagagaaacgcgtcctcaatgccatcaatncacgaaagacgtgcaacntcgcagatagctgacgcngcngctaccttagagagatctccgcgnagtgatgcntgcggctcaagcaaggttgcctcggacaagatgtcaagcgagcgaccttctgccagcagtacgtctanctcncaaaanagttcaacncgagcagcaaagcgnccgcctggctttctngcaccctttgcgacagcncgacgntcttctcccgaatcngagagcatggttaagatgagntcttgctcagcnagttttgttctatcaagcacaatngctttaagacgngnngtctttctaccaggcacaactagtcctcagttgagtanccnaggcgcttaatctcnttggcatcacgcctccagagaggctgaacgcgnacctgnaggtcaaggtaaaccttgcgaccaaacagtttctccaggtcttttctagcntcnacnccaacncgcttnatcatngagccgccctggccaacnacgatgcccttttgtccttctcgctcaaccaaaatggtggcagaaatagagaggtgnccatcngttgcnacctcatangaatcncaaacaacggcaacggaatggggaacttcctgacgaaggttcagcaanagcttctcgcgnacaaactctgctaccaggtcttctggcaatgcgtcagtctccatgtcctctgggaaccacataggaccctcaggaagatgctctgaaacaagcgcaataaatgcctggatattgaagtcttctggagcagaaacaacaagcacgtcatcaaagtgcgcaagagcctgtgcggcctcaagctgctctgttacttgctctggagttgcaatgtcngccttggtaataaccagcagcttaaaggcggcatgcgcctgctcaacatgattggcaacccattcatctccacgaccaacaggcttagtagcntcaatcaaaaaagcaatgacatcagcgtcattaagctctccgagcgctgccttgttgagctcttttccaagagcgtctttgggcttgtggaggcctggngtatctacaatgaccagctgggagttctcnccgttnaccactgccctaaaacgacgncgngttgtctgggcaacagggcttgcaatagcnactttctggcccatgcaagcntttaacagngtggacttaccaacacttggacgaccaactaaagcaacaaaaccgctcctaaagggagtggtctcagatgtagtgttttcagaaactgaattggcggtcatatgtcctccaacttaccaatgaaaaattgcacgcgagaaaatcaaaagtcctataagagctgcggtaatgctaatgcagcangangcagctgccgcaatatctttagctttaccagccatggggtgaaactctggagaaaccagatctaccacggtttctattgctgtattgagaagttctgtggttaaaaccgcaccaatacaagcaagaacaagtgcccagctcacagcntctaaaccaacaaacaatcccaccaccacggttactgcagcagcaacggccatacgacgcaagtttgcntcntgagcaaatgcttgncgagcgccctgtagngcaaagagaaggccgcgctta

SEQ ID NO: 1416 - DNA, 4000 bp, Escherichia coli
  misc_feature (341)..(341): n is a, c, g, or t
  misc_feature (538)..(538): n is a, c, g, or t
  misc_feature (1633)..(1633): n is a, c, g, or t
  misc_feature (1735)..(1735): n is a, c, g, or t
  misc_feature (1851)..(1851): n is a, c, g, or t
  misc_feature (1978)..(1978): n is a, c, g, or t
  misc_feature (1999)..(1999): n is a, c, g, or t
gcgatcgtgctgcaggtcacgtcacaaccgggcacgtcccccacggtgttgctaaccctcccaagtgatgttttgcgcattagtgcataaaaaacattaattttatgtccaaaacgctggatccagagggcaactggcggtactttttcatcgacggcgtcttaggggtgataatttgaaactgcaacaattgagatacatctgggaagttgctcatcatgacctcaatgtgtctgcgacggcacaaagtctgttcacctcccagccaggaatcagtaagcaaatacggctcctagaagatgaattgggcgtggagatttttgcacgcagcggaaaacatntgacgcacattactcctgctggcgaggtcatactggagttagctggggagatgctgcgcaagtcagatgcaataaaacgtgtggcacaggaattttcggacgagacgagtggtactttgtctatagccaccacccatactcaagcgcgctacgtgctgccacctattattaaagactttatgtcgggttaccctaangtgtccttgcaaatgcagcagggcacgccgccgcagattgcagagatggccgcagaaggcagtgttgatttcgcgatcgctacggaggccctccagcaattcaatagtttggttttattgccctgctatcgctggaatcgttgcatagtcgtgcccaaaggacatcctctaactcaagtagaacggttgactttagaggctgtggcggagcatccaatcgtgacttataccttcggatttacaggccgatcgaagcttgatgacgcgttcaaaagtaggggcttagtgcctcacgttgtatttaccgcagttgattccgatgttatcaagacctacgtcagactaggcctagggataggcattattgcgggtttggcccatgatgaagatctcgacgaggatctcgtcaaactaaacgtagatcatctctttgccagtagcgtgaccagccttgccttcagaaagggctcgtttttacgcggctacatgtacgattttattcaggcccttgcgccgcatctgacgcgagatattgtcgttgaagcactctcgagatcgaatcccgcagagcgggaggcgctttatagtcacatcgaattgccaacctactgactgtcgagagcgcgcataaaaccggcgactttgtccatggtttcactgaactcttcctctggcactgaatcccaggtaattcctccgccgccccagcaataaagcacgccattcgaggcctcaagggtccgaattgcaatactcgattcgagccatccgttcgaagacatggcaaaaacactgccgcaataaacccctctagagccggtctctaggcttttgataatttctacagagcgtttcttaggggcccccgtgattgaaccaccgggggaagccgcaataaaggcggctccaggggttacttccggtttcagctcgccttcaattcgactcactaaatgatgcacgttgtcgtagctgtagagggcacataactcggtgacttcgaccgttcccgttttgcagagtttacccaggtcattgcgcaataagtcaacgatcataatgttttctgcgcgatctttcgttgaacttaaaagngcgttagccgagtcattatctcgcttctgatcgcgaaagcgggggcgcgtacctttaattggttgggagcgtataaagccggcatcaatacttaaaaagcgntctggtgattgagaaataacggcatgattagagccaagtttaaggaatgctgcgtaatctcccggggccacatctcttagtgcttcgtaaatgccatactcagatccactgtaggngcactgaaatcgctgggcgatattagcctggtaacaatctcctgcagcgattagcgccctgacttcggccaccatcgacctgtaacttccacttgaaatatcagctgtaaacttatgatctatatgntattttagctcccttttgttntcagccgcggccattctatttcgcacttcagtgctggtttgcgctgagacacacggatcttgtaccagccaagcgcgctcctcagaatgatcctgtaggacataccaagagtatattccagcgattgcgggttgcagcggctcactcggcacattaagcgtgtttgcggcggcggtttcaaaatcaagaaacccaattgccatgcgagacgattcggcaggggatgcgttcaggtctgcttctatcgcgcttatccagcgtgccgcgtctccaccaaaatccgtaacgcagaaatatcgatctggcagcgcagtgataatgtcatagcggccactatcgttatcacgctttcgactgtcgagaacagcaaagccctccaaatcagcgaagcgtcgggcccaaagcgttacatcattcgaatagggtacggggtggcagtgtggactatgaattttcaaagattttgatgaccatttcgcaacaaattgacacaatactgctcttaaccgtaagttacgagcgcgctttgatggcggactaacaagcgcaggttaccgggtcacccaagggtagccgaaccgcgcccacaaacagtaggattaagggtttccatgaccgataaagtcaagccggaaaacgaacaatgcagcggggatacggcgcccccctttgccacgcttagcaatccacttcggcgtcgtgtgccgtcttccgacagtcagtcagggcgctacgagcagacgcttgcgcgtggcatggagcttcagcaacgtccctacgaagccgcagggcagcgtggcatacagcgccagcatctgaagaatcgtatgacggtgtgggaaagagttcagtttttagctgacggcgccccgcaagtgctttaccaaaactggggaccgaatcttgatggggcctcgctcgttactgccatcattcagattgatggacgtgatgtcgccatttacggccacgattttacagtgcgtgccggttcaatggacgccaccaacggtaaaaaattagcccgtctctttgagttagcggcgaagcgaggcattccacttgtaggactcaatgactcggctggtgcttacattcctgccggagtaggtgggctcgatggctacgccgacgcatttactgcgcttaggaaggtgagcggagtggttcccagcataatgtgtatgtttggtttcaatgctgggggaggcagctatctgccgcgtcagggcagttttctgattcaacctaaggatacgttttttggcttgaccgggccgggcgttgtcaaatctgtgctcggcgaggatattacccccgaggaactgggtggaccaaatgttcatagtcaaacaggtgtcacggactttgtcgtagacgatgaggtatcggcactgcaaaaagttcgggagattttgaaatacatacctgactcaagtgctgcagcgcctcaattcaaacccaccactgatccagcagcacgttctactgttgatatcgatattcttctacgtaaggcgtttaactctccaacgggctttaacacaccggtcgacattactattttgatccaacagctttgtgatcacggtgactttcttgaagtgcaggctgagagggctcgaaatacgatcaccgcatttggacggatggcggggaacgtagttggttttgtggccaacaactctgcagtcgcctcgggacaaattgatattgatgccgcctacaaaaatgcgcggtttattcgattttgcaacctctacaacattcccgtgatgtttttagaagatacaacaggctttcttcccggccgtgagcaagagcatcggggcattgttcaggcgggacgagcgatgcttgatgcgattgtagatttgcgcaccccacgattcctggttctggttcgcaatgcctttggtggagcttacgcgtcctacaacaactacccgaccggtgcggattttgtcgttgcattaccaacgacccgcgttgccgttatgg

SEQ ID NO: 1417 - DNA, 4000 bp, Escherichia coli
  misc_feature (1)..(1): n is a, c, g, or t
  misc_feature (7)..(8): n is a, c, g, or t
  misc_feature (10)..(10): n is a, c, g, or t
  misc_feature (17)..(17): n is a, c, g, or t
  misc_feature (21)..(21): n is a, c, g, or t
  misc_feature (173)..(173): n is a, c, g, or t
  misc_feature (630)..(630): n is a, c, g, or t
  misc_feature (731)..(731): n is a, c, g, or t
  misc_feature (1376)..(1376): n is a, c, g, or t
  misc_feature (1478)..(1478): n is a, c, g, or t
  misc_feature (1528)..(1528): n is a, c, g, or t
  misc_feature (1595)..(1595): n is a, c, g, or t
  misc_feature (1604)..(1604): n is a, c, g, or t
  misc_feature (1628)..(1628): n is a, c, g, or t
  misc_feature (1631)..(1631): n is a, c, g, or t
  misc_feature (1874)..(1874): n is a, c, g, or t
  misc_feature (2645)..(2645): n is a, c, g, or t
  misc_feature (2871)..(2871): n is a, c, g, or t
  misc_feature (2997)..(2997): n is a, c, g, or t
  misc_feature (3267)..(3267): n is a, c, g, or t
  misc_feature (3411)..(3411): n is a, c, g, or t
  misc_feature (3511)..(3511): n is a, c, g, or t
nacatcnncncctattnctantcctattactaaaattgctactaaactggctgaaactaggatcatagaataccctacttgtctcaaattttgagattttttcatttacgtggaatcaataacccttgaatttaatcttttcaagtctgaatttgtcttttagatctttaacnctagactcatttttccgataaaaagaaaagaaagtactttgaaatacattcattgagcattcaaattcttcaatatgagtttcttggacctatacctattactgaatggggtcctccaatggaaaaattagtttatttgatcttatctcgaaacaaggataaatttgatataatttatgttggcgattgtcaaaaaactgatgataaatccttctttactaatcatggtaaattcaaatgctggcttgaacaatctggctctgaacaatctttgtatcttgctattttgccgctgtttgaatctagtaatgaaaaaagaatgaatgtaattcaaaagatattatctcaatacaaaccacattgtaattctgatgacatgattgaatctaaacctgattatgttgtaagagtttcagaggaacctgatataaattctgataagataatttgtgcatgntgtggttctgaaatgaatttagaaaaaactcttgaaaaatctaatctttatcgttgtactggttgtggattaagcgacactagacttaattcttaactttnttttgtacatcaaataattgtaatgttaccaaatcgattgcttttttcaaatgttgaaattcattaattgaatgcatttgtccttctactaatgctctcatgattttaactgaatttttttgatgatcatctgatgcaacaatttccatggcgtttaattttgataataaattatccaaatctttgatcatttcatctgatggtttgtgtttatccatgattcttctattgttttttcgtatatgaattattacaacaacattttgattaatacaaaatacataaaactcgtgtaatttgttaaggaatatgggattcaaaaaaggtattaacaaatgtgttgaatgtgagaaaaaactgtctgaggatccaaatgaaacaggcatgtgtagtaaatgtggttccggtgctagagttgattccgaaatacacaaagaattaagcgatttaggaataatctaaaaaaattagtatgctgagaattgttacaataaatcttcatcaatctcttctattggattgataaattggttacatgtacaagttggaattttacattttcctaattttatcataaaatcacttttttcatctggaatgtgaacttcatctgtatgatggcatcttttacaattcattttgttntccttattttacctctaaatctgtggaaccaaaactgcacgtgcctctatttttgaatcttttaatttttgtaatgcctcatttgctttctctagaggaaangtttcataaattacttcaatattattttcattacatatcttgattacttnctccatgtcttttgttgatcctatcaatgtgcctctaattgttttttcttcaaatgcactaaattcnggattttcncccactgttgcaattacgataatnccncctttctttactgattttattgcagtatctgtaacaatatctgctggagcaaatacgattgctgcatctagcaacccatgtctttcttttaatttacttaaaaattcttcttgctctttagaaaatatcattgtgtccattgcacctaatctttttgcaacatctagatgattttgtgttcttgagaatgcaatgactttgcatttttctattttggcaaattgaactgccatgtgacctacncctccaattccaaatattcctatttttttatttatttttggctctgcagctttaactgctttgtatgctgttattcctgcacaaaataatggtgctgcatattctgatttcatattatctggaacctttgtggcaaactcttctgtaactgtaatgtattctgagtatcctcctttcaatgtctctcctgtgatttttgatgattcgcaaagatactcttttccttcatcacaatattggcattttttacatgcttctaataatggagttattcctgctctatctccaattttaaatttagtgacatcttttcctatctcaactatttctccaacaacttcatgccctggaacaattggtaatgatgctggaattcctatatgtttccagtctccttcaattccatgaagttgtgaatgacaaacaccacaggcttctattttcagtaaaatttcatttggtctttcaatttgatgtttatctatattggttgatttcaaagggtttgtttcaattttggcacattctgatagtaccattgcacgcattttttccataattcaaaaaatttttcattgaattttaacatactgttttgattttatccctaaatcgtatagttaagataagatttatttttaaaatgctgtaatcaagagtatggctgatatcacacctgaagatcgtgaacgagttaaattactaactttactttcttcatccaaacatgaatttgataaattatctttagaacaattagccagattacangaattacttgaaaaaaaggattacagtcatgataaaaaggctaataaaacaaaaacaaaatttcttaaaaaaattaatgttagaatttatgaattgactgaaggtaagggaatttggtaattatttttatatctaggtacaaatattttaaaatctatgattagttatggttgaaaataacttaattcatgaaactagtccttacttgcttcaacatgcagaaaancctgttaactggtatggatggaatgatgaagcattacaaaaagctaaagatgaaaataaaccaatttttttgagtgtcggctatagtgcatgtcattggtgtcatgtgatggcacatgaatcattngaaaataatgatgttgctgaatttatgaatgaaaattttgtaaacataaaagttgacagagaagaacgccctgatatcgatgatatttatcaaaaggcttgtcaaattacaacgggccaaggtggttggcctttaagcgtttttcttactcctgatcaaaaacccttctatgttggaacttattttcctgtattggattcctatggtagacctgggtttggaagtatatgtagacaattggcacaagcatggaaagaaaaaccaaaaganattgaaaaatctgcagaaagttttattcacgcattacataaaacagaaaaaattaccgttcctacaaaattagaacaaactttacttgatgaagctgcaatgaatttatttcaattaggtgatcctacatatggtggatttggntccgctcctaaatttccaaacgctgcaaacatttcatttttgtttagatatgccaagatggctaatttaccaaaattcaatgaatttgcattaaaaactntaaacaaaatggcaaaaggtggtatctttgatcaaattggaggtggatttcatagatattcaactgatacaaaatggttagttcctcattttgaaaaaatgctttatgataatgctctcatgcctgtaaactactgtgaagcatatcaaattactaaagatccattctatcttgatgttttacaaaaaacacttgattttgttttacgtgaaatgacttcttctgaaggtggattctattctgcatatgatgcagattctgaaggtgtagagggtaaattttatgtttggactaaacaagaaattaaagaaattcttggaagtgatgctgatatattttgtctttattttgatgtaactgatggtggaaattgggagggaaatagtattctttgcaataatcttaatccttctactgttgcatttaattttggaatttcagaacaaaaagtacatgagattataaattcatgttcaacaaaattattgg

SEQ ID NO: 1418 - DNA, 4000 bp, Escherichia coli
  misc_feature (557)..(557): n is a, c, g, or t
  misc_feature (2015)..(2015): n is a, c, g, or t
  misc_feature (2048)..(2048): n is a, c, g, or t
  misc_feature (2051)..(2051): n is a, c, g, or t
  misc_feature (2054)..(2054): n is a, c, g, or t
  misc_feature (2060)..(2060): n is a, c, g, or t
  misc_feature (2129)..(2129): n is a, c, g, or t
  misc_feature (2165)..(2165): n is a, c, g, or t
  misc_feature (2279)..(2279): n is a, c, g, or t
  misc_feature (2402)..(2402): n is a, c, g, or t
  misc_feature (2417)..(2417): n is a, c, g, or t
  misc_feature (2442)..(2443): n is a, c, g, or t
  misc_feature (2536)..(2536): n is a, c, g, or t
  misc_feature (2541)..(2541): n is a, c, g, or t
  misc_feature (2676)..(2676): n is a, c, g, or t
  misc_feature (2744)..(2744): n is a, c, g, or t
  misc_feature (2750)..(2750): n is a, c, g, or t
  misc_feature (2858)..(2858): n is a, c, g, or t
  misc_feature (2891)..(2891): n is a, c, g, or t
  misc_feature (2912)..(2912): n is a, c, g, or t
  misc_feature (2960)..(2960): n is a, c, g, or t
  misc_feature (3029)..(3029): n is a, c, g, or t
  misc_feature (3118)..(3118): n is a, c, g, or t
  misc_feature (3125)..(3125): n is a, c, g, or t
  misc_feature (3143)..(3143): n is a, c, g, or t
  misc_feature (3179)..(3179): n is a, c, g, or t
  misc_feature (3206)..(3206): n is a, c, g, or t
  misc_feature (3320)..(3320): n is a, c, g, or t
  misc_feature (3338)..(3338): n is a, c, g, or t
  misc_feature (3362)..(3362): n is a, c, g, or t
  misc_feature (3575)..(3575): n is a, c, g, or t
  misc_feature (3590)..(3590): n is a, c, g, or t
  misc_feature (3692)..(3692): n is a, c, g, or t
  misc_feature (3974)..(3974): n is a, c, g, or t
gaataccgataaccatactattatacttctgtatttcacgaataattgtttctttagcacctttaatttgtatcaatttcatctgttgtttcagttgatgtttaatacgtttcttggcttttgatgcaatatgagagaaacaaaccaaacgattattcttagaaactagctttaaagtaatcccaaggaattcactgcttttctttctcagattggtaatttgagatttttcctctgaaatagggaggttaagtcgttcttttaaccacaattttacagccttaaacgttcgctctgcctcattcctatttcgacaaaagattttaaaatcatccgcatatcggacaatataaacttcttttagcgtcgttgaagttcgcagctttctgtaaacatgtgacttgtgtcttgttcccttggaattatattgaggaactaattccttacaatctctttcttcccattgtcgtcctatccaccaatcaaattcattgagattgatattggcaagtagtggagataagatacctccttgtggtgtgcccttagttggatangtcacttttccattcggaagaacaattggtgcttttaacatttttcgaataatcactagaagttgtttgtccctgatacctaatgtccagatttgacgcattaacttagtatgattcacttcatcaaaaaagcctttaatatcaacgtcaacgacataagtcatatgacttttattcatacgatacatacagtccataatagcgttatcagccgaccttaagggtctaaatccataactgtgtttgtaaaatttcgcttcacagattggatccaacacttgtaaaatacactgttgggccactctgtcccacatcgagggaatgccaagtggtcgtttcttcccatttggcttaggaatctctactcttctgacttttctgggtctataatattgaaatcttctttgaactttagagataaagtcttcttgggtcagattttctaaatctttaatggtaacaccatctactccttcggtttgactaccaccattccgctttatggtacgataagcgagcagtatattctcgggagatatgataatgttcattaagttcttaaaactgaatcccttttgacttttggaatataaatcatcaaatatctcggtcatgccatagtattccgcataccttagtttttgatgttttaatagtttgtcatcattttttggtttcgtcatggtctatcactcctctctttggattcgtgaccttttatgtcttacaagaatccatgaaatgataaagttcataacaatacactattgactagtggctgttcctccagtatcattacaacactttcaaaggtcgtgccaccactctcactagagattaaggaaagttatgattttctttccaatgtttctctggttgtgcaacctccacatctctagctttcgacgttcccttatctttatcaatactaaacttaggtgcctagctataccccttcaactttgatatgcctgtaacataacaaggaatttcatatcgtcgattcttactcttcctcaagttgaaacaacttacgttgttatacgcatttctacgtactcgccttcggagcgtacattcgctggttcgtcagtgctcatgcacattctcaccctatttagtttttaatgactcccgacctatcagatacatattccacctctggaacactttcgattcttaagtccttaagaatgacggtatctttcagccgacttcaccgagcttcaaacctttacctttgcacaagataaacgcatgtcggagtattagagaaatcgtttcagggcgttaccccttcattccaattttcaagataagagttctccattctattcaaatttaacctgattatcaggttgatttttcaagaacgtgtctaaccttttcagttagaaacgtctcgcacctacaaaagccacatgaccatagtctgctggtgtgccatgtgtacctccnacaaaagaaacaatagcacctgctcttggtgtnganccngtttcnccaccaagacttgaagctgtcgcaacccagtcctgaccatttcccatggtattaatgattgaaatcttntctccatttctaccttttaattttaagcctaactgnttcatacgagccgcaacaccccatgtacattgtccataggcataggccataccatctccaccaccaggaacagaatgatcatacaagtccccacgaaccccttcaagggattgngggtcactttttgcctgtcctccatttgtttggctaaagcctttttcaatttggtaataccattccgttgctctggtttgtctttccagtagtttgtcaccagaatttccctcccaataggtnaggaagagttgggcnagattggctgcactgcccgtatttnnaaagaaatcctttaaccaactttgatagtaaggactatccccatgaagcataaaatcaagttggaggtctaaatcataccacttcttattttnggtgngtgcataattcaataaagctgtatgacgtgttgaaccatctgcagtatccgtccattgccctaaacccaaacctctatgaagaatattaggataagcaccactataaatggctggacctccaatcgctaaccagntttcatcatcccatgaggaatcggtagcgccaactggaggagataaataatctccttcagctcgtttnggattnatagaagactctaccgaccaatttcctaaaatagccgcaatggcttggggacttgccccttgagatttcaaaaactcataaatatgttttgctcgttcaaactcatcnccaccaaactgaccaatggcaggtaagatagtngtctgaagttgaatgactttnggaaaataaaattgcggattgacatacaccaatttttctttcttgttnttatacttttgataggaaactttcaaacctgtatcgtctggtgtttcaccaataatatcacccgttagnactcttgtcccctcaatcgcacggccattatgaatagaatacaaggtcaatcgactctcattctctccttttccgttagtgagaataanattgtcnccatctagagatacaacnccatccattggtgcgacaatcgtttggtgagccttngcttctagtagaatgtactcctgaagngtaggttttccgtctaaatcatagtatccataacgataagtcatggttagactatcttcgttgcttttcccctcaaatggattgtccaattcctgcatggaagcatacacaccntcttcttttagttccttnatttcctcttgatcgtctttcganagtttatacttaggagtttcatagaggtcttgcatggatttcaaatcttccccatcgtttaaatcatgccacaaagtagacagataatccttgtaagtttctgaactaaataagtgaactggtttgtgtaactcatagtcatggaatttaaagttcatataccccatcacatcatcaacttttgtgtaataggtaattcctttgtcatttgtncgagtatgttctgcntcttcccaagttaggtgggtataagcttttgttaattcaaattcatcttgttgaatcaaactagcagatgaaaatcctaaaaagaagctcatcataagtaanagaagaaagactattcctccaactatccaggttacaggatttccagccgcaaatgtaaagaaggaaaaggctgcttttagtttttgatagatatttcggacacttgtaagaccttgtttctttaattttcgaaaccgatttttaaaggaacttgggttatctttcgctagtttccatccttttccatccttaaaatgatggtatcgctcttttgtgttggtcagtcttttcttggtaaaacgacctgttgcttgtcctgttttgacactagcttttccaagnttataagaaagccgactgtagcgttt

SEQ ID NO: 1419 - DNA, 4000 bp, Escherichia coli
  misc_feature (253)..(253): n is a, c, g, or t
  misc_feature (1937)..(1937): n is a, c, g, or t
  misc_feature (1948)..(1948): n is a, c, g, or t
  misc_feature (1951)..(1951): n is a, c, g, or t
  misc_feature (2165)..(2165): n is a, c, g, or t
gagcacggcaaacttgccgctgtgattttcccaaccgtgcatcatgcccccaccgccgcgtccgctgcgtccagaaccagagtcgtacataccgggagtgaagaattcggcgcacgtggcgaagccagcggctgcgtttccagtgttcttcgcacctttgatcatgtcgtagatgagtttcgggtgattgcacagctttttcaacgcggtgattgcgggaagcacggcggttgctttgccagtcagcgcttgngtcgcagccttggagctcaaaaagtgttcgtacagcgcctgttgcagcggcgagagcttacagcacacaacctcgacaactttgggcggcaagtgtttactcaaaatggtattcgtccggcgaaggataaacttgttgacgagatctgagagttccgtgttcgccgcctgcgccttttccatctctgcttcggtgcagtctggctcacgtccggctaagattggacgttcgtactttttcgcaaattccgccggcgttcccaagagccccgggttacagaaaccaaccatggagtaaaattcatccaaatgattttgcatcggcgtaccgctcaacatgacgcgacgaaggcacggcaccgaacacaacgccttgtttgtcaacgtctcgccattcttcaaacgatgcgcttcatcgcacatgatgagatccaccgccccgtcaaagttgaaacgactcgagtgaattcgaaacgtctcgtaactcacaatcattacctgcgcgaggtgtcgaggcgccaagaaggatttcaccgaactcaccacctctgcacgcgtggaatcgcaaattggaagcgttttcacgcgaccattcagccacttgttgcactcgtcgtcccagttggacacgagcgaagtcgggcacacgatgagcgcccgtttcacggcgggagaaccgtcgagtccttgccgcaacagcgtccacaagagcgtgatgccctgaagtgtcttacccagacccatgtcatccgccaagatgcaccccgtgccttcgaaatcgcgaagacccatgacgcactcaaacataaacttgacgccttcgcgttggtgcggtcgcaaccagcgcgtgagcattctatccacgacaacgggcttggcattcggacgcggttcctcaccgctcgtccccgcctcgccctccggcgcgcgatcaccaggggtccacaacacgagatcttccacgccctccggaagctcgatgtgttccgattccatcgacgtcaacgccttgggtttcggcatagccgcggcgacgtcgctcgccttggctccccacggcacaaagacgcgtctgctcgccaatctgcgcatcaactcggctgagggaagaaaggcacgcgcacaacacaaaaaaatcgtcagtcagccagccaacgcaggcgctctcatcgctgcgcgttcgccttctcgcgttcgacacacgctcgcgttcgcgcgcgcgcggtgccgacttttgaaaacacgcgcagacagcccgttaacgcgcgcgcgtccgaattcaacccacgtaccactccgattcggcgcgttcggaaacggcgacttgaacgcccgtcgcaaaaccaccgccgggtcttccaccgtcaacccgcggacgtacggtttcacgctcgtctccagcgttccgctcaacaacgccgcgacgttcgcagccttgacatccttttgcgacatgacgacggcatcgtcgtcttcatcttcctctgcttcgtactcggattcctcctcctcctcctcctcctcctcctcggattccgtctccatggtttcctcgtcggcgtcttccgcgtcgtcctccgacatcgtccgcgtcgtccgtcgcgcgcgacgccgtgtcgcgtcgacgacggcgagtcgaacgttcgttcggggtgggctttgtcgtgtaccccactatcattgangattcataacnctnaatgatcacatacgacgagtcatgacccgtaaaaccaaactaggggtacacgacgcacgacctctagggcaagacgcgcgtcgctcgagacgacggcagtatccggaccgggaacgcggcgcgccattccctcggtggggttttcgaggagaggacgacggcgacgatgttgcggagagcgctcatgacgcagctgcgccggagcgcggcgaangcgccgcggtggatgtccgcgacgacgaccaaggagacgactgggatcgtcggtttgtcagtgctggaggatgggaagggtgcgtacgcagccatctgtaaacgcgtgctgagcgagattcaacgcgggattcccgcggatgcggggtacaggcaggtggtggaggcggtgtacgccgatcggttggcgaagacggaggcaggggcgagcgtgagcgagatcgaggcggcgatcgggcagggacaaatcgaagagttgtacgagattgccgaggatgagttggagctgattccgaagatgcgggagtggaaaccgtgggagtttgatcacgagattgaaatcatcgaggcgccaaaggaaaacccgtacttggaggaggcgagaaaggagtagactggttggttgacgtctgcgcgcggaatttttcctttccgcgcgcgaagtatacacctcgaatcgcgcgcgcgcatcgacgaggaaattgtaacatacactaaagtatcaaaaacagtcttcttctcgtttttgtctttttttttccgtcttcctcgtcgtttctcctcatcgcgcatcgcgttttgaaatcgagttggatttgacctgtacgtccacgatgcgccgcgcgggtgtgtcggttcagagttgactcgaacaaccccacttttcgcgcgcgtgagaaatgtccgacgccccgtcatcggcgccgacgacgacgcggatcaagacgtaccttcgactgcgaccgtcttcgagaccttcgagcgatcgcgcgagcatacgcgcgctggatgacgcgacgagtttggagggcgaagactcggaagatgaaacgttgtcctcgtccaagcgtcggcgaatcgtcgagtgtaaggcggcgctggatcgaaggacgggcgcggcgcagacggtcgagcaaaagtttgcgttcgacggtgtctttgacgagagtgcgactcagaacgcggtgtttgacgaggttggaagcgacgtggtgcgcgcggcgttggacggttacaacgcgactctgttcgcgtacgggcagacgggaagcgggaagacgtacactctgactggcggggtagccgagtacgaggatcgaggcattgttccaagagcgctttcgatgattttcaacgagattgaatcgatgagcgctcaggacggcgtcaaatttacagtcgaggtgaactacgtcgagatttacttggagcaggcgtacgatttgctcgccacaaacttggacgaaagacagagcgccgcgagagggtacgcaagagcgtctgaaattccgttaccgaaagtgcgtttcatggaggatgaaaatgggcagatgcataccatggatttgacgacgcgcgtcgtgtctagcgaaggcgaagcacttgatttactctttgtcggcgataccaatcgagcagtagcggaaaccccgctgaacatggcgtcgagtcggtcgcactgcgtgtttacagtgataatcacgcgtcgctcgagagatactgacacgctgaggcgtgcgaaactccatctcgtcgatttggcgggaagcgaacgagtgaacaagagtcgagtcaacggaacgacgcttcaagaggccaagtacattaacgtttctctgcattttctcgagcaagtcatcgtcgcgctgcaggaacgcgcagagggcaacgtgaatattcacgtcccgtatcgaaacagcttgatgacattgatgcttcgggatagtttaggaggtaactgtcgcaccgtcatgattgccactgcaagcgcggagatggacgcattcgccgagagcgtaagcacgtgccgattcgcgcagagagtgcgcaaaattt

SEQ ID NO: 1420 - DNA, 4000 bp, Escherichia coli
  misc_feature (143)..(143): n is a, c, g, or t
  misc_feature (254)..(254): n is a, c, g, or t
  misc_feature (538)..(538): n is a, c, g, or t
  misc_feature (543)..(543): n is a, c, g, or t
  misc_feature (737)..(737): n is a, c, g, or t
  misc_feature (762)..(762): n is a, c, g, or t
  misc_feature (979)..(979): n is a, c, g, or t
  misc_feature (1001)..(1001): n is a, c, g, or t
  misc_feature (3229)..(3229): n is a, c, g, or t
  misc_feature (3469)..(3469): n is a, c, g, or t
  misc_feature (3560)..(3560): n is a, c, g, or t
accagagcggttttgatcatcttgatagacgcctgttattaacccttatggaaaaatttgacggaggcccagttggtgtggatagcttggcggccgcattgagtgaggaaagaggtaccattgaggatgtgctggagccttanctaatccagcagggctatttaatgagaacctctcgaggacgcatggcgacgcgcatggcatatgagcattttggtttgaagagccccaaacgtattcaacagcagatgganatcatggatgactgaattttgttggccgatgcgtgtctatattgaagatacggatgcgggtgggatcgtctactatgccaattatttaaaatttatggagcgtgctcggacggagttaatgcgaaccctaggttacgggaaaccagctctgtttgacggtttacagttagtggtccacgaactgaatattaaatatcatagtcctgcgctacttgatgatgagcttaaagtgtcagcggaattgacaaagataggtagggtaacatttttgatgagccaaaccnttcancgaggtgacagcttactggttgagggtgaggtaaaagtggcctgtttagatgccttaaccaaaaaaccagcggcaatgccggcgccaatgtatcaaaaactaaagggccttttgggctgaaactggagtttagagcagtgaatgaagaaaatttatcgattttagcgttaattttaaatgctggtgttctggtncaggcggtgatggggattttgcttntcgcgtcagtcatgtcttggataatgattgttcagcggggtatttttcttaatcatgcgcagactagtttccgagagtttgaggatacattttggtcgggagtggatctggcgcagttctatcaggagctaacggataaggccaaagagtcgggtgtcagtaatggtattgaaaatgtgtttagagcaggttttagagagtttaaccgcttaacgcngtctgacaaagccgatccagangctgtaatggagggtgctgatcgagcaatgcgagtggcgctatcccgcgaggatgaaaagttgggtactaatcttccgtttcttgcgaatgtggcatcagtgagtccttatattggcctgtttggcactgtatggggaattatggtcacggtaagaggcttgggtatgatgcagcaggcaaccttagcggcggtggctccggggatttccgaggcgctgataccgacagcaatggggctctttgcagccattcctgcggttatcgcttacaaccgttatgcggctaaagttgaggcaattaatgcaagctatgaaactttctcggacgagttctctagtatcctgcacaggcaggtttactctcgataatttagctcctggagttggatagattgaataggaaaaaacaaaaacgcaaattggtagccgaaattaatgtggttccctacattgatgtgactctagtgttgatggtgatattcatgatcaccgctcctttgttgatgcaaggcgttaaagttgaattgcctcaagctaactcaagccccatggatagcgacgatcaagaaccctttattgtttcaatcaaaagtgatggtacatactggattgatgacaaggggattaaccaatctaggccgcttaatttaatcaaagatagagttagcaagattattcgtcaagaacctaaaacacctattttggtttggggggacgcctcagtggattatggcgtggttgtgaatcttatgagtgagttgcaacgttccggagctacatccgtaggtttggtgactgagccgccgcctcagtagcatgaaagtttctattagctacgcattaggtattacgtttagcttgaccatacatgggctaattattgctgctatgtatggagggtggaaagctgaaccagagagggtagtaattcagccgcgatttatagatgcgaaactggttgaactagcccctaagcaaaaggtaattaagaagaagaaaaacaccgacgcaaacgctgcccagagaaaacgagatagtcaacgaagacgagcggctgagaagaaaaaagcggatgcccttaagagtaggcaacggcaagcagagcttgatagaaaagaaaaagagcgtctggcaaaagaacgagaagaacaaagagaacgagcagagagggagcgactagctgagttgcaaagacagcaaaaggagcaagaatttgctgacgctattgctgaagagcagaggttagtaaatgccgagaaagatgagcgcgaggcaaatagttatcgacagctcattcagcaacgactttccgaaaattggaatcgccctccgagtgcgcgaagaggtatggaaacaatgattcgattgcaactagtgcctacgggtcgcgtggtaggtgtcacagttcttaagtctagtggggattcagcatttgaccgatccgtcgaacaggccgcattcaaagcggatcaatttatagagttacaaaagatgtcgccaagtttgtttgaaaagaagtttcgccaagtagatgttttatttagccctcaagaccttaggttgtaatcaatggagatccgatgctacaaaaaagtatatttttaaatcgctctgtcaaaatatttttactgtcgagtatattggccattgctcctgccatagcctggggagagctagtgattagagtcactcaaggtaacgataaacccacgattgtagctattcctccaatggttatggcgggcgcacagctctctgaggatattagctcaattgttgagtcagaccttgagcgaagcggcttgtttaaggttgttccaagaaataacatgctctctttcccatctgatgctgatgatgtttatttccgagattggcgattgctggggagtgagtatctgcttgttggtgctgtcacaaaggatgatgatctaattgaattgagttttagcctacttaacgtcaatgcccaaaatactgtgtttaagcatagtgttaggggcacagaaaatcagttaagagatttagcccatatggctagtgataaggtatatgaggagataacaggcattcgaggggcgtttagtactcgccttgcgtacgtaacagctgatcaggtaaatggtaatttcgtctataaattaaatgtctcagactcagatggcgctagagagagattaatgctggaatcatcagagccaattatgtctccagcgtgggcaccctcnggcgatgagttagcctatgtttcttttgagacagggcggcccgcaatatggcgtcagagtcttgtaaccgctgctcgcaaacagttgactaactttcgtggccttaacggggcccccgcttggtcgccagacggtaaaaagctggctatggttttgtcaaaagatggcaatcctgagatttatatcttggatctgacgtctaataaactgtcgagattgactcgtcatttcgccattganactgagccaacgtgggaaccagatggaaaaagtttgttatttacctcagatagagggggaactccgcaaatttataaattaacggttgcanctaaggcagtgcaaagaataacattcagaggtaattacaacgctaggcccagtttggcgccagacggtcgcaccttagtggttgttcatcgagaatcgggtgttttccatatagcgactctcgatttaaagacacggcggatggtagaattaacagagactagacttgatgagtctcccacagtggctcccaacggagctatgttgatatacgctacgaaacagggtgacaggggagtgttgtcagcggtttctctcgatgcgggcataaagtattccctgccggccaagtctggtgacgtaagagaacctgcttggtcaccatttttgaggtagaattaggatacgcaatttaacgaacaacacattttaaaaggagctctacatgaatatttctctaactaaacttggtttaccggcactttgtctgtcggtattgct

SEQ ID NO: 1421 - DNA, 4000 bp, Escherichia coli
  misc_feature (1)..(2): n is a, c, g, or t
  misc_feature (4)..(6): n is a, c, g, or t
  misc_feature (10)..(11): n is a, c, g, or t
  misc_feature (14)..(21): n is a, c, g, or t
  misc_feature (23)..(24): n is a, c, g, or t
  misc_feature (26)..(30): n is a, c, g, or t
  misc_feature (32)..(32): n is a, c, g, or t
  misc_feature (34)..(39): n is a, c, g, or t
  misc_feature (41)..(50): n is a, c, g, or t
  misc_feature (53)..(53): n is a, c, g, or t
  misc_feature (56)..(71): n is a, c, g, or t
  misc_feature (73)..(74): n is a, c, g, or t
  misc_feature (76)..(76): n is a, c, g, or t
  misc_feature (79)..(83): n is a, c, g, or t
  misc_feature (85)..(88): n is a, c, g, or t
  misc_feature (90)..(91): n is a, c, g, or t
  misc_feature (93)..(99): n is a, c, g, or t
  misc_feature (101)..(102): n is a, c, g, or t
  misc_feature (104)..(121): n is a, c, g, or t
  misc_feature (124)..(128): n is a, c, g, or t
  misc_feature (130)..(132): n is a, c, g, or t
  misc_feature (134)..(134): n is a, c, g, or t
  misc_feature (136)..(139): n is a, c, g, or t
  misc_feature (141)..(150): n is a, c, g, or t
  misc_feature (152)..(152): n is a, c, g, or t
  misc_feature (155)..(161): n is a, c, g, or t
  misc_feature (163)..(166): n is a, c, g, or t
  misc_feature (168)..(179): n is a, c, g, or t
  misc_feature (181)..(185): n is a, c, g, or t
  misc_feature (188)..(196): n is a, c, g, or t
  misc_feature (199)..(199): n is a, c, g, or t
  misc_feature (201)..(203): n is a, c, g, or t
  misc_feature (207)..(209): n is a, c, g, or t
  misc_feature (213)..(220): n is a, c, g, or t
  misc_feature (222)..(222): n is a, c, g, or t
  misc_feature (225)..(229): n is a, c, g, or t
  misc_feature (231)..(232): n is a, c, g, or t
  misc_feature (234)..(234): n is a, c, g, or t
  misc_feature (236)..(238): n is a, c, g, or t
  misc_feature (241)..(246): n is a, c, g, or t
  misc_feature (250)..(251): n is a, c, g, or t
  misc_feature (253)..(256): n is a, c, g, or t
  misc_feature (259)..(259): n is a, c, g, or t
  misc_feature (261)..(263): n is a, c, g, or t
  misc_feature (266)..(272): n is a, c, g, or t
  misc_feature (276)..(279): n is a, c, g, or t
  misc_feature (281)..(284): n is a, c, g, or t
  misc_feature (287)..(292): n is a, c, g, or t
  misc_feature (295)..(295): n is a, c, g, or t
  misc_feature (299)..(301): n is a, c, g, or t
  misc_feature (304)..(305): n is a, c, g, or t
  misc_feature (307)..(310): n is a, c, g, or t
  misc_feature (312)..(314): n is a, c, g, or t
  misc_feature (317)..(317): n is a, c, g, or t
  misc_feature (320)..(321): n is a, c, g, or t
  misc_feature (324)..(324): n is a, c, g, or t
  misc_feature (326)..(334): n is a, c, g, or t
  misc_feature (336)..(336): n is a, c, g, or t
  misc_feature (338)..(340): n is a, c, g, or t
  misc_feature (343)..(343): n is a, c, g, or t
  misc_feature (345)..(356): n is a, c, g, or t
  misc_feature (360)..(367): n is a, c, g, or t
  misc_feature (370)..(370): n is a, c, g, or t
  misc_feature (373)..(373): n is a, c, g, or t
  misc_feature (377)..(377): n is a, c, g, or t
  misc_feature (379)..(388): n is a, c, g, or t
  misc_feature (391)..(395): n is a, c, g, or t
  misc_feature (397)..(398): n is a, c, g, or t
  misc_feature (400)..(406): n is a, c, g, or t
  misc_feature (410)..(410): n is a, c, g, or t
  misc_feature (412)..(412): n is a, c, g, or t
  misc_feature (415)..(415): n is a, c, g, or t
  misc_feature (418)..(428): n is a, c, g, or t
  misc_feature (431)..(440): n is a, c, g, or t
  misc_feature (443)..(448): n is a, c, g, or t
  misc_feature (451)..(453): n is a, c, g, or t
  misc_feature (455)..(459): n is a, c, g, or t
  misc_feature (463)..(463): n is a, c, g, or t
  misc_feature (466)..(467): n is a, c, g, or t
  misc_feature (469)..(474): n is a, c, g, or t
  misc_feature (476)..(485): n is a, c, g, or t
  misc_feature (488)..(490): n is a, c, g, or t
  misc_feature (492)..(492): n is a, c, g, or t
  misc_feature (494)..(495): n is a, c, g, or t
  misc_feature (498)..(500): n is a, c, g, or t
  misc_feature (502)..(505): n is a, c, g, or t
  misc_feature (508)..(517): n is a, c, g, or t
  misc_feature (520)..(521): n is a, c, g, or t
  misc_feature (524)..(524): n is a, c, g, or t
  misc_feature (526)..(527): n is a, c, g, or t
  misc_feature (529)..(533): n is a, c, g, or t
  misc_feature (535)..(538): n is a, c, g, or t
  misc_feature (543)..(543): n is a, c, g, or t
  misc_feature (545)..(547): n is a, c, g, or t
  misc_feature (551)..(564): n is a, c, g, or t
  misc_feature (566)..(566): n is a, c, g, or t
  misc_feature (568)..(568): n is a, c, g, or t
  misc_feature (570)..(577): n is a, c, g, or t
  misc_feature (581)..(592): n is a, c, g, or t
  misc_feature (594)..(595): n is a, c, g, or t
  misc_feature (598)..(598): n is a, c, g, or t
  misc_feature (601)..(601): n is a, c, g, or t
  misc_feature (607)..(609): n is a, c, g, or t
  misc_feature (611)..(616): n is a, c, g, or t
  misc_feature (618)..(623): n is a, c, g, or t
  misc_feature (625)..(626): n is a, c, g, or t
  misc_feature (629)..(632): n is a, c, g, or t
  misc_feature (634)..(634): n is a, c, g, or t
  misc_feature (638)..(640): n is a, c, g, or t
  misc_feature (642)..(642): n is a, c, g, or t
  misc_feature (645)..(647): n is a, c, g, or t
  misc_feature (649)..(650): n is a, c, g, or t
  misc_feature (652)..(654): n is a, c, g, or t
  misc_feature (656)..(657): n is a, c, g, or t
  misc_feature (659)..(668): n is a, c, g, or t
  misc_feature (671)..(681): n is a, c, g, or t
  misc_feature (683)..(683): n is a, c, g, or t
  misc_feature (688)..(688): n is a, c, g, or t
  misc_feature (690)..(690): n is a, c, g, or t
  misc_feature (692)..(693): n is a, c, g, or t
  misc_feature (697)..(698): n is a, c, g, or t
  misc_feature (700)..(702): n is a, c, g, or t
  misc_feature (705)..(722): n is a, c, g, or t
  misc_feature (726)..(726): n is a, c, g, or t
  misc_feature (728)..(730): n is a, c, g, or t
  misc_feature (733)..(739): n is a, c, g, or t
  misc_feature (741)..(749): n is a, c, g, or t
  misc_feature (754)..(763): n is a, c, g, or t
  misc_feature (766)..(766): n is a, c, g, or t
  misc_feature (768)..(770): n is a, c, g, or t
  misc_feature (775)..(781): n is a, c, g, or t
  misc_feature (783)..(784): n is a, c, g, or t
  misc_feature (788)..(797): n is a, c, g, or t
  misc_feature (800)..(802): n is a, c, g, or t
  misc_feature (804)..(812): n is a, c, g, or t
  misc_feature (814)..(818): n is a, c, g, or t
  misc_feature (821)..(823): n is a, c, g, or t
  misc_feature (826)..(831): n is a, c, g, or t
  misc_feature (833)..(839): n is a, c, g, or t
  misc_feature (841)..(841): n is a, c, g, or t
  misc_feature (843)..(843): n is a, c, g, or t
  misc_feature (845)..(845): n is a, c, g, or t
  misc_feature (847)..(848): n is a, c, g, or t
  misc_feature (850)..(852): n is a, c, g, or t
  misc_feature (854)..(855): n is a, c, g, or t
  misc_feature (857)..(862): n is a, c, g, or t
  misc_feature (864)..(864): n is a, c, g, or t
  misc_feature (866)..(871): n is a, c, g, or t
  misc_feature (873)..(880): n is a, c, g, or t
  misc_feature (883)..(888): n is a, c, g, or t
  misc_feature (890)..(894): n is a, c, g, or t
  misc_feature (896)..(896): n is a, c, g, or t
  misc_feature (898)..(903): n is a, c, g, or t
  misc_feature (905)..(909): n is a, c, g, or t
  misc_feature (912)..(912): n is a, c, g, or t
  misc_feature (916)..(921): n is a, c, g, or t
  misc_feature (923)..(923): n is a, c, g, or t
  misc_feature (925)..(929): n is a, c, g, or t
  misc_feature (932)..(934): n is a, c, g, or t
  misc_feature (936)..(936): n is a, c, g, or t
  misc_feature (939)..(942): n is a, c, g, or t
  misc_feature (944)..(956): n is a, c, g, or t
  misc_feature (958)..(958): n is a, c, g, or t
  misc_feature (960)..(961): n is a, c, g, or t
  misc_feature (963)..(964): n is a, c, g, or t
  misc_feature (966)..(970): n is a, c, g, or t
  misc_feature (973)..(974): n is a, c, g, or t
  misc_feature (976)..(981): n is a, c, g, or t
  misc_feature (983)..(985): n is a, c, g, or t
  misc_feature (987)..(987): n is a, c, g, or t
  misc_feature (989)..(989): n is a, c, g, or t
  misc_feature (992)..(992): n is a, c, g, or t
  misc_feature (996)..(998): n is a, c, g, or t
  misc_feature (1000)..(1007): n is a, c, g, or t
  misc_feature (1010)..(1015): n is a, c, g, or t
  misc_feature (1018)..(1018): n is a, c, g, or t
  misc_feature (1021)..(1025): n is a, c, g, or t
  misc_feature (1027)..(1030): n is a, c, g, or t
  misc_feature (1033)..(1034): n is a, c, g, or t
  misc_feature (1036)..(1037): n is a, c, g, or t
  misc_feature (1039)..(1049): n is a, c, g, or t
  misc_feature (1053)..(1056): n is a, c, g, or t
  misc_feature (1059)..(1065): n is a, c, g, or t
  misc_feature (1067)..(1069): n is a, c, g, or t
  misc_feature (1071)..(1075): n is a, c, g, or t
  misc_feature (1077)..(1082): n is a, c, g, or t
  misc_feature (1085)..(1086): n is a, c, g, or t
  misc_feature (1088)..(1091): n is a, c, g, or t
  misc_feature (1093)..(1099): n is a, c, g, or t
  misc_feature (1328)..(1328): n is a, c, g, or t
  misc_feature (1538)..(1538): n is a, c, g, or t
  misc_feature (1953)..(1953): n is a, c, g, or t
  misc_feature (1980)..(1980): n is a, c, g, or t
  misc_feature (1992)..(1992): n is a, c, g, or t
  misc_feature (1998)..(1998): n is a, c, g, or t
  misc_feature (2013)..(2013): n is a, c, g, or t
  misc_feature (2124)..(2124): n is a, c, g, or t
  misc_feature (2151)..(2151): n is a, c, g, or t
  misc_feature (2265)..(2265): n is a, c, g, or t
  misc_feature (2559)..(2559): n is a, c, g, or t
  misc_feature (2562)..(2562): n is a, c, g, or t
  misc_feature (2835)..(2835): n is a, c, g, or t
  misc_feature (2922)..(2922): n is a, c, g, or t
  misc_feature (3042)..(3042): n is a, c, g, or t
  misc_feature (3069)..(3069): n is a, c, g, or t
  misc_feature (3231)..(3231): n is a, c, g, or t
  misc_feature (3303)..(3303): n is a, c, g, or t
  misc_feature (3309)..(3309): n is a, c, g, or t
  misc_feature (3315)..(3315): n is a, c, g, or t
  misc_feature (3333)..(3333): n is a, c, g, or t
  misc_feature (3528)..(3528): n is a, c, g, or t
  misc_feature (3660)..(3660): n is a, c, g, or t
  misc_feature (3678)..(3678): n is a, c, g, or t
  misc_feature (3777)..(3777): n is a, c, g, or t
  misc_feature (3859)..(3859): n is a, c, g, or t
  misc_feature (3867)..(3867): n is a, c, g, or t
nnannnaaannaannnnnnnntnnannnnntncnnnnnntnnnnnnnnnnaanttnnnnnnnnnnnnnnnntnncnaannnnntnnnntnnannnnnnntnnannnnnnnnnnnnnnnnnnaannnnngnnntnannnnannnnnnnnnnanttnnnnnnncnnnntnnnnnnnnnnnncnnnnnttnnnnnnnnnctnannntttnnntttnnnnnnnncnttnnnnntnnangnnnaannnnnnaaannannnnaantnnnttnnnnnnnaaannnnannnnaannnnnnaantttnnnaannannnncnnnaanttnnccntnnnnnnnnncntnnnaangnnnnnnnnnnnntttnnnnnnnnttnaantttngnnnnnnnnnnttnnnnncnngnnnnnnnaaangnaanttnnnnnnnnnnnttnnnnnnnnnnaannnnnnaannnannnnnaaanttnntnnnnnnannnnnnnnnnaannngnannttnnngnnnnttnnnnnnnnnnttnnttnanngnnnnngnnnnaaagntnnnaaannnnnnnnnnnnnnangntnnnnnnnnaaannnnnnnnnnnntnnaanttnaaaaannncnnnnnncnnnnnncnnttnnnnantttnnncnttnnnannannntnnannnnnnnnnnaannnnnnnnnnntnaaaangntnnaaanngnnnttnnnnnnnnnnnnnnnnnntttngnnnaannnnnnncnnnnnnnnnaaaannnnnnnnnncangnnnaaaannnnnnnannaaannnnnnnnnnttnnnannnnnnnnngnnnnnaannnccnnnnnnannnnnnntnantngnngnnngnnannnnnncntnnnnnnannnnnnnnaannnnnngnnnnntngnnnnnntnnnnnaangaannnnnngnannnnnggnnnanttnnnnannnnnnnnnnnnncnannannannnnnaanngnnnnnncnnnancnaanaaannngnnnnnnnnttnnnnnnaanttnnnnncnnnnggnngnntnnnnnnnnnnntttnnnnaannnnnnncnnntnnnnnannnnnnaannannnngnnnnnnnaatggcaagcgttaaatttaaagatcaactagatgcagctaacaagctcatcgagatcttgccaaaaaaagagctaaatgacgctaagacgatagttctttgcatgtcgcttgagtcagttatcctgactgatgtggtttgcagggggctaaatttaagctatgagatgctctttagcgagccaatccctgcgccaaacaacagcgaatgcgacgtagcgatagttagngaaactgaggatatcgtgctaaacgatcctctcataaaagcttttaacataagctatgactacatctacggcgaagcgcatagaaaatatgaagagaaaattttaaaaaatgtctataaatacagaaaaggaaatttgataggagagctaaagggcaagaatattttactgatcgatgaggggtgtgagactggcatgacggcactcatntgcataaagacgctgcttgatgtgaaggtaaaatccatctcatacgcaacgccgatgatagccactgatgtctttgcaaatttaaatgatatggtcgatgaaatttacacgataaacaagatcgttgattttatcgatgtggattcgtattacgagaaaaagatcgaggctacgagcgagcgcatcatgtcgatattagaagagagccctcactatttaccgttacaaaaacaacaaggagataaaaataatgcaatatagtatagaagtcaataatcaggtcgaaatttttgaccttaataaagtagctaaacaagctagtggggcagtgcttttaagggtgaaaaacaccgtagttttagcaactgtggcaagagaagatgtgcaagttgaagaggactttttgcctctaacngtgcaatacatcgaaaaagcttacgcngctggtaaaatnccaggnggttacgtcaagcgngagaccaagccaggcgactttgagacgctaacagctcgcatcatagatagatcacttcgcccactttttccaaaaggctacgcatacccaacacagatcgttgtcatggtnctttcagctgatcctgaggttgatttncaagttgtgagcctaaatgcggcttcagttgcactttaccttagcgacatccctgtaaatcgcccagtttgtggtgtaagagttggctatatagatgataaatttgttatcaanccaagcaactctgagctaaaacaaagcgcgatcgatctttatgttgctggcacaaaagatgagcttttgatgatcgagatgagaagcttgcctcagcaaactacgcagctcataccgatggtagcgatcgagccgatgatagatcctagcctaagcgatagcatggcgcaaaagcaagtgatgaatgaatttagtgaagataagatggttgaggcgatcgactttgctggcaaggctatactaagagctagcagcgcttatgaagaggcgtttaaagagcataaaaaagaggangcngcacttgagctaaaaccagagatagaaaacgaaaatatcgctatttacatcgataaattttataaagcagaggttaaaaacgcgatcaatcaaatggcaaagagcgagcgtgcaagcgagcttggcaagatcgctaaacaaatttcaagcgatgaggtagctcaaaaagagggctgggacgaggctgtcatctcaaatgtccttggtaaatataaaaagaaaatagtaagagagcagatcataaacgagggcgttagagccgacggacgcggncttgaagaggttagacctattagcatcgagacaaatgtccttccaaatgctcacggctcatgcctctttacaagaggtcaaactcangcgctagttgtcgccactcttggcacagatagcgatgctcagatgtatgacatcctaactgaaaaagctcctttggttgagaaatttatgtttaactacaacttcccaggctttagcgtnggcgaagcaagcccacttaaagctccnggcagacgtgagcttggacatggaaatttagccaaacgtgcccttgcaccaagcatcgatctagcttctccatatacgataagggtcgtttcagaaattttagagagcaacggctcaagctctatggctagcgtttgcggtggttcgctcgcacttagagcngctggggtcaatacccaaaaactagtcgctggtgttgcgatgggtcttatatttgaaggcgataaacacgcngttttnactganatcatgggtcttgaagancacgacggcgatatggactttaaagttgctggcacaagtgatggcatcacagcgcttcagatggacatcaagcttggaggcatcagcctagaagtgctaaaagaggcgctttatcaagcaaaacgcggcagagagcacatccttgctctaatgacacaggctgataaaaatatagagataaacgaagatgtattnccaaaacttgagctatttaacgttgatccaagcaagatcgtagatatcatcggtcaagctggcaagactataaaagagatcatcgagaaatttgaagtttcgatcgaccttgatagagaaaaaggcgaggtnaaaatcgcaggcggcgcnaagaaaaacgtcgatgcagcaaaagactacatcatctctatcacttcaaaagagaactctcgctcatttggcaaaaagccgtttaaacacgacaaagancgtgtaaaaccgacatttaatatcggagatgagtttgttggaagcgtaaaaagcgtggttgattttggagtatttatcgagntaaaaganggtgttgatggtctgcttcacatctcaaagataaagagcccattaaacgtaggcgatcaggtaaaagtgtgtgtgagcgagcaaaaaggaaacaaaatttcgctctctttggttgaataaatttttaaaggat

SEQ ID NO: 1422 - DNA, 4000 bp, Escherichia coli
  misc_feature (474)..(474): n is a, c, g, or t
  misc_feature (1695)..(1695): n is a, c, g, or t
  misc_feature (1992)..(1992): n is a, c, g, or t
  misc_feature (2015)..(2015): n is a, c, g, or t
  misc_feature (2036)..(2036): n is a, c, g, or t
gggatcaccgtgccggcgatggtcgacgtgccgagcgggcaggtggtcaccaacgacttcccgacgatcaccagggacctgttcttcgagtggcggccctaccaccgcgacggcgcgccggacctctggccggcggcggtccgggccgagatggacgagctgatggagtgggtctacacggaggtgaacaacggggtctaccggtgcgggttcgcctcgtcccagcaggcgtacgacgacgcgtacgaccggctgttcggcgcgctcgaccggctctcggaccggctcgcggaccggcggtacctcctgggtgacgcggtcaccgaggcggatgtccggctgttcaccacgctggtccggttcgacgccgtctaccacggccacttcaagtgcaaccggcagaagctgaccgagctgccggtgctgtgggcgtacgcgcgggacctgttccagacgccggggttcggcgacacngtggacttcgaccacatcaagcggcactactacgaggtgcaccggaccatcaacccgagcggcatcgtgccgcgcggtccggacctggcgaactggctggagccgcacggccgggcggcgctcggcgggtcgccgttcggcaccggcacgccccccggtccgccgtcgccgccggagaccgtgccaccggaccacaccccactcccctgagcgacccgccctcagtcgtgctcggcgagttcgcggaactcgtcggggacgccgcgggagcgggtgcgggccggcaggtagcccaccgcttcgcggccgaaccggtcgcggaccgcgtcgaccgagctgtccagcgcccagcgggctgagccgcgcgcggacccgggccggcgcgggtcgtccgggggcaccggcagctccagctggatcgagtgctgcagggtgaggttggagaccgagatcgccagcaggctgatctcgaccgccgcgtcctggtcccggatcgcctgccaggccagctgttcggccacctcggtcagcgtgagcgtggccgcgatcggtccgggcagggtcagcgaccgggtcaccgacttcatcccggcgaaccgcacccgcacggtgacggtccggccggcccggtgcttggcccgcagccgcccggccacccggtcggcgaggtggctgagcacctcggtcaccaggccaggggtcggctggtgcgcgccgatcgccgactgcgcgccgaccgacttggcccgcccgaggccgctgatccggcgcgggtcctcgttgaccgccagcgcggccagcttcagcccgacggcgtggccgagcagaccctccagagcgcgcggcgacatctcggccagctcgccgatcgtgtgcacaccacgctcggccagccgccgctgcgccaccgggccgacgccccacatcagcccgaccggcagcgggtcgaggaactcccgctcccgctccggctcgaccaccaccagcccgtccggcttggccacctgcgaggcgaccttggccaggtgcttggtccgggccgcgccgatcgagatcggcagcccgacctcccggcgcaccctggcccgcagccgggcggcgatctcgcccggcggcccgaacaggtgggtcgagccggtgacgtcgaggaacgcctcgtcgatcgagatccgctccaccgccggcgtgacggcgttcaggatgtccatcacgtcgtcggcnagccgctggtactgggagaagtgcccccggacgaacgtgatccgcgggcacagctggcgcgcctgccagcccgccatcccaccgtgcacgccgaacgccttcgcctcgtacgaagcggcgagcacgacgcccccgcggtcgctgccgcccaccgcgatcggccgaccccgcagcgccgggtcgagcagttgctcgaccgacgcgtagaacgcgtcgaggtccgcgtgcaggatcgtcggcccgcggggcatgatcgcactgtatcgaacacgtgttcgaacgactaggcctgatgtncgccagactttctggcagtcttnccggaccgtgacaggcagccntccgcttggcgcgggtggtcaacccgccctccgtgtggtgtgaccgaggcatttccgtaccgactcacgggaggctgacgccatgcggagactgacctttggcatgaacgtgagcgtggacggctacatcgccgcgccgggcgacaacctcggctggagcgtgccgagcgacgagctgttccagtggtggtccgaccgggtgggggcgacgggcctggcgctgtacgggcgcaaactgtgggagacgatgagctcccactggccgaccgccgaccagcagcccggcgccaccccggcgcagatcgagttcgcccgccgctggcgggacatgccgaaggtggtgttctcctcgacgaccagcgcggtcgactggaacacccgcctggtcaccggtgacgctgccaccgagatcacccggctcaagactgaggatggcggtcccatggacatcggcggcgccaccctcgccgcggcagccatgcgggccgggctgatcgacgagtacgtgatggtcacccacccggtcctggtcggcggcggcacgccgttcttcacggccctggacgactgggtggacctggacctggtggagacccggacgtttcccgacggcgtgctcctgaccagatacgagaccaggcgctgagtcagccgcgggcctcgaccaggccgaggccgaccggcgacgcggtccggtgcaccgcggtgacggtgaacccggcgtcggcgagcagctcgcgatactcggcctcggtccgctcccgggcggcgccgaacagcatgagcatcgtcaggtccatccggatcgccgccggctgatcccgggcccgctccggcagcagcgcctcggcgaccagcagccgggcgccggagggcaccgccttgcggcaggtcgcgaggatccggccggcctcctcgtcggaccagtcgtgcagcacccgggacagcacgtacgcgtcggcgccggccggcagggcggcgaagaagtcgccggcgaccaccgtagaccggtcggcgagcccggccgcggccagccgttcccgcgccggctcgaccaccgccggccggtcgaccagcgtcgcggtcagtccgggcgtcgcccgcagcaccgcgccgaccagcacgccgtagccgccgccgacgtcgacgaggtgccggatcccgccgaagtcgtacgcgtcgaccaggtcggcggcctcccggtcggcccggccggccatggccgcggcgaagacctgctcgtgcgccggggtcgcgtccaggtggtcgaagaaccggcggccgtacacccgctcgaacgcggtgtccccgccgcggaccgccgccggcaggccggccgcggcgtcgaagtagagctcgccgcggacgagcgccagctcgcgcatggacccgggtacgtccgagcgcagccaggcgccggtcgcggtgagcccgaaccggccgtccggcagctcgtccagcacctggtcggcggcgagcccgcgcagcacccgggtcagcggcccgaccggcacccccaccgccgcggccaggtggtccgcgctgcgcggccccgcggccagctcgtcggcgacgccgagccgggcggcgaggaagagcagctgcgtgctgaggtaaccgtccatcagccggccgagccgaagcgggccggccgtctcgctcgggacccccgtcatccaggcaggtaaccacgcccggtggtcacccggcagtggctttgccccaaggggcaggctctctcgacgctgcgggcagcgcggtccggccggtcagccgctccagccgagcgtccggtcgcgctggtcaaccccgagctccccgtacgggtagtccggcgggtgcgggtcgctggccgcgtccagggccgcggtctcggccgcggacaggtgcaggtccgccgcgccgaggttggcccgcagctgctcggtggtgcgggcgccgaggatcgtcgcggtcacccccgg

SEQ ID NO: 1423 - DNA, 4000 bp, Escherichia coli
  misc_feature (468)..(468): n is a, c, g, or t
  misc_feature (473)..(473): n is a, c, g, or t
  misc_feature (489)..(489): n is a, c, g, or t
  misc_feature (553)..(553): n is a, c, g, or t
  misc_feature (667)..(667): n is a, c, g, or t
  misc_feature (765)..(765): n is a, c, g, or t
  misc_feature (767)..(767): n is a, c, g, or t
  misc_feature (777)..(777): n is a, c, g, or t
  misc_feature (903)..(903): n is a, c, g, or t
  misc_feature (1162)..(1162): n is a, c, g, or t
  misc_feature (1996)..(1996): n is a, c, g, or t
ttacaattgttctgataagcaaactagattctaaatgataatattccgaatcattctgagtttgaaaaggcaattcagagggataattcaattcattatgttgagagaacatgttggttgaaaataataatattataagtactacaaggaacttaaattgattcatggtgataatttttatacttcataaatttaaaaaaaagaagagtaaaacgtgataaaatctctaaatactttttgataaattcaatttaataaaagtcaaatgaagtgggtgttaagggattcgaacccatgacctctaccctgtcaaggtagcgctctaaaccaactgagctaaacacccaaaatgtttctgctaattattgacatttaaatagtgcaaaatattttatgtttgaatcaaatatattacttcttactcaattcgcaccttaactaataatactttgaagcagtaattctctnatagntaaaaataatctgtanttataacgggtaatatgcctgtggttttatgtaaaccatacctcaaaaaagtaatatttatttnacattaaaacaactaggaattggattatcaaaaatgtgggagtaaaatatgaggtttacgttctgtctacatcttcaacttcattaccccactcccacgaggattgaatctatnacaaaaatgataattaaaattgaacaaactactcttgatatatattttaatcttatgattgtatagtgtaaaattataaagacttttcttttaaagcntnttaatctatnggttagcatcaaaaagttactgtagtttgacctattaaagagtgttagaaataaatgaaaatacgacaaatgatttcccgatggtttattagaaatcagagctatatgagtaattaaaatataggntaaaacatgctggttttatttataaaatatcaaaaagataggaggtaatttacaattgcaaataaataaaaacaaactgttaaaaaaattgcaataataaagactccctttgctaaatctttattagtaatattatttatccagactattgttggttttataccttttatgagtaaaaaaaaaccaaaaaatgctaaaacataagctaataactccatatgactaatataacaaatcccaaaacttacagaagagtatntgcctatgattcttttataaaattgaatatattttacagaaaatcgttcatgatgactagataaaaaataattccatttatcatcatataaaaaagggcaggtattattttcaaaagttcatctttaattcttatgcgaactaaaattgctactagcatcattaatgtcagtgcaagggaagaaattaaaagtaagtatggaatcaaaagccctaaaagcaaacctaaaccccctaatatctgaaaagttccaatggtaaatcgatgattcaaaaagccccatcgttcaaattctgctttcatccttctagaccgaaaagaactaataccataaaaaagaaatgatataccagaaaaaaaactcaatataatggttagggtcatgagctaaagtaaacccatatttactgcagcaataaacaaggataaaactaaaaaaagaagagaagggatgaatttaatcaatggatttctcactttgatatgtgccaattgcgcacaaaacataaaaaaagccattgataaagaagaaaaaactaccaaacctgggtaaaaaacaccagcaattagtaaggctgaaagagatatcttagaagctcctactgaatttcgaattaaatcagaaagaccatactgtttaaattctttgacaatattatcaaacctaaaaacccaaacgaagagaaccgagaaggcaacaatcaactgactagcaagtgcaattttatccatatttaattatcttttgttaatgtacaaaaaaattatctttttacactttgtaacttatgttacataactatatgcatattaatttaattttgaatatcaatncttcaattttgaattggtttatggttaaactgttaggaataattcctagcagttttttttatccttattttcttatccaattttgagtacgacccaaaattgaaaaccctaaaaatcctcttacttttaatttatcttcagcttctaaagtaagataacaatcatacactttaccagacttaggatccaagatagtaccttcctcccaactcccatcctcgaggacaagatcattgactataataagcccctcaataggcttgtttttattttctcccttacactcaccacataatttaccttgatctccgggaagtaataatttaagaatcttaccataaagctttccattttcttgataaagtaaaacctctgattttttttgtcctgtttcatcatcctgagttatccatatgccctcaacggacgaaggctgtattgtattaagaaaaacgtaggtgatgaggtataaaaaatgcaacatattttgataaattgaaaattgttgcctaaaaataaaaaatctctttctattttagtgtcattaaacttttaaatatgaattcgtttctaaataaattcaagtttattttccttttaattcctgtgggcctctttatagccttcctagacggcaaaatattacagggttttttagcctctaatcaaattccagatcattatctgtttattggatctctagttttggttgtaatgggtataattttcgctatacttcgatttgataataaaaatgaataaaaaagagcgtttggtcttccctatctttgcaaaaaaaatatgaagcattttagccaaaaagatatagatactctatccaaaatttacagacttaatctaatcaatagcgcaacaggctataaatctgcacaattagtgggaagtgtttcttcagagggaaatgaaaatttagcagtttttagttctattgtacatctgggaagtaatccagcccttatagggatgatcctgcgtccaactaccgtacctagacatacttatgcaaacatgaaagcaaccggcgttttcactttaaacgcgattcacgaaagtcagatagaagatgctcaccatacctctgcaagttatcctgagtccatctctgaatttgacaaaacccaacttaaagtggagaggaaaaagaattttttagctccatttgtgaaagattcaccaatccaaatggcctgtaaatatttgaatgaataccatattaaagaaaatgatactcttttaattgtagggagtatagaagacctttatgtcaaagattcaatcttacttgaagacggttggattcaattagacttgggaggtatcgtaacaataaatggcttggacggttatgcaattccaaaactccaagaacggtttccttatgctcgaccaaaagatgaataatccaaaatttacagaagcattgagtgagcaatggatcaactatgcatctaatcatagcgagccaatccctgaaattcttattgaacttgagcgcgaaacgcatcaaaaaatacttcaaccccgcatgttaagcgggccattacaaggccgattattgagtttaatttctcacctaattaatcctgtgtccattattgaaataggaacttataccggatacgctacactctgtctagcagagggactgcaagaaaagggtattatacacaccatagatagtaatgaagaactagttcccattcaacaacacttttttaataaaagtgcttttaaatgtcaaattaaaagatatttaggcgctgcagtagaggtattgcctgaactttctggcccttttgatctcgcttttatcgatgctgataaagtaaattacaccatttattttgagatgcttctgccaaaaatgaaaaagggtggattaattatttctgataatgtattatggagtggaaaagtgataaaaaaagccgatcctaaagatgaaagtacaattgcattacaacattacaatgaaaaattaaa

SEQ ID NO: 1424 - DNA, 4000 bp, Escherichia coli
  misc_feature (40)..(40): n is a, c, g, or t
  misc_feature (53)..(53): n is a, c, g, or t
  misc_feature (89)..(89): n is a, c, g, or t
  misc_feature (92)..(92): n is a, c, g, or t
  misc_feature (98)..(98): n is a, c, g, or t
  misc_feature (130)..(130): n is a, c, g, or t
  misc_feature (146)..(146): n is a, c, g, or t
  misc_feature (160)..(160): n is a, c, g, or t
  misc_feature (237)..(237): n is a, c, g, or t
  misc_feature (266)..(266): n is a, c, g, or t
  misc_feature (286)..(286): n is a, c, g, or t
  misc_feature (291)..(291): n is a, c, g, or t
  misc_feature (329)..(329): n is a, c, g, or t
  misc_feature (370)..(370): n is a, c, g, or t
  misc_feature (388)..(388): n is a, c, g, or t
  misc_feature (392)..(392): n is a, c, g, or t
  misc_feature (400)..(400): n is a, c, g, or t
  misc_feature (402)..(402): n is a, c, g, or t
  misc_feature (404)..(404): n is a, c, g, or t
  misc_feature (407)..(408): n is a, c, g, or t
  misc_feature (417)..(419): n is a, c, g, or t
  misc_feature (421)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (436)..(437): n is a, c, g, or t
  misc_feature (439)..(441): n is a, c, g, or t
  misc_feature (444)..(445): n is a, c, g, or t
  misc_feature (449)..(451): n is a, c, g, or t
  misc_feature (454)..(454): n is a, c, g, or t
  misc_feature (456)..(456): n is a, c, g, or t
  misc_feature (460)..(463): n is a, c, g, or t
  misc_feature (465)..(465): n is a, c, g, or t
  misc_feature (467)..(469): n is a, c, g, or t
  misc_feature (471)..(471): n is a, c, g, or t
  misc_feature (475)..(475): n is a, c, g, or t
  misc_feature (478)..(478): n is a, c, g, or t
  misc_feature (480)..(483): n is a, c, g, or t
  misc_feature (486)..(487): n is a, c, g, or t
  misc_feature (489)..(489): n is a, c, g, or t
  misc_feature (493)..(495): n is a, c, g, or t
  misc_feature (497)..(499): n is a, c, g, or t
  misc_feature (501)..(501): n is a, c, g, or t
  misc_feature (505)..(507): n is a, c, g, or t
  misc_feature (509)..(510): n is a, c, g, or t
  misc_feature (513)..(513): n is a, c, g, or t
  misc_feature (515)..(515): n is a, c, g, or t
  misc_feature (519)..(519): n is a, c, g, or t
  misc_feature (521)..(521): n is a, c, g, or t
  misc_feature (523)..(528): n is a, c, g, or t
  misc_feature (530)..(530): n is a, c, g, or t
  misc_feature (532)..(533): n is a, c, g, or t
  misc_feature (535)..(542): n is a, c, g, or t
  misc_feature (544)..(545): n is a, c, g, or t
  misc_feature (547)..(547): n is a, c, g, or t
  misc_feature (550)..(550): n is a, c, g, or t
  misc_feature (552)..(554): n is a, c, g, or t
  misc_feature (556)..(558): n is a, c, g, or t
  misc_feature (564)..(565): n is a, c, g, or t
  misc_feature (567)..(567): n is a, c, g, or t
  misc_feature (571)..(571): n is a, c, g, or t
  misc_feature (573)..(573): n is a, c, g, or t
  misc_feature (575)..(576): n is a, c, g, or t
  misc_feature (578)..(578): n is a, c, g, or t
  misc_feature (581)..(582): n is a, c, g, or t
  misc_feature (585)..(586): n is a, c, g, or t
  misc_feature (590)..(590): n is a, c, g, or t
  misc_feature (592)..(592): n is a, c, g, or t
  misc_feature (595)..(595): n is a, c, g, or t
  misc_feature (597)..(598): n is a, c, g, or t
  misc_feature (604)..(604): n is a, c, g, or t
  misc_feature (606)..(608): n is a, c, g, or t
  misc_feature (610)..(612): n is a, c, g, or t
  misc_feature (614)..(619): n is a, c, g, or t
  misc_feature (621)..(621): n is a, c, g, or t
  misc_feature (623)..(625): n is a, c, g, or t
  misc_feature (630)..(634): n is a, c, g, or t
  misc_feature (640)..(640): n is a, c, g, or t
  misc_feature (642)..(642): n is a, c, g, or t
  misc_feature (644)..(650): n is a, c, g, or t
  misc_feature (653)..(655): n is a, c, g, or t
  misc_feature (658)..(659): n is a, c, g, or t
  misc_feature (661)..(662): n is a, c, g, or t
  misc_feature (665)..(666): n is a, c, g, or t
  misc_feature (669)..(670): n is a, c, g, or t
  misc_feature (674)..(675): n is a, c, g, or t
  misc_feature (677)..(678): n is a, c, g, or t
  misc_feature (681)..(682): n is a, c, g, or t
  misc_feature (691)..(691): n is a, c, g, or t
  misc_feature (693)..(693): n is a, c, g, or t
  misc_feature (695)..(697): n is a, c, g, or t
  misc_feature (699)..(700): n is a, c, g, or t
  misc_feature (702)..(702): n is a, c, g, or t
  misc_feature (704)..(704): n is a, c, g, or t
  misc_feature (707)..(708): n is a, c, g, or t
  misc_feature (710)..(710): n is a, c, g, or t
  misc_feature (712)..(713): n is a, c, g, or t
  misc_feature (715)..(724): n is a, c, g, or t
  misc_feature (727)..(728): n is a, c, g, or t
  misc_feature (731)..(731): n is a, c, g, or t
  misc_feature (733)..(733): n is a, c, g, or t
  misc_feature (735)..(735): n is a, c, g, or t
  misc_feature (738)..(744): n is a, c, g, or t
  misc_feature (746)..(751): n is a, c, g, or t
  misc_feature (753)..(753): n is a, c, g, or t
  misc_feature (757)..(757): n is a, c, g, or t
  misc_feature (759)..(761): n is a, c, g, or t
  misc_feature (763)..(764): n is a, c, g, or t
  misc_feature (766)..(776): n is a, c, g, or t
  misc_feature (778)..(779): n is a, c, g, or t
  misc_feature (781)..(781): n is a, c, g, or t
  misc_feature (783)..(783): n is a, c, g, or t
  misc_feature (785)..(794): n is a, c, g, or t
  misc_feature (796)..(796): n is a, c, g, or t
  misc_feature (800)..(810): n is a, c, g, or t
  misc_feature (813)..(814): n is a, c, g, or t
  misc_feature (816)..(820): n is a, c, g, or t
  misc_feature (822)..(826): n is a, c, g, or t
  misc_feature (828)..(828): n is a, c, g, or t
  misc_feature (831)..(832): n is a, c, g, or t
  misc_feature (834)..(837): n is a, c, g, or t
  misc_feature (839)..(847): n is a, c, g, or t
  misc_feature (849)..(850): n is a, c, g, or t
  misc_feature (853)..(853): n is a, c, g, or t
  misc_feature (855)..(858): n is a, c, g, or t
  misc_feature (861)..(861): n is a, c, g, or t
  misc_feature (864)..(865): n is a, c, g, or t
  misc_feature (868)..(868): n is a, c, g, or t
  misc_feature (870)..(872): n is a, c, g, or t
  misc_feature (874)..(876): n is a, c, g, or t
  misc_feature (879)..(879): n is a, c, g, or t
  misc_feature (881)..(883): n is a, c, g, or t
  misc_feature (885)..(886): n is a, c, g, or t
  misc_feature (888)..(888): n is a, c, g, or t
  misc_feature (890)..(897): n is a, c, g, or t
  misc_feature (899)..(901): n is a, c, g, or t
  misc_feature (904)..(908): n is a, c, g, or t
  misc_feature (910)..(911): n is a, c, g, or t
  misc_feature (913)..(913): n is a, c, g, or t
  misc_feature (915)..(921): n is a, c, g, or t
  misc_feature (923)..(923): n is a, c, g, or t
  misc_feature (926)..(928): n is a, c, g, or t
  misc_feature (930)..(930): n is a, c, g, or t
  misc_feature (932)..(932): n is a, c, g, or t
  misc_feature (934)..(947): n is a, c, g, or t
  misc_feature (950)..(953): n is a, c, g, or t
  misc_feature (955)..(959): n is a, c, g, or t
  misc_feature (961)..(963): n is a, c, g, or t
  misc_feature (965)..(967): n is a, c, g, or t
  misc_feature (969)..(970): n is a, c, g, or t
  misc_feature (972)..(974): n is a, c, g, or t
  misc_feature (977)..(983): n is a, c, g, or t
  misc_feature (987)..(987): n is a, c, g, or t
  misc_feature (989)..(993): n is a, c, g, or t
  misc_feature (997)..(997): n is a, c, g, or t
  misc_feature (999)..(1000): n is a, c, g, or t
  misc_feature (1002)..(1006): n is a, c, g, or t
  misc_feature (1009)..(1014): n is a, c, g, or t
  misc_feature (1016)..(1020): n is a, c, g, or t
  misc_feature (1023)..(1027): n is a, c, g, or t
  misc_feature (1030)..(1035): n is a, c, g, or t
  misc_feature (1037)..(1039): n is a, c, g, or t
  misc_feature (1042)..(1045): n is a, c, g, or t
  misc_feature (1048)..(1049): n is a, c, g, or t
  misc_feature (1052)..(1052): n is a, c, g, or t
  misc_feature (1054)..(1054): n is a, c, g, or t
  misc_feature (1056)..(1058): n is a, c, g, or t
  misc_feature (1060)..(1061): n is a, c, g, or t
  misc_feature (1064)..(1066): n is a, c, g, or t
  misc_feature (1068)..(1069): n is a, c, g, or t
  misc_feature (1071)..(1073): n is a, c, g, or t
  misc_feature (1075)..(1075): n is a, c, g, or t
  misc_feature (1077)..(1077): n is a, c, g, or t
  misc_feature (1080)..(1081): n is a, c, g, or t
  misc_feature (1084)..(1088): n is a, c, g, or t
  misc_feature (1090)..(1096): n is a, c, g, or t
  misc_feature (1099)..(1104): n is a, c, g, or t
  misc_feature (1106)..(1108): n is a, c, g, or t
  misc_feature (1110)..(1110): n is a, c, g, or t
  misc_feature (1115)..(1115): n is a, c, g, or t
  misc_feature (1118)..(1120): n is a, c, g, or t
  misc_feature (1123)..(1123): n is a, c, g, or t
  misc_feature (1125)..(1128): n is a, c, g, or t
  misc_feature (1130)..(1135): n is a, c, g, or t
  misc_feature (1138)..(1138): n is a, c, g, or t
  misc_feature (1143)..(1143): n is a, c, g, or t
  misc_feature (1146)..(1150): n is a, c, g, or t
  misc_feature (1152)..(1153): n is a, c, g, or t
  misc_feature (1155)..(1157): n is a, c, g, or t
  misc_feature (1159)..(1161): n is a, c, g, or t
  misc_feature (1163)..(1163): n is a, c, g, or t
  misc_feature (1165)..(1165): n is a, c, g, or t
  misc_feature (1168)..(1169): n is a, c, g, or t
  misc_feature (1173)..(1174): n is a, c, g, or t
  misc_feature (1178)..(1178): n is a, c, g, or t
  misc_feature (1180)..(1180): n is a, c, g, or t
  misc_feature (1182)..(1189): n is a, c, g, or t
  misc_feature (1191)..(1191): n is a, c, g, or t
  misc_feature (1194)..(1195): n is a, c, g, or t
  misc_feature (1197)..(1202): n is a, c, g, or t
  misc_feature (1206)..(1208): n is a, c, g, or t
  misc_feature (1211)..(1212): n is a, c, g, or t
  misc_feature (1214)..(1215): n is a, c, g, or t
  misc_feature (1217)..(1218): n is a, c, g, or t
  misc_feature (1220)..(1220): n is a, c, g, or t
  misc_feature (1222)..(1222): n is a, c, g, or t
  misc_feature (1225)..(1225): n is a, c, g, or t
  misc_feature (1227)..(1228): n is a, c, g, or t
  misc_feature (1231)..(1231): n is a, c, g, or t
  misc_feature (1237)..(1237): n is a, c, g, or t
  misc_feature (1239)..(1240): n is a, c, g, or t
  misc_feature (1242)..(1242): n is a, c, g, or t
  misc_feature (1244)..(1244): n is a, c, g, or t
  misc_feature (1251)..(1251): n is a, c, g, or t
  misc_feature (1256)..(1258): n is a, c, g, or t
  misc_feature (1261)..(1261): n is a, c, g, or t
  misc_feature (1265)..(1265): n is a, c, g, or t
  misc_feature (1270)..(1270): n is a, c, g, or t
  misc_feature (1272)..(1272): n is a, c, g, or t
  misc_feature (1274)..(1274): n is a, c, g, or t
  misc_feature (1277)..(1277): n is a, c, g, or t
  misc_feature (1279)..(1282): n is a, c, g, or t
  misc_feature (1284)..(1284): n is a, c, g, or t
  misc_feature (1288)..(1288): n is a, c, g, or t
  misc_feature (1293)..(1293): n is a, c, g, or t
  misc_feature (2072)..(2072): n is a, c, g, or t
  misc_feature (3167)..(3167): n is a, c, g, or t
  misc_feature (3583)..(3583): n is a, c, g, or t
  misc_feature (3727)..(3727): n is a, c, g, or t
aacacgagagattactaataatatttactggattggaacnggttttaaaaagngcggaaatgaagttttaattggtggatcaactgggntangtgaanctgaatcagttatagctgatgctgttgtattncaacaatttgcaatgntacttgcaattaanaatggtttaaatcctgatgcaccaattggtttattaaaagttactcaaacaatttaaatgctgctatctgaaggtanttttgctactagtcgggcatatattgatngtaactgggttgatggtggnataantgttgaagattataaattaacttcttatagtgaatcanctggtgatcaaggaatggcaattcctggctttgtagatctncaagtaaatggtcatggnggtnttgatttntnangannaaaagatgnnncnnntanaanaanaatnncnnnttnnttannnaancntggnnnnantnnntntttnccnannnnaannantggnnntnnngnaaannntnnaananttanancnnnnnntnannannnnnnnnannanccntnnncnnntgaggnnanaatnantnncnctnnttnngaangnccntnnatttcncnnntnnngnnnnnngngnnnccagnnnnncatatntnannnnnnnatnnnaanntnnttnnagnntttnncnnaannggaaaaatntntnnngnnantnttnnancnnannnnnnnnnngcnnttnangnaannnnnnntnnnnnngnctcngnnntnntnnnnnnnnnnngnnantnannnnnnnnnncnaaannnnnnnnnnntgnntnnnnngnnnnngnggnnannnntnnnnnnnnntnnaangnnnngcnaannaantnnnannnccnannngnntnannnnnnnntnnnttnnnnngnnangnnnnnnntnttnnntnantnnnnnnnnnnnnnnatnnnnannnnnannnannnanngnnncannnnnnnaatntnnnnncagntnnannnnnacnnnnnntnnnnnctnnnnngcnnnnnnannngannnnaannttnantnnngnnaannngnnannnangntannaannnnngnnnnnnnagnnnnnncnnnanattanctnnnggngnnnncnnnnnnacnaactnacnnnnncnnannngnnngnanggnntttnnctanangnnnnnnnngnttnnannnnnncacnnncgnnanntnngntnggnanntcngatttngnncnantatctcngggtnnnccngcgnagatntngncantnnnnantggnttttnctttttcaccccccacgcataaactatccctcctgcctcgcaaggggtaaacctgatttagaacagataagtaggtatcgcttggccaagaaagacggtgctattgagatcgaaggcactgttgctgaagcactaccgaacgcaatgttccgagttgagttaacaaatggacataaagttttagcacatatcagtggaaagatgcgacagaactacattcgtattttgccagaagataaagtgattgtagaacttagtccgtatgacctcactagaggtcgaattatttatcgttacaaataaataatttttaaactgtagttgttagaaaggtaatcgtgaaggtcaaacctagcgtgaaaaagatttgcgacaagtgcaaagttattcgtcgtaatggccgcgttatggtgatctgcgacaacctacgtcataaacaacgtcagggttaatttaaaaaacgcgtgatgcgacgtaattaaggtaaaacttaattatgacccttagtccgaaaggctgaggccagataagaaattatctgggggcattgcggaggacctttcggatattagaaacaggttaacgatatggcacgtcttgttggtgttgatcttcctcgcgaaaagcggttagagatcgcacttacctatatttttggaatgggacttacccgtgcgcaagcaacacttgccgctactggtatctcaccaaacatcagagttaaagatctacaagagccagaattggcaaagcttcgtgaattcattgaagccaattanaaaattgagggtgatcttcgccgtgagatcgctggcgatattcgtcgcaaagttgaaattcaaagttaccaaggttctcgtcaccgcaaaggattaccagtccgcggtcaacgtactcataccaatgctcgtactcgcaagggtccacgtgttgcaatcgctggtaagaagaaggagaccaagtaatggccgccgaaaaagctaaaccagctaaagaagcagcagcaaaagctgcaccaaagaaaattaaagcacgtaagaaggataagaaaaatgttgccttcggtcatgcttatattaagagcacatttaataacaccattgtttcaatcacagatccagcaggtggcgtaattgcttggtcatcatctggtcaggttggatttaaaggttctcgtaaatcaactccatttgctgcgcaaatggctgctgaggctgctgctcgtaaagcgcaagagcacggcttaaagaaagttgatgtatttgttaagggacctggctctggccgggaaactgcaattcgttcattacaagcagccggtcttgaagttggagccatcgcagatgtaactccagcaccacataacggttgtcgtccacgtaaaccacgtcgagtataaggaaagggagaaaactatggctcgctataccggtgcagattgcaaaagatgccgtcgcgaaaaagtaaagctcttccttaagggctctaagtgcgatggaccaaagtgtccaattgagtcacgtccatatccaccaggacaacatggccgtgctcgttcaaaagattctgagtacttattacagatgcgtgagaagcaaaagtgtgcacgtatttacggagtacttgagaagcagttccgtggttactacgaagaagcaaaccgtctgcaaggtaagactggtgagaatcttttggtactacttgaaactcgtctagacaatgttgtcttccgcgctggctttgctaagagccgggatatggcacgccaattagtgcgccatggtcacttcttagttaatggcaagagcgtgaacattccatcatttagaactacaccgatggacataattgatgttgtaccagcttcattgganaccacaccatttatcgtcgcaagtgcagagcttggtgagaaaactgttccagcatggatggaggttgtgggttctaaaatgcgaattttggtccacgccgttccaacccgcccaattattgatactcaagtacaagagcaactaattgttgagctttactccaagtaatcaagtacttaagcagtaaagatttaccgcagtaaaactaaatatcgtaagccaaccgaaagatcaaatagagggtctttcagaacatacggaggaacaaagtgctaattgcacaacgcccaatcctcactgaggaagttgtaagcgaataccgttcacggttcattattgagccgctagaacctggtttcggctacacacttggtaattcaattcgtcgcaccttattatcttcaattccaggagcngctgttactggtattagagtaaataatgcgctgcacgagttcactgctttagaaggtgtgaaagaggatctaactgagatcgtcttaaacatcaaaaacctagttttatcttcagataatgatgaaccatcacttctttacatncgtaaaaatggtgagggaattgttactggcgcagatgtggccgctccaacaggagttgccgtacacaatccagaacttcacattgcaacactaaattcaaaggcaaagtttgagatcgagttaactgttgagcgtggtcgtggttacatcaccgcggtacaaaacaaagcagcagggggagagattggccggattccggttgattcaatttactcaccagtgcttcgtgttacctacaaagtagaggcaacacgtgttgaacaacgcaccgac

SEQ ID NO: 1425 - DNA, 4000 bp, Escherichia coli
  misc_feature (744)..(744): n is a, c, g, or t
  misc_feature (857)..(857): n is a, c, g, or t
  misc_feature (860)..(860): n is a, c, g, or t
  misc_feature (864)..(864): n is a, c, g, or t
  misc_feature (1990)..(1990): n is a, c, g, or t
  misc_feature (2437)..(2437): n is a, c, g, or t
  misc_feature (2542)..(2542): n is a, c, g, or t
  misc_feature (2584)..(2584): n is a, c, g, or t
  misc_feature (2653)..(2653): n is a, c, g, or t
aagcacgaacggcgcgaacaggaacggcagcccgtagatgatgtacttctgcggcccttccatcccctggccgcggaccgtcatcgccaggcccgaggcgagctgggtgacgatgaagaggacgacgaggacggccgcgacggcgccctcgggcggctggatcaggctcgggatgaacaggaagccctccggcggcgagttctgcacgtccatctggaagctgtcgcccttgagcatgtagtagagcgagatgaagaccgggatctgcagcagcagcggcaggcaggaagcgagcggattgatctcgttctcctggtagaacttcatcatcgcctgctgctgggcctgcttgtcgtccttgtgcttctcctggatctgcttgagctgcggctgcagctcctgaagcgcccgcatcgagcggatctgcttcatcgagatcggcaggatcgcgagccggacgacgaagacgagggcgatgatcgccggaccccagccgagcccgagcgtgtcgtggaagaagacgatgatcgcctcggggatgtcggtgaagatcgatgcgacgggcagggtcatcggctggaggctctctcgctacgctcggtaacggttcgggtggctcggaagatcgggcgctcggagacgggatcgagaccgccggcgctgaaggggttgcatcgtaggacgcgccaggcggcgaggatcatgccgcgaaacgccccgagctcgcggacagcctcctcggcntaggcagagcaggtcgggtagtagcggcagcgctggccgagcgcgggggagaggaagcggcggtagaagcggatcggcagcagcgccagggtcgcggcgaagcccgtccgcgncgncgancccgtttcacgtgcaacggtggccgggctcaactgggaccgcccccgggtcgcccgcggccgcgtttcacgtgcaacgcccactccccctgccctcattctccggcctcgtcgagcagcgtcgtcagcgaggccgtcagccccgccgtgccttcccggtcgatcaggccggcgacgtcgctgcggccgacgaggacgaagtcgtagccgtcgggaagccggtcggcgagtccccagaacgcctcgcgcatcgcccgcttcaccttgttgcgatcgatcgcaccgccgaccttgcggccgaccgagacgccgagacggacctcgtcgccggagtcgtccccgcgggggaacgcgtagaggaccaggaagcggttcgcgtgcgagcgcccgtcgcggtaggcgcgatcgaaatcgccgctgcgcgagaggcgaccccgcttgcgaccctcgccaccggcctcgcgggacatctagacggtcaggcgcttgcggcccttgcgacggcgccggcggatgatctcgcgaccatggcgggttcgcatccgggcgcggaagccgtgcgcgcgggcgcgctttctcttctttggctgccaggttcgcttcattctcggtccctctcgtgcccgcggaaggggaatcggcggggcatgccggacggcgcggggacggagcagtatagggaggtcgtccggagggttatggcgcgatttgcggagtcgggcgcgggggtcgttcgattcttcgagtggggccgcgatcgccgacctatgatcgcccgcggaggccgtccccggcgctcatttccacccttgcacgccgaatcgagacaaccgagcgaccagaccgagccgggccgggagctggcgacgatctggaacggagtccgcgaggagctccgccggacgctgccgccgtccgcgttcgagaactggctcgagccgctccgcgccgtcggcatccagggcacccgcctctacgtctccggccccgaccgcgtccgcgactggttccagcgccgctacggcgccgctgcgaccgaggcgctgcggaggcgcgcgcccgggttcaccgagatcgccttcaccgagcccccggcgggtgccgagcgcgatcccggcggtgatgcnggcggttccgccacgccgccgattcccgccgggctcgcatccggcctcgacttcgaccacttcgtgatcggctccggcaaccgcttcgggcactccgccgcgctcgcggtggccgagtccccgggcgagtcctacaacccgctgttcctctacggctcgccggggctcggcaagacgcacctgctcgtctcgatcgccgactacctgcgcaaccgccggcccgacctcgacgtcgcctacaccaccgccgagcgcttcacctccgagttcgtgaccgcgctgcgcggcgacggtcgcccgaccgagcgcttcaagcggcgctaccgcggcgtcgacgtgctgctgatcgacgacgtccagttcctcgaaggcaaggcgcggaccgaggacgagttcttccacaccttcaacgagctctacgcgcaggggagccagatcgtgctctcnagcgaccgcccgccggaggcgatgggccggctcagcgagcggatgcgcgaccgcttcgcctgggggctgacggtcgagctgcagggccccgacccggcgacgcgnatcacgctgctgcggcggctcgcggtcgagaacgggatcccngtgcccgacctcgaggtgctccagcagatcgccggcgccgcgccgggcaacctccgccggctcgaaggngcgctgacgcgggtgaccgcgttcgcctcgatgctcggcgaggtcccgagcgtcgatctggtccgcaaggcgctcggctccgacgccgcgccgatcgacgcgaccccggtccgcgagcccgcggccgagcggctcgagcggatccagcgcgccgtctgcgacgtgttgcgtctctcgctcgaggacatgcgctcgccgcgccgcgctccgaacctcgttcgcggccgccagctcgcgatgtatgtcgcccgcaaccagaccgatctctcgctcgccgagatcgcccgtggcttcgaccgcgaccactcgacggtgatccactcgatccgccgcgtcgagcgcgacctcgagccgggctcggatatccacaaggcgctggagctgatccacgagcgcctccacatcgccggggagggcgcgtgaggggcggtcgggattccacggcaggggacttgtccacgaccgcttccacaacccgcgatcgcgcatcgctgctgccgtcgcggcgttctgaaagggtttccacggacctaacatcaactcggatgaccggaagaggatgcagatggaattgaaagccgaacgcgatccgctgctcgacggcctgcagaccgctgccagggccctgtcgacgcggacgacgctgccgtcgctcggcgggatcatgctcgtcgcgaacgggggcaaggcgatcgcgcgggcgaccgacggcgagctggcggtctcggtcgagctcgacgccgaggtcgacggcgacggtgaggtcctgctgccgggccggctcctggccgacgtctcgcgggcgctgccgcagggccccgtgaccctggccgaacgcaaggacaagggcgatgtcgagctcaccgccggcaccgccaacttccacctgcggctgctcgacgccgaggacttcccgcccctgcccgccgccgagggcgagctcctgaagatgcccgggggagcgctcgccgagaccgtcgaccgcgtcgcgcgggccgcctcgcgcgacgaggtccggccgatcctgaccgggatcctcgtcagcgtcgaggaatcgaccctgacgatggtcgcgaccgactcctaccggctcagcgtcaagcggaccgagctcgagggcggggcgccgcagcagttcgaggcgaacgtgccggcgcgggcgatgcgggagctggcgcgcgtcgtcgagcagcacggcgtcgaggaggtcgagatcgcgctgcccggcaaccagatcgtcttccgggccggcaacgtgacgatgtcatcgcggctgatcgagggccagttcccgagctaccggcagctccttcccgacgccttcgaccacgacgtccggttgccgcg

SEQ ID NO: 1426 - DNA, 4000 bp, Escherichia coli
  misc_feature (202)..(202): n is a, c, g, or t
  misc_feature (1403)..(1403): n is a, c, g, or t
  misc_feature (1406)..(1406): n is a, c, g, or t
  misc_feature (1479)..(1479): n is a, c, g, or t
  misc_feature (1876)..(1876): n is a, c, g, or t
  misc_feature (1937)..(1937): n is a, c, g, or t
  misc_feature (1991)..(1991): n is a, c, g, or t
  misc_feature (2190)..(2190): n is a, c, g, or t
  misc_feature (2631)..(2631): n is a, c, g, or t
  misc_feature (2733)..(2733): n is a, c, g, or t
  misc_feature (2745)..(2745): n is a, c, g, or t
  misc_feature (2862)..(2862): n is a, c, g, or t
  misc_feature (2868)..(2868): n is a, c, g, or t
  misc_feature (2883)..(2884): n is a, c, g, or t
  misc_feature (2889)..(2889): n is a, c, g, or t
  misc_feature (2896)..(2896): n is a, c, g, or t
  misc_feature (2901)..(2901): n is a, c, g, or t
  misc_feature (2930)..(2931): n is a, c, g, or t
  misc_feature (2940)..(2940): n is a, c, g, or t
  misc_feature (2949)..(2949): n is a, c, g, or t
  misc_feature (2952)..(2952): n is a, c, g, or t
  misc_feature (2963)..(2964): n is a, c, g, or t
  misc_feature (2967)..(2967): n is a, c, g, or t
  misc_feature (2982)..(2982): n is a, c, g, or t
  misc_feature (3018)..(3018): n is a, c, g, or t
  misc_feature (3210)..(3210): n is a, c, g, or t
  misc_feature (3213)..(3213): n is a, c, g, or t
  misc_feature (3244)..(3244): n is a, c, g, or t
  misc_feature (3278)..(3279): n is a, c, g, or t
  misc_feature (3295)..(3296): n is a, c, g, or t
  misc_feature (3303)..(3303): n is a, c, g, or t
  misc_feature (3309)..(3309): n is a, c, g, or t
  misc_feature (3312)..(3312): n is a, c, g, or t
  misc_feature (3318)..(3318): n is a, c, g, or t
  misc_feature (3328)..(3328): n is a, c, g, or t
  misc_feature (3341)..(3341): n is a, c, g, or t
  misc_feature (3348)..(3348): n is a, c, g, or t
  misc_feature (3376)..(3381): n is a, c, g, or t
  misc_feature (3383)..(3385): n is a, c, g, or t
  misc_feature (3388)..(3392): n is a, c, g, or t
  misc_feature (3395)..(3400): n is a, c, g, or t
  misc_feature (3403)..(3404): n is a, c, g, or t
  misc_feature (3407)..(3407): n is a, c, g, or t
  misc_feature (3409)..(3410): n is a, c, g, or t
  misc_feature (3412)..(3413): n is a, c, g, or t
  misc_feature (3415)..(3415): n is a, c, g, or t
  misc_feature (3417)..(3417): n is a, c, g, or t
  misc_feature (3419)..(3425): n is a, c, g, or t
  misc_feature (3431)..(3434): n is a, c, g, or t
  misc_feature (3436)..(3436): n is a, c, g, or t
  misc_feature (3439)..(3446): n is a, c, g, or t
  misc_feature (3448)..(3452): n is a, c, g, or t
  misc_feature (3454)..(3454): n is a, c, g, or t
  misc_feature (3456)..(3456): n is a, c, g, or t
  misc_feature (3458)..(3459): n is a, c, g, or t
  misc_feature (3461)..(3461): n is a, c, g, or t
  misc_feature (3463)..(3463): n is a, c, g, or t
  misc_feature (3465)..(3468): n is a, c, g, or t
  misc_feature (3470)..(3473): n is a, c, g, or t
  misc_feature (3476)..(3476): n is a, c, g, or t
  misc_feature (3478)..(3487): n is a, c, g, or t
  misc_feature (3489)..(3490): n is a, c, g, or t
  misc_feature (3492)..(3498): n is a, c, g, or t
  misc_feature (3500)..(3500): n is a, c, g, or t
  misc_feature (3503)..(3504): n is a, c, g, or t
  misc_feature (3506)..(3506): n is a, c, g, or t
  misc_feature (3508)..(3508): n is a, c, g, or t
  misc_feature (3510)..(3511): n is a, c, g, or t
  misc_feature (3513)..(3513): n is a, c, g, or t
  misc_feature (3515)..(3520): n is a, c, g, or t
  misc_feature (3522)..(3526): n is a, c, g, or t
  misc_feature (3529)..(3530): n is a, c, g, or t
  misc_feature (3532)..(3532): n is a, c, g, or t
  misc_feature (3534)..(3536): n is a, c, g, or t
  misc_feature (3538)..(3539): n is a, c, g, or t
  misc_feature (3541)..(3543): n is a, c, g, or t
  misc_feature (3545)..(3546): n is a, c, g, or t
  misc_feature (3549)..(3550): n is a, c, g, or t
  misc_feature (3552)..(3553): n is a, c, g, or t
  misc_feature (3555)..(3560): n is a, c, g, or t
  misc_feature (3563)..(3568): n is a, c, g, or t
  misc_feature (3572)..(3576): n is a, c, g, or t
  misc_feature (3578)..(3578): n is a, c, g, or t
  misc_feature (3580)..(3582): n is a, c, g, or t
  misc_feature (3585)..(3585): n is a, c, g, or t
  misc_feature (3587)..(3589): n is a, c, g, or t
  misc_feature (3591)..(3593): n is a, c, g, or t
  misc_feature (3596)..(3607): n is a, c, g, or t
  misc_feature (3609)..(3612): n is a, c, g, or t
  misc_feature (3615)..(3616): n is a, c, g, or t
  misc_feature (3618)..(3621): n is a, c, g, or t
  misc_feature (3623)..(3627): n is a, c, g, or t
  misc_feature (3631)..(3631): n is a, c, g, or t
  misc_feature (3634)..(3634): n is a, c, g, or t
  misc_feature (3636)..(3637): n is a, c, g, or t
  misc_feature (3639)..(3651): n is a, c, g, or t
  misc_feature (3653)..(3653): n is a, c, g, or t
  misc_feature (3656)..(3660): n is a, c, g, or t
  misc_feature (3662)..(3663): n is a, c, g, or t
  misc_feature (3666)..(3667): n is a, c, g, or t
  misc_feature (3669)..(3671): n is a, c, g, or t
  misc_feature (3673)..(3675): n is a, c, g, or t
  misc_feature (3677)..(3684): n is a, c, g, or t
  misc_feature (3686)..(3688): n is a, c, g, or t
  misc_feature (3694)..(3698): n is a, c, g, or t
  misc_feature (3701)..(3702): n is a, c, g, or t
  misc_feature (3704)..(3715): n is a, c, g, or t
  misc_feature (3717)..(3722): n is a, c, g, or t
  misc_feature (3724)..(3729): n is a, c, g, or t
  misc_feature (3731)..(3732): n is a, c, g, or t
  misc_feature (3734)..(3734): n is a, c, g, or t
  misc_feature (3736)..(3738): n is a, c, g, or t
  misc_feature (3741)..(3748): n is a, c, g, or t
  misc_feature (3751)..(3751): n is a, c, g, or t
  misc_feature (3753)..(3754): n is a, c, g, or t
  misc_feature (3757)..(3760): n is a, c, g, or t
  misc_feature (3762)..(3762): n is a, c, g, or t
  misc_feature (3764)..(3767): n is a, c, g, or t
  misc_feature (3769)..(3770): n is a, c, g, or t
  misc_feature (3773)..(3774): n is a, c, g, or t
  misc_feature (3776)..(3777): n is a, c, g, or t
  misc_feature (3779)..(3780): n is a, c, g, or t
  misc_feature (3782)..(3790): n is a, c, g, or t
  misc_feature (3792)..(3795): n is a, c, g, or t
  misc_feature (3797)..(3808): n is a, c, g, or t
  misc_feature (3810)..(3814): n is a, c, g, or t
  misc_feature (3816)..(3816): n is a, c, g, or t
  misc_feature (3819)..(3821): n is a, c, g, or t
  misc_feature (3824)..(3828): n is a, c, g, or t
  misc_feature (3831)..(3832): n is a, c, g, or t
  misc_feature (3834)..(3834): n is a, c, g, or t
  misc_feature (3836)..(3841): n is a, c, g, or t
  misc_feature (3843)..(3846): n is a, c, g, or t
  misc_feature (3848)..(3852): n is a, c, g, or t
  misc_feature (3855)..(3856): n is a, c, g, or t
  misc_feature (3858)..(3861): n is a, c, g, or t
  misc_feature (3863)..(3864): n is a, c, g, or t
  misc_feature (3866)..(3866): n is a, c, g, or t
  misc_feature (3868)..(3871): n is a, c, g, or t
  misc_feature (3874)..(3875): n is a, c, g, or t
  misc_feature (3877)..(3877): n is a, c, g, or t
  misc_feature (3879)..(3883): n is a, c, g, or t
  misc_feature (3885)..(3889): n is a, c, g, or t
  misc_feature (3891)..(3891): n is a, c, g, or t
  misc_feature (3893)..(3893): n is a, c, g, or t
  misc_feature (3895)..(3895): n is a, c, g, or t
  misc_feature (3897)..(3897): n is a, c, g, or t
  misc_feature (3899)..(3899): n is a, c, g, or t
  misc_feature (3902)..(3902): n is a, c, g, or t
  misc_feature (3905)..(3908): n is a, c, g, or t
  misc_feature (3910)..(3910): n is a, c, g, or t
  misc_feature (3912)..(3912): n is a, c, g, or t
  misc_feature (3914)..(3914): n is a, c, g, or t
  misc_feature (3916)..(3916): n is a, c, g, or t
  misc_feature (3918)..(3918): n is a, c, g, or t
  misc_feature (3922)..(3922): n is a, c, g, or t
  misc_feature (3924)..(3931): n is a, c, g, or t
  misc_feature (3933)..(3935): n is a, c, g, or t
  misc_feature (3937)..(3943): n is a, c, g, or t
  misc_feature (3945)..(3950): n is a, c, g, or t
  misc_feature (3952)..(3953): n is a, c, g, or t
  misc_feature (3955)..(3955): n is a, c, g, or t
  misc_feature (3957)..(3960): n is a, c, g, or t
  misc_feature (3962)..(3962): n is a, c, g, or t
  misc_feature (3964)..(3964): n is a, c, g, or t
  misc_feature (3966)..(3972): n is a, c, g, or t
  misc_feature (3974)..(3978): n is a, c, g, or t
  misc_feature (3980)..(3980): n is a, c, g, or t
  misc_feature (3982)..(3985): n is a, c, g, or t
  misc_feature (3988)..(3989): n is a, c, g, or t
  misc_feature (3991)..(3991): n is a, c, g, or t
  misc_feature (3994)..(3996): n is a, c, g, or t
  misc_feature (3998)..(4000): n is a, c, g, or t
gctgatggcgcctaggtcgtgcaagatgtcttctgctgcgatggtttctttgcgaatacggctctctgcaaaggccaagtcttctgcaattgaaggatcgaggtggtggcaaaccatcagcatgtcaacgtgttcgtcgagggtgttgatggtgtagggccgcgttggattggtagaggagggcagcacgttggcttcgccnaccactttcaaaatgtcgggggcatgaccgccacctgcgccttccgtgtggaaggtgtgaatggtgcggcctttgaatgctgccacggtgtcttccacaaaacccgattcgttcagggtgtcggtgtggatggccacttgagtatcggtttcttcagccacgttcaaacagttatcaatggctgcaggtgttgtgccccagtcttcgtgtagtttgaggccaatgacgcccgccttgatttgttcgtgcaatgcagcaggcaaagcagcattgcctttgcccaagaaacccaagttcatggggaatgcatcagctgcttgcagcatgcgctcaatgttgtgcgggccaggcgtgcaagtggttgcgaaggtgccagttgcaggcccggtgccaccacccagcatggtggtaattccgctggacaaagcttcttctatttgctgcggtgctatgaagtgaatgtgcgtatcaatgccacctgcagtgacgatcatgccttcgcagctgatgatctctgtgccggggcctatgatgatatcgacaccaggttgcgtgtcggggttgcctgctttgccaatggcggcgatgcgattgcctttgaggccaatgtcggccttcacaatgccccagtggtcaataatcagggcattggtgagcacgcaatccatggcgccttctgcgttggtgcgctgcgattgcgacatgccatcgcgaatggttttgccgccaccaaacttcacttcttcgccgtagctgccggcctgtaatgtgaaatctttttcaacttcaatgatgagctcggtgtcggccaagcgaacacggtcacctacggtggggccaaacatttcggcgtaagcgcgtttgttgatatgggccatgttaagaaactttcttggaaggcgcgtcaagcgcgccgttggtcagggctctaaagccatagatcacgcggtcgccagcgtagtcgaccaattcaacggtgcgttgttggcctggttcaaatcgaacggcggtgcctgaagccagattgagtcgcatgccatgcgctgcagctctgtcaaagctcagaccgccattggtttcagcaaagtgatagtgcgatcccacttgaatggggcgatcgctggtgttttgaaccaccagtgtgcaggtccgtctgccaacattgaggtcgtggtggccttcgtcgatgaggagttcgccnggnatcatgatcgggtccttaaacaatgggttgatgcacggtgaccagcttggtgccatcaggaaaggttgcttcnacttgaatgtcgggaatcatttctgcaataccgtccatgacatctgcacgtgtgagcagggtgcgaccttcgctcatgagttgggccacggttttgccatcgcgtgcaccttccatgacggctgcactgatgtaggccacagcttctgggtaattcaattgaaggccacgggcttttcggcgctcggccaagagccctgctgtgaatatgaggagtttgtctttttcgcgtggggtgagttccatggtgcactcgtttgaagttcagattcaagcttacctcaagcaacatgcatgcccttgagcttcttgagaatctttgggctgcaccgcaaaagggcataactattttggtgccgacaaagatgaaatgcacaaacttggttcattttttggantttggcctgcctcatgtgtggggaaactcgttctacattgaatcgaattaggtcatttccnctctcaacgggattggaaacccaagtgttggcacagcccttgcagaaggctaancagcgttgcagttcttcgcttgtttaccaaccttccttaatttgattggagtgctcttatgttgaatcgtcgtggcaatctcaaagccttggccctagcgtctgccctcgtggccggtggcttgtctttctctgtacaagctcaaacgtctaacaccatcaaagtgggcatcttgcacagcttgtctggcaccatggcnatttctgaaaccgtgttgaaagacaccgtgctcatggccatcgatgaaatcaacgccaaaggcggtgtgttgggcaagaaactcgaacccgtggtggttgaccccgcttccaactggcctttgtttgctgaaaaaaccaagcaactcttgggtcaagacaaagtgtctgtgatttttggttgctggacttctgtgtcacgtaaatctgtgttgcctgtggttgaagaaatgaacggcttgctgttctaccccgtgcagtacgaaggtgaagagctgtctaagaatgtgttttacacaggtgcagcacctaaccaacaagccattccagcggttgactatttgatgagcaaagacggtggctctgccaagcgttgggtgttgttaggtaccgactatgtgtacccacgtacaaccaacaaaattttgcgcgcttacttgaanagcaaaggcgtgaaagattctgacattgatgaaaaatacacaccctttggtcattcagactaccaaacgattgtggcggacgtgaagaaattttcagctggnggtaaaacagcngtggtctccaccatcaacggtgactccaatgtgcctttctacaaagagttgggcaatgcaggcttgaaggccaaagacgtgcctgtggttgcgttctctgtgggtgaagaagaactncgcggngtggacaccaagccnntggtnggtcacntggcngcttggaactacttcatgagcatcaaganncccgccaangacgagttnacnaaaaagtgggnngcntatgccaaggccaanaacattgcaggtcacaaagacaagcctttgaccaangacccgatggaagccacttacattggtatcaacatgtggaagcaggctgttgagaaggccaagtctactgatacagacaaagtgattgctgccatggctggtcagaccttcacagcacctagcggtatcacatctaagatggatgagaaaaaccaccacttgcacaagtcagtgttcattggcgaaatcaangcngacggccaattcaatgtggtttggaaaacancaggccctgtgaaagccaagccatggagcccctnnattcctggcaatgacnngaagccngacganccngctaanaagtaatttntgaagctcgtccnagagganggacggcttcgtccttcctctttttttnnnnnncnnnaannnnnaannnnnntcnnttnannanntngncnnnnnnntttttnnnngnttnnnnnnnngnnnnngncntnntngncnnnncnnnnaangnnnnnnnnnntnncnnnnnnnanggnntngntnnangnnnnnncnnnnnaannantnnnanncnnnannaanntnntnnnnnnggnnnnnnaaannnnntngnnnttntnnnannnttnnnnnnnnnnnncnnnnaanntnnnngnnnnnaaanttngnntnnnnnnnnnnnnntnggnnnnngnnaanncnnngnnncnnnnnnnngnnnaaaaannnnnttnncnnnnnnnnnnnnannnnnngnnnnnnannancnnnttnnnnnnnnaantnnaannnncntnnnngnnttnnanntnntnnnnnnnnnannnnannnnnnnnnnnnannnnncnaannnttnnnnnaannancnnnnnncnnnnannnnnccnntnnnnannangnnnntgnncnannnnnannnnncnangntntnaanttnnnncnantngncnaagncnnnnnnnnannngnnnnnnncnnnnnngnngntnnnntngnannnnnnnannnnntngnnnnaanncnaannncnnn

SEQ ID NO: 1427 - DNA, 4000 bp, Escherichia coli
  misc_feature (1)..(1521): n is a, c, g, or t
  misc_feature (1609)..(1611): n is a, c, g, or t
  misc_feature (1614)..(1618): n is a, c, g, or t
  misc_feature (1620)..(1621): n is a, c, g, or t
  misc_feature (1623)..(1625): n is a, c, g, or t
  misc_feature (1627)..(1627): n is a, c, g, or t
  misc_feature (1629)..(1631): n is a, c, g, or t
  misc_feature (1633)..(1634): n is a, c, g, or t
  misc_feature (1673)..(1675): n is a, c, g, or t
  misc_feature (1743)..(1744): n is a, c, g, or t
  misc_feature (1746)..(1746): n is a, c, g, or t
  misc_feature (1945)..(1945): n is a, c, g, or t
  misc_feature (1987)..(1987): n is a, c, g, or t
  misc_feature (1991)..(1991): n is a, c, g, or t
  misc_feature (1996)..(1996): n is a, c, g, or t
  misc_feature (3730)..(3730): n is a, c, g, or t
  misc_feature (3757)..(3757): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgacattcgcatgtgtattaattaatacacacacatgcatcgttgcacgcgcgtgtcatgatcacgggtcaggactcaagagtatannngtnnnnntnngnnnanannntnncgatgcgtcgtccgtcccgacggcccgacgccccgcacnnngacgcgcgccgacgcgcgaccgcgcgatggcgcgcgcgcgcgcggcgccgacctcgcgcctcgcgacnncncgcgcgcgtctcgcgaccgcgcgaccgcgcgcgcgcgtcgcgagacgcgcggcgacgccggacgacgacgcgacaaaaaactgccggcggctcgtggtgcgcgaattgcgcgagcgattgatcgcgtccggcgcgcacgacgccgcgatcgtgcgtcgtgcgaacaaggcggcgttggtggagatgtgcgaagcgctgntgcggcgggagcgcgcgcgcgagcgcggcgcggcgagcgggngagnggggncgcgcgaggacgagggggagacggcggaggcgggcgacgaggacggcgaggcgacggcgacgggggacgcgattcgagcgcacgggggagggtatcagcgcacgatgtttaatgggaaggttgtagacgccgtttcgggggggtcgacggcgttggaggaggatatgaagtcgaattttagcggcgcggagttgacgtttctcggcacgtcgagcggggcgccgagctttacgcgaaacgtctcgtcggtggcgttgaggttagagaacgaggtttggttgtttgattgcggtgaggcgacgcagcatcagttgatgcggtcgaagctgaagtatgcgaagatcacgaggatttttatcacgcacatgcacggggaccacatcttcggtttgcccgggttgatttgcgcgattagcggcgcgcgcacggcgcactcgaggtcgtacggtggttctgtcgtgcctttgcacatcataggcccgccggggatacggcagttcatttactcatccatcacgtggtcgagatcggtgctcgggatgccgctgatcgtgacagagttgaggcagcctgcgcgcgcgagcggcggctcgcccgcggcgcacacgtcggtcgatccgcgagggaagattttcatgggcgaatattggcccgataacgtctccgaaccgctgccgcacttcagagacgccgcacgatggaacgaactcgggatgagcgagcagctgccgatttggaccgcgtataacgatggaaacttttgcgttcgcgcctcggtgctgcgacatcccgtgccgtgcttcggttacgtcatcgacgagtgtgacgccagcggtcggctcgacgccgagaagtgtgtggagatgggactgcctccagggcgcgaatatgccatgcttaaagcagggcagtcggtgacgacgaaggatggacgcgtgattcgtcccgaagacgtcataggcacgcctcgaccggggcgtcgactggtgcatctcggcgacacgtgcgacagcagctcgatggtttccctggcgcagggtgcggattccttaattcacgaatctacgtttgaagcaaagaaagtgtcagaggcgctgtacaaaggacactccacggcgcgcatggctgggaagtttgccgcgcaagtcaacgcgcgcgcgttgattttaacgcatttttcaaatcgctacgccggcggcatccatcgcgctgattcaaacagcgatgatctcggtgccagcggagacgacgacgacgacgacgaagatgattgtgaagatatgtcgccacccgatgtcgactccgacggcgaagcactcgccgagggcgatcgcatgaacgtcgagcgtctcgtcgaggaagccaaggaggccaagggcgactcgcgcgtcatcgccgcgagcgacttcttcgtcttcaacgtcggtcggcgcgaagagttcgacgatttcgatttctccaagggtgatcgatcggtgttattcgccagcccccgcaagacgaccccagagacgttcgtcgtcgatcaggacgacggccgcgcgtcgtcgtcatcgggtggcgacgatcgagaccgtcgaccgcggcgaggcggcggctccgccgaccgtggcggtcgcggccgcggcgcccgggccccggttagtggacgctatcagcggtcgccatcttcgcaatagctttcacgcgcgagctcatgtaaacatacacaccgtcgagtcgacgcgccgtccngaagcccctatccacgacgtccccttnccacgcggtcatcactgtgcgccgcggacccgaattcgcgcgccatgttcgccgcccgcgcgcccgcgaagctcgccgcgtcgcccgcgcgcgcgtcccgcgcctctcgcgccgtcgtcacgtgcggcgcgtctcgtaaagcgcgccgagcgcaaaccggcggcggcggcgccgacgcggcgacgaaacccaaacccgcgctgagcgcggcgaacaaagccgcgcgcgataaagctcgcaaag

SEQ ID NO: 1428 - DNA, 4000 bp, Escherichia coli
  misc_feature (1989)..(1989): n is a, c, g, or t
  misc_feature (2297)..(2297): n is a, c, g, or t
  misc_feature (2302)..(2303): n is a, c, g, or t
  misc_feature (2312)..(2313): n is a, c, g, or t
  misc_feature (2318)..(2319): n is a, c, g, or t
  misc_feature (2324)..(2324): n is a, c, g, or t
  misc_feature (2327)..(2327): n is a, c, g, or t
  misc_feature (2329)..(2330): n is a, c, g, or t
  misc_feature (2333)..(2334): n is a, c, g, or t
  misc_feature (2336)..(2337): n is a, c, g, or t
  misc_feature (2339)..(2340): n is a, c, g, or t
  misc_feature (2343)..(2344): n is a, c, g, or t
  misc_feature (2347)..(2347): n is a, c, g, or t
  misc_feature (2350)..(2350): n is a, c, g, or t
  misc_feature (2353)..(2353): n is a, c, g, or t
  misc_feature (2355)..(2358): n is a, c, g, or t
  misc_feature (2361)..(2361): n is a, c, g, or t
  misc_feature (2363)..(2363): n is a, c, g, or t
  misc_feature (2367)..(2378): n is a, c, g, or t
  misc_feature (2380)..(2380): n is a, c, g, or t
  misc_feature (2383)..(2383): n is a, c, g, or t
  misc_feature (2387)..(2387): n is a, c, g, or t
  misc_feature (2389)..(2390): n is a, c, g, or t
  misc_feature (2393)..(2394): n is a, c, g, or t
  misc_feature (2398)..(2398): n is a, c, g, or t
  misc_feature (2403)..(2404): n is a, c, g, or t
  misc_feature (2411)..(2413): n is a, c, g, or t
  misc_feature (2415)..(2422): n is a, c, g, or t
  misc_feature (2424)..(2425): n is a, c, g, or t
  misc_feature (2428)..(2441): n is a, c, g, or t
  misc_feature (2443)..(2444): n is a, c, g, or t
  misc_feature (2446)..(2447): n is a, c, g, or t
  misc_feature (2449)..(2450): n is a, c, g, or t
  misc_feature (2452)..(2453): n is a, c, g, or t
  misc_feature (2455)..(2459): n is a, c, g, or t
  misc_feature (2461)..(2463): n is a, c, g, or t
  misc_feature (2465)..(2471): n is a, c, g, or t
  misc_feature (2474)..(2475): n is a, c, g, or t
  misc_feature (2478)..(2479): n is a, c, g, or t
  misc_feature (2481)..(2484): n is a, c, g, or t
  misc_feature (2486)..(2487): n is a, c, g, or t
  misc_feature (2493)..(2494): n is a, c, g, or t
  misc_feature (2496)..(2496): n is a, c, g, or t
  misc_feature (2498)..(2499): n is a, c, g, or t
  misc_feature (2503)..(2503): n is a, c, g, or t
  misc_feature (2505)..(2505): n is a, c, g, or t
  misc_feature (2507)..(2513): n is a, c, g, or t
  misc_feature (2517)..(2517): n is a, c, g, or t
  misc_feature (2519)..(2526): n is a, c, g, or t
  misc_feature (2528)..(2528): n is a, c, g, or t
  misc_feature (2531)..(2532): n is a, c, g, or t
  misc_feature (2534)..(2534): n is a, c, g, or t
  misc_feature (2536)..(2537): n is a, c, g, or t
  misc_feature (2539)..(2539): n is a, c, g, or t
  misc_feature (2541)..(2541): n is a, c, g, or t
  misc_feature (2544)..(2545): n is a, c, g, or t
  misc_feature (2547)..(2549): n is a, c, g, or t
  misc_feature (2551)..(2562): n is a, c, g, or t
  misc_feature (2564)..(2567): n is a, c, g, or t
  misc_feature (2569)..(2569): n is a, c, g, or t
  misc_feature (2572)..(2572): n is a, c, g, or t
  misc_feature (2574)..(2580): n is a, c, g, or t
  misc_feature (2582)..(2583): n is a, c, g, or t
  misc_feature (2585)..(2587): n is a, c, g, or t
  misc_feature (2590)..(2593): n is a, c, g, or t
  misc_feature (2597)..(2598): n is a, c, g, or t
  misc_feature (2600)..(2600): n is a, c, g, or t
  misc_feature (2603)..(2604): n is a, c, g, or t
  misc_feature (2607)..(2607): n is a, c, g, or t
  misc_feature (2609)..(2609): n is a, c, g, or t
  misc_feature (2611)..(2611): n is a, c, g, or t
  misc_feature (2613)..(2625): n is a, c, g, or t
  misc_feature (2630)..(2630): n is a, c, g, or t
  misc_feature (2632)..(2632): n is a, c, g, or t
  misc_feature (2652)..(2652): n is a, c, g, or t
  misc_feature (2658)..(2659): n is a, c, g, or t
  misc_feature (2664)..(2664): n is a, c, g, or t
  misc_feature (2698)..(2698): n is a, c, g, or t
  misc_feature (2707)..(2707): n is a, c, g, or t
  misc_feature (2710)..(2710): n is a, c, g, or t
  misc_feature (2713)..(2713): n is a, c, g, or t
  misc_feature (2716)..(2716): n is a, c, g, or t
  misc_feature (2719)..(2719): n is a, c, g, or t
  misc_feature (2785)..(4000): n is a, c, g, or t
acaaagatatacaagattaaagcaacaaaaacaaagagtatatgctcaaagaggaagacgttctaagaatagtggcaatgaaggaaatagcaatggaaatggaaatactttaaatacagaagaaaataatatctttaataaaaacaatatattaaatcttaatgagattcaacaataccttttgaatgaagaaaagaatagtaaaaagaataatggattgctacaagtgtcttcaagtaatatgaatactactccaccatcgatgacaacaacaccaaactttagtctttctacccacttaaataataatacaaaattgaataatgccaattctatcgattttaatttacctctggataaatctattattaatggtaatgaagatgatgctagtaaaaagaataaggatttatattctcaacttttaaattctatgggtagcagcaatacttctcctcctcctcctccaaaggtgaaaagtggaaagagagagatgaaggttgtcgactccaccacaattcttagtaaggtgaatgatagaagtaaggagattgcagaaaagaaaaagagaagatctgctgcaactatgagatgtcgagaacgaaagaagaatcaattacaaaagaaggaacaatatattaaatatttggagaatcaaattttatttttgaatggatccattttacatatgagtaatgaaattacgtggttgagaagatcttttcttgatcagtatggtgaacaatcgcttaaaaatatttatttgaaaaatggatttaagaatgttaactttgatagtgtcatgtactctggatcaagtccatttagtccatccacatttaccaatacaagtatgttatcgcctgatttaacgctaagtccaggaagtggacaagaacaaaaccaagatcataaccaaggttcagatcaagattctagctttttaactcctgcttccccttcatccttgaaaaatatttcttcaacatcgacgaccgatacggttactactacgaccaaaaagaggtcaacgaagacgacagctactgattccatagttataggtgatgatgatgatactcatggttcatctactacccgtcgtagagaaaatcatagtcatttcatggcaggagcaactcctacctcaacaaattccaatactggtgtacgtagtcatcgtagcggtcaagaggataatagtaattcaggttttcttcgtacctaccaacctactccgacttcaaccctagatcaatcttcaccatctgtgtcttcgttggataatgttgaaaccctttcaagccaaaaggatctctttagtcaacttgatatggaaactctgaatgaatttacaagattatccaaggaacaaagagaaattttattgaagatattggaaagacaacaaataggtaatactaaggataatcctgctcctccgccaccgcaaaggaactatataaatattgccgctaatgatgaagaggtgaatggtggtaatagtcgtatgatttcaaaaccatcgtcttcattattaaattttgatccagcttcgactgctgccaatactaatcaatttaattcgttatctccaaatcttttgcaatccttaaatcaacaagacttacaaacgatttcattccgttcttcttctatgacacttccatcctcctctgctgtatcaggaccatcttcttctgttactacaaccacgaaggatcaaattttcttaactccttcatcacataccgctaatactaatagtcttaacttaacgacatcttctgatctattaacatcacttaatgcacaaaataatcttcaaaatagtaatccagtatcttctaccatttcaaaggattcaaccacaagtggaatacctacatctacaaatactcaagattcagagtatatcaatttagaaaatttaatttattatatttagaaagtttttatttttttttttttttttttaaaaaaaaaaanaaaaaaaaaatttttaattttttatttcattctattctttttcctatttttcattttcattttcatttattattatatatatatatatatttttaataattattataacatgacttttaaaaaaaaaatggttatatttataaaacataatagtatcatggaaatatatataaattctaacgtaatattaaaatagtcttgttcatgcatttactataatacttttaatggtataaaatggtcaagatttaaaaaaagtaaataaataaataaataaaatttaaaaaaaaaaaaaaaaaaaaaaaaanaaaannaaaaaaaannaaaannaaaanaanannaannannannaannaanaanaanannnnaananaaannnnnnnnnnnnanaanaaanannaannaaanaaaannaaaaatnnntnnnnnnnntnnttnnnnnnnnnnnnnnannannannannannnnnannnannnnnnnaannatnntnnnnannaatatnnanannaaananannnnnnntaanannnnnnnntntanntntnnantntanntnnntnnnnnnnnnnnnannnntnttnannnnnnnanntnnnaannnnaaannanaanntanananannnnnnnnnnnnnatttntnattattatttaattttatanatatannttatnttttatttttttttttttaatttttttttttttnatttttttnttnttnttnttnttttttttttttctttttttttttttttttttattttttttttttttttattttatagcttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1429 - DNA, 4000 bp, Escherichia coli
  misc_feature (1375)..(1375): n is a, c, g, or t
  misc_feature (1999)..(1999): n is a, c, g, or t
ttgtttaaaggcagagaatatctactacatcggtgatttgatccgacgtacagaggttgagctgttaaaaaccccgaacctagggaagaagtctctgacagagatcaaggacgtcctcgcatccaggggcctatctttgggtatgcgtttagaaaactggccaccgtccagcttacgtggtgatgaccggttattgggttaagcagcattggtgtgtaccgggcgactgaacgtgatactcgctggtacaaattattcagattgttatagatagtaattcaggaacttaggtcatgcgccatagaaagagcggtagacaattaaatcgaaatacatcgcaccgtaaagcgatgtttaaaaatatggcttgctcgttgttcgagcatgaagtcatcagaaccacagtgccaaaggcgaaagaactgcgtcgggttactgaaccgatgattaccattgcgaaagttgattcagtcgcgaatcgtcgattgattttcgctcggactggcagtaaggcaatggtgggtaagctattcacagaaattggcccaaggtatgcagagcgcccaggcggctacactcgaattttgaagtgtggattccgtaccggtgacaaagcacctatggcgtttgtggaaatggtcgatcgtccgatacccgacttcgacaatgtcgaagagatagatgacgacgagtagctcgaagtctaattaatgaataagcgtcaaataaagtaaaaagaccgggcattcccggtctttttgcgtcaggagtagcgccgatgtatcaatcgtttgtacccacgttgagaacactaatgggccccgggccctctgatgtcaatccgcgaatattaacggcgatggcgcggccgaccatcggccaccttgatcctgagttcattcgaatgatggatgaaatcaagggtatgttgcagtatgcgttccagactaaaaatgaactgacgctacccgtttcggcgccaggctcagccggtatggaaacctgtttcgttaatttaatggagccaggtgacaaggtcatcgtctgtcaaaacggggtctttggtgggcgaatgtccgaaaatgtgcggcgacttggtggcgaagcggtcatcgtcgagcaagtttggggccgggccattgatcctgagcagttggaggcggcgctacgccagcacccagacgcaaaaattgttgcatttgtgcatgccgagacatcgaccggcgtgcagtccgatgcgcagacattgtgcgcgcttgccaaggcccatgactgcctgaccatcgttgattgcgtgacttctttagcgggtactgaagttgcattggatgcttggggcgcggatgcggcctacagcggcacacaaaaatgtctntcttgtgcgcctggcttatcccccatcagtctgagtcaacgcgctgtggataccgttaaatctcgaaaggcaccggtgagttcctggtttttggacttgaatctggtcatgggttattggggtgaagggcaaacacgtagttaccatcatacggcgccggtcaatgcgctctatgggttgcatgaggcattagtggtgttgcacgaagaaggtttggcgtcgagttggagtcgccatgcacggaatcataatgcgctgaaagctgggctagaagccatgggactgacattcgttgttccagaagccgagcggttgccgcagttgaacctggtcagcgtacctgaaggtgttgatgaggccagtgtgcgcaagcaattgctgcaacagtacaatctggaaattggcgctggcctgggtagtctggccggccgcgtctggcgaatcggtttaatgggatttgccagcaacccaaaaaatgtgctgttctgcgttaatgcgttagaagcggtattgtcacaatataacgcgccaattcatcgaggcgttgcgactggcgccgtccaggcagcctataaagtttgatgtaagtgggtgcttacatactaagcgggcgtccaaaaacancgttcgcccccttttaattaacgacggtttgcttttcacggtcgctggccgcgagcaatacgtcagctagaaactgtccggtaaacgagtgcggagacgcggccacatcttccggggtgccgctggcaatgatctcgccaccgcctgaaccgccctcgggtcccaagtcgataatccagtcggccgtcttaatcacatccagattgtgctcaatgacaacaatcgtgttgccgtgactgcgcagctttgacagaacttccagcagttgtttaatgtcgtggaagtgcagcccagtggtaggctcatcgagtatgtagagagtttggccggtatcacgtttagacaattctcgggccaacttaatccgctgcgcctctccgcctgatagcgttgtagcactctgacccaggcgaatatagccaagcccaacgtccattaaggtttgcaagcgacgctctatcataggcactgcattgaaaaactgatgcgcgtcttcaacggttaagctcaaaatttcatgaatgctcttgttcttatagagcacctcaagagtttctcggttgtagcgtttgccgcgacattcatcgcaggttacgtaaacatcggcgaggaagtgcatttcgactttgatcaggccgtcgccctgacaggcctcgcaacgcccgcccttgacgttgaaactgaagcgtccgggcttgtagcctctggatctagcctccgatgttgcggcaaacagttcacggatcggagtaaagatattggtataggtcgctgggtttgagcgtggtgttcgtccgatagggctttgatcgatatcgaccactttatccaaatgctcaatgccttggatagaatcgaagggtgcggtctgaggattagtcgccccgtttaacgccttggccgcaataggatatagggtgccgttgatcagcgtcgacttacccgatccagacacgcctgttacgcaagtcatcaacccaatgggaatattcaggtttaccttttgcaggttattaccacgcgcgccgaagatacggagttgtttgtcaggatccgcgggttgtcgctgagccggcactgcaatctgacgtttgcctgatagatattgaccagtaatcgacgcctcactgttaagaatgtcgctgagcttaccttgggcgatcacgtgcccgccatgaacgcccgcgccggggccgatgtcgacaatgtgatcggcggcgcgaatggcttcttcatcgtgctccaccacaatcactgtattaccgatgtcacgcagatgcgtcagggtattgaggagtcgctggttatcgcgttggtgtaagccaatcgacggttcgtcaagaatgtacatcacgcccaccaggcccgcgccaatttggctagcaagccgaatacgctgggcttcaccccctgacagcgtgtctgcgcttcgtgacagcgacagatagttcagaccaacatcaatcagaaaacgtaagcgggcgctaatttcctgcagaattttctcagcgatctgttgccgttgcccctgaagtgccagtgtggaaaaataatccagcgtctccttgatagaccaatgagtaatttcagataaagacctgccgttgatggtgaccgcccgggcgtcgggattcaagcgcgtgcccgcgcaggaaggacattgttgcgtgctcataaacttggctaaattttcgcgaaccaggctcgactcggtatcgcgataacggcgctccatgttaggcacgatgccttcaaaggggtgggctcgcgtataggtgtcgcccttgtcgttgacgtaacgaaactggatcatttcggcttcgttgccgtacaggatagtctggcgctgatccggttctagctcaccaaacggtgtcgtcatcgaaaattcaaaatgttccgcgatcgatgttagcatctgatagtagtagacgttgcggcgatcccagccctgaatagcgccttctgccagggacaactcatcatcgaagacaatttgct

SEQ ID NO: 1430 - DNA, 4000 bp, Escherichia coli
  misc_feature (362)..(362): n is a, c, g, or t
  misc_feature (446)..(446): n is a, c, g, or t
  misc_feature (710)..(710): n is a, c, g, or t
  misc_feature (725)..(725): n is a, c, g, or t
  misc_feature (1082)..(1082): n is a, c, g, or t
  misc_feature (1123)..(1123): n is a, c, g, or t
  misc_feature (1129)..(1129): n is a, c, g, or t
  misc_feature (1199)..(1199): n is a, c, g, or t
  misc_feature (1472)..(1472): n is a, c, g, or t
  misc_feature (1775)..(1775): n is a, c, g, or t
  misc_feature (2907)..(2907): n is a, c, g, or t
  misc_feature (2910)..(2910): n is a, c, g, or t
  misc_feature (2912)..(2913): n is a, c, g, or t
  misc_feature (2916)..(2916): n is a, c, g, or t
  misc_feature (3241)..(3241): n is a, c, g, or t
  misc_feature (3513)..(3513): n is a, c, g, or t
  misc_feature (3657)..(3657): n is a, c, g, or t
acagttgcatcagtccgtaatcggttacctgatatccatcctgctgcaatccggcgatggcatctgcgccaagttcggtcggtgtaaaataccagaacctgtcggaatccgcctggttgtaatctccgttcacgatttcattatccggatagtaataatacagcacggtccaacccagatgttttacaccattcgtgaccatatttacatcctcatcgggggtaccgatcagatccagtgtcttttcggtctccaccttctgctgttcatagctgtcatagcattcccgatagttctgaattcccaggccgaataatactaccagcaataccgccagcacaattctgcttacagcctccagncccttccaggacttcttctccagctctgcagccagttccagcacacggctgctgcccaccgccagcatgacgattgccaccgcncttaacggatacagatatctctgtgccagcatcggtgccataacaacacttaacaaataagcaaatgccaaagttccaaggattgtgcaggctcccactgccatggcatatgtcttgtcagaccagtttctcacagaaggcttctgcatatgtactccgtctttttccacagagaatacagaagaatccactgccagggtcaccaccagaaacagaatcaccaacgggaatacgataccattcatccctctgccgcccataacnatctccagactctgntccagtcccaggatctctgtcatccaccagcctctgctgacatttttcaagccggcatagaagaaatatagccagggtgcataacctatgaaaaatgctacgatggccagaacaccctttatccatgttttcccacggtatttgatccatacggccactccggtgaaaaacatcataatgcctacagccaccagtgcataatagtgagaatacgctgctgccagtgcccacagcaccatgcctgcccaggtcttcctgctgccgtcagcaatgactctgtaggaacaatagaagcaacccattacacacaggaaagccagcgcatacatgcggacttccagattgtactccagacangcctgtcccagaccggagatcatcacaaaaaatgttgccgnaagcantccgaaatgtttccgcacaacggtcagtgccagtacgatcccgatcacgaagggcaccagagaggccagntggaataccggtaccttatatccgaacagggtcccgaataatttcagccagtaataatacagtggcggatgattgtcccagtaatacaatacctgcaaaatgccatccacatccttgtgggccgtattcgcagaaaacgcctcatccccccacagtacgcggtcggacatcatgctgaaattcagacacaccaccagcactgtcaatgccagtactgccaccggtcctatgtatttgcgaaatacgctccacgccttgctgtcggtaatcttnctcaggacgctccggatcttctcatgctttccggctttcgcttcttccacgaacaattccgcaatggcatagaccagcatcatgctgatctccagacatagaactttcactgcatattctctggattccaacagctttctcaagatcgtattgccgtcattgccggtcagcgacaacaggatccagggaatgaccagcatacagagcaggcaggtgagatagcgaaggacatattctcccttcccgatcgtgacagactgtccgctttttttgttattttttaaaatagattgccgccagatnccaatggataccagcggcaacagcagggtaataatgatggtgaacatcgaatatcctctctgtcttttgtatttgtaactattcagagccatgtaaatagtatcgaatgagcgtcgaatccttgcattcgtaagagcatttgatactatttatagggcgaagtaaccaccatgagcaaaaaggaagcctcgcagaggcggttttgcgaatggtgttctgaatagttacatatatttattcttctacgtatttcaggatcgttgccgaggtctgtggcatctcgatcagaaccttgcctgccctgatctcatactccgcaccttccatgcaatacccgtcatccctggactgcaggatcactttcatcttacctgtcttaggggttccgatctcccacacatgaatctctttggtgatgggatgataattattgttgatcaggatcgcacactgccccttgcggttaaaacgtccgtaagaaataaagttgtagtcattttccagcattttcaaggagccgatccgcagctcctcgttctcccggcgcaggcggataatgtccttatgaaatgccagcagcacctgatcctcatgtccccagggatacgttctgcggttgtcaggatctgtgaaaccacagacaccggcctcatctccgtaatagattgtaggagcacccgtccatgtcatctggatcacaacgccttcccggaagactgccttattgataccctgttccgcagcctgcggtcccagtgtattggtacgtcccaccttatgatttgttctcgtcagaaaacgggaatgatcatggttggacagttcattcatagccacctgccagctgggcatggagaaactggaggtatgatgccgcatggctccccagaagctctctgcattgccgagcagatcctctctgtagtcatcgctgtgcttctccataccggtgaggaaccaggtcacgggctccatgaacgcatcgtagttcatgacagtatcccattcgttgccctgcagccagtctctggtattgccgtagtgctctgccagaataatagcctccggattggcctcttttaccgctttccggaattcctgccagaaatgatggttgaattcctgactgtgnccnanntcngctgccacatccagtctccatccatccacattgtagggcggagatacccattttttcgctacatgaaggacatagtccatcagttcctgggatccctcgtagttcagcttcggcagtgtgtcatgtccccaccatccgtcataggaattgttatagggccatgctgcctgattgtggaaatcaaagtaattccgataagggctgtcagcactgacataggcacccttgtcatatccttccgcattctcatagatgcgctctctgtccatccatttattaaaggaaccacagtgattgaacacgccatccagaatgactctcatgnctctgcggtgtgcctctgccaccacctgagcaaacagctcgttgctggcttccagattcgccttgttagtcacacggtcgatgtaacgggaagcaaaacggttctcccgctgtccgtcgggaagcagatccccttcatcactgacaatctttccaatatggggatcaatataatcataatcctgaatatcgtatttgtggttggaaggggagacaaacagaggattaaaataaatcacctcaactcccagatcctgcaggtagtccatcttntccagcacaccctgcaggtctccgccgtagaactcacggacatccatctgtgcgggataacgtccccagtcctctacgcggtgtaccggttctccgatgtagcaatattcattggtcaacacatcattggaagaatctccattncagaaacgatccgtatagatctggtacatgaccgctcccttggcccagtcgggggtgtggaaaccgggaatgataatgaaatcataatattcattaacttcctgcaccaggccccgcatatcaaagatgccggtaattctgccggtctgcacctcaaaataataagataccttctgatcatccagacgcattacgtaggcataatagtcaaaatcatttttgctctccacacgtaccataagatgcttctgtccgccgcataccaggaacactctgtccacattatttctggcggtccggaagcggatcgtcacttcggaaaaacaggccggctcttccggaa

SEQ ID NO: 1431 - DNA, 4000 bp, Escherichia coli
  misc_feature (1)..(2): n is a, c, g, or t
  misc_feature (4)..(12): n is a, c, g, or t
  misc_feature (14)..(16): n is a, c, g, or t
  misc_feature (18)..(19): n is a, c, g, or t
  misc_feature (22)..(28): n is a, c, g, or t
  misc_feature (31)..(43): n is a, c, g, or t
  misc_feature (45)..(45): n is a, c, g, or t
  misc_feature (48)..(48): n is a, c, g, or t
  misc_feature (51)..(53): n is a, c, g, or t
  misc_feature (55)..(55): n is a, c, g, or t
  misc_feature (57)..(60): n is a, c, g, or t
  misc_feature (64)..(66): n is a, c, g, or t
  misc_feature (68)..(70): n is a, c, g, or t
  misc_feature (73)..(73): n is a, c, g, or t
  misc_feature (75)..(76): n is a, c, g, or t
  misc_feature (78)..(82): n is a, c, g, or t
  misc_feature (84)..(92): n is a, c, g, or t
  misc_feature (95)..(95): n is a, c, g, or t
  misc_feature (97)..(98): n is a, c, g, or t
  misc_feature (100)..(101): n is a, c, g, or t
  misc_feature (103)..(103): n is a, c, g, or t
  misc_feature (105)..(106): n is a, c, g, or t
  misc_feature (108)..(109): n is a, c, g, or t
  misc_feature (111)..(117): n is a, c, g, or t
  misc_feature (120)..(121): n is a, c, g, or t
  misc_feature (124)..(126): n is a, c, g, or t
  misc_feature (128)..(130): n is a, c, g, or t
  misc_feature (132)..(137): n is a, c, g, or t
  misc_feature (139)..(142): n is a, c, g, or t
  misc_feature (144)..(146): n is a, c, g, or t
  misc_feature (148)..(153): n is a, c, g, or t
  misc_feature (157)..(160): n is a, c, g, or t
  misc_feature (184)..(184): n is a, c, g, or t
  misc_feature (274)..(274): n is a, c, g, or t
  misc_feature (298)..(298): n is a, c, g, or t
  misc_feature (451)..(451): n is a, c, g, or t
  misc_feature (595)..(595): n is a, c, g, or t
  misc_feature (859)..(859): n is a, c, g, or t
  misc_feature (1316)..(1316): n is a, c, g, or t
  misc_feature (1325)..(1325): n is a, c, g, or t
  misc_feature (1508)..(1508): n is a, c, g, or t
  misc_feature (1850)..(1850): n is a, c, g, or t
  misc_feature (1955)..(1955): n is a, c, g, or t
  misc_feature (1979)..(1979): n is a, c, g, or t
  misc_feature (1982)..(1982): n is a, c, g, or t
  misc_feature (1985)..(1985): n is a, c, g, or t
  misc_feature (1991)..(1991): n is a, c, g, or t
  misc_feature (2586)..(2586): n is a, c, g, or t
  misc_feature (2626)..(2626): n is a, c, g, or t
  misc_feature (2862)..(2862): n is a, c, g, or t
  misc_feature (2926)..(2926): n is a, c, g, or t
  misc_feature (2946)..(2946): n is a, c, g, or t
  misc_feature (3054)..(3054): n is a, c, g, or t
  misc_feature (3197)..(3197): n is a, c, g, or t
  misc_feature (3300)..(3300): n is a, c, g, or t
  misc_feature (3435)..(3435): n is a, c, g, or t
  misc_feature (3916)..(3916): n is a, c, g, or t
  misc_feature (3919)..(3919): n is a, c, g, or t
  misc_feature (3922)..(3922): n is a, c, g, or t
  misc_feature (3973)..(3973): n is a, c, g, or t
nngnnnnnnnnntnnngnnttnnnnnnnaannnnnnnnnnnnnanaanaannnanannnnaaannnannnaananncnnnnnannnnnnnnnacntnntnngntnntnnannnnnnnatnnttnnntnnntnnnnnnannnncnnntnnnnnnctannnnctaatcactacgcttccccaggtnaaaccactaccaaaagcagctaagacaagcaaatcattttccttgacacgtccttgttccaccgcttccgctaaggctattcctatagangctgctgtcgtgttcccatatttntgaatattgttgaacacctgagcatcagaaagtttgaatttctgttggataaactgggatatacgcaagttggcttggtgggggatgaatagatctatatctccttcggtaaggttgttagccttaagcccctccataatcacttctgagaancgtactacagcattcttgaagacaaactgtccattcatataagggtaataggaggtatcttctgggtcattttccttgataagatcggtaacccacttcttccctaccccaggggtaacgatggccaattcctctgcatgcgcnccctcactgtgtaggtgtgaagagagaatacctttaccttcttgggtagtgcgagagagtaccacagctcctgccccatctccgaaaagtactgccatattgcgccctcgtgtggtgaggtctaaggcgggcgactgcatctcagaagcgattaccaagatattcttatacatccctgttttgataaactgatctgctactgatagggcatatacaaagcctgaacattggttgcgtatatccaaagctcctatggtaccaagncctaactctttctgagctaaaaccccacaaccagggaaataataatcgggactaagggtcgcaaagataagaaaatcgatatcttccttatttattttcgctttttctatagctctctcggcggcacgtacccccatggaggtagtagtatctttccctcgggtggcaaatcgtcgttgttctatccctgtacgctctctaatccactcatcggaagtatccatcagcttagagagatcatcattggttacaatattttctggcacataatagcctgtgcctatgatagttgaattatacataagttatttaacattaaaaagaaagccttgataacaaggctttctattacaatatgatacttggttactttagtacttcttttactttgtcagctgcttcttggaactgaatagctgaatgcacagccaatcctgatttgtcaataatctctttngcaatctcngcattagttccctgtaggcgaacgataataggcactttaatatcagttcccatattcttataagcatctacaataccttgtgctacacggtcacaacgtacgatacctccaaagatattcaccaatattgcctttacatttggatcttttaggatgatacggaaagctgtttctacacgagcngcatcggcagtacctcctacatccaagaagttagcaggttctcctcctgcttgcttgataaggtccatggtagccatcgcaagaccagcaccattgaccatacatcccacattaccatccaagtctacatagttaagacccgcggctttggcttctacctcgataggtcgctcctcacgagtatcacgcaattcggcatagtccttatgacggaaaagagcgttatcatctatggtaactttggcatctaccgcaagtattttattatcagaggttttgagcactgggttgatttcgaacaaattcgcatcagaagtgatataagctttgtatagagaagtnacgaacttgaccatttccttgaaagcctctccttccagtcctaaattaaaagctacatttcttgcttgaaaagggagcaatcccaattctgggtctatctcttcngtaaagattaggtgaggagttttntcngcnactgcntctatatccatacctccttcggtagaatacataatcatattctttcctttagcacgattcagtaggatcgacatgtagtattccttaggctcgctttctcctgggtagaatacatcctcagcgataagtacttggtgtactttttttccttccttaggggtttgtggagttaccaaatgcatccctatgatttgggaagaaatttctttaacctgctccaagttcttagcaagcttcacgcctcctccttttcctcgtcctcctgcatggatttgagcttttactacataccattgtgttcctgtttgttctgtaagcttttctgctgctttgacagcttcatcggctgtagtggctacaataccacgctgtacacgtacaccgaagcttgagagaatttcctttccttgatattcatgtaaattcataatataactttaatttgtagtggcaaatgtacaaaaaaaatatgacatttccatgtttttttcatattttttttctcaatccttttttccttagaaatcagtcttgtgtagagagttcttttaacaattctcctaccaaggcatagatctctctgtaggaaagttcntccttgctcatatagagcaacgccaaggagtaggtacgcnctgtagagagcagcaccttctgatggcgatagctctcccttatcaggcgcttcattctattcctatccactgcttttttcataagccttttaggaacactgatgagcagttgggtaggttgtgtagagccttctataggggtatataggagcttcaatggatattttttcaatacctttgcctctcggaagagcttgtttaccctatggtaattacacaatctttctgccttgggnaaggtatttcttttttcttttagagaaaccattttatttagataaagtcgcataagcgagtatntgagtaaaaaccagccagtnttcacagctgtatatgcaataacaggtaacaaacaaaaacactttgcctattacctgttattttatctttttatgctatattaggcgttttcttcttcctcttctttncctgtaagaagtcggaaaccttcgccatggatatttacaatttctacattctcgtctttcttgagatatttacggagttttgctatatacacgtccatactacgagaagtgaagtagttgtcatctttccatattttgttcantgccaactcacgaggcatcaaatcattttcatgaagggctaataggcgcaatagttcattttctttaggagagagttttaggggttcttcatctctgtagcgnaggaaacgaagcttagagtttaggaaaaagtctcctatttggaattcgaattttttgctatctattactgtatcaattgactttctttggagcattgcacgaatcttcatgagcaatacttctgaatcaaaaggnttattcaagtaatcatcggctcctgatttgtatcctttgatcacatcctcacgcatagttcttgctgtaaggaaaatgataggcactttctcattcttttcacgaatttccttagcgagggtaaaaccatctttgtaaggcatcataacatcaagaatacacatatcataaggatccttgcggaacttatcaaaaccttccatcccgttcttggccaaagtaacatcgaagccactcatggataggtaatctttcaatacggtcccaaagtttgggtcatcttctacaagaagaatttttttattaactgcttccataatttcaacatttaaaaataatatatttttttacgtttatacaaaatttcatttattagatgataaggggcaccttgatcacaaacgtacttccttttcctttttcactctcggcatatacttccccatcgtgatattttacaatacgctttacataagcaagnccnagnccatgaccttttacattgtgcaaatcgcctgtatgttccctgtaaaatttntcaaagattttcttcagtacagccttg

SEQ ID NO: 1432 - DNA, 4000 bp, Escherichia coli
  misc_feature (368)..(368): n is a, c, g, or t
  misc_feature (1877)..(1877): n is a, c, g, or t
aatgttgcatggcatagtcttccacaaatggtggacgagaactcttgccgtaaccacgcaggttcggcgcccaagccgtatatccctggtcagcaagcataggcagctggtagcgccaagaatagctgctctctggaaagccgtgcagacagatagcgagcttgtcaccttcgccgcattggtccacctcgaaggtcaaaccattggcttgcacaaacctagtgatgattctcgaatctcgaggcgccgcgctgcggtcagccgtagtatctgtcattgcaatgatttcctgagtcttcaatcgtgaatgctaacagctattagatgttggccatcgcgcgccaacccatcataatttgacgagatcngtctgaactacatagactgctggtcattgtttctgtaaccgagtatctcatgacttatcctgatctcaaattcggcattttcctcgccccctttcatgccttgagtgaaaatcccactgcggcgctggcacgcgacctgagcctcattgagcgattggatgagttgggctacgattacgcctggattggcgaacatcactcagccgggtttgagattatcgcctcaccggaactctttatcgcggccgcagcacagcgcacccagcatattcacttcggtaccggcgtctcgtcactgccctatcatcacccgttcatgctcgccgatcgcatcatgcaactcgaccatatgacccgcggcagagtctcttttggggtgggtccaggtgccctgccctctgacgcgtttatgctgggcatcaaccctctggatcagcgcgacatgatgcttgaggctattgaggtgctggttcccctgctccgcggcgagactgtgacccgcaagacccgctggtttgaactcaatgaggcgagactccaactgcaaccctacacaaaacccatggtcaacatggccgttgcctcccaggtttcccctgccggtgccagagccgccggcacccatgggctgggtctgctgtccatcggcgccacgaacgctggtggcttcagcgcgctggcgaccaactgggaaatctacgcccgcaaggccaaagagcataagcaggtgatcgataggcgcaattggtcgttggtcggcccggtacatattgccgagtctcgagagcaggcattagacaacgtgcgctacggcctggaagcctgggtcaattacttccaagaggctgcggcactccccatcgccccgaatgagcctggcgttgatcaagcccaggcactgatcgatagcggcatggccgtgatcggcaccgcggatgatgcaatccagcaaattcagcggctacaggaacaatctggtggatttggcagcttcctgcaactggcccataactgggcagactgggagcagacctgcaaaagctatgaattgtttgcccgccatgtagcgccctgttttcagtccaccaatgccaaccgcaccgcaagctatgcctgggccagcaagaaccacgaccgcttcctcaacgctgtcggtggtgcgatccaacaagaaattgacaaagacgagcaagaaaagcaggccaagtgagaatctattcgctatactacgcgcttcacctcggtcctctcgcaacgaataattgcgaaccccgccaggcctggaagggagcaacggtagcgacgactttgtgtgccgggatgtggctgaggtgatctaatttcttttgtcgtggccgtgaaatcagcctgtcgctatgcccagcctagtctcggggcaaatcacgaccagaccaacaatcgtcaacagactcaattgaattgccagaccagttcagctaggctggcgcgctgctgtacgggcattatcgtatcatcagccaatcagcntagatcagttttacggagaggtgtccgagtggcttaaggagcacgcctggaaagtgtgtatgggttaatagctcatcgagggttcgaatccctctctctccgccaataccctatgtaaatcaatcacttatggtttgctgccttaaaagcccaacaaaaagcccaacatcaaataaacgctgtgttttggctaagtacctaagcccccggagcggctcaaggttgctactatcaattacctatacggccaagcagtttagtaatttttttgcttccgggtcgtttagatggtcacaaactttgctacgccacctcgatactcacctgacccaccacaccgctgatttatttttaacccgcgcgtgcacaatcctgaattgcataatctgcccgccagtatgctggggcggtctaaaaccctacggccccatgcacttgctgaccgctgatttggttttatttcgtgagcgcagttggggtttttgaaaatgggtagatttaccctgccaaactgcagatggcctgcttcccctaggcgcgctcccgcctttcgcactcgacatcgcaaactgacacgcaatacagtattgcgtgtcgcaagcccgcagtcagtacattgaggtctagatatatcgcaaggcaccctaatgccaataatgcaattctaggtgatcagcacgggtcggtagcacaagggattgaaaatccctgtgtcggtggttcgattccacctctggccaccattaaccttcgcatttcttgcggggttcatagaatccacgatattccccgattgttaagacaggtgtgaaaagtcgtaattatcccatggtccaccatcgaggccacgtaacctgcgtttagggaaaattaaagcgtcgtacggaatctcggcatagttaatgccagatttcacagacgaaataatccatctctcgcaaaagatctggtcaccttagtacatccacacctccgtaggtcttgcaaaatgttgcaatgctggaaaacacttcgcagttaagttcactcccaaaatcgccagggggttttgtctataaacgacacaaacccgaagaatctgatttatacaaaatcattgaacaaaaccttcctatattccagtcccatctttccaatgcggacatttcactacctgctttcgtccacaatgaatttcgcagctaccttcgatgcgggttgttggaacatggttttcttcgtgtgaaatgcagccgttgcaggttcgaacacttggtagctttttcatgcaaactcaggggtttctgcccatcctgcggtgctcgtcgcatggttgaaacatcagcacatttgattgatcacgtgatacctgctgcaccagtaagacaatgggttctcagctttccctggccactacgattgctttttgcacgtcaacccaacacgcttagccgatgcctcgcggtcatcatccgtgtaatagaaacagacctcattcatcgcgccggactaacgagagcgagtggtgcacgaagcggtatcgtgacgctggtacaacgttttggaagtgctctaaatttaaatattcacctacatatggtcgcactcgacggcgtttacaccgttagcaaatcaggcaaagctaaatttcatcgtgtaaaggcaccgaatcaaacagagctgcaaaccttactcaatcgtgtgatccaacgtgtagttcgcagactcgagaaagaaggtttgctcattccagacccagagcaaccttggcttgacctagacttccatgagccattagattcgctcagcaccgcatcgatacgatatcgtatcgccatagggccccattccggcagccgtactcttacactacatgatccatcatttatccgaacagacaaacctattaaatcctttactgctgatcgagatggcttttcgctcaatgccgccgtttcatgtcagccctatcaacgggatcgattagagcgtctatgcaggtatgtcaccagaccggccatttgtctagaccgactcactgttagagtcgatggtaagatccaatatgagctaaagaacccttttcggaatggcaccacacatatcttgttttctccagtggatttcctgagcaaactcgctgc

SEQ ID NO: 1433 - DNA, 4000 bp, Escherichia coli
  misc_feature (1039)..(1039): n is a, c, g, or t
  misc_feature (1768)..(1768): n is a, c, g, or t
  misc_feature (1799)..(1799): n is a, c, g, or t
  misc_feature (1830)..(1830): n is a, c, g, or t
  misc_feature (1985)..(1985): n is a, c, g, or t
  misc_feature (2506)..(2506): n is a, c, g, or t
  misc_feature (2511)..(2511): n is a, c, g, or t
  misc_feature (2833)..(2833): n is a, c, g, or t
  misc_feature (3340)..(3340): n is a, c, g, or t
  misc_feature (3345)..(3345): n is a, c, g, or t
  misc_feature (3350)..(3350): n is a, c, g, or t
  misc_feature (3353)..(3353): n is a, c, g, or t
  misc_feature (3357)..(3357): n is a, c, g, or t
  misc_feature (3367)..(3369): n is a, c, g, or t
  misc_feature (3376)..(3376): n is a, c, g, or t
  misc_feature (3378)..(3378): n is a, c, g, or t
  misc_feature (3385)..(3385): n is a, c, g, or t
  misc_feature (3387)..(3387): n is a, c, g, or t
  misc_feature (3390)..(3390): n is a, c, g, or t
  misc_feature (3392)..(3393): n is a, c, g, or t
  misc_feature (3395)..(3395): n is a, c, g, or t
  misc_feature (3398)..(3398): n is a, c, g, or t
  misc_feature (3401)..(3401): n is a, c, g, or t
  misc_feature (3405)..(3406): n is a, c, g, or t
  misc_feature (3408)..(3408): n is a, c, g, or t
  misc_feature (3410)..(3410): n is a, c, g, or t
  misc_feature (3414)..(3415): n is a, c, g, or t
  misc_feature (3438)..(3438): n is a, c, g, or t
  misc_feature (3440)..(3442): n is a, c, g, or t
  misc_feature (3444)..(3444): n is a, c, g, or t
  misc_feature (3721)..(3721): n is a, c, g, or t
  misc_feature (3923)..(3923): n is a, c, g, or t
caccattaaacaaatataaaatatataaatcaataacttagaaacggccttttttgcgcccttttgtccaccttctttctgatagaaaatactatgtggtgtaacccgcgctcgccgctggatgcggatgcgcaaattggcatataagtcgatcaaatcctcaaatctgtcccaaaggtgctgacgttagacactgaaaactccttaaagttcttgtgcattttgtgatcgggcattttttgtatcgaccataaagcaacaacttcaaccgcctgccaccatcattaaaataacaggggcgacgatagaatgaatttcacatcaatggccgtcaggtgatgagttgctcatccaaggatcgactattgcgagtgggacgcaaattaacgaagtttagggtcagagacacatagcatggtgatggggaatgctgtgcctctaaccctttacgctgcccgttacctcaaacgaggaaaaaagtcataagtatccttaggaaagcaaaattcgtgccgatataatttcaaaggatagttttacatccgatacataaggcgaagagcgcctttggcattgtggcggttgctaatcaagtaacgctcatcggagggcattagcgtgattgaaacgtttccaaactttggatttttttcgaagagagattattgacgatctggcctgacctttttgattttaagaagcttttgggttaaactgttggttatgagatgaggtacgaacatgagtatgcccaagataatagttgccagcttgctatgttttttcgttgttctcgggggctatgcaatgatttttaagccccgcaacgataattttgatgaaggcgcaggccaagttttaggcactaagaagtagcatgtttgcaatggtggaatttatcatccagtggcttgccgcttctgtggcggcgtttggccgggcttgaggcgcagatttggtctgacaaactggcccataatcgtgagataaaagacatcaaagaggcgttgcgatcgatagcgtctaagctggaccgtgncgcgctggcatcgcgcgagaggtgatttatcgccttggaaacaaggctccatttcgatttccacatacgtcgtttcgggggcttttatcccaaatgttcttattttttgctgtggcgcaattcatcacgtatttgggtaagtaactcttctgcagttggcggcttgggtcttggctccatctcctcctcgttttctccatctaccaaatcttcaattttgttcacggcctttatgagtaaaaagaccgcccatgcaataatcataaaattgataatcgctgtaatgaaactgccccatgcgagcacgggcgctcccgcttctcgcgcctgtgcaagcgtttcatatgttcgaccatttaacgccataaaataattggagaagtccaaatttcctgtgacaatcccgagcaacggattgacgatgtcctttaccagactttgcacaattgcggtaaaggccgcgccaataacaataccaactgcaaggtcaatcacatttccccttgcaatgaacttcttaaattcgtcaaaggtttttctcggcatctcttctctccagccttttttgcaggtgcccccttatcacaatcaaagcatagactgcaccgttggcagaagcgacgatttttaaccgatgcccaaggacgtaaggaggagaagctctgggaagcgcgcggacagccgcatctgactgttagatgttgattgttagtgcattattggcctctnacccatggatatgatggcttcgctgatggtngagaaccagatgcactgcgtcggcttttcanatataggatttcctccatttttggatgatgatctgtgattcccgtaggttgaagaatatttcaccgttgagtagtttatctctgagcctagcgatgaagcgctcgcaatatccattttcccaatttaccttgttgatattccttgttatcataancatggggttttggtcgcttgtcagaaggtagatcaggacaaatctaggtgaaaatttagtttttttgaattaaggtgaatttgacgccataattaacgaaattttagccgttactttaagaaactgtatgcaaaattggtgagataaggctgtcaatgatgagtcgtctaaaagtcatgcggttgagaacaatctctcttttattggccataggcgtattgcaggcctgcgtttcgcaatttggtggggcgaacgggccagagcttggcaatgaaaagcaacccagaatacttacaattggggattctcttatgcgatggaatgccctctcagggaattctattgcgcaagtgatctcaaaaaacttgaatgaaccggtggtggacagatctcaggtcggctcagtgatgcttttcaaacaaaatgcgggccaaggtgcggcagtgagcataccggaacagtatattgccaaagactgggactggaccgtcatgacaggtggtggaaacgatttacttttnggttntgggtgcatggcctgcgacgacaccattaatgagatggtttctgaaaatgcaagggatggcaaaataccggattttctgaaaacaatacgcgataacggctccaaaatcctgtatataggttatttacgtagtcccggccttcttactccaattgaacattgcaaaaatgaaggtgacctttttgaagcccgtttagcaaaatttgcggacagtgaggagaatatttactttgcatccatgcaaaatcttgttccccgcggtgacgccagttatttttctttggatcgcatccatccgtcccgcaagaccagcaaaatgatnggggagtttgccgccgactttattggcaaacacgacgatagaaaataatcccaagcgcttcaggaacaccgcgatttcttaaaaaagatgttctcaaatgctttaaaaattagggggcctcttctaaaggatcgccaccaatttatcacggatatacatccagttggatttgctattcgctgtcaaaaggtgaccctgccgcatgtttggtgaatattctgaaccatccagcatacgagcgtaccctccggcctgttgaacaataaaagagccggccagatgatcccagggttttaaaaaagctgaaagacaaaaatcatatgccccctgtgcaaccaatcgatattcatgacaggaacactgcaaagaggtgatccgattaaaatcgctaagcgcatatgaaagatctgcgcgcagcattcggtcaaaaagatgtatacttaccaggccattgagcatgtggggcggtttcggctttgcgacctcaagcgtatttttttggccggnttttnaaatntgnagcncttttccgannnttagggnanaaaactnanaancnncnttnaanggannananaggnncccaaaaaccggttttccaaaangnnncncagcaaggatgatcccgaagacggaaataccgttggcaaaattccacgttccgtcaatgggatcaattataaaggccaattcgctttgtgcgacctgtgtgagtattgtcgggtctttttcaaatgcttcttcccccacaacatacgcctttggaaacaatgccgaaagctctgaagcgatcaaagcttctgctgccaaatccgccactgtcacaggatcatcaagagacgatttacatgaaacatctgtcgactttaaattccgaaatctgggaanaatttctgactgtgcgactttcctgataattgtaacaattggttctaaatttgacactaggtgatcagagacagaattttgatccatgccacagccccctcgtcaataggcacccaacaaatgtcagagtgccgtctcggcactattcataatttcttaaaacccgcgcaggtctggcgtttaatgcgcgaagtgcaaatancaaccccgcgccaatattggccaaaataccgccagaaatgattgcgaccgcgtttggccaaataacatgaaaatccg

SEQ ID NO: 1434 - DNA, 4000 bp, Escherichia coli
  misc_feature (1293)..(1293): n is a, c, g, or t
  misc_feature (1344)..(1344): n is a, c, g, or t
  misc_feature (1464)..(1464): n is a, c, g, or t
  misc_feature (1986)..(1987): n is a, c, g, or t
  misc_feature (1992)..(1992): n is a, c, g, or t
  misc_feature (2200)..(2200): n is a, c, g, or t
  misc_feature (2206)..(2206): n is a, c, g, or t
  misc_feature (2225)..(2225): n is a, c, g, or t
  misc_feature (2548)..(2548): n is a, c, g, or t
  misc_feature (2573)..(2573): n is a, c, g, or t
  misc_feature (2645)..(2645): n is a, c, g, or t
  misc_feature (2647)..(2647): n is a, c, g, or t
  misc_feature (2663)..(2663): n is a, c, g, or t
  misc_feature (2689)..(2689): n is a, c, g, or t
  misc_feature (2692)..(2692): n is a, c, g, or t
  misc_feature (2794)..(2794): n is a, c, g, or t
  misc_feature (2800)..(2800): n is a, c, g, or t
  misc_feature (2813)..(4000): n is a, c, g, or t
ggtattatcagaaagtagactatccaattcggattgtaattctctaacccttgaatctgcatcagctttactctcctctagcttgctattcttgcgttgcagcgaggagtttttgagctctaggtcacgaattttcgcataggcactttgctcctcgttggttgcacttttttgggcattctgaagctttctattttctagagaaagctctttgttttcctgagctaagtcttgctcatctgctttcgcttgctggagttggcggcgaagacgtgcattcgtatcgtccaagtactggttgctgttcacatttctcaaaccttcctgtttgagtttgagcatttgcgtttcaagagcagccacttggccaagtgccttgtttaattcattttgcaactccgcttctcgggcagaatcaaaaactggagcgggtgcgtccactttctgttgaacaaatgtacgagttttttcgaccagagcgttatgcttggcagcaagttcattgtagcgttggatcaggaaatcagggtctcgcagttgcgcatctgtttgagcccaaaccaaggagtgcagcaaaaacaatttgcatgcgatcagggcggtaagattggataaataattcacgggtatttggggcttatacttaaacttatgagaatagaaaaaagccacccttggcaagcgtgagttattagtaatctctgatcattgaaaaaaaagagcaacggctgtgggtgatcgggctcttaaatcgagaaaattgtgtctttccttgccgcccgaaacaagcgatcattgaccgctccggcaaggtggtgctcatccggtaggctggcaatttgtatgcttgatttaccggccttgtccgcgaggtgaaggcaggcatataagttctgagcaatttcggcaggatctccatccgtggataaactgattacaggaatatttttttcattccagagctgtttatcttggtcacgatggacaagaacgattgtgtctttacctgttttttcggcatttgcacataatatgtccacactggcatgcaaaaggaggggggtctgaggagcatagtgaatggaacttgtcccaggagagagctggggctcggtggcagctagcatcctccctttcttttcaccgatttcggatgttactttttgaacattcgtgccgagcacggcccgaatttgttccgcagatataggaccttcccggaaaatttttatattttgggggtcgaccagggagagcacagtggattccagaccaatctggcaaggcccgccntccaaaatcttaggacagttctccccaaatgattccatgatatgctccggncgggttgggctaatgtggttggatcggttggcactgggggcggcgaggggaaagtctagctggccaaggaccttacgaaaaaggggatgcgcaggagagcgtagggcaacggtgggcagnccggcagatatacgctcaggtatgcaatctctcttcggtaggattagggtgagaggtccgggccaaaatacctctgccaactgagtagccagattgttaaagtgggcaaggttcctggcctgatcaaggccggtggtatggacaataagggggttggtggaagggcggcccttgagtttgtagatcagatcaagggtactgtccagtagggcatttcctgccagaccatagacagtttcgctgggaagggcaactaggcgacctgcttttaggtgaagcagggagtcatcaagggagataatcaattttgaagtaaagactacttcaatatctgcatgtgtcttgcttttttgatcaacttggaaaccttacgctgttgcatcggggtaaggccggtgtacttccttggcaaaattttaccagtgtcagtcgtgtactttgcaagagcatccttgtccataaaggagtagtgctcgggatttttgctctttacagcggtgtcctgtgtttcagtcatagagnnttatnaataccaaatgattttctaagatcaatctcaaaaagttagggatcagccgactttatagattgaccaagcctcgaacttttgatgttttgtttccttgctatgaaagttgtatcttcaattaagacactcaaaaaccgccaccccgactgcaaggtcgtccgacgcaggggcagagtctatgttatcaacaagaccaaccctcgcttnaaagcncgccaaggctaattatttncggtcatgagaaaagatatacatcccaaactcaaccctacctgctttgtcgatgtgtccagcgggaagaagtttacaactctttctaccaccacctctaagaagatggaaaacattgacggggtggatcatcacttgatctattgtgatgttacaatggattcccaccccgcatacaccggtgaaaaacgctttgtggacactgctggacgggtagagaagttccagtccaagttctcccgcaaacgctaggtaagctttcgtacctctggctcgggttattgagccaaaaaataatcccttgacggattatcctatacaggnaaaagatgggctatctttcgtctantacactgtcttttattttatctttttcccttggtaattatggcgggggaacctgtgcgtacatggacgagtncngatgggcgcactttgnaggcccaatacattgaatcctctgcnggnaaagtaaccatcaagatggggagccgggaatatactcttccactatcccgattctcccaggcagatcaggactatgttgctggggttgccaaccaacctccncccgcntaccaacccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1435 - DNA, 4000 bp, Escherichia coli
  misc_feature (50)..(50): n is a, c, g, or t
  misc_feature (103)..(103): n is a, c, g, or t
  misc_feature (1990)..(1990): n is a, c, g, or t
  misc_feature (2033)..(2033): n is a, c, g, or t
  misc_feature (2635)..(2635): n is a, c, g, or t
  misc_feature (2914)..(2914): n is a, c, g, or t
  misc_feature (2935)..(2935): n is a, c, g, or t
  misc_feature (3121)..(3121): n is a, c, g, or t
  misc_feature (3486)..(3486): n is a, c, g, or t
gctgaactccgactcggtcactgcgacctggtcgtgatcgtccgccgcancggcgcgatcgtgaaggaggggctcgagcgattggccctcgagatggacgttngcaccggcatcaccgccgagtgcatcgacgaacgtcggtgcaaggtcgatcatctcgacgaggtcggtggagaccgaccccctcgtggcgtcggcgcccgctcgcgggtcggccacgatcatcgggattcgcacgacctcttcgtggagccagtccttttcccccatccagtggtcgccgaggtagtcaccgtgatcggaggtcaacacgatcatcgtgtcgtcggaacggcccagatcgtggagtgctcggaacagccggccgagatggtcgtcgagttgtttcaccaggccgaggtaggcggggtagacggtcgtgcgcacctcgtcacgcgagaacgtcgacccgattcggctgcgctggaatgctcggagcaccggatgcgcagtttcgagctcggcgtcgcaacggttgggcgacggcagatcgttgcgatggaccaggcggtgatagggctcggacaccacgtagggccaatgcggcttgatgaacgaaaggtggatacaccagcggtcgtcgcctgcatctcggatgaagtcgatcgcccggttggtcatgtaggcggtctcggacagttcgtcggggatgattgccgggtactgcgacgcctcgagcagccaccccgacatgcgttcaccgtcgggggtcaggaccgagttggccgcggtgtgccacgggttggggccgtcgtagccctgttcgacgaggaaccggttgtagccccgttcgaacagctgcggccgcgtgttgggaacgagtccgtcatcgcgttcgatcggctcgaatccgcactggttgacgatcgtcgtccacggatcgtcggggtcgagtcgcagccgatcgaggccgctgcgatcgcgggccatgtgggtcttgccgatcaggacgcttcgcacaccgagtggtcgcagatgatcgccgatcgtgggctcggcgaccgacaggggaacgctgttgtaccgggacccgtgcgactggacgtagcggccggtgtaggcactcatgcgcgaggagccacagaccgatccctgtgcgaaggcccggtcgaaccggacgccacgatcggccaacgcatcgatgttcggggtgtcgatcagcccgccggcacacgacagggcgtcgtggcgaagctggtcacacatgatgaagaggacattgtgcaccgacgcatccacgccctgacggtaaccgtcgagggcgtggatgcgtgacgaccgactcaggcgacgaatccctcgaggggcgtcggctccggcacctcccagtcgaggggcatctgggagaagtcgaagaacggtgattcgtcgccttcgtcgattgcgtcctgcacctggtcgtagaaccctttgccggtctcctcggcgaaggtgattgcaacctcttcggcagtatcggagcgtgccggccgctggcagtactcggggaacgatgcctcgccggcgtctccctcctcgtacccgcgggcgaacagttgcttgagcacaccgaacccatcgttgcgaacgagcatctcgcctcgcgggtgaccaccgagacgctgcatgtgctcgatgaacttctcgagatcgtgtgtgtcgtaggcaacgtgctgaacggcgtggtctccgtggcgctcggtgaacctggtcacctgactgatctcggcccgatcgatgccctcgatcagcgcaacaccgaagtcgccgtagtcgatgcaccagatcttcatcgacgacccaggatcgtcgggccgcacgtcgtcgatgcgattgatcagcgtgcccccctcgacctcgatgtggaaccacgcccacttctcgatctggcccttggcgcaggcgtaggtgacatggtcgactttcttcaggtgcgatcccatggcctgatcacagcagagtgttcagtatnatgcaatgatgttgaacattctgttgctcaaagcagcatctcnaagccagaacgtctgatccgatggcccgactgtccgccccacatgaacacctcgacgcaaccgacgttgcccttctccaggcggcacgggccagccccagggcaagcatcgcccagctcgctcgcgacaccggcctggctcgcggcaccgtctacacccgcctcgaccagctgcacgccgacgggatcatcgtcggctggggaccagaactcgacagccgcgcactcggcttcgatgtcctggccttttgcacgctccagatcgcgcagggggcccacgacgagacgatcgcagcactggccgacatcgccgaaatcaccgagattcacaccgtcaccggtgacggtgacctgctcgtgcggatcgtcgcccgctccaacgatcacctgcacgaggtgctcatgacggtgacctccctacccccggtgcgccacagccacacccagctctcactggcaacccgtcaccaccgacctgtcgtcgacgcactctgaacccaccgatcccctcgaaaccgcgcgggggtgtcgtcacaccgacctgtgtccagctgctcgcctcgttcgaatcatcccccctcgattgcggcgttgagtgcctcnagcccgctcgggtcgagcgcgccgcgccacgaccagacgacgacatcgacaccgacatcgaaaaaaccctgcgctgtgtcgagaagctcggcgggttcaccgtcggttccgagatgtaccgatcgggtgatctcggcctgatcgcgtccgaccctgtcgcagtggccgcggagcacctcgtcgagttcctgccaatccgacggctgttcgggaaaggtcatgtcccactggtctgcgaacctggctgcggtccgcagcgtacggatccgtccctttccnccgatcacgatcggtatccgntcctgcaccggcttcggttcgcaccacgccttctcgagttcgaagaagcgacccgagaacgacgtctccttgttggccaggagcgacacgatgatctccatgccctcctcgaggcgatcggaacggtcgcgcaacgggccgaggtcgatgccgtaggcatcgctttccatgaagttccagcccgcncccatgccgagttcgaatcgaccatcggagatgatgtcgatcgtggctgccatgttggcggtcaccgcagggtggcgatggtgcataccgttgaccatcgacccgatccgcagccgtgaggtcgcctgcgccagcgcagccaacatcgtccagccctcgaggttcgggccgtcgtagggcggcgccagcgggtagaagtgatcccagttccaggccgactcgaatgccggcatctcgtcggccatctgccagaagtgcagaaactcctgccaggttgcgtggtgcggcggcgtcttcagtgcgtgacgtcccatcggcatgccctttcgtcggcgtaccgagaccgtaccgctccgatgccgagngctcagcccagcgactgacgacgcagctcgcgacgtgcgatcgccatcaggtggacctcgtcgggtccatcggcgatgcgaagcgcacgcaggtcggcgtacatgcgggcaagcggagtgtcgtcactgacgccggccgccccgtgcacctggatggcgcgatcgacgacggtcgtggccatccgcatcacctgcaccttgatgatcgacatgtgcggtgcggctgccttgtcgccttcggtgtccatcaacgcagcgacccgcagggtcgcaaggcggcaggcgtcgatgtcgatcctcgactcggcgatccagtccatgacgtttgctcgtgacgcaaccggcgcaccaaatgtctctcgtgcctcggctcgtcgacacatcagcgtgagtgctcgctcggcgaccccgatcgtccgcatgcagtgctgcacccgagccgggccgaggcgagcctgcccgatcgcaaagccgtctccgacgtcgccgaggatggcgtcgtcgccgacccgca

SEQ ID NO: 1436 - DNA, 4000 bp, Escherichia coli
  misc_feature (33)..(33): n is a, c, g, or t
  misc_feature (650)..(650): n is a, c, g, or t
  misc_feature (654)..(654): n is a, c, g, or t
  misc_feature (659)..(659): n is a, c, g, or t
  misc_feature (665)..(665): n is a, c, g, or t
  misc_feature (667)..(667): n is a, c, g, or t
  misc_feature (671)..(675): n is a, c, g, or t
  misc_feature (681)..(683): n is a, c, g, or t
  misc_feature (685)..(685): n is a, c, g, or t
  misc_feature (691)..(692): n is a, c, g, or t
  misc_feature (694)..(696): n is a, c, g, or t
  misc_feature (698)..(698): n is a, c, g, or t
  misc_feature (700)..(701): n is a, c, g, or t
  misc_feature (704)..(706): n is a, c, g, or t
  misc_feature (708)..(709): n is a, c, g, or t
  misc_feature (715)..(715): n is a, c, g, or t
  misc_feature (717)..(717): n is a, c, g, or t
  misc_feature (719)..(719): n is a, c, g, or t
  misc_feature (721)..(722): n is a, c, g, or t
  misc_feature (724)..(724): n is a, c, g, or t
  misc_feature (726)..(726): n is a, c, g, or t
  misc_feature (728)..(730): n is a, c, g, or t
  misc_feature (733)..(733): n is a, c, g, or t
  misc_feature (737)..(738): n is a, c, g, or t
  misc_feature (740)..(740): n is a, c, g, or t
  misc_feature (743)..(743): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (763)..(763): n is a, c, g, or t
  misc_feature (765)..(765): n is a, c, g, or t
  misc_feature (767)..(768): n is a, c, g, or t
  misc_feature (771)..(771): n is a, c, g, or t
  misc_feature (774)..(776): n is a, c, g, or t
  misc_feature (781)..(782): n is a, c, g, or t
  misc_feature (785)..(785): n is a, c, g, or t
  misc_feature (788)..(789): n is a, c, g, or t
  misc_feature (792)..(792): n is a, c, g, or t
  misc_feature (794)..(794): n is a, c, g, or t
  misc_feature (796)..(797): n is a, c, g, or t
  misc_feature (799)..(801): n is a, c, g, or t
  misc_feature (803)..(803): n is a, c, g, or t
  misc_feature (805)..(805): n is a, c, g, or t
  misc_feature (809)..(809): n is a, c, g, or t
  misc_feature (811)..(812): n is a, c, g, or t
  misc_feature (816)..(816): n is a, c, g, or t
  misc_feature (820)..(822): n is a, c, g, or t
  misc_feature (825)..(826): n is a, c, g, or t
  misc_feature (828)..(828): n is a, c, g, or t
  misc_feature (831)..(831): n is a, c, g, or t
  misc_feature (833)..(833): n is a, c, g, or t
  misc_feature (837)..(838): n is a, c, g, or t
  misc_feature (840)..(840): n is a, c, g, or t
  misc_feature (842)..(844): n is a, c, g, or t
  misc_feature (846)..(847): n is a, c, g, or t
  misc_feature (850)..(850): n is a, c, g, or t
  misc_feature (853)..(853): n is a, c, g, or t
  misc_feature (855)..(855): n is a, c, g, or t
  misc_feature (857)..(858): n is a, c, g, or t
  misc_feature (862)..(863): n is a, c, g, or t
  misc_feature (865)..(866): n is a, c, g, or t
  misc_feature (868)..(868): n is a, c, g, or t
  misc_feature (874)..(876): n is a, c, g, or t
  misc_feature (879)..(879): n is a, c, g, or t
  misc_feature (881)..(881): n is a, c, g, or t
  misc_feature (886)..(886): n is a, c, g, or t
  misc_feature (889)..(891): n is a, c, g, or t
  misc_feature (893)..(893): n is a, c, g, or t
  misc_feature (896)..(896): n is a, c, g, or t
  misc_feature (898)..(898): n is a, c, g, or t
  misc_feature (908)..(908): n is a, c, g, or t
  misc_feature (910)..(911): n is a, c, g, or t
  misc_feature (913)..(913): n is a, c, g, or t
  misc_feature (915)..(916): n is a, c, g, or t
  misc_feature (918)..(918): n is a, c, g, or t
  misc_feature (920)..(920): n is a, c, g, or t
  misc_feature (922)..(924): n is a, c, g, or t
  misc_feature (926)..(926): n is a, c, g, or t
  misc_feature (928)..(928): n is a, c, g, or t
  misc_feature (930)..(930): n is a, c, g, or t
  misc_feature (932)..(935): n is a, c, g, or t
  misc_feature (939)..(939): n is a, c, g, or t
  misc_feature (941)..(941): n is a, c, g, or t
  misc_feature (944)..(945): n is a, c, g, or t
  misc_feature (947)..(948): n is a, c, g, or t
  misc_feature (956)..(956): n is a, c, g, or t
  misc_feature (958)..(958): n is a, c, g, or t
  misc_feature (970)..(971): n is a, c, g, or t
  misc_feature (975)..(975): n is a, c, g, or t
  misc_feature (979)..(981): n is a, c, g, or t
  misc_feature (985)..(985): n is a, c, g, or t
  misc_feature (988)..(988): n is a, c, g, or t
  misc_feature (990)..(990): n is a, c, g, or t
  misc_feature (992)..(993): n is a, c, g, or t
  misc_feature (995)..(995): n is a, c, g, or t
  misc_feature (998)..(998): n is a, c, g, or t
  misc_feature (1000)..(1000): n is a, c, g, or t
  misc_feature (1003)..(1004): n is a, c, g, or t
  misc_feature (1009)..(1009): n is a, c, g, or t
  misc_feature (1015)..(1017): n is a, c, g, or t
  misc_feature (1550)..(1551): n is a, c, g, or t
  misc_feature (1555)..(1557): n is a, c, g, or t
  misc_feature (1562)..(1563): n is a, c, g, or t
  misc_feature (1566)..(1568): n is a, c, g, or t
  misc_feature (1571)..(1571): n is a, c, g, or t
  misc_feature (1573)..(1574): n is a, c, g, or t
  misc_feature (1579)..(1579): n is a, c, g, or t
  misc_feature (1581)..(1581): n is a, c, g, or t
  misc_feature (1583)..(1584): n is a, c, g, or t
  misc_feature (1589)..(1590): n is a, c, g, or t
  misc_feature (1592)..(1593): n is a, c, g, or t
  misc_feature (1596)..(1596): n is a, c, g, or t
  misc_feature (1598)..(1599): n is a, c, g, or t
  misc_feature (1601)..(1602): n is a, c, g, or t
  misc_feature (1605)..(1609): n is a, c, g, or t
  misc_feature (1611)..(1611): n is a, c, g, or t
  misc_feature (1614)..(1616): n is a, c, g, or t
  misc_feature (1621)..(1621): n is a, c, g, or t
  misc_feature (1623)..(1624): n is a, c, g, or t
  misc_feature (1630)..(1630): n is a, c, g, or t
  misc_feature (1634)..(1635): n is a, c, g, or t
  misc_feature (1638)..(1641): n is a, c, g, or t
  misc_feature (1643)..(1644): n is a, c, g, or t
  misc_feature (1646)..(1651): n is a, c, g, or t
  misc_feature (1653)..(1656): n is a, c, g, or t
  misc_feature (1659)..(1659): n is a, c, g, or t
  misc_feature (1662)..(1662): n is a, c, g, or t
  misc_feature (1665)..(1665): n is a, c, g, or t
  misc_feature (1668)..(1672): n is a, c, g, or t
  misc_feature (1674)..(1675): n is a, c, g, or t
  misc_feature (1677)..(1679): n is a, c, g, or t
  misc_feature (1681)..(1683): n is a, c, g, or t
  misc_feature (1687)..(1687): n is a, c, g, or t
  misc_feature (1696)..(1697): n is a, c, g, or t
  misc_feature (1700)..(1701): n is a, c, g, or t
  misc_feature (1704)..(1704): n is a, c, g, or t
  misc_feature (1706)..(1709): n is a, c, g, or t
  misc_feature (1711)..(1712): n is a, c, g, or t
  misc_feature (1714)..(1715): n is a, c, g, or t
  misc_feature (1717)..(1718): n is a, c, g, or t
  misc_feature (1720)..(1720): n is a, c, g, or t
  misc_feature (1723)..(1723): n is a, c, g, or t
  misc_feature (1726)..(1730): n is a, c, g, or t
  misc_feature (1734)..(1734): n is a, c, g, or t
  misc_feature (1737)..(1737): n is a, c, g, or t
  misc_feature (1739)..(1742): n is a, c, g, or t
  misc_feature (1748)..(1749): n is a, c, g, or t
  misc_feature (1751)..(1752): n is a, c, g, or t
  misc_feature (1754)..(1756): n is a, c, g, or t
  misc_feature (1758)..(1758): n is a, c, g, or t
  misc_feature (1761)..(1763): n is a, c, g, or t
  misc_feature (1766)..(1766): n is a, c, g, or t
  misc_feature (1769)..(1771): n is a, c, g, or t
  misc_feature (1773)..(1775): n is a, c, g, or t
  misc_feature (1779)..(1779): n is a, c, g, or t
  misc_feature (1781)..(1781): n is a, c, g, or t
  misc_feature (1783)..(1783): n is a, c, g, or t
  misc_feature (1785)..(1785): n is a, c, g, or t
  misc_feature (1787)..(1791): n is a, c, g, or t
  misc_feature (1794)..(1794): n is a, c, g, or t
  misc_feature (1796)..(1798): n is a, c, g, or t
  misc_feature (1800)..(1800): n is a, c, g, or t
  misc_feature (1805)..(1807): n is a, c, g, or t
  misc_feature (1809)..(1809): n is a, c, g, or t
  misc_feature (1811)..(1811): n is a, c, g, or t
  misc_feature (1813)..(1813): n is a, c, g, or t
  misc_feature (1815)..(1815): n is a, c, g, or t
  misc_feature (1817)..(1818): n is a, c, g, or t
  misc_feature (1821)..(1821): n is a, c, g, or t
  misc_feature (1823)..(1823): n is a, c, g, or t
  misc_feature (1828)..(1829): n is a, c, g, or t
  misc_feature (1832)..(1832): n is a, c, g, or t
  misc_feature (1836)..(1837): n is a, c, g, or t
  misc_feature (1845)..(1845): n is a, c, g, or t
  misc_feature (2034)..(2035): n is a, c, g, or t
  misc_feature (3655)..(3655): n is a, c, g, or t
  misc_feature (3696)..(3696): n is a, c, g, or t
  misc_feature (3889)..(3889): n is a, c, g, or t
tctcatcgtcgcttttgatttcgtatcgccacngaaaagatgccccagtcgatgccgacgacgactttaacagagaacgtcgtctctccgccgcagacgccaccgcgttttcaaaagcaatcccatatcctttcattacatcctctgcatctgctcccaccactgtccgaatcggacagttcacgtgaatcggcggtaaatgcttcaccgcttcctcgtacggcgttttacgagacgcgcccggaacatccgtcgccgtcgcggtactcttcgcctgcggtttcctcttttggaaaaaactgtgcactttctgaggaggctgctcttccgttttcgtcttctccttttcgtcgtcgttgtccttctcttgcgtcaaatcgacaatcgacgactcttcttcttcttgttttgtgcaacagaatttttgaatatctttgttcaaattcgtcgtcgtttttgcgtctgtctgctctcctcctttggtcaagtcaatggtcgcttccgcgactctcttcgcgtcgttgatattctcaacgttattattattgtacgcgttcgtttcctccttcttcttttctttcgtcgtaaacatcggatgcatcgtcgtcgtcttgggaggacgtttttcttcttctttttccatcatctcncgcnctctntcacancncaannnnnctctcnnngngaaaannannncncnncgnnnannagaganancnanngngntnnntgncgcnntnttntgcncctctnttntctctcncnannatntcnnntcgcnnaangtnntcntntnnannngngnagananntttnaatnnngcnnanaananaaanntnannnannttntcncncnnaaannannanaaaaannnctntnaatgngannngnganancataaaaaanannancnngngngnnntntntntnnnngagngnganngnnagagagananaaaaaagagagnngagngatnnngagnggngngnngncgngngcnnagaanagacgnnntggtcagagagatgtgtgggatttgattgtgaataacgacgatatttgttttaaacacattcttccgagattgaattcgaatgatgtgaaattcttgtacgaggtgaatagtgaaacgagaaagttgattaagaggtcatctcgtgcgggtgatttgaaaaagtggtttagaatgaacgagatgtcgtcgatatcgactttggaagtagcgtgggagcattatccgtggggcacgtatgactacgatgtggaagaaaagatggacgaaacatatttctgctatcgagttgcttacacgaataaactcgagttgctcaagtggatacgagaggagaaacagtgtgattgggatgaaaagacgattagagcggccacaagacaaggtaatctggaaatgataaagtattgcgttgcaaatgagtgtcctatcagtacgtgggcgtgtgcacatgctgccgaaagcggtcatctcgagatactcaaatacttacgcgaagaagtcaaagcgccttggggttggatgactgccgctnncgcnnntgaanntgnnnatntnnatatncncnnatatnntnntgngnntnngtnnnnnanatnnngcgtntnngcgtgngaanntgnnnncnnannnnnncnnnnggnctnttngannnnntnncnnnannncgcnaaagcgccnnggnnctntnnnncnntnngnngngcncannnnnacanacncnnnnactgtnnannannncnccnnnacnacnnntnnnctcncncncncnnnnngcnannngnagatnnnangntncncnngtnanaaacnngtncacnnatacacanagagagagagagagagagagagagagacaaattaatatacaatacgttacgcgttacacttcaatcacacaacgtgtgtttctcttaaccagcttgatgcaaaaaaaaatcatttccaatcggatttccgcacaaaacaacgaacctcttcgcgcggacggcgcaagaactcaacacgctttaaacgannacaatgactgaacaacagaagtacgggaaggacatattcaacgggaagggagagaattggtaccacgagttaatcgaggacggtttagctttatcctacagagtggacgaagtgtaccaccggggaaaaagcgagtttcaagagattgaggtggtgcagacgcacgcgttcgggaagttattaatcacggacgggttgatgcaatcctcggagtgcgacgaggtggtgtatcacgaagcgttggtacacccggcgatgactttacacgaaaacccgaagcgagtgttcatcgccggcggcggcgaaggagcgactctgagagaagtgttaaggcacccgatggtggaagagtgcgtgatggtggacatcgacggcgttttggtcgagcagtgcagagaacactgcccgttttataacgcgaacgcgtacgatgatccgagagcgaagctggtcattggtgacgcgaagaaaggtttagaggattacccggaaggatcgttcgacgtgatcatcatggatttatccgacccgttggacggcggtccgtgttatcaactctacaccacgtcgttttacgaaaccgcgaaatcgaaattgaaaccgaacggtattttagtcacgcaaagcgggtgcgcgtccgtgcgagacgcgcagttcgtgtggtcgccaattcacaacacgttgaaacaggttttcgacaacgtcagcggatacaccatgtgcgtcccgtccttcacctccgagtgggggtttaacgtcgcgagcacggacccggcgaaaccagatttacgcgaaaaaggcatgaacgaagtcgacgcgagattaaaagcgcgcaaattggattctgttttacaattttacgactctatttcgcacgctcgcatgtttagcccgccgaagcagttgcgaaagatgatcgaaaacgagacgagagtgatgacggttgaaaaccctctcttcatgtgcaccacagacactcacacagggttgttcgagaagaaatagtacgaccagtggacgatggttaagtaatagtatccgtatgtatcttttctttaatatcaccagattatagataccaacttccgttaatactaagacgcttcgatagactcaaaatcgaaccttttttccttctcttggtctttcaaagagcgccgacacataaattttcttcactctttctctctgtcggtaacgcacgtacttccttcggtaaaaaaccccgacagaagataataactactactaatactattgctcttaatactaataatgtacaacggcatcggattaaccaccgcgcgcggttccgggacgtccggttacgtccaatcgaacaaattccaccgagagcgcagtcgtttgcacagagacgattttcattctcaagatctgaaaacaatacacgatcgcgagaagaaacgaggcggagacgacgtctcgaaacgagaagggaacagaggaattttagaacacaacgagaaacggaaaatcgaagtctctttggtcgcgtttcgagacaagttggaagaggatttgggtgaaggaaaagaggaggacatcgaaaggaaagtgaacgaagaaagaacgcggctgacgaagaagatgaaagaggancaagaacgacaatcacagagagaagaagaagaagaaaacancagaagagggtttaagcggaaaaactttaacagaggaggaaaagaagaagaaacgcacgaagtcgccgagcgacagcggcggaagatggcgaatttgcgccaggcgtttggcatatcgagggaagacgacgaacgaagagaaggcgaagcgttcgatcgagagttacagcgagagatgcgagaggagaagcancggaagagggaggatgagattttacgcagagagaaagaaatggcgaagagaaggaaagaggagaagaaagaggagaagaggaggagaaaggaaaggaagaaagaggagaag

SEQ ID NO: 1437 - DNA, 4000 bp, Escherichia coli
  misc_feature (1982)..(1982): n is a, c, g, or t
  misc_feature (1992)..(1992): n is a, c, g, or t
  misc_feature (2700)..(2700): n is a, c, g, or t
  misc_feature (3421)..(3421): n is a, c, g, or t
  misc_feature (3628)..(3628): n is a, c, g, or t
  misc_feature (3736)..(3736): n is a, c, g, or t
  misc_feature (3748)..(3749): n is a, c, g, or t
  misc_feature (3771)..(3771): n is a, c, g, or t
  misc_feature (3774)..(3778): n is a, c, g, or t
  misc_feature (3780)..(3781): n is a, c, g, or t
  misc_feature (3783)..(3783): n is a, c, g, or t
  misc_feature (3786)..(3789): n is a, c, g, or t
  misc_feature (3791)..(3793): n is a, c, g, or t
  misc_feature (3795)..(3795): n is a, c, g, or t
  misc_feature (3797)..(3798): n is a, c, g, or t
  misc_feature (3800)..(3804): n is a, c, g, or t
  misc_feature (3806)..(3807): n is a, c, g, or t
  misc_feature (3809)..(3810): n is a, c, g, or t
  misc_feature (3812)..(3818): n is a, c, g, or t
  misc_feature (3821)..(3822): n is a, c, g, or t
  misc_feature (3824)..(3825): n is a, c, g, or t
  misc_feature (3827)..(3829): n is a, c, g, or t
  misc_feature (3832)..(3833): n is a, c, g, or t
  misc_feature (3837)..(3841): n is a, c, g, or t
  misc_feature (3843)..(3843): n is a, c, g, or t
  misc_feature (3845)..(3846): n is a, c, g, or t
  misc_feature (3848)..(3854): n is a, c, g, or t
  misc_feature (3856)..(3859): n is a, c, g, or t
  misc_feature (3861)..(3861): n is a, c, g, or t
  misc_feature (3865)..(3865): n is a, c, g, or t
  misc_feature (3869)..(3876): n is a, c, g, or t
  misc_feature (3879)..(3879): n is a, c, g, or t
  misc_feature (3881)..(3883): n is a, c, g, or t
  misc_feature (3885)..(3885): n is a, c, g, or t
  misc_feature (3889)..(3890): n is a, c, g, or t
  misc_feature (3893)..(3893): n is a, c, g, or t
  misc_feature (3895)..(3900): n is a, c, g, or t
  misc_feature (3906)..(3906): n is a, c, g, or t
  misc_feature (3910)..(3910): n is a, c, g, or t
  misc_feature (3912)..(3913): n is a, c, g, or t
  misc_feature (3919)..(3926): n is a, c, g, or t
  misc_feature (3928)..(3930): n is a, c, g, or t
  misc_feature (3934)..(3934): n is a, c, g, or t
  misc_feature (3936)..(3938): n is a, c, g, or t
  misc_feature (3940)..(3940): n is a, c, g, or t
  misc_feature (3942)..(3944): n is a, c, g, or t
  misc_feature (3947)..(3947): n is a, c, g, or t
  misc_feature (3950)..(3951): n is a, c, g, or t
  misc_feature (3953)..(3953): n is a, c, g, or t
  misc_feature (3955)..(3956): n is a, c, g, or t
  misc_feature (3958)..(3959): n is a, c, g, or t
  misc_feature (3961)..(3965): n is a, c, g, or t
  misc_feature (3967)..(3968): n is a, c, g, or t
  misc_feature (3970)..(3976): n is a, c, g, or t
  misc_feature (3978)..(3980): n is a, c, g, or t
  misc_feature (3982)..(3983): n is a, c, g, or t
  misc_feature (3988)..(3993): n is a, c, g, or t
  misc_feature (3996)..(3997): n is a, c, g, or t
  misc_feature (3999)..(3999): n is a, c, g, or t
cccacttccttaaaactgacaaacaaaatctaatctataaaccacgatagtatccagagaggaatatcccaagttgggaatttttattcaatactctttactttaaatattttattttgattaaaaaatatgcatgtatcaaaattattatttaaatattgcaattatacttgataattgatgattgaaggtgtgtgactatgagtatcaaaattaatacaatatggagaataatatgaaagattatatggtagcacacaaatttaaaacagaagaattaagagaccaatattttgaaatgtctaaagatatgactgctgatgacatacgtgcaaatatgaaaaatgaaaatgctagttttcaaatgaattggaataatgaaaaaaatgacatggtaatgttttgttggtggaaagcaaattctccagaagcaatagaagaaacactcggagaaatgggtcaaatgtttgttaatgacataaaagaaatggcaaatgtaatggatgtgactgattaattttctataaacttaatattcaatttaaattaataaatttaggagttattttatggaaatgtttgggataataaaatttacatgcagttatgatgaatggaaatcaatttatgacggagatattcagttaagaaagcaatttatgaaagatgatatcattggaaaagttgatgaaaatacagcaatgtttaaagcaactattaccgatcctgctaaaatgggtgagataatgtcaaaaagaatggaagaaattggaccaaaattaggattaaaccacgatttttatagcattactcctatagaaaactaaattactgttctcttcttttttagatttgtaaggatttgtaataaataagttaattggaaaggaaatgagatgtctaaagtattagtccatatccatagtgatctacaatttaaaaacaaagttacgttaggattaatggttgcccttgctgctataaaaaaagatcatgaagttactctcttcttagcagcagatggggttcatatattaaattgtaaaagtactggtcaaatagttggacaaggtaccggagatttatatgaacaccttcttaatttgaaggaaacaaatgccactatattagtttctggtatgtccgcaaaggcaagagggtatgatgaatcgcttttagaggggtataatgcagaatttgctatgcctgacaaactaattgaacagtcattagagtcagatagcgttctctgttattgagttacctctcgcagagaagtaacctttgttatttaaccactttgcaatttcattctatgatatttctttttctagaagtttagatatgttttcataaaggaagaatttatattgtgaactaaaagggtttggagtagagaatttctaaatatgattgcaaaacagaagaatgcgtctgacttaaatcttacgcacccactccctcaagactgacaaccaaaacctaatctataaaccacgatagtatttagagagaaatatcaattactctttaccttaagtgactattttgagtagactataagcatgaaactaatcattgctactcctagtccatatgcacgcaaagtaagagtaatattacgtgaaaaaaatatagactttgaagaaataattgatgttccatggaatactgacactttaactcttggggttaacccattaggaaaaataccaatacttcttcgcgatggtcatgaaccattgtttgatagcaaggtaattgttcaatatttagatggatataaaccaaaacctcttttttaccctaatgactacacggaaaacatctcagcgcggttggttgaaactgtttcagacggcatatgtgattctatagttcttatattccttgaaaactcaagaaaagaaattttaaggagtaaaacttggattaaaagacaagagaaaaaaatctttgaaggagttcaatatctttcaaanaatcttgatnaaaaaaaatattttgtaggtaaccattttaatattgcagatgtaagtggatttacttgtttagaatatcttgatttaagatttcctaaatttaaatggagagataagtataaaaatttagtgtcatattggaacatacataaagatagacaatcatttaaagaaactaaaccatatgcacagattattgaacctctagatgattaaagagatgaaatatcattattgttctcaatgtaaaattcttggttaggaaaataaaattcagttctgctttcttttttcctaaataaacctaatctataaaccacgatagtatccaaagagaaattttaattattctttaccttcacaaagtattttgattaaaatatatatatgacaaagcatattaacttatattctaaatttgataaatttggagattattggtctccaaaagttattgctgaaatgaatgattatcaatttaaacttgtaaaaataaaaggtgaatttgtaaaacatcaacattctgatactgatgaagtgtttattgtaatagaaggtaaaatgagcattgaattcaaaactgagacaattgaaatcaaaaatggtgaaatgatagttgttccaaaaggagtggtacataagccttttgcagatgaagagtgcaaagtaatgttggtagaaccaagaggagttttaaatactggtgacactaaagganatttgactgctccgaatgatcaatggatttaaaagtgtttcaattttatacaaaatttttactgtttttaggaattacaattttcctttctatcactacatctgttgtttcgggtcaatcggattttgatttagtagagattaagttaattgataatctagatgataaaagaggattttgtatcgacataaaaggatataaatctagggcaaaaatagagagaggactgcaagcacatacctgttactcttatcaaggagaaattgctatagatcaaggtttagatgcaaataagttaaagaaaaaagaattatttttccctaattttgatgtttgtatacatccatcttcatataataatccactaattttaacccttataaaatgtaaaaattcacaagaatttatatttgataaagataatactattcgtttaaagaataacagtaatttatgtttaacagttgcaaaagaagaatcaagaaaaggtggtggcggttcacctgtacatttaatgagaaatttatctatgcaaatatgtaataacaaacattctgtttatcaaaattgggtaataagatattttaaaaaaggtaagatttttaaagaaaaactttcaaagttttaattttatactcttaattgaagaaaaaaggtaacaacattgatcgctgatattgtgttagtatctcattttaccattgttatttttataactttnggtttttttttaataccaattggatacaagtttaattgggattgggttaaaaatttaaaattaagaatatgtcattgtggaatgatgacttttgttactttagagagtttattgggaataacttgcccactaacttcatttgaaaatagtttacgtgggattaatgaatccacttcgtttatatcttattggatccatcaaattatntattggaatttaccatctcaattttttattattttatattgtattgttctagtatggacatttttattatggaaactctttccacctatgattaaaaagtgctaattngaactcccctcnnctcaaaactaacaaaaaaaacntannnnntnnantannnnannntnannannnnnanntnnannnnnnnttnncnntnnnaannaatnnnnnantnngnnnnnnnannnntntagnaaannnnnnnnatnannntnaaannttntnnnnnnaaaaanaaancnnaaaaannnnnnnngnnnaaanannngntnnnaanttnnancnncnntnnnnnanntnnnnnnngnnntnnaaatnnnnnnttnntna

SEQ ID NO: 1438 - DNA, 4000 bp, Escherichia coli
  misc_feature (87)..(87): n is a, c, g, or t
  misc_feature (213)..(213): n is a, c, g, or t
  misc_feature (216)..(216): n is a, c, g, or t
  misc_feature (261)..(261): n is a, c, g, or t
  misc_feature (290)..(290): n is a, c, g, or t
  misc_feature (650)..(650): n is a, c, g, or t
  misc_feature (1065)..(1065): n is a, c, g, or t
  misc_feature (1138)..(1138): n is a, c, g, or t
  misc_feature (1228)..(1228): n is a, c, g, or t
  misc_feature (1293)..(1293): n is a, c, g, or t
  misc_feature (1522)..(1522): n is a, c, g, or t
  misc_feature (3054)..(3054): n is a, c, g, or t
tcaagtaaagcttgacctatcttcttagcctcttccatagatgttttacgaaccttagtttgtgctaaggtaaggttttccataacngtcatatgtgggaacaaattaaagttttggaataccattcctacttcagcacgaacgtcatttaactttttcttatcagaaagatccatgccatctacgataaccttaccagatgtaggttcctcnaantagttcatagtgcgcagtaccgtacttttaccagaaccagaaggnccgatgattacaactacttgaccttgttnaatatgtaaattaataccttttagtacttcatttttaccaaaagatttatgtacattttctaatttaatcatttaatgctatatttcctttcaagatatccaactaattgtgagatagtcactgtcataataaggtaaatcacagcaaccgtaccccagatttcaaaggatgcataggttttagcaatgattaattgaccacgacgtgtcaactcctcgaaaccgataacagaaactaaagaggaatctttcaacatggcaataaattcgttccctaacggaggaataattgctttaaaagcttgaggcataatgatgtaacgcatggtttgtccccaagttaaaccaagagaacgaccngcctccatttgacctttatcaatagattgaataccagcacggaaaatttcagatacataagcaccagagttaatactacatgcggtaacagccgcaatatatggatcaatccgttgacctgtaatcataggcaaggcaaaatagattaggaaaatttgcaccagtaatggtgtaccacgaatgatatctacataacattttgcaagcaatctaactaatctaaatttagataaatttgctaaagatactaaaagaccgataaaaaagccacaacctacagacatggctgtaatttctacagtcactagagcaccttgtagcaagagcggtaaattatccgcaattaacccccaattaaaactcataatctctcctattatttaaattctaaaactactggcatatcagcaggtgnatctacattaaaccattttttatataatgtattaaattcaccatcagccttcatatcagcaattgctttattnatttcttcttgcaatgctttgttatccttattaattgctaagcccaaatattctttagtatttggatatgccataaatttaatatgttgntcaggatgcttagtactgtaatattgagctacaggtaaatcgattacagttgcatctactccacnattttgtaattctaacaaagcttcattactatggtcaaattcttttacagtagtaccttcaattttatgagctaaatctgcaccagtagtacctaattgggctgcaatttttttaccctttaagtcatcaagagaattcacagccgttccatctttatatactactgctaaggcattttcataataaggagaagaaaataatactttttcacttctcgcttttgtaatngtcataccagatgcagcaacatcaatatcatgtgtgttcaaagctggaatcaaagcatcaaaagctacattttttagctctacatctttattaatacgcttaccgatcgcacgaatcaattcaatatcaaaacctgtataatcttgagttttttcatctttaaactcaaatggaacaaatgtagcattagtgccaacgacaagtttattagatgtaggttgattagaagaaccacatccaccaactaaagaagccgccatcactaacatacaaccgccaagaattattttttttactttgctatttaacatattatcaacctcattattttaacttactactactttataatagtatatagattaagtataattatgtcaataattttgtatataattttagatgcaatcgcaaaatctctatatttatattttaattttatacattgtttgtataaatattacgttcatgtataaaaactttcccatagttagtggttttctatagattttataatatacaactgtataaaaaaagcacatgagaaaagcctcatgtgcccctatacggctgacctggtctttgcccccacactcgcctgctggaaggttcgctcataagtccaagactccccactactacctctctcgattttatcggcaggacttacacctaagccgcaccatgctcacaaccctttgggctgcttatgtggatcgttttgcctgcgactagcctcgactttcaaccacagacccgtatagacgtattataaagaataacagtattcatgtctagttttactattattttaaaaaattttgattatatagttaagtagccaaacataatttttttaccaaacatactatcgcataattcttagaacaatgagaataaattttgcaacccctatttgttgatgtatagaaaattggaatagaaaacctaaaatattcttcataatattttaatatttctaaaatcacattttttaagtaccatatctagtggattcttaaattgtcaattagtttttgtatgccaaatatgaatacaacatatttgtaagaacatacgtatcatacacaaaaaattatttatggtgtataatttgtatactgttaaattagaacggcctaaagttgtacgatatgaacataagtacgaggggttgtaccatatgttcagtttgttagttagaggggtttattatgtttatgttatcattgatgcaaccatcaggtttgtatgaactggagaaagatagtttagaagccataagcgcacaacttttacagatgatacaaatgaaaagctatcatctctatacacattctatccaggtttcaaactatgctgttagcatcgcagctaaaatgggtttgccattaaatgaaattgaacagattcgtcacgcagctctacttcatgacgtgggtctattaatggtacctaatgcattaatccaaaaatctccatatcttaataagcaagaaatgtctaagtataaacaacatgcggcaagtggngccaatatgattgaaaactatccttgctgccaacaaattttgccttatattcgttaccatcatgaaaaatgggatggctctggttatcccaaacatttacgtggtgccaatattccgttaggagctcgaattattgctgtagcagattactatgatacaacagttaatccttctactgaattttgggcgaaaacaaaagctaaagcaaaagaagaactctttagtgcatctggctcactctttgatcctgatgtagttaaagcatttattgatgtgcttggctaatatgaaatcaaatattatattcctacatttagtaataaagattagaaactaccactagccagcgtaagggcatcaatgcgtagcgctttatgcttttgtaagacttttgctacagcttcaattgtggcacctgtagtatatatatcatcaacaattaatatattcttattggtaaaatcaatatccttataatcagcacatataacaaaggcatcatcaatattttgatgtctttctttatttgttaatccccacatatctcgagaagtatcaaacttgtatatacaatctaaccatttaaagttttttctatctatctcccataaagaatgagcccattcaagaaagaataaatctacttgattatatcctctcttagcttttttcttttcgctagatggtacaggaacaatataatcatacataattttacaattactattcacaatattagactcattatatttcatgtaaaagttgtacgatactaaaaaaggagcggcccctttggactgctcctttttttcattaaattttacatcgtaaatcatagactttagaccaccacgatattcggccaacacacatacatcatctacatagtgtaaaaatttatgtggtacatgacgaatatgtaataaatctgtaaaacaagctttac

SEQ ID NO: 1439 - DNA, 4000 bp, Escherichia coli
  misc_feature (770)..(770): n is a, c, g, or t
  misc_feature (1161)..(1161): n is a, c, g, or t
  misc_feature (2008)..(2008): n is a, c, g, or t
acggccattgcccgtaataacgcctgcggtaaggccgtcatcttcatcaagttcttttatcgcgttccacagcccattggacagagcgccattgatcgcgttcatcgcatccggacgatttaaggtaatgatcatcacgcgatcacggcgttcgactaggacggcttgttcttcactcatgggtcaaatcctttcttattaggcaattgtgcgaactcgaaccatagcgcaattgacgctggggtaaaactccgtctcgctcaaaaactcactcgtgccaagatttgagaagtatttaaaaatccaaaagataaccaaggaatgctggttgctgaagtttgctgacctctgttagggtcaaaatcctaacaaaaccagatggcaacggagggtgaatagatgtcccacagaagcgcgcaagaaaccatagaactgttttggcagattcaaaatgatggggactacactcaggtcgtgaagctctttgcagaaacggctgttttggtcgatcctgtgtttggcgtctttgagggtcgagccgcaattgccgaatttatggcaaaaatgaatattgaaatgcagtcgagacaaaccacttttaaagctattgagattgccggaggcggtgatacggcctgggctcagtggcttgctgagacgccgacaggcaccatcgaaggatgcggtctttatcgggttgaagagggtcttttaacttactacaaagactatatgaatccaccaagttccgcttgaggctttaggcaggngaggcagcgcctgcatcgatcgtcatccagacttggaatgcctgcaagctagtttttgtatggagggatgcagatgttaacgcgtaaatatgggtatctctgggataacgcatcgggcgatgtatccgatgctacaaggcgcctagagacaagtggtgcttgcgtggtcaaaggggtttttgacgaggacgctgttgcacagcttcgggaagccattgacgaggtgtttgcagtatttccggccgatcgtcgaagtgagcatcgcgctcaacaggcggaccagcaatttcgatatgaaatgttgaatcgaagtagtcaatgcctaaaagccgtggccaactcgataattcttagtactatcgagccgcttttgggagaggattgtcatgtnattgccaacacggcatggcgaaatccacccaacccgaatgatagcgctcagccctggcatgtagatggcggtcctcacatccccttgccggcggatgttttgtggccgccggagattccccaccctgtgtttgcgatcggttgccatatcctgttgcaagattgtgcgctgaacgatggtcccacggggtttattccgggcagtcacctgtctgggcgacctccgccttaccgccaggcgttggatgcaaacctcacttatcaaggccaaggcgcagttcccttaacgggtgaggttggcgatgttttgttatttgtgtctgatgtttggcaccgaagaatgcctacaggcgcaaacgatcgcggtcggtattttttgcaggtgcactatgcccgtcgagacattcagcaacggcttaaaacaagtgatatcagccatcagttgagtgattcgatactgtcagatctcgatggcaaagataactcgcggttgcgaaccttggttgggttgcatagtcctgggttttatgatggctagggtttaatttgcgcatcctgacaaggtgatcatcattgcttgtctgccaaggcgcagcctacaagccttttaatccgatgattaagccaaggtgattaaagcaaggtgattaaagccgattatttcgcagcggtgattaaacaaaacgcggcgactcaggcataaacccttggggttgggtttttagttagcttcggcaaagcatgcagtgcctgatctatctggcgccagagtgcgctcttaagcccaggaaccgtccgcgaaatgcgccaatgtaaagtctagtctaatgagccctgggcagggcttntgccgacgtattcacaaatcgtccgtttaatttttttggcgacgatgggtcacgcgcgaaggttcattattgaccagcggatggtattgttaggctccgatccgagtagggtagtctaccaagtattcagactaagccgggggtgttgcggcctgcattttcgccatttcttcccagctcaaataacgcgtgaggccgtcgtcatcgaagaagatgactgggccgttacagataaaaagatactcagtatcttcaagtgcaactgtcgcgccatggagcacgccgttgggttcgtagtcgtagtcgccggcattcaaaatgccatctctgacttgcagcttgcctttgatcacgaaggtatgcgcatctgaaagatgcttatgaggcgacgctgtgtagcctttgttccagcgaaaaagtgctgcccagccaccactttcggcgccggtccaaagcacttttgtccatgcctgacccggctctgtttcgatccagggcgcatctgatcgcacaataatatcggccagctgattattgataggagtaatgtcttgtaatgccatgctgtgtacctgataaggagttgacggtgtcaacatatacccttctgcgttgtgtttaaagtcaagccgaatttggaccttaatgtagctaatgcgagttgaaagatagcagacggcgtgtgcgagcaactgattgctcggtcgaaggtttaatggttgcacgatcgagaagtcaataaccgtttaccgactaggtcgcacggtcacaccaagacatccgtggtccgttgggcgtagattcagctaatccggtattttgtcgtcagcttatcgagtctgtttatggcttcaaacaggatgagctttgttgagttgggcggaaatctcacgattgcggcaatgtatttaccccggtcttagagtaatttttttacatgctcggcgcagtcttccgcggggctccagaaccaacccttaggatcccaggctcggccgcaagtcatgtaaacgcattggctgtacgccccgatcacttcgtctttgcgaccaagttcatcgagggcgcgggctttggcccaaagcgcgagggcaacatcattgatgaggtagttggcctctatttttgcgcgcgccttagcggagacacgaccagtcttgggacagcgcttaccggcatcatgcattcgcttttgttggtggcccgcttctggtccccagcgatcaaagcaagcatcaacggttgccactgcggcttcagagtcttggctggcaaactgctcaacggctcgcacagcccaaaaggctgaatcccctagggttgcatctgtagaaatacagggatctgcctcaccagcattattggcgaatgcagcctttgagaaatcaaaaatcaagaaaacgagagccataaggctcgcagatagattaggcctaaacatgaaagaggtatccttaattcattgctgaagggtgcatgtgctgatcagccgtcgcagaagggcaccgggtttctgcgcgtttggtcaggaaaggcgacgctcaaggtaaacctcagcttctggcgcgaccgcactggtccttcttgcactgggctctgtcctgaccaaaagtcacgaaacataggtcgttgagctacccatgcggttaacgcttcagcgcggaaaaacagcgaggcgctaaaactctcacgtacttggctcacggttacttcatgaaggatccgtgtttttggcgcagcgctcgcggtatctaaaaatttctgggccaacggtgggacccagctgttcgaatggggacgttcatgaacgaccaggccttcggttaagcccctcctgacagcagtggcagcctgtatctgggcacatctgggcttcgatatctgccgcgattgatgacaactcagcgtcattgcctcgtgatgattggctagctgagttgcacaattggcctgggtcaagcgagcctctcagcgacaaaatcgagaaaggca

SEQ ID NO: 1440 - DNA, 4000 bp, Escherichia coli
  misc_feature (594)..(594): n is a, c, g, or t
  misc_feature (645)..(645): n is a, c, g, or t
  misc_feature (978)..(978): n is a, c, g, or t
  misc_feature (1985)..(1985): n is a, c, g, or t
  misc_feature (1987)..(1987): n is a, c, g, or t
ttttcttcgcgcaactcatccgtgatgtttgacagcgttaaaccaagcagctcggcttttggcacctctatcgtttcctctggcactggcgcggttgccaaaattgcctcttcacccggccgttgccccaaaatcacgtccagcgttttacgctgcccgtcgcgcaatacgatcgtctttacaactttgcccacgggcgatttgccaaccaatttgaccagggatccagaatcggtaaccgcctgcccgtcaaacatcacgatcacatcggtcacttgcaggcctgccgctttcgccgggccatcaaaaacatccaacacgatggcaccagatggttcatccatcgcaagcgcatccgccatttcatcggtgacattgccaatattcacgcccaaccagccccgacgcacttcgccaaattcccggatttgatcaacaacgggcaaaaccacattggacgacatggaaaagccaatccctatcgatccgccattcggcgagaggatggccgtattcacaccgatcacatccccgttcatattgaacaaagggccgcccgaattgccgcggttaatcgctgcatccgtctgaatntaatcgtcataattacctgataactcacgatttctagccgaaattatcccngctgataccgaaaatccctgccctaaaggattgccgatggccatcacccaatcgcccacgcgcgccacatcgctattgccaaaggcaacgaaagcaagcggaccctctgcctctactttcaaaaccgcgatatcaacgtttttatcaactccaaccaatgttgcagaaagctctgccccatcggaaaactcaaccataatctcatcagcaccttcgatcacgtggttattggtcaccacatagccatcttctgaaatcacaaagcctgacccaagcgccgagcctctgcgcggtccaggccgcgaggggccacgctcattaaaatcgcgaaanagatcctcaaatgggctgccctcgggcaccacgccgcgtggcattacattttccgacatttttgtcgttgtcgtaatattgaccacagcggggctaatctcttcaaccagatcagcaaagctttccggagcgctgcgcgccgccgccattaggctttgtaaaagaaccaaaattgtcaccagaaaggccagtttcacggctttaaagcttatctgccccggggcttttgcggttataacgggcacatatgcgctgcctcgcttaatattcataaatgcaactccttgtcatttgctcaatgtggtttgctcgaccgcggatcttttggagattgtcaaaatatccggcctccgcctttaaataagcccgccccccccaacagacaagggccacagccaatcttcagctaaatgtgaacaaacgtgtgctgatgcggtgcgctaggcgattatccgcgcagcccataaaataatagcgcccagcaaagcgatgacggccccaatgaaccggcgctgcgaaagcggcaaggcttgcaaatattgcaacatcgcttcaaccaaagaaggggccagcacatagaccagcccctcgaaaactaaaatcaatccaatcgcccataggcagatttcgatcatttagcgattacatccgatttcaaatagttgaaaaactcggaatccggcgacataaccatcgtcgaattctgacccttcaacgcggttcgataagccgccaaagatctgtaaaattcgaagaattccggatctgccccgaacgcgctggcaaagattgcgtttcgttctgcatccgccaaaccgcggatgatttcagattcgcgcttcgcctcagatacgatctcaacttgcgttctgtccgccaaggcccgtacccgctgcgccgcttcgttcccgcgagcgatttcatctgcggcttcacgttcgcgctcggcgcgcattctggcaaaggtcgcatctaagttggcgcgcggtagatcggttctcttcaancntacatcaaccacttcgatgcccagcggcagcgctttttcaatcgccgcgttgcggatccgcgacatcagaacagcccgatccgaactgagaatatcgttcgagctaaccgagcccagaacttcacgcatttcacttttcaaaatgctgtccaaacggctttctgcaacttgcacaccgccggtgccaacggcttcacgaaactggttcacatccgtgatccgataccgcgtaaacgcatccaccaccaaacggcgatcatccaaaggcgtcacttccagcgggtcaacatcgcggcttaaaatccgatcatcatagaagacaacttcttgaataaagggaattttaaacgccaaaccaggatcttctttcaccgcaaccacgcggccaaattgcaaaaccagtgctttattccgctcatcaacgatgaacacggttgacatgaacagcgcgatcaaaacgacagcgactggaacaataaaacttaacttacgcattagtttttctcctgacgcaattggttcaatggcagatagggcaccacgccctgaccgccggtttgatcatcgatgatcaccttctcaagcccacctaatacctcttccatggtttccagatacagccgtttgcgggttacctcgggggctttgctatattcttccaaaaccgcactaaagcggctggcttcacccgtcgcctcattcaccacgcgcgcacggtacccttcggcttcttcaaagacctgcgcagattcaccacgggcttgcgccaagacgcggttcgcataagcatccgcttgcttttccagacggtcgcgctcttgctcggcggcttgcaccgcgcggaacgcatcaatcacctgttcgggcgggtctgcccgatcaaagttcacccgcaccaagctgacgccgctgccgtaactgtcgagcgtttcttgaatgagggtttcaagatttgcagcgatcaaaccccggtcacggttcaggatcggggccaattcagattgggcaataatttcgcgcatcgcagattcagacacggcgcgaatggtcatttgtggatcgcgcaagttgaacaaatattttgcgggatcgctaatattccagaccacctcaaaatcaatatccacgatattctcatcgcgcgtcagcatcaaacccgcgtcactgccgcggccacccacgccaatgctttcattttgttctcgggttaccggcaacacttcacgggtgactagtggccaaggggcaaagttcaaacccggattgccaatagaggaaaacttgccaaggaataactcaaccgacttttcttccggcttcacagtgtaaaaactggaaaaactccaaaacgccaccaataaagccgcgatcaataaatagccgctgcggcccatgccggggccggattgctgcgaagatccgttggatcctccgcccgaaccgccgcccaataaaacctttagctgctcttggcctttgcgcagcatatcatccaattctggcggcatttgcgggccatcattgcgcggacgacgatcgtcgccgccgttgccattgggacggttgcgatcatcattatcaccgccgccgccgccgcggccccatgggccacctgagtttccagtcattaaattcgttcccttatttgaccttgcatatttgtgaatttccccatctctttacatgggcgtatttttttcaatttcaaccgctgcgtgatggatggcgcatcgtaaccagttcttcggccaatgtcggatgaaccgccacggtttgatcaaaatccgctttcgtcgcccccattttgatcgcaatcgcaaccatttgaatcatttcaccggccccgggggcgatgatatgacagcctaaaaccttttgggaagcttgatcgacaaccaatttcataaaggttttttcgtcttgttgcgcaaagccttggcgcatcggcttgaactgcgtggtgtaaatatcaaccgggcctttggcacgggcctctgcctcgctctgcccgat

SEQ ID NO: 1441 - DNA, 4000 bp, Escherichia coli
  misc_feature (617)..(617): n is a, c, g, or t
  misc_feature (1881)..(1881): n is a, c, g, or t
  misc_feature (1986)..(1986): n is a, c, g, or t
  misc_feature (3123)..(3123): n is a, c, g, or t
ggacttcaccattcgagcaatcacccccggtgtaaagttaatccactgctacaatccgctaaacgaccttttcaacctcgaagtcagaatggattttggttttgatcatgagccgaaactatcttttgccaagcgcatgcttgatcgagcaggtgcgggcgaaattgaatctgatgctctcaaaattgagtggtacaaattaggcacagattttggcttcggcattcaggagcatttctcaaattttttcattaatggactcgatgaaaactttgaggaatccttagaccttactggaatccacctactggatcctaaaactttagatagtgtttgggcacaaactaaagacataattctctccgagcgtgatgatgagacaaaagaccctaattcactgacgcatgcactcgctcactttcaccgatacggagacaaatctcgctacctcaaacgctcctcggataatgaattaatggcatcttctactgttgagctcaaaaaaatactcaaaaaagccatctttgctccccgttcgattctttattttgggccgaaatctcctgaccaagttgaaaacctaatccgtaagtcttttcttggtaaagcaccggagncaacctcgaatgacaacacacctgaccgttcaattgaccctcaaaaaaaccaagtttatttcctccataaagaaatggctcaggcacaggttcgtttggaattctcatcaggtttacttgatgaaaacctcacaccttcagttcaactttttaatgaatactttggcggaggtatggctggacttgtttttcaggaactgcgtgaggcaagggctttggcttactcagcttgggctcgtttttttactccttccagacctaacgaagaaaatattttagttggttcaataggttgccaagcagataaaacaatcgatgcggttcatgctttcattgatctgttaaaaaaaatgcccattagtgaaacccgttggtcttcagctcaaacatccttgctaagtacctatcggacaaaccccatccattcccgtgcgattccaggattcgtttatgatgtcaatgccctcggtttagatttggatccgagaaaaagtagatacaaagctcttcagaattctaagattgagaattttacagacttttaccaagaaaaggtacagtcccgtccaatcttgttttctatcgtaggagattctaacagaatcaatataaacgatttggcaaaactcgggaaagtgactgaaatcaaacctgaacaactcttcaggcgctaggaggcttttcctgggctcccctagtgctgtcaggcataccatcagatagtggtgtgattgggctaacttcttcttcgcgacccaggaaagtattttcactttccgaatttttctttatttgttcagaaagcccgatctctcttttatcagattgacttgttgcatctaaaataacttcagagtccggaagatccatcacattacgaaaaaaattaaaaacttttaagctttctgactgcctttcctcagaattattcagtctcaaagaaagttgttgggttcttccattttgtaattctgtcatcgtacagctacaacccgacttttgattagagcccggaaactcgatcacatcaattcttcccattggagaaaattcgctttgatctttggaagtctccatgtacagggacactctccgtttttcaaaattaaacatcctcaaacattttacctcgtgagacttcgtttgcttaagcatagactccattccttggcgcaatctatcgataatctgaacagcacgattcatatctcccatattcgtaaaaactccatgtttttagcaacagaaatttgacttatcacanaggtctccaggaattactcatgtctagttaaaataattgtaaaatcgagtcttccgtaaacattatatcggaattgacggtttctattctcatatgtattttgantgcttgcttgcgggtcggtagctcaatcggtagagcagtggccttttaagccattggttccgggttcgagtcccggccggcctaccaagcggaacatttcccaccccaagcaaaaactactgatcactcaaatattttgatgtaagttttttcaccgtttgccagtcgatctttccacttcccaaggtgggaattaccgaaacagttagaaattgtttagggatccataaattgggtagacctatctgtttgagtttctgcttaatttcttcagcattgatttcaaaagtactaagaacaatcattcgctcccctttttgttcatctcggactgcagagacaacaagcttaacctcttgatctgatgtcatgtctaatgcgttcataatctcatcctctattttagagtgaggaaccatttctccacctatcttggagaaccttgataccctaccctcaatccaaagaaaaccatcacgatcaactcgacccaagtcaccagtatgaaaccaaccatctggagtgatagtcttattggataaatcggtatcctcccaatatccgttaaaaatatttggccccctaaaacaaagaattccaccacgatcagaatctgttatttgaccattttctgggtcaagagtacgacattcaattccaccaagtaaacgccccacagatccttttcttttttgatttccaggaagattaaatgaaactgcaggagaagtttctgtaagcccatatccctcaagatattcgcaatcaccgaaatcttcccactgcttacataatgcaccaggacttttttctgctccagatacaacatatttgacgcttagaagatcattcttttgggctgttttcaaatatcctcgcaaaaaagtgggagtgcctagtaaaacttcaactttctcctctctaattgccctaatacttgatttactatctaaaggattgggtgtgcatacgagtactaggccacgcaaggtcgaaaaaatcataccaacagaaagaccaaaactgtgaaataaagggaggttaagtaaaactctcgttttttcctcaaataattgtaaagcaaacatttgtttacaattggctaatatatttgagtgacttaatgggactcctttnggtttccccgcactgccactagtaaaaagaaggagggcagtttccgtatttccattagtggaaatattgaagtgggatcgtactctcttgggcatgatcaaaaccgttgtgtagatcaataaaaccaaccatcgttttgcccgaagtttttttaagatttcatcaatcaatatgcattgattagtccagggaaattccgggaccttttttttcattttcgaagcggtaattaatgtttgtaaaccaatacgctcaataatctcctgattaatttctctccctaatgtaaaattaagattaactggtactcgcccgctgaggagtaatgaaaggttcgccagaatccccccgaaaccaggcggcagaatcactccaaccagtttttctgattcaagccttttatttaaataagaacaaaagagtagggaaagactcagggttacacctctactgaacttcattttggggttgagaccataatcgcaaataaattcctgaaatggtttttttctcagagaatcaaaaagggcacttcctaaatgatgatgttgtgaaatagacacaagaaaaccctaggacaaatgaattggaattgccaaccagattgaggatgagatgtagtttcttatcgaggaaagggcttggtaactatcccttgcacccttctgctcgaagtactatttatagataagcatcaatttttttataaatatgggagagaataatattttgatttacgatactacccttagggatggttctcaggccgagggtgtatcgttcacggtcgcatccaagctcagggttgcacaaaaactggatcagtttggtgtcgattacattgagggcggatggccagggagcaatcctcgagata

SEQ ID NO: 1442 - DNA, 4000 bp, Escherichia coli
  misc_feature (27)..(27): n is a, c, g, or t
  misc_feature (1447)..(1447): n is a, c, g, or t
  misc_feature (1450)..(1450): n is a, c, g, or t
  misc_feature (1463)..(1463): n is a, c, g, or t
  misc_feature (1468)..(1468): n is a, c, g, or t
  misc_feature (1483)..(1483): n is a, c, g, or t
  misc_feature (1504)..(1504): n is a, c, g, or t
  misc_feature (1507)..(1507): n is a, c, g, or t
  misc_feature (1534)..(1534): n is a, c, g, or t
  misc_feature (1567)..(1567): n is a, c, g, or t
  misc_feature (1571)..(1571): n is a, c, g, or t
  misc_feature (1662)..(1662): n is a, c, g, or t
  misc_feature (1681)..(1681): n is a, c, g, or t
  misc_feature (1689)..(1689): n is a, c, g, or t
  misc_feature (1704)..(1704): n is a, c, g, or t
  misc_feature (1977)..(1977): n is a, c, g, or t
  misc_feature (1986)..(1986): n is a, c, g, or t
gcaaaatcatccggactaaaccctttntcagtaagtaaactcactgccaatgcatcgcccatcgcaagtgccactgtggtggacgaggtaggtgctaaattatgcggacaagcttctttttcaacgccgacatcaagatgaacgttacagacttcgccaattgaagagtgggcattgccagtcatgccgataatcggcacaccaagtcgctggattactggcaccaaggtcataatttcatctgattcacccgaataagaaatggtgatgaccacatcaccttcagtaatcatgcctaaatcaccatgacctgcctcacctgggtgcactgcaaaagatggggtgcctgtggaagcgaacgtggcagcaattttattgccaatgtggcctgatttacccatgccaataaggataactttgccagtgcaattctgaatcagttgacaggcatcaacaaaactttgatcaagactttcggccaacttggttactgcttgggcttcggttaagataacgtccttggcagattgtatgagtgagtttgacatgggttctaaaattagttgatataatgttcgattttatcgataactaggatcaatgggcaaggaaaaaatcaaaattttatttgtgtgcatgggtaatatttgtcgatcacccacagccgagggcacatttagatcgcaagttaaaaaacaaggtgtcaaagatttatttgaaatcgactctgccggtacacatgcttatcatattaatgaggcaccagattctcgctcgcaattatcagcacgtaagtttggcgtggatttgtctgatcaacgtgggcgccaagtgcatgaatccgatttttatcattacgattatatttttgccatggatgcctcaaatttagcagatcttgagtttatctgtccagaagaatatcaacataagctttctttgatgttagacaatatcccaaataataacggcagaagtgtacccgatccttattttgaagggcgctttgacgaggtgtttgagatgctgaatcgtgccagtgattttttgttgcaaagtttgttgaaaaaagtctaaaacttattgacacggaccctccttacacagtataatttgcctctttattgcccttgggaaaacagcgggtaatttttaagacttaattaattaagagaatttcggagaaattgtatttatgtcaacgattaaccaattggtgcgtagtccacgtaaaaagaaagttgttaaaagtggtgtgccagcattagacagctgtcctcaaaaacgtggtgtttgtactcgcgtatacacaaccacacctaaaaaacctaactcagcattacgtaaagttgctcgtgttagattaaccaacgcagctgaagtaacaacttacattggtggtgaaggtcataacttacaagagcactcagtgattcttattcgtggnggncgtgttaaagatntaccnggtgttcgttaccanacagtacgtggtgcactaganacngttggtgttgacggcagaatgcaaggncgttctaagtacggtactaagaaacctaagaantaanaacaatttaaaataagagaaacactatgagaagaagatccgcccctaaaagagaaatcctaccagacccgaagtttggtgatttagtattngctaagtttgtaaacatcntaatgttngatggtaaaaaatcngtagctgagaagatcgtttatgatgcgttagatacaattgaagctaaaggtaatgctgagccaatcgaaactttcaagcaagcgttagacaacatcggtcctcaagttgaaatcaaatctcgtcgtgttggtggttcaacttaccaagtcccaattgaagttaggtctgagcgtaaggtcgcactagccatgcgttggattattgaagcatcacgcaagcgtggtgaaaaaggcatgaagcttagattagcaggcgaagtattggacgcggtncaaaatcgnggtactgcatttaagaagaaagaagacactcatagaatggcagaagcaaataaagcgtttgctcattttcgctggtagtcgaatatttaaggatttaagaaaatggcaagaaatcacccacttagtcgctatcgcaatgttggcatcatggcacacattgatgctggaaaaacaacaactactgagcgtatcttattgtacacaggccgtactcacaaaattggtgaagtgcatgacggtggtgcaaccatggactggatggaacaagagcaagaacgtggtattaccattacttctgcagcaacaacctgtatgtggaaaggtatggacgatcagttcgatgagcaccgtattaacattattgatactccgggacacgttgacttcaccattgaagttgagcgctcattaaaagtattagacggcgcatgtgccgtattttgtgcagtgggcggtgtagagcctcaatctgaaaccgtatggcgtcaagctaacaaatacaacgttccaagaattggttttgttaataagatggatcgtgcaggcgcagatttcttacgtgtttgtgagcaagttaaaacacgcctaggtggccacccagtgccgatgcaaattgctattggtgctgaagaagactttaaaggtgtggttgatttaattaccatgaaagccatttattggaatgaagaagaccagggtgcgacttacgaaactaaagatattccagcagacctacaagacttagcagacgaaaagcgtgaattcatgattgaatctgctgcagaagctaatgacgacctaatggaaaaataccttgaagaaggtgagttgagcgatgatgaaatcaaagagggcatccgtttacaaaccattaaaagtgaaattattccaatgttctgtggttctgcctttaagaacaaaggcgtacaagcggtattggatgctatgattatatatatgccgtctccactagatgtggaatctattactggcatcttggatgacaaagatgaaaccgtcgcaccaagaaacgcagatgataatgagccatttgcagcattagcgtttaagattgcaactgacccatttgtaggcacattaacattcttccgcgtgtactcaggcgtcctaaaagcaggtgattttgtatttaattcatccaaaggaaaaaaagaacgcattggccgtatggtgcagatgcactcaaacgagcgtgatgaaattaaagaagtacgtgctggtgatattgctgccgcgattggccttaaagacgtaaccacgggtgacactttatgtgaccttaaagagaaaattgttcttgaaagaatggaattccctgagccggttatcgcattagcagttgagcctaaaaccaaagcagaccaagagaaaatgggaattgctttaggtaagctggccgctgaagatccgtcatttagggtatcaagtgatgaagagtcgggccagacaattattgcaggcatgggcgagcttcacttagacattattgttgatcgtatgattcgtgaattcgacgttgagtgtaacgttggtgcgccacaagtgtcttaccgtgaagccattacaacattagttgagcatcaacacaagtttgctaagcaatcgggtggtcgtggtcagtacggacatgtgtatttacgcattgagcctcaagagccaggtgctggctatgaattcgttgacgaaattaaaggtggtgtaattcctaaggaatacattcctgcggttaacaagggtgttcaagagcaaatggaaaacggtgtattggctggtttcccactagtagatattaaagtaacggtttatgatggttcttaccatgatgttgactcgaacgaaatggcgtttaagattgccgcttctaagtgtttagcagaaggcgtaagaatggccaatcctcaattgctggaacctatgatggcagtagaaattgtcacccctgaagattacatgggtgatgtaatgggtgacttaaacagacgacgtggtttag

SEQ ID NO: 1443 - DNA, 4000 bp, Escherichia coli
  misc_feature (1)..(2): n is a, c, g, or t
  misc_feature (4)..(4): n is a, c, g, or t
  misc_feature (6)..(10): n is a, c, g, or t
  misc_feature (13)..(14): n is a, c, g, or t
  misc_feature (16)..(16): n is a, c, g, or t
  misc_feature (18)..(19): n is a, c, g, or t
  misc_feature (21)..(22): n is a, c, g, or t
  misc_feature (24)..(26): n is a, c, g, or t
  misc_feature (28)..(28): n is a, c, g, or t
  misc_feature (30)..(34): n is a, c, g, or t
  misc_feature (39)..(41): n is a, c, g, or t
  misc_feature (43)..(44): n is a, c, g, or t
  misc_feature (46)..(47): n is a, c, g, or t
  misc_feature (50)..(50): n is a, c, g, or t
  misc_feature (52)..(54): n is a, c, g, or t
  misc_feature (57)..(57): n is a, c, g, or t
  misc_feature (63)..(66): n is a, c, g, or t
  misc_feature (68)..(72): n is a, c, g, or t
  misc_feature (74)..(77): n is a, c, g, or t
  misc_feature (81)..(83): n is a, c, g, or t
  misc_feature (85)..(86): n is a, c, g, or t
  misc_feature (88)..(92): n is a, c, g, or t
  misc_feature (94)..(95): n is a, c, g, or t
  misc_feature (97)..(97): n is a, c, g, or t
  misc_feature (99)..(104): n is a, c, g, or t
  misc_feature (106)..(114): n is a, c, g, or t
  misc_feature (116)..(116): n is a, c, g, or t
  misc_feature (118)..(119): n is a, c, g, or t
  misc_feature (121)..(122): n is a, c, g, or t
  misc_feature (124)..(124): n is a, c, g, or t
  misc_feature (127)..(127): n is a, c, g, or t
  misc_feature (130)..(131): n is a, c, g, or t
  misc_feature (134)..(137): n is a, c, g, or t
  misc_feature (140)..(141): n is a, c, g, or t
  misc_feature (143)..(144): n is a, c, g, or t
  misc_feature (146)..(149): n is a, c, g, or t
  misc_feature (151)..(152): n is a, c, g, or t
  misc_feature (154)..(162): n is a, c, g, or t
  misc_feature (164)..(164): n is a, c, g, or t
  misc_feature (166)..(167): n is a, c, g, or t
  misc_feature (169)..(173): n is a, c, g, or t
  misc_feature (177)..(178): n is a, c, g, or t
  misc_feature (180)..(180): n is a, c, g, or t
  misc_feature (182)..(183): n is a, c, g, or t
  misc_feature (185)..(188): n is a, c, g, or t
  misc_feature (190)..(190): n is a, c, g, or t
  misc_feature (192)..(209): n is a, c, g, or t
  misc_feature (212)..(214): n is a, c, g, or t
  misc_feature (217)..(217): n is a, c, g, or t
  misc_feature (219)..(220): n is a, c, g, or t
  misc_feature (222)..(227): n is a, c, g, or t
  misc_feature (229)..(230): n is a, c, g, or t
  misc_feature (232)..(233): n is a, c, g, or t
  misc_feature (238)..(240): n is a, c, g, or t
  misc_feature (244)..(248): n is a, c, g, or t
  misc_feature (251)..(251): n is a, c, g, or t
  misc_feature (253)..(253): n is a, c, g, or t
  misc_feature (256)..(259): n is a, c, g, or t
  misc_feature (264)..(264): n is a, c, g, or t
  misc_feature (266)..(266): n is a, c, g, or t
  misc_feature (270)..(270): n is a, c, g, or t
  misc_feature (273)..(274): n is a, c, g, or t
  misc_feature (277)..(277): n is a, c, g, or t
  misc_feature (279)..(280): n is a, c, g, or t
  misc_feature (282)..(282): n is a, c, g, or t
  misc_feature (285)..(285): n is a, c, g, or t
  misc_feature (287)..(291): n is a, c, g, or t
  misc_feature (297)..(297): n is a, c, g, or t
  misc_feature (300)..(300): n is a, c, g, or t
  misc_feature (303)..(304): n is a, c, g, or t
  misc_feature (306)..(306): n is a, c, g, or t
  misc_feature (309)..(309): n is a, c, g, or t
  misc_feature (312)..(313): n is a, c, g, or t
  misc_feature (315)..(316): n is a, c, g, or t
  misc_feature (318)..(320): n is a, c, g, or t
  misc_feature (324)..(325): n is a, c, g, or t
  misc_feature (327)..(328): n is a, c, g, or t
  misc_feature (330)..(334): n is a, c, g, or t
  misc_feature (336)..(340): n is a, c, g, or t
  misc_feature (342)..(343): n is a, c, g, or t
  misc_feature (345)..(345): n is a, c, g, or t
  misc_feature (347)..(349): n is a, c, g, or t
  misc_feature (351)..(351): n is a, c, g, or t
  misc_feature (353)..(355): n is a, c, g, or t
  misc_feature (357)..(357): n is a, c, g, or t
  misc_feature (359)..(362): n is a, c, g, or t
  misc_feature (364)..(369): n is a, c, g, or t
  misc_feature (371)..(371): n is a, c, g, or t
  misc_feature (373)..(373): n is a, c, g, or t
  misc_feature (375)..(375): n is a, c, g, or t
  misc_feature (377)..(377): n is a, c, g, or t
  misc_feature (379)..(379): n is a, c, g, or t
  misc_feature (381)..(381): n is a, c, g, or t
  misc_feature (383)..(383): n is a, c, g, or t
  misc_feature (385)..(385): n is a, c, g, or t
  misc_feature (387)..(387): n is a, c, g, or t
  misc_feature (389)..(390): n is a, c, g, or t
  misc_feature (392)..(399): n is a, c, g, or t
  misc_feature (401)..(401): n is a, c, g, or t
  misc_feature (403)..(405): n is a, c, g, or t
  misc_feature (407)..(409): n is a, c, g, or t
  misc_feature (412)..(415): n is a, c, g, or t
  misc_feature (417)..(417): n is a, c, g, or t
  misc_feature (419)..(422): n is a, c, g, or t
  misc_feature (424)..(427): n is a, c, g, or t
  misc_feature (430)..(430): n is a, c, g, or t
  misc_feature (432)..(438): n is a, c, g, or t
  misc_feature (440)..(444): n is a, c, g, or t
  misc_feature (446)..(449): n is a, c, g, or t
  misc_feature (451)..(451): n is a, c, g, or t
  misc_feature (454)..(454): n is a, c, g, or t
  misc_feature (457)..(460): n is a, c, g, or t
  misc_feature (463)..(466): n is a, c, g, or t
  misc_feature (468)..(472): n is a, c, g, or t
  misc_feature (474)..(476): n is a, c, g, or t
  misc_feature (478)..(478): n is a, c, g, or t
  misc_feature (481)..(484): n is a, c, g, or t
  misc_feature (488)..(488): n is a, c, g, or t
  misc_feature (491)..(494): n is a, c, g, or t
  misc_feature (496)..(505): n is a, c, g, or t
  misc_feature (508)..(509): n is a, c, g, or t
  misc_feature (511)..(519): n is a, c, g, or t
  misc_feature (521)..(522): n is a, c, g, or t
  misc_feature (524)..(528): n is a, c, g, or t
  misc_feature (530)..(534): n is a, c, g, or t
  misc_feature (536)..(537): n is a, c, g, or t
  misc_feature (540)..(542): n is a, c, g, or t
  misc_feature (546)..(549): n is a, c, g, or t
  misc_feature (551)..(551): n is a, c, g, or t
  misc_feature (554)..(555): n is a, c, g, or t
  misc_feature (557)..(558): n is a, c, g, or t
  misc_feature (560)..(560): n is a, c, g, or t
  misc_feature (565)..(572): n is a, c, g, or t
  misc_feature (574)..(574): n is a, c, g, or t
  misc_feature (576)..(584): n is a, c, g, or t
  misc_feature (586)..(586): n is a, c, g, or t
  misc_feature (588)..(590): n is a, c, g, or t
  misc_feature (592)..(594): n is a, c, g, or t
  misc_feature (597)..(599): n is a, c, g, or t
  misc_feature (601)..(602): n is a, c, g, or t
  misc_feature (604)..(605): n is a, c, g, or t
  misc_feature (607)..(608): n is a, c, g, or t
  misc_feature (610)..(611): n is a, c, g, or t
  misc_feature (614)..(614): n is a, c, g, or t
  misc_feature (616)..(618): n is a, c, g, or t
  misc_feature (620)..(624): n is a, c, g, or t
  misc_feature (627)..(627): n is a, c, g, or t
  misc_feature (629)..(630): n is a, c, g, or t
  misc_feature (633)..(633): n is a, c, g, or t
  misc_feature (635)..(636): n is a, c, g, or t
  misc_feature (638)..(652): n is a, c, g, or t
  misc_feature (654)..(655): n is a, c, g, or t
  misc_feature (657)..(657): n is a, c, g, or t
  misc_feature (660)..(666): n is a, c, g, or t
  misc_feature (668)..(670): n is a, c, g, or t
  misc_feature (672)..(672): n is a, c, g, or t
  misc_feature (675)..(675): n is a, c, g, or t
  misc_feature (677)..(680): n is a, c, g, or t
  misc_feature (682)..(684): n is a, c, g, or t
  misc_feature (686)..(686): n is a, c, g, or t
  misc_feature (688)..(690): n is a, c, g, or t
  misc_feature (693)..(693): n is a, c, g, or t
  misc_feature (695)..(695): n is a, c, g, or t
  misc_feature (701)..(701): n is a, c, g, or t
  misc_feature (703)..(705): n is a, c, g, or t
  misc_feature (707)..(709): n is a, c, g, or t
  misc_feature (714)..(716): n is a, c, g, or t
  misc_feature (718)..(724): n is a, c, g, or t
  misc_feature (727)..(730): n is a, c, g, or t
  misc_feature (732)..(740): n is a, c, g, or t
  misc_feature (742)..(746): n is a, c, g, or t
  misc_feature (748)..(749): n is a, c, g, or t
  misc_feature (751)..(755): n is a, c, g, or t
  misc_feature (757)..(759): n is a, c, g, or t
  misc_feature (761)..(763): n is a, c, g, or t
  misc_feature (765)..(769): n is a, c, g, or t
  misc_feature (771)..(776): n is a, c, g, or t
  misc_feature (779)..(779): n is a, c, g, or t
  misc_feature (781)..(782): n is a, c, g, or t
  misc_feature (785)..(785): n is a, c, g, or t
  misc_feature (787)..(788): n is a, c, g, or t
  misc_feature (790)..(798): n is a, c, g, or t
  misc_feature (800)..(800): n is a, c, g, or t
  misc_feature (802)..(803): n is a, c, g, or t
  misc_feature (805)..(806): n is a, c, g, or t
  misc_feature (808)..(811): n is a, c, g, or t
  misc_feature (814)..(817): n is a, c, g, or t
  misc_feature (819)..(825): n is a, c, g, or t
  misc_feature (828)..(831): n is a, c, g, or t
  misc_feature (834)..(839): n is a, c, g, or t
  misc_feature (843)..(846): n is a, c, g, or t
  misc_feature (848)..(851): n is a, c, g, or t
  misc_feature (853)..(857): n is a, c, g, or t
  misc_feature (859)..(864): n is a, c, g, or t
  misc_feature (867)..(867): n is a, c, g, or t
  misc_feature (869)..(876): n is a, c, g, or t
  misc_feature (879)..(879): n is a, c, g, or t
  misc_feature (881)..(883): n is a, c, g, or t
  misc_feature (885)..(885): n is a, c, g, or t
  misc_feature (887)..(887): n is a, c, g, or t
  misc_feature (890)..(892): n is a, c, g, or t
  misc_feature (894)..(898): n is a, c, g, or t
  misc_feature (901)..(901): n is a, c, g, or t
  misc_feature (903)..(904): n is a, c, g, or t
  misc_feature (907)..(908): n is a, c, g, or t
  misc_feature (910)..(910): n is a, c, g, or t
  misc_feature (913)..(915): n is a, c, g, or t
  misc_feature (918)..(918): n is a, c, g, or t
  misc_feature (921)..(922): n is a, c, g, or t
  misc_feature (924)..(924): n is a, c, g, or t
  misc_feature (926)..(933): n is a, c, g, or t
  misc_feature (936)..(939): n is a, c, g, or t
  misc_feature (941)..(941): n is a, c, g, or t
  misc_feature (943)..(946): n is a, c, g, or t
  misc_feature (948)..(948): n is a, c, g, or t
  misc_feature (950)..(966): n is a, c, g, or t
  misc_feature (969)..(974): n is a, c, g, or t
  misc_feature (976)..(978): n is a, c, g, or t
  misc_feature (980)..(987): n is a, c, g, or t
  misc_feature (989)..(991): n is a, c, g, or t
  misc_feature (993)..(993): n is a, c, g, or t
  misc_feature (996)..(996): n is a, c, g, or t
  misc_feature (998)..(999): n is a, c, g, or t
  misc_feature (1001)..(1001): n is a, c, g, or t
  misc_feature (1003)..(1003): n is a, c, g, or t
  misc_feature (1005)..(1009): n is a, c, g, or t
  misc_feature (1012)..(1012): n is a, c, g, or t
  misc_feature (1014)..(1017): n is a, c, g, or t
  misc_feature (1019)..(1021): n is a, c, g, or t
  misc_feature (1023)..(1029): n is a, c, g, or t
  misc_feature (1031)..(1031): n is a, c, g, or t
  misc_feature (1035)..(1035): n is a, c, g, or t
  misc_feature (1037)..(1038): n is a, c, g, or t
  misc_feature (1041)..(1043): n is a, c, g, or t
  misc_feature (1045)..(1045): n is a, c, g, or t
  misc_feature (1047)..(1048): n is a, c, g, or t
  misc_feature (1051)..(1051): n is a, c, g, or t
  misc_feature (1053)..(1054): n is a, c, g, or t
  misc_feature (1057)..(1062): n is a, c, g, or t
  misc_feature (1064)..(1066): n is a, c, g, or t
  misc_feature (1068)..(1070): n is a, c, g, or t
  misc_feature (1072)..(1072): n is a, c, g, or t
  misc_feature (1074)..(1076): n is a, c, g, or t
  misc_feature (1078)..(1088): n is a, c, g, or t
  misc_feature (1090)..(1090): n is a, c, g, or t
  misc_feature (1092)..(1093): n is a, c, g, or t
  misc_feature (1095)..(1095): n is a, c, g, or t
  misc_feature (1097)..(1098): n is a, c, g, or t
  misc_feature (1100)..(1100): n is a, c, g, or t
  misc_feature (1103)..(1113): n is a, c, g, or t
  misc_feature (1116)..(1116): n is a, c, g, or t
  misc_feature (1118)..(1119): n is a, c, g, or t
  misc_feature (1124)..(1128): n is a, c, g, or t
  misc_feature (1130)..(1132): n is a, c, g, or t
  misc_feature (1137)..(1137): n is a, c, g, or t
  misc_feature (1140)..(1140): n is a, c, g, or t
  misc_feature (1142)..(1143): n is a, c, g, or t
  misc_feature (1145)..(1146): n is a, c, g, or t
  misc_feature (1148)..(1150): n is a, c, g, or t
  misc_feature (1152)..(1158): n is a, c, g, or t
  misc_feature (1160)..(1164): n is a, c, g, or t
  misc_feature (1167)..(1170): n is a, c, g, or t
  misc_feature (1172)..(1174): n is a, c, g, or t
  misc_feature (1180)..(1180): n is a, c, g, or t
  misc_feature (1183)..(1184): n is a, c, g, or t
  misc_feature (1187)..(1187): n is a, c, g, or t
  misc_feature (1189)..(1195): n is a, c, g, or t
  misc_feature (1199)..(1199): n is a, c, g, or t
  misc_feature (1203)..(1203): n is a, c, g, or t
  misc_feature (1205)..(1205): n is a, c, g, or t
  misc_feature (1207)..(1207): n is a, c, g, or t
  misc_feature (1210)..(1210): n is a, c, g, or t
  misc_feature (1215)..(1215): n is a, c, g, or t
  misc_feature (1221)..(1221): n is a, c, g, or t
  misc_feature (1224)..(1224): n is a, c, g, or t
  misc_feature (1229)..(1230): n is a, c, g, or t
  misc_feature (1234)..(1235): n is a, c, g, or t
  misc_feature (1243)..(1245): n is a, c, g, or t
  misc_feature (1249)..(1250): n is a, c, g, or t
  misc_feature (1261)..(1261): n is a, c, g, or t
  misc_feature (1264)..(1264): n is a, c, g, or t
  misc_feature (1267)..(1267): n is a, c, g, or t
  misc_feature (1269)..(1269): n is a, c, g, or t
  misc_feature (1271)..(1271): n is a, c, g, or t
  misc_feature (1274)..(1274): n is a, c, g, or t
  misc_feature (1277)..(1278): n is a, c, g, or t
  misc_feature (1280)..(1280): n is a, c, g, or t
  misc_feature (1301)..(1301): n is a, c, g, or t
  misc_feature (1303)..(1304): n is a, c, g, or t
  misc_feature (1306)..(1306): n is a, c, g, or t
  misc_feature (1308)..(1310): n is a, c, g, or t
  misc_feature (1312)..(1313): n is a, c, g, or t
  misc_feature (1320)..(1320): n is a, c, g, or t
  misc_feature (1322)..(1323): n is a, c, g, or t
  misc_feature (1325)..(1326): n is a, c, g, or t
  misc_feature (1331)..(1331): n is a, c, g, or t
  misc_feature (1335)..(1335): n is a, c, g, or t
  misc_feature (1337)..(1337): n is a, c, g, or t
  misc_feature (1340)..(1342): n is a, c, g, or t
  misc_feature (1345)..(1345): n is a, c, g, or t
  misc_feature (1347)..(1348): n is a, c, g, or t
  misc_feature (1352)..(1352): n is a, c, g, or t
  misc_feature (1355)..(1355): n is a, c, g, or t
  misc_feature (1357)..(1357): n is a, c, g, or t
  misc_feature (1364)..(1364): n is a, c, g, or t
  misc_feature (1369)..(1369): n is a, c, g, or t
  misc_feature (1380)..(1380): n is a, c, g, or t
  misc_feature (1382)..(1383): n is a, c, g, or t
  misc_feature (1385)..(1387): n is a, c, g, or t
  misc_feature (1389)..(1389): n is a, c, g, or t
  misc_feature (1391)..(1391): n is a, c, g, or t
  misc_feature (1394)..(1396): n is a, c, g, or t
  misc_feature (1398)..(1401): n is a, c, g, or t
  misc_feature (1403)..(1404): n is a, c, g, or t
  misc_feature (1408)..(1409): n is a, c, g, or t
  misc_feature (1411)..(1416): n is a, c, g, or t
  misc_feature (1420)..(1421): n is a, c, g, or t
  misc_feature (1423)..(1424): n is a, c, g, or t
  misc_feature (1429)..(1429): n is a, c, g, or t
  misc_feature (1438)..(1443): n is a, c, g, or t
  misc_feature (1446)..(1447): n is a, c, g, or t
  misc_feature (1449)..(1457): n is a, c, g, or t
  misc_feature (1461)..(1462): n is a, c, g, or t
  misc_feature (1464)..(1465): n is a, c, g, or t
  misc_feature (1467)..(1467): n is a, c, g, or t
  misc_feature (1470)..(1474): n is a, c, g, or t
  misc_feature (1476)..(1478): n is a, c, g, or t
  misc_feature (1480)..(1482): n is a, c, g, or t
  misc_feature (1484)..(1485): n is a, c, g, or t
  misc_feature (1488)..(1498): n is a, c, g, or t
  misc_feature (1500)..(1501): n is a, c, g, or t
  misc_feature (1504)..(1515): n is a, c, g, or t
  misc_feature (1517)..(1517): n is a, c, g, or t
  misc_feature (1520)..(1522): n is a, c, g, or t
  misc_feature (1525)..(1525): n is a, c, g, or t
  misc_feature (1528)..(1529): n is a, c, g, or t
  misc_feature (1532)..(1533): n is a, c, g, or t
  misc_feature (1535)..(1537): n is a, c, g, or t
  misc_feature (1539)..(1540): n is a, c, g, or t
  misc_feature (1542)..(1544): n is a, c, g, or t
  misc_feature (1547)..(1549): n is a, c, g, or t
  misc_feature (1552)..(1553): n is a, c, g, or t
  misc_feature (1556)..(1558): n is a, c, g, or t
  misc_feature (1562)..(1567): n is a, c, g, or t
  misc_feature (1570)..(1571): n is a, c, g, or t
  misc_feature (1574)..(1575): n is a, c, g, or t
  misc_feature (1577)..(1577): n is a, c, g, or t
  misc_feature (1583)..(1585): n is a, c, g, or t
  misc_feature (1587)..(1587): n is a, c, g, or t
  misc_feature (1589)..(1589): n is a, c, g, or t
  misc_feature (1594)..(1594): n is a, c, g, or t
  misc_feature (1596)..(1597): n is a, c, g, or t
  misc_feature (1601)..(1602): n is a, c, g, or t
  misc_feature (1605)..(1607): n is a, c, g, or t
  misc_feature (1609)..(1609): n is a, c, g, or t
  misc_feature (1611)..(1611): n is a, c, g, or t
  misc_feature (1613)..(1614): n is a, c, g, or t
  misc_feature (1616)..(1616): n is a, c, g, or t
  misc_feature (1618)..(1620): n is a, c, g, or t
  misc_feature (1623)..(1623): n is a, c, g, or t
  misc_feature (1642)..(1642): n is a, c, g, or t
  misc_feature (1647)..(1647): n is a, c, g, or t
  misc_feature (1659)..(1659): n is a, c, g, or t
  misc_feature (1662)..(1662): n is a, c, g, or t
  misc_feature (1750)..(1750): n is a, c, g, or t
  misc_feature (1978)..(1978): n is a, c, g, or t
  misc_feature (1984)..(1985): n is a, c, g, or t
  misc_feature (1987)..(1987): n is a, c, g, or t
  misc_feature (2033)..(2033): n is a, c, g, or t
  misc_feature (2066)..(2066): n is a, c, g, or t
  misc_feature (2834)..(2834): n is a, c, g, or t
nngntnnnnntgnnantnntnnannncnannnnntcgtnnncnncnntcncnnnccnaaaccnnnncnnnnncnnnngccnnngnncnnnnncnnantnnnnnngnnnnnnnnncnanngnnancgnaanncannnncannannannnntnncnnnnnnnnntntnngnnnnnggannangnnannnngntnnnnnnnnnnnnnnnnnnctnnnacncnnannnnnncnncnncgccnnngccnnnnncantnacnnnnacgcngncgcnggnnatngnnangcngnnnnnggtcanggncanngnganagnntnnannnccanngnnannnnngnnnnngnnanannnanannngnannnncnnnnnngncngngncngnantntnanngnnnnnnnnanannnannnaannnnanannnntnnnnttntnnnnnnncnnnnncnnnnanacnaannnnaannnntnnnnntnnnantgnnnntggngtnnnngnnnnnnnnnncannannnnnnnnncnncnnnnncnnnnncnnccnnnaccnnnncntcnncnncntccgnnnnnnnngnannnnnnnnntncnnntnnnatnnntnntnntnntnntcntnnncnnnnncancnncancnncnnnnnnnnnnnnnnncnncnccnnnnnnntnnntnttntnnnngnnngngnnngcngngcctgngnnngnnnaagcnnnannnnnnnggnnnngnnnnnnnnngnnnnngnnannnnnannntnnnannnnnannnnnnatngnnatngnnannnnnnnnncngnnanngnnnncgnnnncnnnnnnntgnnnntgnnnnnnacannnncnnnntnnnnntnnnnnngcncnnnnnnnntgntnnngntntgnnntnnnnntgnanncgnnanctnnncanatnnanannnnnnnncgnnnncnannnnantnnnnnnnnnnnnnnnnnatnnnnnnannntnnnnnnnntnnnantgncnntncngnnnnngcngnnnngnnncnnnnnnnanacananncannntngnnatngnnatnnnnnngnnngnnnangnnnannnnnnnnnnngnanngnanngnaannnnnnnnnnnccnanncccannnnnannnagacncantnncnntnnngnnnnnnncnnnnncannnntnnntgttcntgnnccntnnnnnnnttcnaatncngnagntgctnctccgnctncgagnntgcnnccgctgtnnngccnnccgccgccgtngtngtnantngcngcnncntctgatgctgacaaggctttntnntnannncnnaagtcgncnncnncaccncaanancannnatngnnaccnccncnttcccantcgcngccgccgatgnannannntnantcnnngnnnnanntatnnannnnnntgcnngnngtagntgctgctgnnnnnncannannnnnnnnngtannannancannnnngnnnannncnnctnnnnnnnnnnncnnctnnnnnnnnnnnntngtnnnggnggnnacnncnnngnngnnngtnnnagnngcnnnggtnnnnnnaanntcnncnttgccnnnangnaggangnngccnnaannnangncnncnannncancaactttgtacgccaccancccanttggtgcgggcntgncctcatccgcagccggcttaatccagagggcaatggtgaaatcgccgctgccggcatccagcgcatcgtagtgcgggacggtaatacnaccccaagttgattccggcagcgtgagataatagtttgccacagacctgctcccgttagttccagatttcggttaccgtgatgctggaggtcaatgtttcgccgtacagtgttccggttgtcccattgaacccaacagtcaccgagcttgcactccccaatttgaccatatatgtaatctcagacagcgatggtgcagtggtgtaataagtgataacaatagtcccanaatggnngnatgaaccgccgccccatccgcacgccagtgctttgcctgctgcatncttgaatagtgcagcacacacagaggtgccgtngccattcattccgtactgtaccactgcgtccaccttgatgatattcccaatagccttgggtgtaatcgccgcctgcataaccagtgtgcctccacccccataggttggggctgagctgcttggaatagtggaattgcagagcagataattggtatatttgctgtagacgacttgtgccggcaagcctttgtaatttggaactccgccggcactgtgtccaacaagcaggaagttgttcagctctgttccccaagtgccggcagacccgccgatggttggtagtgatgccatttatactgtgcctccgtagcgtccgctgccgtaattgccgaaaccatacaataccgtgtcggacgcataaacgatattgaccggctgactgttggctgtaaacaccgttgagcagtccagaaaagactgcgtatcctgacggcctgtataacgagcagcaaactgctcgatgtaatactgctctatgccgccgatgatgcgccgcacgcacacatacacttcatcctccggcattcctcgaatcacacacacactactgaactgcccttgatacggcgtaagcagtaagccgcccgtgacatgttcgctccatgcggaaacctcttccttcggctcataggtaaaagacaccaaagcgccgtcctgccgtacaatccacaaaatagcatacggcacccgctggacagcgatttgcacaggcaaagaatcaaaaatatcatccaccagcagagttgcattgtcggactcataccgcanggtagcatccatcagccgcattgaacggagtgtgcggccgcccccttgaaaataaaacagggtgttgttgagatggacgggctgcatcgaattgctgcccaatgcagactgcacacggcatcgcacatcatccggcgtgattgggtcgtcaatgttgctggcagatattttgtattctttgttggctgttccaaccaccaagtattcatccgaagccatccactgaatattggatacatcggagtcttcaatggtaacagtcacagcatcgctgtcggtgtcgccagcagtgaaattcaggaacctggatgaggaggagccccaaagggtttggggattattgctggtggacgcaaaccataaacggttttcgtggattaccagtgttctggggtacccccgatatgcattaaacgctccttctgcccacatcgatgtagtaaccgcagagtcatcagaattattgctcaatacaggctgaatgactgtagccgagacgcttgtgggcgagatatagcctgtaatcttcacaatgccgacattggtttggtcttttgctgtcaggacggctgaaccgctggacgatgaactggtgaatgtataatacacatcatcgtccaattcatctgatgtgtaagcagtgttggccaagaatgtgcggtattcctgccaagcaccattgccttgacgccgccagattttgaaggtgttggagttgacggtcacatcaaacgaaaaagaccccttaatctttatgcccgtgcccgtcggcacagcattggtggtgttgtctggtgtggacatggtgttgtctggccttgtgtgcttcagcatccacagcgaccccacatgctgcggcagaaacggcgcattacctgtgccgctggcagtcagcgtgccgattgcccctgcgggaaagtaatgtccacaacgggctattccgcctgtgcgggtaaagcccagcaggtatgtgtctgttgtgttttcgcccaaaaaaggcccgccgaccaaattggcttcctgaataacccagctggcatcgccgtatcgggaaagcgtatacggcggatagtctgggtgggttaaatacagcacatcaccggactgtgtgtaatgcagctgccaaacatcatcaagggtgtatggcgaagcaatggaataaatcc

SEQ ID NO: 1444 - DNA, 4000 bp, Escherichia coli
  misc_feature (637)..(653): n is a, c, g, or t
  misc_feature (662)..(662): n is a, c, g, or t
  misc_feature (674)..(674): n is a, c, g, or t
  misc_feature (680)..(680): n is a, c, g, or t
  misc_feature (682)..(683): n is a, c, g, or t
  misc_feature (688)..(689): n is a, c, g, or t
  misc_feature (706)..(707): n is a, c, g, or t
  misc_feature (709)..(709): n is a, c, g, or t
  misc_feature (713)..(713): n is a, c, g, or t
  misc_feature (718)..(718): n is a, c, g, or t
  misc_feature (729)..(729): n is a, c, g, or t
  misc_feature (746)..(746): n is a, c, g, or t
  misc_feature (749)..(751): n is a, c, g, or t
  misc_feature (753)..(756): n is a, c, g, or t
  misc_feature (765)..(765): n is a, c, g, or t
  misc_feature (767)..(768): n is a, c, g, or t
  misc_feature (770)..(771): n is a, c, g, or t
  misc_feature (773)..(773): n is a, c, g, or t
  misc_feature (776)..(777): n is a, c, g, or t
  misc_feature (779)..(780): n is a, c, g, or t
  misc_feature (784)..(784): n is a, c, g, or t
  misc_feature (789)..(789): n is a, c, g, or t
  misc_feature (791)..(792): n is a, c, g, or t
  misc_feature (799)..(807): n is a, c, g, or t
  misc_feature (809)..(809): n is a, c, g, or t
  misc_feature (818)..(824): n is a, c, g, or t
  misc_feature (834)..(835): n is a, c, g, or t
  misc_feature (838)..(838): n is a, c, g, or t
  misc_feature (845)..(845): n is a, c, g, or t
  misc_feature (847)..(847): n is a, c, g, or t
  misc_feature (849)..(849): n is a, c, g, or t
  misc_feature (853)..(853): n is a, c, g, or t
  misc_feature (857)..(857): n is a, c, g, or t
  misc_feature (859)..(862): n is a, c, g, or t
  misc_feature (864)..(865): n is a, c, g, or t
  misc_feature (868)..(868): n is a, c, g, or t
  misc_feature (871)..(872): n is a, c, g, or t
  misc_feature (875)..(876): n is a, c, g, or t
  misc_feature (879)..(881): n is a, c, g, or t
  misc_feature (883)..(884): n is a, c, g, or t
  misc_feature (886)..(886): n is a, c, g, or t
  misc_feature (889)..(890): n is a, c, g, or t
  misc_feature (897)..(897): n is a, c, g, or t
  misc_feature (900)..(901): n is a, c, g, or t
  misc_feature (905)..(906): n is a, c, g, or t
  misc_feature (908)..(908): n is a, c, g, or t
  misc_feature (910)..(910): n is a, c, g, or t
  misc_feature (916)..(917): n is a, c, g, or t
  misc_feature (930)..(930): n is a, c, g, or t
  misc_feature (933)..(933): n is a, c, g, or t
  misc_feature (936)..(936): n is a, c, g, or t
  misc_feature (941)..(941): n is a, c, g, or t
  misc_feature (944)..(945): n is a, c, g, or t
  misc_feature (947)..(948): n is a, c, g, or t
  misc_feature (950)..(951): n is a, c, g, or t
  misc_feature (956)..(956): n is a, c, g, or t
  misc_feature (962)..(962): n is a, c, g, or t
  misc_feature (969)..(970): n is a, c, g, or t
  misc_feature (978)..(978): n is a, c, g, or t
  misc_feature (984)..(985): n is a, c, g, or t
  misc_feature (988)..(988): n is a, c, g, or t
  misc_feature (991)..(993): n is a, c, g, or t
  misc_feature (996)..(997): n is a, c, g, or t
  misc_feature (999)..(1001): n is a, c, g, or t
  misc_feature (1004)..(1006): n is a, c, g, or t
  misc_feature (1008)..(1008): n is a, c, g, or t
  misc_feature (1011)..(1013): n is a, c, g, or t
  misc_feature (1015)..(1015): n is a, c, g, or t
  misc_feature (1017)..(1017): n is a, c, g, or t
  misc_feature (1021)..(1022): n is a, c, g, or t
  misc_feature (1025)..(1028): n is a, c, g, or t
  misc_feature (1031)..(1032): n is a, c, g, or t
  misc_feature (1038)..(1039): n is a, c, g, or t
  misc_feature (1041)..(1041): n is a, c, g, or t
  misc_feature (1043)..(1045): n is a, c, g, or t
  misc_feature (1054)..(1055): n is a, c, g, or t
  misc_feature (1057)..(1057): n is a, c, g, or t
  misc_feature (1059)..(1060): n is a, c, g, or t
  misc_feature (1062)..(1062): n is a, c, g, or t
  misc_feature (1065)..(1068): n is a, c, g, or t
  misc_feature (1071)..(1071): n is a, c, g, or t
  misc_feature (1073)..(1073): n is a, c, g, or t
  misc_feature (1076)..(1076): n is a, c, g, or t
  misc_feature (1079)..(1079): n is a, c, g, or t
  misc_feature (1081)..(1081): n is a, c, g, or t
  misc_feature (1084)..(1084): n is a, c, g, or t
  misc_feature (1086)..(1086): n is a, c, g, or t
  misc_feature (1088)..(1088): n is a, c, g, or t
  misc_feature (1091)..(1093): n is a, c, g, or t
  misc_feature (1101)..(1101): n is a, c, g, or t
  misc_feature (1104)..(1109): n is a, c, g, or t
  misc_feature (1112)..(1113): n is a, c, g, or t
  misc_feature (1115)..(1115): n is a, c, g, or t
  misc_feature (1117)..(1117): n is a, c, g, or t
  misc_feature (1128)..(1128): n is a, c, g, or t
  misc_feature (1132)..(1132): n is a, c, g, or t
  misc_feature (1134)..(1135): n is a, c, g, or t
  misc_feature (1139)..(1139): n is a, c, g, or t
  misc_feature (1144)..(1144): n is a, c, g, or t
  misc_feature (1147)..(1148): n is a, c, g, or t
  misc_feature (1153)..(1154): n is a, c, g, or t
  misc_feature (1156)..(1156): n is a, c, g, or t
  misc_feature (1164)..(1165): n is a, c, g, or t
  misc_feature (1172)..(1172): n is a, c, g, or t
  misc_feature (1175)..(1176): n is a, c, g, or t
  misc_feature (1181)..(1181): n is a, c, g, or t
  misc_feature (1189)..(1189): n is a, c, g, or t
  misc_feature (1193)..(1193): n is a, c, g, or t
  misc_feature (1197)..(1197): n is a, c, g, or t
  misc_feature (1991)..(1991): n is a, c, g, or t
  misc_feature (2052)..(2052): n is a, c, g, or t
  misc_feature (2787)..(2787): n is a, c, g, or t
  misc_feature (2867)..(2867): n is a, c, g, or t
  misc_feature (2912)..(2913): n is a, c, g, or t
  misc_feature (2917)..(2917): n is a, c, g, or t
  misc_feature (2920)..(2920): n is a, c, g, or t
  misc_feature (2923)..(2923): n is a, c, g, or t
  misc_feature (2926)..(2927): n is a, c, g, or t
  misc_feature (2929)..(2929): n is a, c, g, or t
  misc_feature (2931)..(2931): n is a, c, g, or t
  misc_feature (2935)..(2935): n is a, c, g, or t
  misc_feature (2939)..(2939): n is a, c, g, or t
  misc_feature (2941)..(2941): n is a, c, g, or t
  misc_feature (2944)..(2944): n is a, c, g, or t
  misc_feature (2946)..(2946): n is a, c, g, or t
  misc_feature (2949)..(2949): n is a, c, g, or t
  misc_feature (2952)..(2952): n is a, c, g, or t
  misc_feature (2954)..(2954): n is a, c, g, or t
  misc_feature (2957)..(2959): n is a, c, g, or t
  misc_feature (2961)..(2961): n is a, c, g, or t
  misc_feature (2964)..(2964): n is a, c, g, or t
  misc_feature (2973)..(2973): n is a, c, g, or t
  misc_feature (2975)..(2976): n is a, c, g, or t
  misc_feature (2978)..(2978): n is a, c, g, or t
  misc_feature (2981)..(2982): n is a, c, g, or t
  misc_feature (2984)..(2984): n is a, c, g, or t
  misc_feature (2987)..(2987): n is a, c, g, or t
  misc_feature (2989)..(2990): n is a, c, g, or t
  misc_feature (2992)..(2993): n is a, c, g, or t
  misc_feature (2995)..(2999): n is a, c, g, or t
  misc_feature (3001)..(3031): n is a, c, g, or t
  misc_feature (3033)..(3034): n is a, c, g, or t
  misc_feature (3036)..(3047): n is a, c, g, or t
  misc_feature (3049)..(3050): n is a, c, g, or t
  misc_feature (3052)..(3056): n is a, c, g, or t
  misc_feature (3058)..(3070): n is a, c, g, or t
  misc_feature (3072)..(3088): n is a, c, g, or t
  misc_feature (3090)..(3091): n is a, c, g, or t
  misc_feature (3094)..(3094): n is a, c, g, or t
  misc_feature (3097)..(3097): n is a, c, g, or t
  misc_feature (3099)..(3100): n is a, c, g, or t
  misc_feature (3103)..(3103): n is a, c, g, or t
  misc_feature (3106)..(3124): n is a, c, g, or t
  misc_feature (3126)..(3133): n is a, c, g, or t
  misc_feature (3135)..(3136): n is a, c, g, or t
  misc_feature (3138)..(3139): n is a, c, g, or t
  misc_feature (3141)..(3142): n is a, c, g, or t
  misc_feature (3144)..(3146): n is a, c, g, or t
  misc_feature (3149)..(3149): n is a, c, g, or t
  misc_feature (3153)..(3154): n is a, c, g, or t
  misc_feature (3156)..(3158): n is a, c, g, or t
  misc_feature (3160)..(3172): n is a, c, g, or t
  misc_feature (3174)..(3175): n is a, c, g, or t
  misc_feature (3177)..(3182): n is a, c, g, or t
  misc_feature (3184)..(3185): n is a, c, g, or t
  misc_feature (3187)..(3187): n is a, c, g, or t
  misc_feature (3190)..(3190): n is a, c, g, or t
  misc_feature (3193)..(3193): n is a, c, g, or t
  misc_feature (3196)..(3197): n is a, c, g, or t
  misc_feature (3199)..(3200): n is a, c, g, or t
  misc_feature (3202)..(3203): n is a, c, g, or t
  misc_feature (3205)..(3206): n is a, c, g, or t
  misc_feature (3209)..(3210): n is a, c, g, or t
  misc_feature (3212)..(3215): n is a, c, g, or t
  misc_feature (3217)..(3219): n is a, c, g, or t
  misc_feature (3221)..(3230): n is a, c, g, or t
  misc_feature (3232)..(3233): n is a, c, g, or t
  misc_feature (3235)..(3236): n is a, c, g, or t
  misc_feature (3238)..(3239): n is a, c, g, or t
  misc_feature (3241)..(3242): n is a, c, g, or t
  misc_feature (3244)..(3245): n is a, c, g, or t
  misc_feature (3247)..(3268): n is a, c, g, or t
  misc_feature (3270)..(3271): n is a, c, g, or t
  misc_feature (3273)..(3274): n is a, c, g, or t
  misc_feature (3276)..(3298): n is a, c, g, or t
  misc_feature (3300)..(3317): n is a, c, g, or t
  misc_feature (3319)..(3320): n is a, c, g, or t
  misc_feature (3322)..(3331): n is a, c, g, or t
  misc_feature (3333)..(3356): n is a, c, g, or t
  misc_feature (3358)..(3359): n is a, c, g, or t
  misc_feature (3361)..(3362): n is a, c, g, or t
  misc_feature (3364)..(3368): n is a, c, g, or t
  misc_feature (3370)..(3371): n is a, c, g, or t
  misc_feature (3373)..(3376): n is a, c, g, or t
  misc_feature (3378)..(3379): n is a, c, g, or t
  misc_feature (3381)..(3408): n is a, c, g, or t
  misc_feature (3410)..(3411): n is a, c, g, or t
  misc_feature (3413)..(3414): n is a, c, g, or t
  misc_feature (3416)..(3417): n is a, c, g, or t
  misc_feature (3419)..(3420): n is a, c, g, or t
  misc_feature (3422)..(3423): n is a, c, g, or t
  misc_feature (3425)..(3426): n is a, c, g, or t
  misc_feature (3428)..(3429): n is a, c, g, or t
  misc_feature (3431)..(3432): n is a, c, g, or t
  misc_feature (3434)..(3436): n is a, c, g, or t
  misc_feature (3438)..(3452): n is a, c, g, or t
  misc_feature (3454)..(3455): n is a, c, g, or t
  misc_feature (3457)..(3458): n is a, c, g, or t
  misc_feature (3460)..(3485): n is a, c, g, or t
  misc_feature (3487)..(3488): n is a, c, g, or t
  misc_feature (3490)..(3519): n is a, c, g, or t
  misc_feature (3521)..(3531): n is a, c, g, or t
  misc_feature (3533)..(3559): n is a, c, g, or t
  misc_feature (3561)..(3562): n is a, c, g, or t
  misc_feature (3564)..(3599): n is a, c, g, or t
  misc_feature (3601)..(3616): n is a, c, g, or t
  misc_feature (3618)..(3619): n is a, c, g, or t
  misc_feature (3621)..(3622): n is a, c, g, or t
  misc_feature (3624)..(3630): n is a, c, g, or t
  misc_feature (3632)..(3633): n is a, c, g, or t
  misc_feature (3635)..(3645): n is a, c, g, or t
  misc_feature (3647)..(3648): n is a, c, g, or t
  misc_feature (3650)..(3662): n is a, c, g, or t
  misc_feature (3664)..(3667): n is a, c, g, or t
  misc_feature (3669)..(3669): n is a, c, g, or t
  misc_feature (3672)..(3676): n is a, c, g, or t
  misc_feature (3678)..(3681): n is a, c, g, or t
  misc_feature (3683)..(3683): n is a, c, g, or t
  misc_feature (3685)..(3686): n is a, c, g, or t
  misc_feature (3688)..(3689): n is a, c, g, or t
  misc_feature (3691)..(3693): n is a, c, g, or t
  misc_feature (3695)..(3696): n is a, c, g, or t
  misc_feature (3698)..(3706): n is a, c, g, or t
  misc_feature (3708)..(3709): n is a, c, g, or t
  misc_feature (3711)..(3712): n is a, c, g, or t
  misc_feature (3714)..(3715): n is a, c, g, or t
  misc_feature (3717)..(3718): n is a, c, g, or t
  misc_feature (3721)..(3722): n is a, c, g, or t
  misc_feature (3724)..(3732): n is a, c, g, or t
  misc_feature (3734)..(3735): n is a, c, g, or t
  misc_feature (3737)..(3738): n is a, c, g, or t
  misc_feature (3740)..(3741): n is a, c, g, or t
  misc_feature (3743)..(3764): n is a, c, g, or t
  misc_feature (3766)..(3804): n is a, c, g, or t
  misc_feature (3806)..(3831): n is a, c, g, or t
  misc_feature (3833)..(3833): n is a, c, g, or t
  misc_feature (3836)..(3836): n is a, c, g, or t
  misc_feature (3838)..(3839): n is a, c, g, or t
  misc_feature (3842)..(3842): n is a, c, g, or t
  misc_feature (3844)..(3849): n is a, c, g, or t
  misc_feature (3851)..(3851): n is a, c, g, or t
  misc_feature (3853)..(3854): n is a, c, g, or t
  misc_feature (3857)..(3858): n is a, c, g, or t
  misc_feature (3860)..(3867): n is a, c, g, or t
  misc_feature (3869)..(3874): n is a, c, g, or t
  misc_feature (3876)..(3877): n is a, c, g, or t
  misc_feature (3879)..(3882): n is a, c, g, or t
  misc_feature (3884)..(3886): n is a, c, g, or t
  misc_feature (3888)..(3889): n is a, c, g, or t
  misc_feature (3891)..(3893): n is a, c, g, or t
  misc_feature (3895)..(3895): n is a, c, g, or t
  misc_feature (3900)..(3901): n is a, c, g, or t
  misc_feature (3904)..(3905): n is a, c, g, or t
  misc_feature (3910)..(3911): n is a, c, g, or t
  misc_feature (3913)..(3913): n is a, c, g, or t
  misc_feature (3920)..(3921): n is a, c, g, or t
  misc_feature (3923)..(3924): n is a, c, g, or t
  misc_feature (3926)..(3928): n is a, c, g, or t
  misc_feature (3930)..(3931): n is a, c, g, or t
  misc_feature (3933)..(3933): n is a, c, g, or t
  misc_feature (3935)..(3935): n is a, c, g, or t
  misc_feature (3938)..(3938): n is a, c, g, or t
  misc_feature (3941)..(3941): n is a, c, g, or t
  misc_feature (3943)..(3944): n is a, c, g, or t
  misc_feature (3947)..(3947): n is a, c, g, or t
  misc_feature (3949)..(3949): n is a, c, g, or t
  misc_feature (3951)..(3961): n is a, c, g, or t
  misc_feature (3963)..(3968): n is a, c, g, or t
  misc_feature (3970)..(3972): n is a, c, g, or t
  misc_feature (3974)..(3980): n is a, c, g, or t
  misc_feature (3982)..(3983): n is a, c, g, or t
  misc_feature (3986)..(3987): n is a, c, g, or t
  misc_feature (3990)..(3990): n is a, c, g, or t
  misc_feature (3993)..(3994): n is a, c, g, or t
  misc_feature (3996)..(3997): n is a, c, g, or t
  misc_feature (3999)..(4000): n is a, c, g, or t
gaagcgattggactgattgtacgatattgagcggaactcacctgctccttgccaccgtagacgaccaacgttgtacccattatcccgtttttcgttaaggccttcaagatcgttatggatttgattaatagtttgttgggcagcgtgagcagacggattactgaagatcggccatgtgtgtttccagtcagtaaatttcttgtgttgatcgtagtctgacggcttgtcgttggtatgcgtattgtagtagtctctgactgcgtggttccggatctgtcggaggatatcaatatgtcgccatgcttcgctagccacctcatcggaaagataagcccggaagcgaagcgtaagatccatcgattcctcgtcttttgaatgggtttgtgggtaattaaaagagtgggaagttgttgacttcaccctcgaagtcaagtctcaaggcagtcgttttgtaccgtttgtacatatctctctgttagactcaaccgtagtgaatcgccgtaagtatacgtcgtgataattgctgtggatcgagtgctgcggctcagtggttgaaagaatgaaaaagggaccggcacgaggccggtggttgaaacggcgtgcagttactcgcggttcgaagtcagattagttctgnnnnnnnnnnnnnnnnngtgctgcgnggaggactgcgncgaggncnncgagnngtgcgacgaggggtgcnncnccgngggtngcgtcgtcggnggagtcgtcggaggagncgnnngnnnngtcgtcggngnngnngncgnngnngtcntcggngnngtcgtcnnnnnnnnngncgtcgtcgnnnnnnncgtcgtcggnntcntcatctncngnttcntcgncnnnngnngcntcnncgnngannntnncntcnncgacganganngagnngncngactcnncatccgagccggngangcngaagnagnngnngnnctcgncatccncttcttnnttgctgangtcganntcnccnnnaanntnnncgnnntngcnnntntngacnntcnnnncannacgganngngnnngaagcaccnncngnngnagnnnnacngngtncgncntcngngncgnnngcgacgtntgnnnnnncgnngncntcggcgtcttngacntnntcgncttcnagnncgtcnncnacgtttannttgtcgnatnngattnctgcgtcngcgnagtngatttctgtgctggatgatacatcggagtcagcctggaagtacgggtaggcatccacaatagaattgaatgctaaaggtggacttccgctgccgaatttgtaccgatcatcgccatcggtagcgtattcgagagttgccgtgtacgagtcaccatcgtctggagcaccgttgctccaggcgtcggtgttactggtatcgacaataacgaagaactgtccgttttcgttgtcaggaaggacaaagacttcgtcgtcggaagcaccgttgaggttaagcgacgttgcttcttggtttccggttgaggattctgcttcgacactgaagtcgataccctcgctatcttggttgttcagctgattgagcgtactggcagatgttccatccgtgaagatatcagtactggtcgtagctccagatttgttggccattgcaccgtagaggccagtagcttcgacctgcacaacaagacggtcatcgattgcgacttcgttgcgctgagtgacctcttcgaggacactatcgagctcagtctctgcgttagcatcgtctgttggtgcgacgtaagtcgtgatgtcgccgatctgtggctgcgacagttcaagcactgccgagtcgagctcgtcgtcgagctcggcctcatcgtcatcgttggcgacgaacacgttgtttccgttcgcggcgacttcgtagttggctgcctgcagcggtcgcgttagctgatcgttctcggtttcaccggactcaatgaggtccaatgcgtagaggtaatcgttgaacgtaccactgctaccgncgctggccccgttgagatcctgtccgtcgtcattctggaactcagcgtcgaatgtaccgcngtgagccgcactacctgcgacgttatcatcgtcactctcgtagacgtcgtcgtaagcagcgtcagttccggcaagtcgcgtgttcatcgtgaacgagacttggtcatcatcattgtcgtcttcgacgtggacaatgtcagtgaatccggagttctggtcaccgatctgaacccacgcttcgtccgtgtcttcaagatcgatagtgaactcagcgaagtcacctgctgcggtttggtagactccctgagagaaggaaccggattggtcctcttcactgatgctgattgatgcagaggcttcggccgtcgtgtcggtcacaacgaagtcgaatgtgtactcgccatcgtctgggagtccctcttcatctgcaagcttcgtgaagtttgcagtaagctcatcgtcgctgaacttattgttagtgctgaggttctgcaggtcaagcgtgacgtagccgtcgtcttcgagatcctgaacggtatcgtcatcactgtcgtaaccgaggcggtcgaatgagatgtgtgcctcatcgtcaacgacttcgtcccccgaagcgttgaacagcgctttgagctgagcagcgtcgagcccatctgcgctgaccgttacattctgtcgcgagacacgcgacgtatcgagttcaacgtaggtatcgttgtcagctcctgttgcttcgtcgttttcccagttggccgagagcgtctgctgggtaacttcgaacgacgttaggagttcacntgacacaccactcgtatccgagagcgtgtactcaccagcgtcaaggtcactagtgtcaatggtagcactctcttgatcancgtcattgtacgtcacaggacggacagtttgtgcgttgtcaacannactnctnctnctnntntnagtnatcntnagnanatnaantntannntnagnactaatatngnngntgnngncgncnncnncnnnnntnnnnnnnnnnnnnnnnnnnnnnnnnnnnnnntnntnnnnnnnnnnnncnncnnnnncnnnnnnnnnnnnntnnnnnnnnnnnnnnnnngnngcngcngnngcngcnnnnnnnnnnnnnnnnnnnannnnnnnnannannannannncancaannannncnnnnnnnnnnnnncnncnnnnnntnntnttnttnttnntnntnntnnttnntnnnntnnntnnnnnnnnnncnncnncnncnncnncnnnnnnnnnnnnnnnnnnnnnncnncnncnnnnnnnnnnnnnnnnnnnnnnngnnnnnnnnnnnnnnnnnngnngnnnnnnnnnnannnnnnnnnnnnnnnnnnnnnnnntnntnntnnnnntnntnnnntnntnnnnnnnnnnnnnnnnnnnnnnnnnnnntnntnntnntnntnntnntnntnntnnnannnnnnnnnnnnnnnannannannnnnnnnnnnnnnnnnnnnnnnnnntnntnnnnnnnnnnnnnnnnnnnnnnnnnnnnnnannnnnnnnnnnannnnnnnnnnnnnnnnnnnnnnnnnnncnncnnnnnnnnnnnnnnnnnnnnnnnnnnnnnnnnnnnngnnnnnnnnnnnnnnnntnntnntnnnnnnncnncnnnnnnnnnnnannannnnnnnnnnnnnannnncntcnnnnncnnnntnannannannntnntnnnnnnnnncnncnncnncnncgnngnnnnnnnnnannannannannnnnnnnnnnnnnnnnnnnnngnnnnnnnnnnnnnnnnnnnnnnnnnnnnnnnnnnnnnnncnnnnnnnnnnnnnnnnnnnnnnnnnnangangnngangnnnnnngngnngannannnnnnnnannnnnncnncnnnncnnncnncnnngncgtcnncgnngtcgnngncgacganncnncnnncnncncnacnacnannaananannnnnnnnnnnannnnnngnnnannnnnnngnnganncancanntnntnn

SEQ ID NO: 1445 - DNA, 4000 bp, Escherichia coli
  misc_feature (22)..(22): n is a, c, g, or t
  misc_feature (500)..(500): n is a, c, g, or t
  misc_feature (1418)..(1418): n is a, c, g, or t
  misc_feature (1422)..(1422): n is a, c, g, or t
  misc_feature (1755)..(1755): n is a, c, g, or t
  misc_feature (1991)..(1991): n is a, c, g, or t
  misc_feature (2001)..(2001): n is a, c, g, or t
  misc_feature (2391)..(2391): n is a, c, g, or t
  misc_feature (2415)..(2419): n is a, c, g, or t
  misc_feature (2421)..(2421): n is a, c, g, or t
  misc_feature (2423)..(2425): n is a, c, g, or t
  misc_feature (2427)..(2428): n is a, c, g, or t
  misc_feature (2430)..(2431): n is a, c, g, or t
  misc_feature (2433)..(2434): n is a, c, g, or t
  misc_feature (2436)..(2438): n is a, c, g, or t
  misc_feature (2440)..(2440): n is a, c, g, or t
  misc_feature (2442)..(2442): n is a, c, g, or t
  misc_feature (2444)..(2448): n is a, c, g, or t
  misc_feature (2450)..(2450): n is a, c, g, or t
  misc_feature (2452)..(2454): n is a, c, g, or t
  misc_feature (2456)..(2458): n is a, c, g, or t
  misc_feature (2460)..(2460): n is a, c, g, or t
  misc_feature (2473)..(2474): n is a, c, g, or t
  misc_feature (2478)..(2485): n is a, c, g, or t
  misc_feature (2487)..(2497): n is a, c, g, or t
  misc_feature (2499)..(2508): n is a, c, g, or t
  misc_feature (2510)..(2512): n is a, c, g, or t
  misc_feature (2514)..(2518): n is a, c, g, or t
  misc_feature (2520)..(2520): n is a, c, g, or t
  misc_feature (2522)..(2527): n is a, c, g, or t
  misc_feature (2529)..(2529): n is a, c, g, or t
  misc_feature (2531)..(2537): n is a, c, g, or t
  misc_feature (2539)..(2542): n is a, c, g, or t
  misc_feature (2544)..(2545): n is a, c, g, or t
  misc_feature (2547)..(2549): n is a, c, g, or t
  misc_feature (2551)..(2554): n is a, c, g, or t
  misc_feature (2556)..(2556): n is a, c, g, or t
  misc_feature (2558)..(2559): n is a, c, g, or t
  misc_feature (2606)..(2606): n is a, c, g, or t
  misc_feature (3624)..(3624): n is a, c, g, or t
  misc_feature (3804)..(3804): n is a, c, g, or t
  misc_feature (3828)..(3828): n is a, c, g, or t
  misc_feature (3854)..(3854): n is a, c, g, or t
  misc_feature (3861)..(3861): n is a, c, g, or t
  misc_feature (3905)..(3905): n is a, c, g, or t
  misc_feature (3909)..(3909): n is a, c, g, or t
  misc_feature (3912)..(3912): n is a, c, g, or t
  misc_feature (3933)..(3933): n is a, c, g, or t
  misc_feature (3983)..(3983): n is a, c, g, or t
cgaattgtactgaggttgcacngctgttgtttgaaattttgcgtggatagttgagcggataggcgatgatttgggttcgcgaggcgacggtgactgaatcttgaattgaaaatcgtaaattgttttttgatagttcgatacccagatcaaagtgatataatccagcaggagtatagctactggaagaagcaatgacggtaaagtttcgtttgctctgcgggagaataaaaagatcgttttgactttgaattagggtccaattatccggagtaatcgctgccggtttgaaccaaagtgtgtctatagagtagttagtgatttgtaaggtgaattgagcatttgcccctggtgcgatgagcgtgtcctgctttataatgttaacttcaacagggttcgttttttggctgaactggaatactaactgacctaaaaaattgggcaccagttgtgcttttcccaaagtgctgagaagtaagaatcctagaaggaatatcgagcgntatgtgatgcgtaaaaccacctccgcatgcgttaaaatgtgatggattctgatactccaaaaacatctccgctgtcggcctcatgtagcaagactaattcatacgtgcctggtgccacatctatattttcaagcaatacctttcggcattgttgaggttgaatactttgacggatagaggtgttctcgtacaccatatttccttccatgtccaagatagaggctttcgtatggaacgtggtggaggcattgcctcggttgaccaatgaaagttcaaaagcgtaatttacaccagcggtatctatgacaagactttgtgtgaataaatccacactagattgaacgctagggttattgtagataatgtttacgccatatcttatctgtactccaaattgaatcactccagccttttgcacgctatccactagtgcggtgttgttgatgaacaggcaagtattagcatttggcaagttgtagttcgaaggaatattcacaagtacactgaaatctctcttttctcttggcaaaagaaccagttcagtattttctaaagtcaaccagggacgacaactactttcaataggctcttcgccatccacatatacatatccttcgttacaatcattatagtagtccatcagggcaaaggtgacacgcttcgcatcatcactgttgttttgaagcgcaatattcagtgtctgtgctgtgccaagaggcgcatcgatgatctgtgtcaaaccgctatttactaccacttgactaaagagtagtgagggcataaatagtatagagagtaactttttcataaaacaaataaccccgagacagcgcactgtctcggggttaagaaattgaaacttaggtttaattggtaatcgtatacgtaatagtcggcgcgtttgcaccgttagaagangttngctctaaactcgagtaatcatttacacttgcagtgtaggaaagcgtgtagtacgcagtcccagtgtaagaagctccaatattttctattatagatgaaggtgaggatcccaccgcagtaccggaaccagtagtttcaaatccagaaactactgtccctacagaaccgtaagtagttgaggatagtgaagagactccagaattatctaccgtcaataccacatctacaccttgagggatgttagtgaattgtaccttaacaaccgcagtattgttgttaccgttgccggttggcatgtatgagtaatacaggtttgttgatgctgcggcagaantgagagaatatccatcaccagcggatgtcggtgtaccaaagttaaaagtcaatgaatttgcatccacccccacaagtgagtgtgtgctaattccaaaatctacagtctgttgatcataagactgaccgtaggaaagcgtcgcgatcaatgaaaatacgctgatccatttgaggtttttgatttgttttttcatggttttgaattgttagtcataaattggcctacattacggcacnataaggatanagcaaaaccatctcggataggtgttcaatcaagttttgaacaaatgtgcggagaccgcgtaaatactgatattccgcaggtaaatgtgttcaattgcatgttcaatcactaattgaacacgtcaatgagagctggataaagtatctctatactcagaaaaggacattccttcgacctctttaaaagccgaatagaaactcgtccgactttggtaaccaattaattggcttaggccatctacactatagtcgttcagtgcaccttgagcaataagatctttgacttaacttattcttatttgtcttttgaactctataggctccagaaaatctttgcttaaattagatcactccccagaaaaatccgctgatcccatactcgtgtatgtcncgattaaagcgataagctacgtgnnnnnangnnntnnanntnnannncntnannnnncntnnntnnngnattttaaatgctnnaaannnnnnnncnnnnnnnnnnntnnnnnnnnnnannnannnnngntnnnnnngntnnnnnnntnnnnanntnnnannnntntnngcttagcgcttcacgagcttgtattgttttatggtgtgttggttttngagcgtcaatacgagggttcctgaagctaccccgcggaggtcgatgcgttcggtgagggtgcctgagcggagcagttggcccgtagtgttgcgcaattcaaaggtggtgtttgcaggtgcgccacggaggtaaataaaatcctctgtggggttcgggtaaagcgctatagatccgtctagttcatttaagcctataccgtagatggttacgtctattgctgccgtgtctgcgacaccgccattgaaggcgtagacggcgaaagatgcagcgccgttggccggtccccattgcacttcaaacgagctgaagtcgggggcgctggagatgagggttgcgttggaaagggcgtaggaaatggaatccacgtactggtaattggtcatggtataggtggtgtttgccgatgcatagatggaatcggacggacctactaaaataggtgcggggggtgcgacgaagaaggatatcgtatcgatcaatttgctgtcgcataatccagtcaatgcggaagaatctgcactgtagccaaagatgagcgtccatggacccggcatgatggaatcgctcgtatggagtttgaaggcgtcgtagctcgaagagagtggggtgcttccggttacgaagttagtggcgtttccgaatgcgtcaaataattggacctgaacggaatcaaaatttgctgaggtcgggaagactgcatctgaagtattgaggtagatatcattttcgccgaaagttgctgaagcgcttgtggcatcaatcaaagtttgtggaggcgctgcactcggactaacgatattcactaagatttcacgttcgatcatacccatgattttgtaggtattcgtagtgtcttgagcccattcgacgattttcacattgactaccgcgttttgaacggtattagaattgatcaccaacatgcggttcgctgtatctattgaaacactacttccgctgccaagaggcgcagcattgctgtaaccggtagaataagcaatgttcgttgctgaaagngacgaggacgctccacttttaacagctacgatctggaaggacaggctgtcaccatccgcatcggcgctacagatttcaaaagggtacgttgtatttgcataagcggttgcaataccaggttgtatctcgggactgttattgtacgaacgaatggcgggcttaccattgactaaaacaccnctgaggtaaacactctggctggangcatttgcaatattcgtgattgcagnaggtctncaacacgtagaatacgcaaaggtgtagccggtgttgttgtcganggtnacntttgcagaataggtgtaggcntcaattccgtacgttgatccacagtttcctgtcaatgctccactactggnctggccaaggccaacgg

SEQ ID NO: 1446 - DNA, 4000 bp, Escherichia coli
  misc_feature (2573)..(2573): n is a, c, g, or t
  misc_feature (2594)..(2594): n is a, c, g, or t
  misc_feature (3428)..(3428): n is a, c, g, or t
  misc_feature (3449)..(3452): n is a, c, g, or t
  misc_feature (3461)..(3461): n is a, c, g, or t
  misc_feature (3468)..(3469): n is a, c, g, or t
  misc_feature (3475)..(3475): n is a, c, g, or t
  misc_feature (3486)..(3486): n is a, c, g, or t
  misc_feature (3594)..(3594): n is a, c, g, or t
  misc_feature (3603)..(3603): n is a, c, g, or t
  misc_feature (3855)..(3855): n is a, c, g, or t
tcatcagcagaggaagaaacagaattattattagtatcccagtaactagacccagcgtacccacattcgacccctttatacaaccaagggcatgaattagacactataactctagagggtaactttatacctataacatcgtatgctgcgcttaactcaaattctatatgagtgaacgtctcaacagcttttctatctatataccatatctcatctgtaaagtgagctgtatcatccgctatggcgttagcgtaccaaataccaggtcctgcagccgcttcacaagtactttgggtgtactccgtccaagtacctgcagatccgttcttattagtatctaaacaatcatccttactaaggcttgggtcagacccggactctcctgtacatacccctcccacagggtacccgtctgtgtagcagtagttatctaagtatttagcgaacgttttcttacgagtgacttttgaccctaccaaatcgttataatcattgattactcctgataatagtgaagtaatattagctaccgttaaattaggtcgaggtatagatccttgtgcggaaaactcgaatccagaggcttcaatagggagcccagagtatttattcccttgccatactatttcttgtaactctgcgttatagcctccgttgaaccatctaaacttaggtacagtagaaggcgccgaccctgcagatagatctaactcaaatagctctactatactaccaggtgttaaactatttatatcagttgtaattttattactcataggattcctttatggttcgaatactctgttgaatgttgcagtaatagtcctatatccacttatatcctctttaacactccatttagcacaggtgtactttttataagggtagatagtatatgtctccccgctagctagtatatccgcggctaaagatagttgggtggcactatctatggccgttactgtggtggttgtaggggtaggagtgactactaccgtaggagctgaggtatacccgctcccgccagctactaatgttattgctgttattacccctgcactagatactactgcagtagcagaagcccctgtaccccctcctcctgtgaaagatattgaaggcaatgaagtactattgtacccgcttcctccagtagataccgatacagacgctacagcatcggctgacaaactagcagtacatactcctccggtacctccgctatcggtaaccgtagtatttaaataacgattagtaaagtattgactagtatctataagtttcttagtagcagtactagtagtggtactagatatactataccctactgggtaccaatcgaaagatgtaactcctccttggtcctctaagaattttataatcttattagtttccgctacaggcctgtttttccactctaagctccactgttcgggtaaattatttataccatctacagttctttgctcatacccgtccccataagatacagtgagtaccttaggcttttgttccgttttcatccctctatcagggttactatttacttctgtgttaaaatttggcataattaatacggactaagtagtcctcctggtctttgttggttaagtagctcttgttgaataacttgagtcatcattccccctaacttgttaaagtctggcccattagacccctcacttgcttgagcagaactagtagtagtaccgtcactggcaacgttaattgtaacattaatgttattctcggtattgttttcagtagcagccccttttccaatcattgctaccgggatagctctaccatccggtaaaggaacaattgcttcattatccttaccttcccccactagtccaagtgtaggcttggttactactcccccttttgcaaaggcttggaagcctcctctaagcacgttaccgttagcactcataacagctgtagtagcccccgataccactgaagatattatagtatttcctatttgctgtacaaaactcatagcaagtttagcagtgtttaacttaccattgtatatgagatccttaaacccagtctgtaatgtattattagttgcagctcctacggtctgcatagtattagtactaaaggttgtattctcgttatcgttccacattccttgctctgcaagcattgctgtctgctccgatccctcattagttttaaaagcagctgcagtacttgcgtttttagcgtacccgccttcagtctccccaaataagctttctcctgctcctgcctgcccttgggctgcagtaatagcctctgggttcttaataactactgcgagtcctttaccttctcctttagctttggcatctgcttgagcttcttctgatctcttttcaagttcagttttagtagtattggctacaagagtttctaacttagtattagttacttcagcttttagattcatttcagctaacttatctgcaactgaagtatcccctgtctgtctgctagcttcttgccacgcactatctgaatctgtgatctctgatctattccatctagtctctgtgtaagcctttaattgctcccaccantccccaaatgccttctctgtnaacccgtcgtctgcaatttggtaccctgcagtacctatagccgctaatgtaacttgcggaatcattgctattttatctagtaactcaggcgtaccttctggagtgttatcaaatgccccataaccaaacttagtcatagaagcgcctttggctttaccaaagttaggatctgctatacctgtagtctttctattattataatagtcagcacttagctcattatccaactttccgtagtcttttattgcactaggtaaagacccgtcttttggagtaatccattctctaaaggaatctcttatttgctctaataaaggtactgcgtggtggtcatgtacggagtgtgatttacctgacttagatatatcatttgctttttgtgcagcatcggctgcttgtttagcttcggagtttagcctgctgttccagtctaaaattttatcccaccaagatttttcttcttccgctactttaggtacttcatcgcctactactagtttctctgttacaggttcattgttgtacgcatcactatttaccaactttttaattcttaaatacccgtccgtaactatattaggcacaatattaagtttacctacgcctaatattactccatccaaagcctttgtattcttctctgttacttcgtctgatgcgctaaagaaatcctttgtatcgtcccacattttaccgaagaagtccccggcaaaactagtctgttctttctgtttagctaatattgcctctgcttgttgttttgcttggtaagtttggaagtcctggttacctgctacagaacctcgctgtgcttgtgcaattagcagttttagntcctcgaactcagcgccaacnnnnctaaggccnccagtanntttatntatagcgcccnctcttgcttgggtcactcgggaaccaaaccaatctctctggtttgaaggcaatgcctcagtgagtttcttaatctcggccaaagctgtttgatcccctttggacaccntcatattcntcagactgtttcctaactgcttctgtctttgttctgggtttgttatctctacagataatatttcctttgaaagtatgtcaacttgtcttgacatcatattcttaatttcagttagtgcagacaaacgtttctcagcgtctgtcttagggaagatagcatccgcccactcgttgcctttctcgtctccgcctagcattcttaacccgcccgcaagtagccctttattaccaaacatcatatctgatatagaantagagataaaatttcccccccagtctgatagttcttgtgccattgctagcctaattctctcactctgtgtatatccatcatcaggctggtccttctgcataaatacatcggagagggcttgccctaaagagtcggttaaccctgt

SEQ ID NO: 1447 - DNA, 4000 bp, Escherichia coli
  misc_feature (3038)..(3038): n is a, c, g, or t
  misc_feature (3050)..(3050): n is a, c, g, or t
  misc_feature (3635)..(3635): n is a, c, g, or t
  misc_feature (3638)..(3638): n is a, c, g, or t
  misc_feature (3701)..(3701): n is a, c, g, or t
  misc_feature (3734)..(3734): n is a, c, g, or t
  misc_feature (3743)..(3743): n is a, c, g, or t
  misc_feature (3745)..(3745): n is a, c, g, or t
  misc_feature (3752)..(3752): n is a, c, g, or t
  misc_feature (3755)..(3755): n is a, c, g, or t
  misc_feature (3757)..(3757): n is a, c, g, or t
  misc_feature (3762)..(3763): n is a, c, g, or t
  misc_feature (3768)..(3769): n is a, c, g, or t
  misc_feature (3771)..(3774): n is a, c, g, or t
  misc_feature (3776)..(3776): n is a, c, g, or t
  misc_feature (3778)..(3778): n is a, c, g, or t
  misc_feature (3780)..(3782): n is a, c, g, or t
  misc_feature (3787)..(3788): n is a, c, g, or t
  misc_feature (3790)..(3790): n is a, c, g, or t
  misc_feature (3792)..(3795): n is a, c, g, or t
  misc_feature (3797)..(3803): n is a, c, g, or t
  misc_feature (3805)..(3807): n is a, c, g, or t
  misc_feature (3809)..(3814): n is a, c, g, or t
  misc_feature (3817)..(3820): n is a, c, g, or t
  misc_feature (3822)..(3823): n is a, c, g, or t
  misc_feature (3825)..(3836): n is a, c, g, or t
  misc_feature (3839)..(3841): n is a, c, g, or t
  misc_feature (3844)..(3859): n is a, c, g, or t
  misc_feature (3861)..(3866): n is a, c, g, or t
  misc_feature (3868)..(3871): n is a, c, g, or t
  misc_feature (3873)..(3873): n is a, c, g, or t
  misc_feature (3875)..(3877): n is a, c, g, or t
  misc_feature (3879)..(3884): n is a, c, g, or t
  misc_feature (3886)..(3887): n is a, c, g, or t
  misc_feature (3889)..(3893): n is a, c, g, or t
  misc_feature (3895)..(3899): n is a, c, g, or t
  misc_feature (3901)..(3902): n is a, c, g, or t
  misc_feature (3904)..(3904): n is a, c, g, or t
  misc_feature (3907)..(3910): n is a, c, g, or t
  misc_feature (3912)..(3921): n is a, c, g, or t
  misc_feature (3923)..(3923): n is a, c, g, or t
  misc_feature (3928)..(3931): n is a, c, g, or t
  misc_feature (3934)..(3934): n is a, c, g, or t
  misc_feature (3936)..(3936): n is a, c, g, or t
  misc_feature (3938)..(3941): n is a, c, g, or t
  misc_feature (3948)..(3950): n is a, c, g, or t
  misc_feature (3952)..(3956): n is a, c, g, or t
  misc_feature (3958)..(3960): n is a, c, g, or t
  misc_feature (3962)..(3973): n is a, c, g, or t
  misc_feature (3976)..(3976): n is a, c, g, or t
  misc_feature (3978)..(3981): n is a, c, g, or t
  misc_feature (3984)..(3988): n is a, c, g, or t
  misc_feature (3991)..(3991): n is a, c, g, or t
  misc_feature (3996)..(3998): n is a, c, g, or t
  misc_feature (4000)..(4000): n is a, c, g, or t
tgctgatgacgacatagtagatgatgatagtgacgatgatgacgtcatcaataatgttactgatgtgagtaatccactcgacggtttttcagatgtttacacgataatagcaaccggtaagatcaaaagaggtggtaccatagtcgccaaaagacagattaagacaaatgtaaccatcattccctctcctgacgtcgaagtagatcccggtgtacagacaagtggcgatattgttggaacaggtggaggttttggtatgacaaatgacggtggaactctttctacaagttttggttctcccggggtaaataacaatacaggccctgaccctgaggacggtattgttattcgccctgcacagcaattggacgaaaattttgttaaggcctttgctatcgatcaggggcactacaacaccctggacctgacgattggccttgctaatgacaattatccggaaccatcagctccgagtttctatcatgattcaccaacagacacaatgccaaactttacctttgttgagcaagactttaccgttggctcaaaccgtagagcgtatggcgtggtctgggtaaaaggaaacgttgttctggatggaacagccacaatggatgccataataatctgtgaaggtaatattacattcaatggcacatcagatatagtgggaggcataatccattacggtgattatataaatggaaatggaaacccgaccgctatcgcaataaataatgatttttttagtaatctgagtaagtcaatgccgattgtagttgtccaatcatcgcatgaagcagtgtctgctaattaggaaagtgaaaaccatgttaaataaaatacgctcttcaatttcaaatagaagtaaaggaaaacgtctgattggtctggacataggcaactattccgtaaaggcattaggtgtatacgccaacggaaccggtcaaaaaatagagtgccttgcaatgtcagaagcagatagagaaacaaggcagaaaggaagagatccggaggtactaactgagttaattaaaaattgtctggcagagggacgcatttctggcaaagatgttgttattatggtatcaggatcccaggtcttcatccggcgtattaccatgccgacgatgccaaaagaggagttggatgaagtgatgccctttgaggtgcagaaatatgtatccatccctatcgacaagatagttatggactatatggttgtaggtgagaaggaggtagatggagtaaacaagctggatattatcctggttgctgcccccaaagagctggtagagcaggagctttctattgctcgtgctgccggcctgaagcccgtcgcgatcagcgctgccccaatggtacaatggaaaacattcacaatgcgcaatggtgagcagatagataaagtgagcgctatggtggatatcggttatgagagaacagtcatcagcttctttaataaaggagtgctggaatttaccaggtctattaatctgggaggtaatgacgttacaaagtcactgatatcagcaccgataagtgaagcaggcaaagaacttcgtacactgttatatgacgatgcagatgccttaaaacgtgaacatggatttccctctccggaaaaagccggtgcgacaaaggagggtatatcatttgcccatctctctatgctcatgagacctgttctggaaaaactcctgagtgagatcaaggcgagttttgatttctacacaacagagtttaatgtacccaatgtagaaaaaattatcatctccggcggaggttcagaactgaaaggcttaagaggatttctggcaaatgagctgggtatggaagtagagtctgccaatcccacacttggtgctaaatacgcagacggagtatctgaggagattactgcagcgagcactccctctttagtgactgcatatggattggccacatggaagagagacgaattgaacctcatctcaggaaggaaagagaacaaaaaaatcgcctctattacatcacttgctgctccctgcggcgtagctgccatggcaatgcttatcttctatttaaacatttcaggaggagtggctagtgccaaatttgaactggaaggcaaaaagaaggagttatcatctttaagctcagcgactacacgggttctgcagcttggctccaaaaaaagaagactactgacggaaagggattcatacccacaggtacttagagaagatatagattccgctgtgatactaaaagagataaggctgcataccgcagacaatatacgtctggaatacatcagctttctctccgaatcatccacagcagaaaagaaaaaagtaaaggtaacgggaacagcattttttctggataagagaggctctgcaatttcagatttcatgacttcccttgaagattctattagatttgatgacatacggcttatccacctggagcaggacaagaattacacagccgaaggtttaaaatttcagataagctgtttatgcaatactatgtaggagataacagacatggcactaaaaattgatataccaaagttagataaaaagaaatgcctgatgatcggaattatcggatcattagccatgctggcggcattctatcaactatattttgatccttcaaagaaaaagatagccgatataaacagggtaatcgctgatcacaataagaaaatcatcaccgctaaaaaacattctgccatgacaaaaaagatggaagaagaagtagtggctcttgagaagcagctcggtactatcaggaccaagattgccacaagcggagagataattccaataattaatactatagaaaacgaagcgcttcgtcttgatctgaaggtgttaaagatgtccacaagggtagtagaaccaccacctcctcctgcacctgacgcgaatggaaatgcaaatgccgatgctaatactgcccttcccggacaaattcccggttatatcaaggtcacctttgatatcaacctgcagggcaggtacgacaaaatggaaaagttcataagngtactacagganctggcaacgttccttatcattgacacattagagatcagcagtgatgaaaaactgtatcctcagatggtgtcgaatattctgataaacgtttacaacaaaaaagaggtcggcgatgttgttgctgtcaaatagtagggagcgtttccatacgcgccgattaataaatgagtcgggtataaaaacccgacctacagaaaactgacacttttaaatagaactatgaaactaaacaaaactaaactatttttatttactactatcattatcctaaggtttacagctgtttgcgttgctaatataagcagcgacaatgcgaacagcgagtcgaatcctgtaaaggatgaagtgttgatgcgtgacccttttgcactccccctcgatgtaaatttcttaaagaaatcgcaggcatctgagaatgctgactcagaatcgggagaatggatagaaggaatggttgccagcaatgtaagaggcatcttcaggagtaacgggaaatccatagccaatatcaaccatgtatgggtagaaacaggcaaatgggtgggagatgagcaggtaaccgcaataaacaaagacagtgtagtnttntccggaaagagcggagtagaaagaaccattcttatgcaggagaaagttgccagatttgagacnactcagcggattgtatcaaggaccgttaaaggnaaatgaagnantaataantgntngaagnnagctnnannnngnantnnntaaanntntnnnntnnnnnnncnnnannnnnnttnnnncnntnnnnnnnnnnnnccnnntcnnnnnnnnnnnnnnnntnnnnnnannnntntnnntnnnnnntnnannnnntnnnnntnnantannnnannnnnnnnnntntaatnnnnttntngnnnntaaaatnnncnnnnngnnnannnnnnnnnnnntcntnnnnctnnnnnctncaacnnntn

SEQ ID NO: 1448 - DNA, 4000 bp, Escherichia coli
  misc_feature (252)..(252): n is a, c, g, or t
  misc_feature (1173)..(1173): n is a, c, g, or t
  misc_feature (1325)..(1325): n is a, c, g, or t
  misc_feature (3343)..(3343): n is a, c, g, or t
aagagctttgatgatgaaagacgaactaattaagcttggcttgacagaggataaaattttaggagtatttttcaacgtgcccaaggatagcaagggctgtatagagattgggtgtgctaagggaagaaaagttgtcattaatttatttaataaataatgcccccaaaaatatcccttatttattgatgccccttttgatattaactgattgtttaatttgataatttttaaatttatttgatagttttcgtntaaaatttaagataaaaatgcttatgaagaacctatttaaattaataactttgatgcctatgatggtctcgttccaggcatacaccgcgcaaccagatgcagggcaaattattaaagaaattgagcttaatgcgcctaaagttgtgaaagataaattgcttattaagcccaaccaacccattgttgaggataaagatgtcccaaagattgaaatcaagaaattttatataattaacaacaaggcattatcttctaaagaaatcttagcgtatctagacaagtttgtcggtaagcaggttactgtgaatgggctcaatgaaattgtgaatgagttatcaaattattaccgtgatttaggttttctggcacaggcttctttacccgaccaggatgtgacagagggtaatgtattgattaatatcactgagggtaactttgctggtgttgaagttgccaccgttgacggaaacgactcccacattgatcctgaatacgtaaaaaaattctttgaatcacatggcttaaataaaatcctaagccttcatgttgtcgatcgaaaggtacttatttttaatagaaatcatggtgttgaagcaacatcttcactggctgcaggggactatgagggcgacactaaggtactgatccaattggaaaatctaccaagatttgactctgtatttaatttagacaactacggctctagaacaacagggcgaacacgaggtctttacagccttaactggaacaatcccattggcactggagagcaattgcaagcaatttacatgaaaaccgagggtgtagattttattagtttaggttatgacgtgcctattggctatgacggacttcgtgcaaatttaactgttggttacatggagtatgaggtaattcatggtgagtatgaggacaatgacntaaatggagattccctctcgttccaaggcaaatttaactaccccattaaaattagctctcaaggctttatggatgtggtagcgcaatttagcaatagatcattcgttaacgactccggcagtataacgcttagtgagttcgacacaaacgtngcaaaatttggtatcgagggttcatacactgactatatgctgctggaaggagcttctaataactatgggatttttctccacaccggcgatgttgattacgccggctcaacagagaatggtctgtttacaaaattaacttttgagtatgagagggtgcaatacatcgacagctattggtcggctagtttccaaatatcaggacagatagctgacagcaatatgaattcctctgaacaattctatcttggggggcctaccggtatccgagcgtaccctgtcagcgaaggtgggggcacccacggcattctatccaccattgaaatcgcacgctccttaccctacgcacttgaagcaaaggccttctacgatatgggggcaatcaaacaggttaaggaccgttactcgggcgataacgtaacaaacaactcatatagccttaaaggatacggtgctggcctcgagtggagggcccctaacgactcatatttaggtgtaacatggtcacatcgtattggcggtaatccaaataaacagtcggacggaagcgatcaagatggggggcataaagaaaactttatttggctcaatggtcacatcacattttgataattgtgcccctttttttttaaaaaattcttgtttttaggggcaatttataataaagttttagatcgatcaaacagtttaaatttgcgcatgagtttttggaatataaacaaagtcatttttaccttaacgggagcgaccctaggggttttttgttgctcaataaatgctgagcctgtttctaatgccctacccacaggcggatcgatttcaagtggagacgtaatctttactagtgaaggttcaccaactgccccagttttaaatatcaatcaatcctctcaaaaagcggtccttaattggaattcatttgatgtgggatcacaatccactgttaactttaatcaacctaacacatcatcctcaacccttaatcgaattcacagccaaagtgcttctgaaattcatggccgcattaatgctaccggtgaggtattgttggttaatgaaaatggtattttatttggaaaaaattcacgaattgatgtcggatctattgctgcaagtgcaaataacatcaagaatgcggattatctaagcgataactatgtgtttgaggagggtgacaatgagtcaaccgtcaccaataagggtagcatcaaaacaagtcttggtggttacgccgcgctcttagccccccatgtgattaatgagggtatagtgacggcgcaaaaaggtacagtcgcgtttgcttctggaaatataattacccttagtgttaataatggctcacttacgtcgctgaccgtaactccaagtaaatataatgccttcatcgaaaataaatatatcgttgaggccccaggcggccgagttattctctcagcgactgcggtgaaccagattagggggggcgtgatcaaacaggcaggcctcattaatgtaggcaatacaccgactatgattgtaaatgaggcagggcggatcacaatatctagcaatcattatatagctacatcagaatcacaaaccttagcctcggcagaaaaccaaggtggcaagatatcgatcgatgctacaaaaaccgctgtattggaaggtggtgcggtaatgaaagcttcagccacaatgagcggtgatgggggcaacattagcataacctctggcgagcagcttgcactagggggcaacattgaagcgaatggggcaaatgagggtaacgggggcattattacgacgcactcccccaatgttatcagcgtagcatccagccttgctgtgtttgctatggcgggattgaataggatagatgaaaacgaaggtagttggacccatacagcaaatcaacattatatcgataccaatacagctgagatcatttcgaatacacttgatcatgctagcgttatgcttgttgcccaagcaggcgatattgtcatacccagcgatgtaaatgttattaagaagtcgtntaattcgccgaagacatcgttgcgtattatgtcgtcagctagtaccagcatcctcggaagcatctccaataatgaagccacagacttatccgttcaactaagcgccttatcaactattactcttggcagttctgctttcataagggccgcggaggtgagctttgaggctgagagagacatcaatgttctgggggatatttatgtctatggtagtaacaatagctcgcctctagctaggtttatgggggcaaatgtagcattaatgggggcaatttatggtgggcgacaggactcgaaatcttcaaccgtaagagcccatgccagcaagttcctctcaaccggacccaaaagtcgtattcagcttatgggtcgtgatgcgcagcttaatttatcatctgagcacgagttagtcatagagggtagtactatccaaaccaatgcaggcaatggcaggggggggacctacaccattaatgcgctagaggatattcttattagcaatgctaccatctcatccaatgcgagtgagggtggttttattcgaatcacttcatctaagaacaatgtcagtcttaaatcaagcctcatacagaccaatggcagttctggccgtgggggtacaattgagattgccggttataatcacaccgtcctttt

SEQ ID NO: 1449 - DNA, 4000 bp, Escherichia coli
  misc_feature (3)..(3): n is a, c, g, or t
  misc_feature (6)..(6): n is a, c, g, or t
  misc_feature (10)..(11): n is a, c, g, or t
  misc_feature (16)..(17): n is a, c, g, or t
  misc_feature (19)..(19): n is a, c, g, or t
  misc_feature (21)..(21): n is a, c, g, or t
  misc_feature (25)..(25): n is a, c, g, or t
  misc_feature (27)..(30): n is a, c, g, or t
  misc_feature (33)..(33): n is a, c, g, or t
  misc_feature (36)..(39): n is a, c, g, or t
  misc_feature (41)..(41): n is a, c, g, or t
  misc_feature (43)..(44): n is a, c, g, or t
  misc_feature (46)..(48): n is a, c, g, or t
  misc_feature (50)..(50): n is a, c, g, or t
  misc_feature (55)..(55): n is a, c, g, or t
  misc_feature (58)..(58): n is a, c, g, or t
  misc_feature (62)..(62): n is a, c, g, or t
  misc_feature (70)..(70): n is a, c, g, or t
  misc_feature (72)..(72): n is a, c, g, or t
  misc_feature (74)..(74): n is a, c, g, or t
  misc_feature (76)..(78): n is a, c, g, or t
  misc_feature (80)..(81): n is a, c, g, or t
  misc_feature (85)..(87): n is a, c, g, or t
  misc_feature (90)..(90): n is a, c, g, or t
  misc_feature (92)..(93): n is a, c, g, or t
  misc_feature (95)..(95): n is a, c, g, or t
  misc_feature (102)..(102): n is a, c, g, or t
  misc_feature (106)..(106): n is a, c, g, or t
  misc_feature (111)..(111): n is a, c, g, or t
  misc_feature (114)..(116): n is a, c, g, or t
  misc_feature (120)..(120): n is a, c, g, or t
  misc_feature (122)..(122): n is a, c, g, or t
  misc_feature (128)..(128): n is a, c, g, or t
  misc_feature (132)..(132): n is a, c, g, or t
  misc_feature (134)..(135): n is a, c, g, or t
  misc_feature (137)..(137): n is a, c, g, or t
  misc_feature (139)..(140): n is a, c, g, or t
  misc_feature (143)..(143): n is a, c, g, or t
  misc_feature (145)..(146): n is a, c, g, or t
  misc_feature (150)..(150): n is a, c, g, or t
  misc_feature (153)..(153): n is a, c, g, or t
  misc_feature (155)..(155): n is a, c, g, or t
  misc_feature (158)..(158): n is a, c, g, or t
  misc_feature (160)..(161): n is a, c, g, or t
  misc_feature (164)..(164): n is a, c, g, or t
  misc_feature (166)..(173): n is a, c, g, or t
  misc_feature (176)..(176): n is a, c, g, or t
  misc_feature (178)..(179): n is a, c, g, or t
  misc_feature (182)..(182): n is a, c, g, or t
  misc_feature (184)..(184): n is a, c, g, or t
  misc_feature (186)..(186): n is a, c, g, or t
  misc_feature (189)..(192): n is a, c, g, or t
  misc_feature (194)..(194): n is a, c, g, or t
  misc_feature (197)..(199): n is a, c, g, or t
  misc_feature (203)..(204): n is a, c, g, or t
  misc_feature (207)..(207): n is a, c, g, or t
  misc_feature (210)..(212): n is a, c, g, or t
  misc_feature (215)..(215): n is a, c, g, or t
  misc_feature (220)..(220): n is a, c, g, or t
  misc_feature (223)..(223): n is a, c, g, or t
  misc_feature (226)..(227): n is a, c, g, or t
  misc_feature (229)..(229): n is a, c, g, or t
  misc_feature (231)..(237): n is a, c, g, or t
  misc_feature (239)..(241): n is a, c, g, or t
  misc_feature (243)..(243): n is a, c, g, or t
  misc_feature (246)..(247): n is a, c, g, or t
  misc_feature (249)..(249): n is a, c, g, or t
  misc_feature (251)..(253): n is a, c, g, or t
  misc_feature (258)..(260): n is a, c, g, or t
  misc_feature (262)..(264): n is a, c, g, or t
  misc_feature (267)..(267): n is a, c, g, or t
  misc_feature (269)..(272): n is a, c, g, or t
  misc_feature (275)..(277): n is a, c, g, or t
  misc_feature (280)..(280): n is a, c, g, or t
  misc_feature (282)..(282): n is a, c, g, or t
  misc_feature (284)..(284): n is a, c, g, or t
  misc_feature (290)..(295): n is a, c, g, or t
  misc_feature (297)..(302): n is a, c, g, or t
  misc_feature (304)..(304): n is a, c, g, or t
  misc_feature (306)..(307): n is a, c, g, or t
  misc_feature (309)..(309): n is a, c, g, or t
  misc_feature (311)..(311): n is a, c, g, or t
  misc_feature (314)..(314): n is a, c, g, or t
  misc_feature (316)..(316): n is a, c, g, or t
  misc_feature (318)..(318): n is a, c, g, or t
  misc_feature (320)..(322): n is a, c, g, or t
  misc_feature (327)..(328): n is a, c, g, or t
  misc_feature (330)..(332): n is a, c, g, or t
  misc_feature (337)..(337): n is a, c, g, or t
  misc_feature (339)..(339): n is a, c, g, or t
  misc_feature (341)..(341): n is a, c, g, or t
  misc_feature (347)..(353): n is a, c, g, or t
  misc_feature (355)..(357): n is a, c, g, or t
  misc_feature (359)..(359): n is a, c, g, or t
  misc_feature (361)..(362): n is a, c, g, or t
  misc_feature (364)..(367): n is a, c, g, or t
  misc_feature (370)..(374): n is a, c, g, or t
  misc_feature (376)..(377): n is a, c, g, or t
  misc_feature (379)..(381): n is a, c, g, or t
  misc_feature (383)..(389): n is a, c, g, or t
  misc_feature (391)..(392): n is a, c, g, or t
  misc_feature (396)..(397): n is a, c, g, or t
  misc_feature (399)..(400): n is a, c, g, or t
  misc_feature (402)..(406): n is a, c, g, or t
  misc_feature (409)..(409): n is a, c, g, or t
  misc_feature (411)..(412): n is a, c, g, or t
  misc_feature (414)..(418): n is a, c, g, or t
  misc_feature (423)..(423): n is a, c, g, or t
  misc_feature (425)..(431): n is a, c, g, or t
  misc_feature (435)..(435): n is a, c, g, or t
  misc_feature (437)..(439): n is a, c, g, or t
  misc_feature (441)..(442): n is a, c, g, or t
  misc_feature (446)..(446): n is a, c, g, or t
  misc_feature (450)..(450): n is a, c, g, or t
  misc_feature (452)..(455): n is a, c, g, or t
  misc_feature (457)..(460): n is a, c, g, or t
  misc_feature (462)..(464): n is a, c, g, or t
  misc_feature (467)..(467): n is a, c, g, or t
  misc_feature (469)..(471): n is a, c, g, or t
  misc_feature (473)..(473): n is a, c, g, or t
  misc_feature (477)..(478): n is a, c, g, or t
  misc_feature (481)..(481): n is a, c, g, or t
  misc_feature (483)..(483): n is a, c, g, or t
  misc_feature (486)..(486): n is a, c, g, or t
  misc_feature (489)..(489): n is a, c, g, or t
  misc_feature (491)..(492): n is a, c, g, or t
  misc_feature (494)..(494): n is a, c, g, or t
  misc_feature (496)..(496): n is a, c, g, or t
  misc_feature (498)..(500): n is a, c, g, or t
  misc_feature (502)..(506): n is a, c, g, or t
  misc_feature (508)..(508): n is a, c, g, or t
  misc_feature (511)..(515): n is a, c, g, or t
  misc_feature (519)..(519): n is a, c, g, or t
  misc_feature (521)..(522): n is a, c, g, or t
  misc_feature (525)..(528): n is a, c, g, or t
  misc_feature (531)..(531): n is a, c, g, or t
  misc_feature (533)..(537): n is a, c, g, or t
  misc_feature (539)..(541): n is a, c, g, or t
  misc_feature (543)..(545): n is a, c, g, or t
  misc_feature (547)..(547): n is a, c, g, or t
  misc_feature (549)..(549): n is a, c, g, or t
  misc_feature (551)..(551): n is a, c, g, or t
  misc_feature (554)..(555): n is a, c, g, or t
  misc_feature (558)..(558): n is a, c, g, or t
  misc_feature (560)..(566): n is a, c, g, or t
  misc_feature (568)..(568): n is a, c, g, or t
  misc_feature (570)..(573): n is a, c, g, or t
  misc_feature (575)..(575): n is a, c, g, or t
  misc_feature (577)..(578): n is a, c, g, or t
  misc_feature (580)..(581): n is a, c, g, or t
  misc_feature (583)..(583): n is a, c, g, or t
  misc_feature (586)..(587): n is a, c, g, or t
  misc_feature (591)..(591): n is a, c, g, or t
  misc_feature (593)..(594): n is a, c, g, or t
  misc_feature (596)..(598): n is a, c, g, or t
  misc_feature (601)..(603): n is a, c, g, or t
  misc_feature (605)..(605): n is a, c, g, or t
  misc_feature (607)..(610): n is a, c, g, or t
  misc_feature (612)..(612): n is a, c, g, or t
  misc_feature (614)..(618): n is a, c, g, or t
  misc_feature (620)..(623): n is a, c, g, or t
  misc_feature (625)..(628): n is a, c, g, or t
  misc_feature (630)..(631): n is a, c, g, or t
  misc_feature (633)..(634): n is a, c, g, or t
  misc_feature (637)..(637): n is a, c, g, or t
  misc_feature (642)..(643): n is a, c, g, or t
  misc_feature (647)..(647): n is a, c, g, or t
  misc_feature (649)..(653): n is a, c, g, or t
  misc_feature (657)..(657): n is a, c, g, or t
  misc_feature (659)..(661): n is a, c, g, or t
  misc_feature (663)..(663): n is a, c, g, or t
  misc_feature (665)..(665): n is a, c, g, or t
  misc_feature (667)..(669): n is a, c, g, or t
  misc_feature (672)..(674): n is a, c, g, or t
  misc_feature (676)..(684): n is a, c, g, or t
  misc_feature (687)..(687): n is a, c, g, or t
  misc_feature (689)..(689): n is a, c, g, or t
  misc_feature (691)..(694): n is a, c, g, or t
  misc_feature (698)..(698): n is a, c, g, or t
  misc_feature (701)..(701): n is a, c, g, or t
  misc_feature (703)..(703): n is a, c, g, or t
  misc_feature (705)..(705): n is a, c, g, or t
  misc_feature (707)..(707): n is a, c, g, or t
  misc_feature (709)..(710): n is a, c, g, or t
  misc_feature (712)..(713): n is a, c, g, or t
  misc_feature (715)..(715): n is a, c, g, or t
  misc_feature (717)..(718): n is a, c, g, or t
  misc_feature (720)..(720): n is a, c, g, or t
  misc_feature (726)..(728): n is a, c, g, or t
  misc_feature (731)..(733): n is a, c, g, or t
  misc_feature (735)..(735): n is a, c, g, or t
  misc_feature (737)..(737): n is a, c, g, or t
  misc_feature (739)..(739): n is a, c, g, or t
  misc_feature (741)..(742): n is a, c, g, or t
  misc_feature (744)..(744): n is a, c, g, or t
  misc_feature (746)..(747): n is a, c, g, or t
  misc_feature (749)..(749): n is a, c, g, or t
  misc_feature (753)..(753): n is a, c, g, or t
  misc_feature (755)..(757): n is a, c, g, or t
  misc_feature (759)..(759): n is a, c, g, or t
  misc_feature (761)..(761): n is a, c, g, or t
  misc_feature (770)..(772): n is a, c, g, or t
  misc_feature (774)..(774): n is a, c, g, or t
  misc_feature (776)..(776): n is a, c, g, or t
  misc_feature (779)..(780): n is a, c, g, or t
  misc_feature (786)..(786): n is a, c, g, or t
  misc_feature (788)..(788): n is a, c, g, or t
  misc_feature (794)..(795): n is a, c, g, or t
  misc_feature (797)..(797): n is a, c, g, or t
  misc_feature (799)..(799): n is a, c, g, or t
  misc_feature (802)..(804): n is a, c, g, or t
  misc_feature (806)..(806): n is a, c, g, or t
  misc_feature (809)..(809): n is a, c, g, or t
  misc_feature (812)..(812): n is a, c, g, or t
  misc_feature (815)..(815): n is a, c, g, or t
  misc_feature (819)..(819): n is a, c, g, or t
  misc_feature (821)..(821): n is a, c, g, or t
  misc_feature (824)..(824): n is a, c, g, or t
  misc_feature (827)..(828): n is a, c, g, or t
  misc_feature (832)..(833): n is a, c, g, or t
  misc_feature (835)..(836): n is a, c, g, or t
  misc_feature (839)..(839): n is a, c, g, or t
  misc_feature (842)..(842): n is a, c, g, or t
  misc_feature (844)..(844): n is a, c, g, or t
  misc_feature (846)..(846): n is a, c, g, or t
  misc_feature (850)..(850): n is a, c, g, or t
  misc_feature (853)..(853): n is a, c, g, or t
  misc_feature (856)..(856): n is a, c, g, or t
  misc_feature (858)..(858): n is a, c, g, or t
  misc_feature (863)..(863): n is a, c, g, or t
  misc_feature (865)..(865): n is a, c, g, or t
  misc_feature (868)..(868): n is a, c, g, or t
  misc_feature (875)..(875): n is a, c, g, or t
  misc_feature (878)..(878): n is a, c, g, or t
  misc_feature (881)..(883): n is a, c, g, or t
  misc_feature (885)..(885): n is a, c, g, or t
  misc_feature (887)..(887): n is a, c, g, or t
  misc_feature (889)..(889): n is a, c, g, or t
  misc_feature (891)..(895): n is a, c, g, or t
  misc_feature (897)..(897): n is a, c, g, or t
  misc_feature (901)..(901): n is a, c, g, or t
  misc_feature (903)..(904): n is a, c, g, or t
  misc_feature (906)..(906): n is a, c, g, or t
  misc_feature (909)..(910): n is a, c, g, or t
  misc_feature (912)..(915): n is a, c, g, or t
  misc_feature (917)..(920): n is a, c, g, or t
  misc_feature (923)..(923): n is a, c, g, or t
  misc_feature (925)..(926): n is a, c, g, or t
  misc_feature (928)..(930): n is a, c, g, or t
  misc_feature (933)..(933): n is a, c, g, or t
  misc_feature (936)..(936): n is a, c, g, or t
  misc_feature (940)..(940): n is a, c, g, or t
  misc_feature (942)..(942): n is a, c, g, or t
  misc_feature (948)..(948): n is a, c, g, or t
  misc_feature (950)..(953): n is a, c, g, or t
  misc_feature (956)..(956): n is a, c, g, or t
  misc_feature (958)..(959): n is a, c, g, or t
  misc_feature (970)..(970): n is a, c, g, or t
  misc_feature (972)..(972): n is a, c, g, or t
  misc_feature (974)..(977): n is a, c, g, or t
  misc_feature (979)..(981): n is a, c, g, or t
  misc_feature (983)..(983): n is a, c, g, or t
  misc_feature (986)..(986): n is a, c, g, or t
  misc_feature (988)..(990): n is a, c, g, or t
  misc_feature (992)..(993): n is a, c, g, or t
  misc_feature (995)..(998): n is a, c, g, or t
  misc_feature (1004)..(1006): n is a, c, g, or t
  misc_feature (1010)..(1012): n is a, c, g, or t
  misc_feature (1015)..(1015): n is a, c, g, or t
  misc_feature (1017)..(1020): n is a, c, g, or t
  misc_feature (1022)..(1023): n is a, c, g, or t
  misc_feature (1025)..(1025): n is a, c, g, or t
  misc_feature (1029)..(1029): n is a, c, g, or t
  misc_feature (1031)..(1031): n is a, c, g, or t
  misc_feature (1034)..(1034): n is a, c, g, or t
  misc_feature (1036)..(1036): n is a, c, g, or t
  misc_feature (1039)..(1039): n is a, c, g, or t
  misc_feature (1041)..(1043): n is a, c, g, or t
  misc_feature (1046)..(1046): n is a, c, g, or t
  misc_feature (1048)..(1048): n is a, c, g, or t
  misc_feature (1053)..(1053): n is a, c, g, or t
  misc_feature (1055)..(1059): n is a, c, g, or t
  misc_feature (1062)..(1062): n is a, c, g, or t
  misc_feature (1064)..(1065): n is a, c, g, or t
  misc_feature (1068)..(1072): n is a, c, g, or t
  misc_feature (1074)..(1075): n is a, c, g, or t
  misc_feature (1077)..(1077): n is a, c, g, or t
  misc_feature (1079)..(1079): n is a, c, g, or t
  misc_feature (1082)..(1082): n is a, c, g, or t
  misc_feature (1085)..(1085): n is a, c, g, or t
  misc_feature (1088)..(1088): n is a, c, g, or t
  misc_feature (1091)..(1095): n is a, c, g, or t
  misc_feature (1097)..(1097): n is a, c, g, or t
  misc_feature (1100)..(1100): n is a, c, g, or t
  misc_feature (1102)..(1103): n is a, c, g, or t
  misc_feature (2520)..(2520): n is a, c, g, or t
  misc_feature (3353)..(3353): n is a, c, g, or t
tgnaanacannaattnnananaatntnnnnggntannnntncnntnnncngttgnctntttnaaaaatanantntnnntnncccnnnttntnngnctctccnctanaaaanttnnnaaantntaaaanagancnntntnnccncnnaaanacncnttntnntanannnnnnnngananntanananaannnnanacnnngagnnatntcnnnaanaaaanacnccnngnannnnnnntnnnanganntnannntcccnnnannnttntnnnnaannntcncncnataaannnnnntnnnnnnantnntntnaanananannnatttnnannnaaaantncntatatnnnnnnncnnnananntnnnngcnnnnnanntnnngnnnnnnncnnaacnntnncnnnnnaananntnnnnnttttntnnnnnnnaatntnnngnnaaanaaantnnnntnnnncnnnaancnnncnaacnnttntnacnccncnnangntnnncnnnnnanaannnnnttcncnnttnnnnaangnnnnngnnntnnnangngnaannccncnnnnnnnanannnnancnntnnanttnncccncnngnnnccnnntnannnntnannnnntnnnntnnnncnntnncanaaaanntttntnnnnnttcncnnntngnannnggnnnannnnnnnnnttnanannnntttnttntntnancnntnnananntntttttnnnaannntnangnanncncnntnaaanannnananaaaaaaaannnanantgnnaaaaanantttttnnananttnnngnttnaanttnggananacnccnnaaanntnnagnggnanantttnaangtntnttttntnttnttttttnttnttnnntntntnannnnntnttananntnttnnannnncnnnnttnanngnnntanaanaaananaaaatntnnnnaancnnttttttttatntnannnnannnanaantnnntnnannnnaaatannntttnnntanannnnanngntttntnttntnttntnnnaanantttanannnnnttntnnaannnnncnntntnaanttnggnaannnnnanttntnnaaaaaaaaatgttgttgaaattatatctgtgaaaaggtgattattttaattttgttgaaattgatttacctaaaaaattaaaacatctttatccggggtacattaaaacactaattgttacatgaataagtaattatgattatttcaatatagagctaattaatttaccaaaatcaaacttttagaagacaacaataaaacttattaggtgatttttggtttttatccgttatttgcaaaaaactttcctttgaattatctgactgttgaaaacatatccaaatcttatggagaacttacactatttgaaaatatttcatttagtgtccataaagatcaaaaaatagcttttgttgccaagaatggaacaggaaaaacttccattttaaatattttatctggtgatgatactgccgattctggtgacgttatatttagaaaagatattaatgtttcgtttttgtcacaagatcctaaatttgacgaaaaacgcactattgaagatactattctagcaagtgacaaccctattttaaaagtgatttcaaattatgaaaaagcacttttaaatccagaagatacagacacatatcaagctgcttttgatgctatggaacatcatcaagcttgggatttcgaaactctttataaacaagtacttttcaaattaaaacttgaaaatttagatcataaggtaagtacgctttctggtgggcaaaaaaaacgtctcgcactcgcaaatgcgttaatcaataaaccagatttattagttttagatgagcctacaaatcatttagacttagaaatgatagagtggttagaatcttttttcgcaaaagaaaacatcacactttttatggtaactcacgatagatacttccttgagcgagtgtgtaatgagattattgaattagacgaaggtcaactgcacagctataaaggtaattactcatactacctagaaaagcgggatgccagaattgagcaacaagctgtagaaacaggaaaagcgaaacaactctttaaaaaggaattggattggatgcgacgccaacctaaagcccgaaccaccaaatctaaatctagaattgatgattttgcagatataaaacatcgtgcgcatcaacgtagaaatgaccatgaggttcagttagaacttaacatggaacgtttaggaagtaaaattttagaattccataaagtatcaaaagcatataaagataaaaccattttagatggatttaattatatgtttcaaaaaggggaacgcgttggtattattggaaaaaacggaacaggaaaaacgacgtttctgaatatacttaccgaaacggctaaaccagattcgggaaaagttatcactggagacactattaaatttggctattacacacaaaacggtattaccattaaaccngagcaaaaagttattgatgttattcgtgaatttggtgattatattccattaaagaaaggcaagcaaataagtgcacaacaacttttagaacgttttttattcagtagaaaaaagcaatatgattttgttgaaaaactaagtggtggcgagcgtaaacgattgtatttatgtacagttctaattcagaatcccaactttttaattcttgatgagcctacaaacgatttggatatagtaacacttaatgttttagaaagtttccttctagattttccaggatgtgttattgttgtaacgcacgatcgttattttatggacaaagtaatagatcatttactaattttcaagggtgatggtgttattgaagattttccaggaaattatacagattatcgagtttatgaagacagccaacctgtgattactaaaacatctgaagggaaaaaagataaacaatcttggaaaaagaatgaagtttctaagctttcttataatgaagaaaaagaactaaaaaacatagagagcaaattaaaatcattggcatttgataaaaaggaactggaaaataagtttcataatcctgagttatcccaagatgacatcaataaattatctgctgagctacaaaaaattatagacactattgaaactaaagaagaacgctggttagaactgtcttctatgcttgaggattagtgttttcgtaattgaatactaaaatgatctatcaaatcactcaatacataaagtttttatttaagagtaccaaccaacacggcgtgcactccccgtttgtttatgatttagtaactcaatgtttttatgataaaacnaattacgaggcctataatgctatttttaattatagaaaagcgttactagagcgtaacactaaaattaaagtcgaagacttaggggctggttcacgcgtcatgaaacatcaagaacgcacagtttctgatatcgctaaaaaagctggcacaactcacacaagagcaaggcttttatacagactaacaaattattttaaacctgataatattttagagttgggaacgtctttaggtattgcaacatatgctatgcattcaggaactcccaaatcacatattacatccattgaaggatgccctaacacctcagcgttttcaaaaaagcaattcaagattcaaggtgcagaacatataaatattattactggggattttaataatgaaattgaaaagctaagttcaaatagttatgatttaattttctttgacggaaaccatcaaaaagaagcaactttgaaatattttgaaaccttattaaatacagctaataacgattctgtttttatttttgatgatatttactggtctgaaggtatgactagagcttgggaaatcatcaaagaacaccctaaagtaacgattactattgatacctttttttggggattcgttttctttagaaaggaacaagaaaaagaacacttcaa

SEQ ID NO: 1450 - DNA, 4000 bp, Escherichia coli
  misc_feature (1)..(3): n is a, c, g, or t
  misc_feature (5)..(10): n is a, c, g, or t
  misc_feature (13)..(15): n is a, c, g, or t
  misc_feature (17)..(20): n is a, c, g, or t
  misc_feature (22)..(29): n is a, c, g, or t
  misc_feature (31)..(33): n is a, c, g, or t
  misc_feature (35)..(35): n is a, c, g, or t
  misc_feature (39)..(41): n is a, c, g, or t
  misc_feature (43)..(44): n is a, c, g, or t
  misc_feature (47)..(51): n is a, c, g, or t
  misc_feature (54)..(54): n is a, c, g, or t
  misc_feature (56)..(59): n is a, c, g, or t
  misc_feature (61)..(62): n is a, c, g, or t
  misc_feature (64)..(68): n is a, c, g, or t
  misc_feature (70)..(72): n is a, c, g, or t
  misc_feature (74)..(74): n is a, c, g, or t
  misc_feature (76)..(83): n is a, c, g, or t
  misc_feature (85)..(87): n is a, c, g, or t
  misc_feature (90)..(94): n is a, c, g, or t
  misc_feature (96)..(112): n is a, c, g, or t
  misc_feature (114)..(118): n is a, c, g, or t
  misc_feature (120)..(121): n is a, c, g, or t
  misc_feature (123)..(125): n is a, c, g, or t
  misc_feature (127)..(129): n is a, c, g, or t
  misc_feature (133)..(133): n is a, c, g, or t
  misc_feature (135)..(140): n is a, c, g, or t
  misc_feature (144)..(150): n is a, c, g, or t
  misc_feature (152)..(152): n is a, c, g, or t
  misc_feature (155)..(158): n is a, c, g, or t
  misc_feature (160)..(166): n is a, c, g, or t
  misc_feature (169)..(169): n is a, c, g, or t
  misc_feature (171)..(172): n is a, c, g, or t
  misc_feature (174)..(177): n is a, c, g, or t
  misc_feature (179)..(179): n is a, c, g, or t
  misc_feature (181)..(181): n is a, c, g, or t
  misc_feature (185)..(188): n is a, c, g, or t
  misc_feature (190)..(192): n is a, c, g, or t
  misc_feature (194)..(197): n is a, c, g, or t
  misc_feature (199)..(199): n is a, c, g, or t
  misc_feature (201)..(202): n is a, c, g, or t
  misc_feature (204)..(207): n is a, c, g, or t
  misc_feature (209)..(212): n is a, c, g, or t
  misc_feature (214)..(214): n is a, c, g, or t
  misc_feature (216)..(219): n is a, c, g, or t
  misc_feature (221)..(221): n is a, c, g, or t
  misc_feature (223)..(231): n is a, c, g, or t
  misc_feature (234)..(240): n is a, c, g, or t
  misc_feature (242)..(242): n is a, c, g, or t
  misc_feature (244)..(259): n is a, c, g, or t
  misc_feature (263)..(264): n is a, c, g, or t
  misc_feature (267)..(269): n is a, c, g, or t
  misc_feature (272)..(272): n is a, c, g, or t
  misc_feature (274)..(282): n is a, c, g, or t
  misc_feature (285)..(285): n is a, c, g, or t
  misc_feature (287)..(288): n is a, c, g, or t
  misc_feature (290)..(290): n is a, c, g, or t
  misc_feature (292)..(292): n is a, c, g, or t
  misc_feature (294)..(297): n is a, c, g, or t
  misc_feature (300)..(300): n is a, c, g, or t
  misc_feature (302)..(303): n is a, c, g, or t
  misc_feature (305)..(316): n is a, c, g, or t
  misc_feature (318)..(319): n is a, c, g, or t
  misc_feature (321)..(322): n is a, c, g, or t
  misc_feature (326)..(326): n is a, c, g, or t
  misc_feature (328)..(330): n is a, c, g, or t
  misc_feature (332)..(332): n is a, c, g, or t
  misc_feature (334)..(339): n is a, c, g, or t
  misc_feature (341)..(343): n is a, c, g, or t
  misc_feature (346)..(346): n is a, c, g, or t
  misc_feature (350)..(352): n is a, c, g, or t
  misc_feature (354)..(356): n is a, c, g, or t
  misc_feature (361)..(361): n is a, c, g, or t
  misc_feature (364)..(364): n is a, c, g, or t
  misc_feature (366)..(368): n is a, c, g, or t
  misc_feature (370)..(371): n is a, c, g, or t
  misc_feature (373)..(376): n is a, c, g, or t
  misc_feature (379)..(382): n is a, c, g, or t
  misc_feature (385)..(386): n is a, c, g, or t
  misc_feature (388)..(392): n is a, c, g, or t
  misc_feature (394)..(397): n is a, c, g, or t
  misc_feature (400)..(402): n is a, c, g, or t
  misc_feature (404)..(404): n is a, c, g, or t
  misc_feature (408)..(410): n is a, c, g, or t
  misc_feature (412)..(412): n is a, c, g, or t
  misc_feature (415)..(425): n is a, c, g, or t
  misc_feature (427)..(436): n is a, c, g, or t
  misc_feature (438)..(438): n is a, c, g, or t
  misc_feature (440)..(443): n is a, c, g, or t
  misc_feature (447)..(447): n is a, c, g, or t
  misc_feature (450)..(452): n is a, c, g, or t
  misc_feature (454)..(454): n is a, c, g, or t
  misc_feature (456)..(459): n is a, c, g, or t
  misc_feature (461)..(461): n is a, c, g, or t
  misc_feature (463)..(471): n is a, c, g, or t
  misc_feature (473)..(473): n is a, c, g, or t
  misc_feature (475)..(477): n is a, c, g, or t
  misc_feature (479)..(480): n is a, c, g, or t
  misc_feature (483)..(485): n is a, c, g, or t
  misc_feature (487)..(488): n is a, c, g, or t
  misc_feature (490)..(492): n is a, c, g, or t
  misc_feature (495)..(497): n is a, c, g, or t
  misc_feature (499)..(502): n is a, c, g, or t
  misc_feature (504)..(512): n is a, c, g, or t
  misc_feature (514)..(520): n is a, c, g, or t
  misc_feature (522)..(525): n is a, c, g, or t
  misc_feature (527)..(532): n is a, c, g, or t
  misc_feature (535)..(539): n is a, c, g, or t
  misc_feature (541)..(541): n is a, c, g, or t
  misc_feature (543)..(544): n is a, c, g, or t
  misc_feature (547)..(549): n is a, c, g, or t
  misc_feature (551)..(557): n is a, c, g, or t
  misc_feature (559)..(559): n is a, c, g, or t
  misc_feature (561)..(562): n is a, c, g, or t
  misc_feature (564)..(565): n is a, c, g, or t
  misc_feature (567)..(573): n is a, c, g, or t
  misc_feature (577)..(578): n is a, c, g, or t
  misc_feature (581)..(583): n is a, c, g, or t
  misc_feature (585)..(585): n is a, c, g, or t
  misc_feature (587)..(589): n is a, c, g, or t
  misc_feature (591)..(595): n is a, c, g, or t
  misc_feature (598)..(598): n is a, c, g, or t
  misc_feature (601)..(603): n is a, c, g, or t
  misc_feature (607)..(609): n is a, c, g, or t
  misc_feature (611)..(611): n is a, c, g, or t
  misc_feature (948)..(948): n is a, c, g, or t
  misc_feature (1119)..(1119): n is a, c, g, or t
  misc_feature (2369)..(2369): n is a, c, g, or t
  misc_feature (3086)..(3086): n is a, c, g, or t
nnngnnnnnnttnnntnnnntnnnnnnnnannnanctannnanngannnnnganannnngnncnnnnngnnngntnnnnnnnncnnncgnnnnncnnnnnnnnnnnnnnnnntnnnnntnnannnannnagtnannnnnntgannnnnnncntgnnnntnnnnnnnatngnnannnncntntaannnntnnntnnnncnannannnntnnnntnannnntngnnnnnnnnncannnnnnntncnnnnnnnnnnnnnnnncaannaannnagngnnnnnnnnngcntnntntntnnnngcncnntnnnnnnnnnnnnanntnnctgncnnncntnnnnnntnnnttncttnnntnnncttanttntnnntnngnnnncgnnnncanntnnnnngnnnnctnnntngctnnntnctnnnnnnnnnnnannnnnnnnnncnannnntttnttnnntncnnnntngnnnnnnnnntntnnntnngtnnntnntnnntcnnncnnnngnnnnnnnnntnnnnnnncnnnntnnnnnncannnnntntnnctnnntnnnnnnnancnnanncnnnnnnnatannaannnangnnntnnnnnttnagnnntagnnnanccacaccctaagcaacttataggcttaaattgacaaactgccctatcagcacgtctagttttacgccctcaaataatccgcggcgtatatatctttgttaagcagcacatcacacgtttttatcgtgtctattaagtctcgatcctccgtatttattatagctgatgaaagaccggcgccaataagcatggctaaaaacgttctttctataagccgcgggttcttcgtgtcgtgcgagatgttgctgaggccaacggtcgtctttagaacggacgcgggactggtaagcattccaattcgccgcaccgcttcgacgactgccggtgcctgatcttgngctgtgctcaccggaagacaaactggatcaacgtacagcttctcgacgtcgatcccgtgctcgcaggcgcctgcgacaattatcgccgcccgttctacccgtttgtctacgtcgccaaggatgaattgctcgtccatcgtcatgcaaataatgtctgaatcgtattctgcngcaagtggaaaaagcgttgtcatcttctcctgttcagcggagatcgaattgatcatagatcttcctttgacctcactaatgcctgctttcatcacatcgagtttcggagtatcgactgaaagcgtaacgtcgaccacgtcttgtactgtcgtcactagccatctcattagctcaactgcgtcgctcttgccaagcccaacgttaaggtcaatgatttgtgcccccacgtcgacttggcgaattgctaggtcctgaatggcctttgtgtctcgtctatcgatgatggtccccacagtttttgagtagccgttgatgttgccgccaataattatcataggtatccccgctgctcccgcgcaagtgattagatgtgtgttatactttaacgctttcggatgagcgcgtacgaagctagccttctcgcaacctatatataaaaatatagtaaataacgacacgtcgattttgaacatatgtaaggcttttggggcaatttgaagaaagaattcaaggttgtttttaaacctgataacaaaaccgtcaaggttgaacgcggaaccaccgtacttgatgctgccacgagctctgacatctatatcgacagcatctgcggaggccggggcaaatgcggtaagtgtaaggtcctcatcgacggaaacgtccagagcgacgaaactgacatacttaccgctgaagaaaaagcgcgcggctattttttggcgtgtttggctcgagtcgctggcaatttgaaagtgaccgtaccaaaagaaagcagagtggagtcacaccaaatactcatgaaaagcgtgatcgcgcccttgccagcgattgctccgcccgtactgaaggtgccgctttccctcactcccccgtcgttagccgattacgtgagcgaccttgatagagtgacgcatgcgctgcgcaatctcgatatggggcacgttacgatcgggctaccgaccttaaagaagttaagcaaggtactccgagacaaccaatggaacgtgaacgtgacgctgatggatctctgggacagaaaagagattatcgacgtcggcccgccttcagacaacgatctaatcgggatcgcggtggacataggcactacgacgatcgtcgtcgagttagtggatttgacctctggcaaggtgattgacgcgcgatccgactataacaagcaagttgtgtacggcgaggatgtcctttcacgagtgatgtacacagaggagcacgaagatggcctccagaanctaacgagcacaattagatacggtatcaacgacctcatacgagagctcgtcatcgaaaataacacgcgatacgaaaagatttgccgcgcagtcctttcaggcaataccgttatgatgcaccttttttatgggttggatcccaagtacatacgccacgagccgtatatcccagtgatgtccttcgttccccagatgaaggcagttaagctcgggctgagcatcaacccaaacgcgtatatctatgcgcttccgtgccgaagcagctacgtcggcggcgacgtcacagctgacgtcattgcgtcaggaatgagcgacaataaggacgtttcactgctaatcgacgtcggcaccaacggcgaggtcgtgctcggaaataataccttcctcgtgtcgtgctcttgttcagcgggtccggcctttgaaggcggggaagtggagttcggcgtacgggcgatgaacggcgcaattgagcgcgtgtggatcaacaacggcctagtagagtactcgaccatcggcaacgcaaaggcaaagggcatttgtggatccggccttatcgaactcatcgcagagctctttagtaacggcgtgattgaccgaacggggaaaatccagctggacactaacaacatcaggactgaggtcggaagcaacggcaaccagttccttgtggcgttcaaagaagacacggccatcgacaaaaatatagtgatgaccgangtagacattcaaaacatattgcgaacgaaggccgctgtctatgcgagctgtagcgtgctgctcaaaacgtttggctaccaatttagtgaccttagcaacgtcttcatcgctgggagtttcggcaactacctcgacgtcaagaaagccatcacgattggattgttgcctgatctatcgcttaacacgttcaagttcatcggcaatggggctcttggtggagcgcgaatggtgttactgtcgcgagatctgcaagacaaagcggcagaaatcgtcaaaaatatgacacacatcgagttgagcgtcagcagcatgttctttaaagagtttacttcagcattgttcattcctcacacggaacttgaccagtttccccacgtttccaaacgaggttatacataaaggctcaagcggagtcaggttatcatttaccctgtttctgagcagtaatcctgtagacagaagacttgtgagagggcgtgtctgcttctgagctgtaacgagggtgtgcaattttaagtagcatagcagtataattttaggtagtagggcttacagtacggaaaacagcatgcaaaccattgctataacgggtaaaggtggcacgggcaaaacgacttttgcctctctccttgtaaaacatctgagcgccaataacaaagccattttggcagttgatgcagatcccaactcaaacttagatatgcgactgggacttcgcgtccagcagacaattggcgacttacgagaagacctgcttaaaaagtcttttcccgcaggggttgccaaaaatgagcttattgagtaccaaatacgactagctctcgttgaaggggatacgttcgaccttattgccatgggacggcccgaaggacccggatgctactgctatatcaacaacgtgttgcgggatgtcc

SEQ ID NO: 1451 - DNA, 4000 bp, Escherichia coli
  misc_feature (1)..(11): n is a, c, g, or t
  misc_feature (14)..(24): n is a, c, g, or t
  misc_feature (26)..(27): n is a, c, g, or t
  misc_feature (31)..(33): n is a, c, g, or t
  misc_feature (35)..(43): n is a, c, g, or t
  misc_feature (47)..(56): n is a, c, g, or t
  misc_feature (60)..(68): n is a, c, g, or t
  misc_feature (149)..(149): n is a, c, g, or t
  misc_feature (1772)..(1772): n is a, c, g, or t
  misc_feature (1942)..(1943): n is a, c, g, or t
  misc_feature (1948)..(1949): n is a, c, g, or t
  misc_feature (1960)..(1960): n is a, c, g, or t
  misc_feature (1966)..(1966): n is a, c, g, or t
  misc_feature (1973)..(1973): n is a, c, g, or t
  misc_feature (1978)..(1978): n is a, c, g, or t
  misc_feature (1985)..(1985): n is a, c, g, or t
  misc_feature (1990)..(1991): n is a, c, g, or t
  misc_feature (2000)..(2000): n is a, c, g, or t
  misc_feature (2003)..(2003): n is a, c, g, or t
  misc_feature (2009)..(2009): n is a, c, g, or t
  misc_feature (2018)..(2018): n is a, c, g, or t
  misc_feature (2050)..(2050): n is a, c, g, or t
  misc_feature (3633)..(3633): n is a, c, g, or t
nnnnnnnnnnnaannnnnnnnnnncnncccnnntnnnnnnnnncccnnnnnnnnnncccnnnnnnnnnccccccgtgtctcaaaagccaccacatggaaccgccccagcggatggatgtatatcaccgttccgtcgtaggcgcgtctgngtgcctttcttttccggttccggtctctgatctcttccgtctctccgaaagtctccggcacccgctgcactctgtctccgatcttcacagtgctttccctccgtggcggtacgggcgcgtgcggttgtactcgtgcttctgcgccagcaccgcctccacatccacgccttccttgccgcaccagtcgaggatgcggatgaggcagtccaccatctccgtggcaatgccctccggcttgcagctgtgctccggcttgccatccacttcgcactgtgtttccttgtcgcagtggccgcagcagccgtagatcatgggtttcccgttgcggtattcctccagcgcctcggacagttcgctgtggcacagcgccacaatgtctccgaagctgcgcggctcgtcccaccagccgtgctccaccgcgttctggtgaatgtcccgtgcccactcgttcagtgtctttgccatattcaattcctcccggttatgtattgccccgcatcagggtctgcctgatggagtacgctttttcatgcgcgcaggctgcgccgccgaagaaccgctccactcacgcctgcgcatctcgaagtggatatatgtccctcggttgatattgttcttgtagcaggtggcctccaccagctgaaagtccgggtagcggtcttcaaaccactgccactgcgttccgcactcgatggcctcctcgatgtctgctatgtcgtccatgttcagctgcccgtcaaactgcgcgcactgcgggatggtcaggttccggctctggttccagcgcttgaagaaatgcttgtccttggcgatgtagtgcgcaaggccggtcacgccggattcgttgaactgcagccgcttgctgttggcgtatcccagcccccacaccttctcgatggtgtcgcggtctaatcctccgctgagaatgacatggtgatgcactcttccgctggtcttgccgtattctgtgcagctgatgtacttcagttccatccccagctttgcataccggcgcttcagtcttcggatgtaattgctcaggatgtgctgcgcttcctcctccgtctgcggctcttcgccgggacggtaggtcagatgcagggcaatgtcatcctcggtgaagttgctgtgcactaagcgggtcagcttcttctccgcgttcttctggttcagcttctgctgaatttcgctcgtgggcttgcaccgcgatctccgcttccccggcgcttggaataccggatatatgtctccgtccatgtaatcgccgcagacatatacgctctcccggttgaatgttctccctgtgtacatccccgcagctcctctctggttgctaagttaagattggttacaagcctcaattcgcgcgtgcgcgcgcgaattatatataagtattcagcctgccatcgtcagtgccgggaggctgtccccggcagacaggacgcacagcgcgccctgtttcggctatgtggataaataatgcccgtagcaccacgctggcggtgcattcccttccacgcacgcttccttgcccttcggaaaaagctgcgtcacccgcccgtaggcgctctgcggtttcatcatgggaacgccgtccgcccgcgccggtgcgcgttcctccgnccttgcccggtatccgcagcgcagcgcgtctgtgtcgcggctccattcctcccggaaggcatgtgcgcagctgctgcagctcggtttcatgtttcgctccttcccgcgcgcacgcggcgcgcggatggtttcgatctcagattaaaggcagaagccgaaggccacgccanncgcanngctcgcgtagnagtagntggcgtngccgntgctgtngacanngcagaaatncgnggagtngctgccatncggagagcgaagccagtaccaccatgtaccgntccccggtctctctttcacgcggctgcgctccgtgctgaacagctccagctgtgtctcatctgtgtccgccggtgcccagtcctctgctccttccttaccgaacatctctgtgaacgacggcagccacagcttgtcctcgctctccagtcgttcgccgtccatggtctgcacgatgcggcgcggcacgatcatctcccgcagctcatccggcagcatgcggataatggtttcgttgagccacaggcgcatctcgctgtcccgccagccgcctttgctggtcatgcgcttgttcatcccgtgttcgtccttcatgcagtccttcagcaggaaaatcagcccacgctccgtggttcccacggcctgcaccgtcagctcttcgccggtcttcagcgtgatgtccagctcatctcccacctgcagcagctcctgcagctttccgtccgcctgcgccttcttaatggtgttccactcgatctcgcttgtgatggtctttctgatattcatggggcatcctcctgattatctgtaccgttcatcccacggtacgaagtattttccgcacgccttcttcaggcgctcgtccaccttgccctgcgtgaaccatatctgcttgtcggtctttgcatccgcaaggcacatttccgcataggtcataaaggtctggtcgtagcagtcgctcagcttcttcagccgctcttcgccccagccgaagtcttcgtgcatggtgatgagcatcatgtccttgcactgctgcagcgtaaagcgccgggtcttctcatcccgaacagcctgctgcgccgccagcttctgtaggtatccgctctgctttgccatcgcttatccctccagtgtttccttcagcgccagcagcttttcaatggtgtcctcataggccgcctccagcagcaccgcgcagtctgtcatgccctcgttgccgtatgggcagccccagtgttcctcgctgctgcatacccgcttgccgcaggcatccatcagctccacagtctgccgcgcgtccttcagctccttcagcagcccctgtgccttttgcagcgtctcaggctccagatcgctgcgctcgtattcccgcagcttctcgtagcagcgccgctgatcgcatcgtccatcctcgcagaagctcccgccggggatggaatcgcactgcgcaatgtcgcagaaggaaaggtcggtgtccactgtcagccgtttcatttgccgcacaccgccggtctgctctgcagctctccgccgcaggccgcatagcccgcaaggtctacccagttgtcgctcttgccgtgtcctgtggcaatgcgtgcgatcttcagcagcgccagcagcgccgccacatcctccggcacgatgcaaacctccgccgccgggtctccgacgcatttttctttgatgtaggtctcccacagctccccgatcacacggaagctgtcctccggtgtgccgtagtcttcttctctctgcccgcacacgcagacctccgccgcgtgcagcaattcgcttctcgtcatcattcgtcctccccgtgcagcaccgcgatgtttgccagcacgctggcattcgtccactccanggccaacaggatcgcgctacgctggaactcgcccgccagcgcgcagaatgcgtcgccgttatggtctttcaccgcgctccacatatccttgtgcacgtccttgatggccttcatccggctctccacgttctcgatgttttccttcagctgcgcccatgcctcccggtcactggcaaatccgcgtccgcgttcttccataattccgctcagcagctccgcagaggtcgcctgcatgttgcccatcaacttctgctgtgcgctcagattatccatgctgcacctccgcgatctcccagtcctccgccagcatgtccgtctggcttgccagccacggcacgcagctgcgcggtgcatccggattgttgct

SEQ ID NO: 1452 - DNA, 4000 bp, Escherichia coli
  misc_feature (955)..(955): n is a, c, g, or t
  misc_feature (1079)..(1079): n is a, c, g, or t
  misc_feature (1926)..(1926): n is a, c, g, or t
  misc_feature (1985)..(1985): n is a, c, g, or t
  misc_feature (1992)..(1992): n is a, c, g, or t
  misc_feature (1995)..(1995): n is a, c, g, or t
  misc_feature (2445)..(2445): n is a, c, g, or t
  misc_feature (2521)..(2521): n is a, c, g, or t
  misc_feature (2624)..(2624): n is a, c, g, or t
  misc_feature (2846)..(2846): n is a, c, g, or t
  misc_feature (2849)..(2849): n is a, c, g, or t
  misc_feature (3372)..(3377): n is a, c, g, or t
  misc_feature (3380)..(3380): n is a, c, g, or t
  misc_feature (3384)..(3386): n is a, c, g, or t
  misc_feature (3389)..(3389): n is a, c, g, or t
  misc_feature (3391)..(3391): n is a, c, g, or t
  misc_feature (3393)..(3395): n is a, c, g, or t
  misc_feature (3397)..(3402): n is a, c, g, or t
  misc_feature (3404)..(3404): n is a, c, g, or t
  misc_feature (3406)..(3408): n is a, c, g, or t
  misc_feature (3411)..(3411): n is a, c, g, or t
  misc_feature (3414)..(3414): n is a, c, g, or t
  misc_feature (3416)..(3417): n is a, c, g, or t
  misc_feature (3419)..(3421): n is a, c, g, or t
  misc_feature (3423)..(3423): n is a, c, g, or t
  misc_feature (3425)..(3425): n is a, c, g, or t
  misc_feature (3428)..(3428): n is a, c, g, or t
  misc_feature (3430)..(3432): n is a, c, g, or t
  misc_feature (3435)..(3435): n is a, c, g, or t
  misc_feature (3439)..(3440): n is a, c, g, or t
  misc_feature (3444)..(3445): n is a, c, g, or t
  misc_feature (3447)..(3449): n is a, c, g, or t
  misc_feature (3452)..(3454): n is a, c, g, or t
  misc_feature (3457)..(3457): n is a, c, g, or t
  misc_feature (3459)..(3459): n is a, c, g, or t
  misc_feature (3461)..(3461): n is a, c, g, or t
  misc_feature (3463)..(3466): n is a, c, g, or t
  misc_feature (3468)..(3469): n is a, c, g, or t
  misc_feature (3473)..(3473): n is a, c, g, or t
  misc_feature (3477)..(3477): n is a, c, g, or t
  misc_feature (3481)..(3482): n is a, c, g, or t
  misc_feature (3485)..(3486): n is a, c, g, or t
  misc_feature (3489)..(3489): n is a, c, g, or t
  misc_feature (3491)..(3491): n is a, c, g, or t
  misc_feature (3495)..(3496): n is a, c, g, or t
  misc_feature (3498)..(3498): n is a, c, g, or t
  misc_feature (3500)..(3500): n is a, c, g, or t
  misc_feature (3502)..(3502): n is a, c, g, or t
  misc_feature (3506)..(3507): n is a, c, g, or t
  misc_feature (3510)..(3510): n is a, c, g, or t
  misc_feature (3513)..(3513): n is a, c, g, or t
  misc_feature (3518)..(3525): n is a, c, g, or t
  misc_feature (3529)..(3529): n is a, c, g, or t
  misc_feature (3532)..(3533): n is a, c, g, or t
  misc_feature (3535)..(3535): n is a, c, g, or t
  misc_feature (3538)..(3539): n is a, c, g, or t
  misc_feature (3541)..(3541): n is a, c, g, or t
  misc_feature (3543)..(3544): n is a, c, g, or t
  misc_feature (3547)..(3547): n is a, c, g, or t
  misc_feature (3551)..(3551): n is a, c, g, or t
  misc_feature (3553)..(3553): n is a, c, g, or t
  misc_feature (3555)..(3555): n is a, c, g, or t
  misc_feature (3558)..(3558): n is a, c, g, or t
  misc_feature (3560)..(3560): n is a, c, g, or t
  misc_feature (3563)..(3563): n is a, c, g, or t
  misc_feature (3565)..(3572): n is a, c, g, or t
  misc_feature (3574)..(3574): n is a, c, g, or t
  misc_feature (3577)..(3577): n is a, c, g, or t
  misc_feature (3579)..(3579): n is a, c, g, or t
  misc_feature (3583)..(3583): n is a, c, g, or t
  misc_feature (3585)..(3587): n is a, c, g, or t
  misc_feature (3589)..(3592): n is a, c, g, or t
  misc_feature (3594)..(3595): n is a, c, g, or t
  misc_feature (3597)..(3597): n is a, c, g, or t
  misc_feature (3599)..(3601): n is a, c, g, or t
  misc_feature (3603)..(3603): n is a, c, g, or t
  misc_feature (3605)..(3607): n is a, c, g, or t
  misc_feature (3609)..(3609): n is a, c, g, or t
  misc_feature (3614)..(3614): n is a, c, g, or t
  misc_feature (3619)..(3619): n is a, c, g, or t
  misc_feature (3621)..(3625): n is a, c, g, or t
  misc_feature (3627)..(3633): n is a, c, g, or t
  misc_feature (3636)..(3640): n is a, c, g, or t
  misc_feature (3642)..(3643): n is a, c, g, or t
  misc_feature (3645)..(3647): n is a, c, g, or t
  misc_feature (3649)..(3649): n is a, c, g, or t
  misc_feature (3653)..(3659): n is a, c, g, or t
  misc_feature (3661)..(3661): n is a, c, g, or t
  misc_feature (3663)..(3663): n is a, c, g, or t
  misc_feature (3665)..(3665): n is a, c, g, or t
  misc_feature (3667)..(3667): n is a, c, g, or t
  misc_feature (3672)..(3673): n is a, c, g, or t
  misc_feature (3675)..(3676): n is a, c, g, or t
  misc_feature (3678)..(3679): n is a, c, g, or t
  misc_feature (3681)..(3690): n is a, c, g, or t
  misc_feature (3692)..(3692): n is a, c, g, or t
  misc_feature (3694)..(3695): n is a, c, g, or t
  misc_feature (3698)..(3698): n is a, c, g, or t
  misc_feature (3701)..(3704): n is a, c, g, or t
  misc_feature (3706)..(3706): n is a, c, g, or t
  misc_feature (3708)..(3708): n is a, c, g, or t
  misc_feature (3710)..(3710): n is a, c, g, or t
  misc_feature (3713)..(3713): n is a, c, g, or t
  misc_feature (3715)..(3717): n is a, c, g, or t
  misc_feature (3719)..(3721): n is a, c, g, or t
  misc_feature (3723)..(3723): n is a, c, g, or t
  misc_feature (3728)..(3728): n is a, c, g, or t
  misc_feature (3730)..(3730): n is a, c, g, or t
  misc_feature (3739)..(3743): n is a, c, g, or t
  misc_feature (3745)..(3745): n is a, c, g, or t
  misc_feature (3749)..(3749): n is a, c, g, or t
  misc_feature (3752)..(3752): n is a, c, g, or t
  misc_feature (3755)..(3755): n is a, c, g, or t
  misc_feature (3757)..(3757): n is a, c, g, or t
  misc_feature (3765)..(3765): n is a, c, g, or t
  misc_feature (3767)..(3771): n is a, c, g, or t
  misc_feature (3773)..(3774): n is a, c, g, or t
  misc_feature (3776)..(3778): n is a, c, g, or t
  misc_feature (3780)..(3783): n is a, c, g, or t
  misc_feature (3785)..(3786): n is a, c, g, or t
  misc_feature (3793)..(3796): n is a, c, g, or t
  misc_feature (3798)..(3798): n is a, c, g, or t
  misc_feature (3800)..(3800): n is a, c, g, or t
  misc_feature (3802)..(3802): n is a, c, g, or t
  misc_feature (3806)..(3811): n is a, c, g, or t
  misc_feature (3813)..(3814): n is a, c, g, or t
  misc_feature (3817)..(3817): n is a, c, g, or t
  misc_feature (3819)..(3819): n is a, c, g, or t
  misc_feature (3821)..(3821): n is a, c, g, or t
  misc_feature (3823)..(3825): n is a, c, g, or t
  misc_feature (3827)..(3829): n is a, c, g, or t
  misc_feature (3831)..(3836): n is a, c, g, or t
  misc_feature (3838)..(3838): n is a, c, g, or t
  misc_feature (3840)..(3840): n is a, c, g, or t
  misc_feature (3842)..(3844): n is a, c, g, or t
  misc_feature (3846)..(3846): n is a, c, g, or t
  misc_feature (3848)..(3848): n is a, c, g, or t
  misc_feature (3853)..(3853): n is a, c, g, or t
  misc_feature (3855)..(3858): n is a, c, g, or t
  misc_feature (3860)..(3860): n is a, c, g, or t
  misc_feature (3862)..(3863): n is a, c, g, or t
  misc_feature (3868)..(3870): n is a, c, g, or t
  misc_feature (3872)..(3872): n is a, c, g, or t
  misc_feature (3874)..(3875): n is a, c, g, or t
  misc_feature (3880)..(3881): n is a, c, g, or t
  misc_feature (3884)..(3884): n is a, c, g, or t
  misc_feature (3888)..(3888): n is a, c, g, or t
  misc_feature (3892)..(3892): n is a, c, g, or t
  misc_feature (3894)..(3894): n is a, c, g, or t
  misc_feature (3896)..(3896): n is a, c, g, or t
  misc_feature (3900)..(3900): n is a, c, g, or t
  misc_feature (3902)..(3903): n is a, c, g, or t
  misc_feature (3905)..(3906): n is a, c, g, or t
  misc_feature (3909)..(3909): n is a, c, g, or t
  misc_feature (3912)..(3912): n is a, c, g, or t
  misc_feature (3914)..(3915): n is a, c, g, or t
  misc_feature (3917)..(3917): n is a, c, g, or t
  misc_feature (3919)..(3919): n is a, c, g, or t
  misc_feature (3921)..(3921): n is a, c, g, or t
  misc_feature (3926)..(3927): n is a, c, g, or t
  misc_feature (3929)..(3930): n is a, c, g, or t
  misc_feature (3933)..(3934): n is a, c, g, or t
  misc_feature (3938)..(3939): n is a, c, g, or t
  misc_feature (3944)..(3945): n is a, c, g, or t
  misc_feature (3948)..(3950): n is a, c, g, or t
  misc_feature (3952)..(3954): n is a, c, g, or t
  misc_feature (3958)..(3960): n is a, c, g, or t
  misc_feature (3962)..(3962): n is a, c, g, or t
  misc_feature (3967)..(3967): n is a, c, g, or t
  misc_feature (3969)..(3969): n is a, c, g, or t
  misc_feature (3973)..(3973): n is a, c, g, or t
  misc_feature (3975)..(3975): n is a, c, g, or t
  misc_feature (3977)..(3977): n is a, c, g, or t
  misc_feature (3979)..(3981): n is a, c, g, or t
  misc_feature (3984)..(3984): n is a, c, g, or t
  misc_feature (3988)..(3990): n is a, c, g, or t
  misc_feature (3992)..(3992): n is a, c, g, or t
  misc_feature (3994)..(3995): n is a, c, g, or t
  misc_feature (3997)..(3997): n is a, c, g, or t
  misc_feature (3999)..(3999): n is a, c, g, or t
tcatctcctgctttagaaaacaatctttgaatatgagtaaactgtgatctacaccaagctaaatttttagctgctttaagtttattttttgctttggtaattttattaagttcagtagttgcatacataccagtagactcatgcccaccatcatctgttgtaacatcaacagactcttttttaagccatgtaatatctgcagctatcatgttgtaattagatttagcttcaatcaatcctgagtaatgcacaaagttagaaccatcatctacatgctctgcaaagtgagcctcccataaatttttagtcatgggctgtaatgctaatacaaatcttgcagcacctattaatgatgatgcacctctagcagccatcaacgcattttgattatcaacgataagctctttgtcctgagtcgttaccatgcttaatttattagtatgatgaccagctattattgcaccacccatttttacagctaatggaattaaataatgtttaataaaagcatccatattctggttactattttcatcaaagctaccagtctgataattgattaatggatctaaaaatatgtacttaatattattttcttttatagctaactctagctccttgtattgctgagtagctgctgctgcttctttagtgaattttacaagtttaagttcatgctctaaacctcttttaaaaagtttatacttaccatcattcttaccaagcttttgtgcacaagcagcccatctaatatctgactcattagatgtttcttctccaaataaacctaatacattccctctaacttcaacatccctgccaaaaaaagggttgccggtacagacacaataagcaagcatatgcagcagcattgttttacctacacccggttgtccaactattaaggttaatgcagcctccagcagcatcccaaacatcatccatggtctttttntaattttttctaatccagtatgctcaaatatttctaatggctttaaaggttctgcatcaggtggtggtggagtatctaaaacagtacctgcaggctgctgggattctttttctaataaagattntaaatattcatctttagagatatattctttttgctcagcaactggctcatgcctaactatttctgcaattcttttttgtattgctgcatctccaacagcatattttttatggatatccttatcagtaattctttttttataagctccatcatcccaaccaaccatggctgctataacagcatctaagtgctgcatcatttttttcttttctaaataggaagcaattaataataaagttttatgcctgcccggttctgtaagaccagcagcaattgctattaaagggtaatgttgaaatctatatttaaacttaaattgatcaaaagttagtttatttccttgtggggaataggggtattgtttttcactacaaaaagggaagttaattccagtttgtccactaagtgtaggctgagtcttatctacatcaaccttatttccatacagttcaataaattttttttctattgctagaatatcttttctaacaacagcagtttttaaatctttatgataaaatttccatgcatgccatttaatgccactaggagatctaaaaggaataattaaaggatctattgcataagcagctctacaaaattctacaggatcaacttctttatcaacgtcaactactgcacaattagctacaccattcctatttaaggagccaccttgttttagtgttccttttatatgagcttcccaatcaatctcctgttttttccaatactgattttttttaccatcagatttaaagccattccaaattaaagtattagctgtgttatgtttaaaaatttctgctataattctgggatctacgacagaattggtgtgcgcttcnccactcatttatcttaaactcccttgctggagattattatgtattgtttccataacaanatctgcnggntaaaatattctaccaccaagttttgcaaatttaaaaatagatctattttttgatctttgttttcttaatgcaccctcagtaactccaagcattttagctaggtcttgtgatgtaaataacagcccatctttctctaaaaatttctttagatcttcagctgatatagtttttatttttggtttcattccttttcctcgtgttggtttattagacatgagctctttttatttgagctgtagccttgtgtgaaatcttgtgggtgtcaggatttagagggggctcactagtgattaatagccctgcagccatcatgacaaagcccccaatgctggagtggaaaacaacagcatcttttctttatgctatttctaattaatttggaaatcctgcgagctgctagattgtggaaagttgcctaccaataactataagaacacaggctcttgaccngaggttaaaatagtttttcagtttcatctaacagatgtattaataaagaaacaactgaaactatgaaacaatcganaccctagctgttatttaaccttgtttcagcagcaagcagtgtcggttattgaaacaaggtaataagctatatcccccttgttgtttcacatgaattgaaactntttgaaactatgaaaccactacaagtacacattggtacacattaaattttgaattctttatccttaaaatgaggaacctttttcttaggtctcttttttccaaagtggtctttaaatgctgtaacattatttttaaaggtactaatagtctgaggtacaagatatccagttgcctcacaaaataaacctagctcacttttaaaaccattttttatgcaatcntcntatatcttttgagctccacctttagcatttgaaatagctttcatgagtctagtaactgcaacatgagcatcagggttacctaaaatcattgtggtgttgtaagtatcaaaaccgtatttaacagcatagtctgcaaggtgtgcagcatctactgctggtacattctcattaataaatttttctagatctttaaaagttttaacttttctagcttctaaaaatggatttgtttcaaacccaccaatactaaaattttttatccttgttcttgcgcctatcttttgcgtttttgaaacagataatgttgttgttttcttttttttcttttttgcaggcatcttgctttttccactccttttttagtttatcttctattaaaatccatacaacttcattgttgttattcttcatcgttagctgctttcttcaactgaaccacattatttccaacattataaatacttgtatgagtctttaatgctttttgatcctcggtataataatgctcttttgttactattannnnnntgnggcnnnttntnannnannnnnntncnnnccnttnanntnnncnanaanannncanaaanntttnncnnnggnnnttnantntnnnnanntttntatntttnnaannttncntttnncngnancccnnaanatnttctnnnnnnnnaaanccnntnttnnantnnaantctntnanttngnttntnnnnnnnntnttntnaatntnnngnnnngnntntnnngntnnngnaaaancccanannnnncnnnnnnnatnnnnngnntnnntntttnnnnnnntnanananttttnnanntnncnnnnnnnnnncncnntcnccnnnntnantncanannngnnntnttctntnttttttgtnnnnntnaaanaanttncnttttttcncnnnnnanncnnncnnnnannttttttnnnntntntnaaannnnnngnnttntncnannntnnncnnnnnntntntnnnantntttcncnnnntncnntttgnnntntnnaaaanntanaaangtgngntncccncnntnnctnttntnnangnanttttnnannttnnaaanntttcnnaannntnnnaatnnncnttttntntttncncncnnnatntttnnnantnntnana

SEQ ID NO: 1453 - DNA, 4000 bp, Escherichia coli
  misc_feature (1968)..(1968): n is a, c, g, or t
  misc_feature (1973)..(1973): n is a, c, g, or t
  misc_feature (1978)..(1978): n is a, c, g, or t
  misc_feature (1985)..(1985): n is a, c, g, or t
gataccttaaaggaaagtacaactaaataatgaatataggctgttacagatgctcattggcgcctgtagcagcctatatatgtttttgttatcttctaaagagttaatatcgtagctcttagctaacaataagttgttctcagcttggctacatcttgcaatgtgttaagtgctccgcaccattggtgtttaccctccgcacaataggtgctaagcaccagcacgagatgtgttggatgttaaaagtgttgttgggtatggttgaatagggttttacgggtcgttattcttataataagataagaatatgtagcttgttgggagtatgcttatcggttaatattgataagttctgtaagccagtatttaccgataaaatgtttgtgataccagacttaaagacataaaaaaaggactaccgctgtagtccaacctttgttaaccttaaatctaatactatgaaaaacacgttgcaaagataaagagtattttttatatttgcaacttttccaatgtctttttttatcatatgatgtattattgatttatatcaagtagtttatatgacaaaatgatagtttaatctctaatgaccgattttggttaatggtttcgccagagccgagatagttgaccttaatggttcattacttgtttggcaatagcggatgtaatgtaaagaggatttatataaagaaagttgaatataacctgaaagaaagactaaagtctgaaagaaaagttgaaatatagcttataaaaaagcatttttatccgttaaaactttgttatgtcattttttaagcctatctttgcaaaaaataaaaggattaagacgtttaaggatatgggattccgacattcagtgagattgatgttggaattctatctttttatgtctattgaaaaacgattaatttttaaaacaagatattatggcttatatgtcacaggaaggttacgacaaactcgtagccgatttgcagtatttagaatctgttgaacgtcccaaggcatctgctgctattgccgaagctgccgataagggtgacttgagtgagaattctgagtatgatgctgctaaggaggcacagcgtcatcttgaagcacgtattgctgaattgaagatgaccgtggcacaagcaaagattgttgatgtgtcacgtttgagcactgatgctgtacagattatgtctactgttgagatgacaaacgtaaagacaaatgctaagatgaagtatacgattgttagtgagacagaggctaacctaaagcagaataagatttcaatcaagactcctattgcacaggggttgttgaataagaaggtgggcgatgaggttgaaatcactatccctcgtggtactatcactctgcgcattgataagatctcaattgatgcataacaataaaacaaggaggtttgtatgacaatattcagtaagattgcagcgggtgagattccaagctacaagtgtgcagagaacgaacagttctatgcttttctcgacattgatcctgtaacaaagggacatacacttgttattcctcgtaaggaggttgactacatctttgatatggaagatgaggaacttgcagcctttgaggtttttgcaaagaaggttgcacgtgctataaagacagtcttcccatgtaagaaggtagcacaggtcgtcttgggattagaggttaatcatgcacatatccacctcttgccaatgaacagtgaggctgatgttaatttcaagcatcacgtacaggttgatgctgaggagcagaaggagattgctgcaaagattttcaaggctttccatgaattggattagcaattggcttttctggaataagatattatcaagacggggatatacagtcattgcatatccccgtttatcattttccttaatataaggaagagacgtttaacaaagtaatctcacctttacgcaaacttgctgctcccctccnttggnggggntgggggnggttttctttatacaaactcttctcccttctttatctgtacttcattcacatatttccttaccaatgcagaagaatcttctttcttacagataagtaatacattgtccttttctgcaatgatatagccatcaagtccatttatgacacctaatttccctttggagagctttatgatattattggcagcatcttcaaggataacatccgagtcaatgacaacattgtcgccatctcgcttgcttagagactcataaacaccatgccacgttccaaggtctgcccaaccaaagtcgcacctcatcacataaacattctccgacttctctaagatgccataatctaatgaaatgttaggatagcgtgggaaattatcatgtatgaaagcctcttcatcctctatcgttgttatcttactgcccatttcaccttcacgcaaaacagaagggaggaagccatagagacattgacgaaggtagtttgtgttagagaggaagagtcctgtattccaacaccactccttactatccatgaacatttgtgcaaattctcggtccggcttttcagtaaaggcttgcaccttatatatatcgccattaccagtgtagacgcccttctgaatatatccgtatccaggttctggtcgggtagggctaacacccattgtcagtatagcatcattcttctcaacgaatgataatccttcttttatattacgaaagaaagcatcatcattaacaatgttatgatcagaaggtgatataatgatgttcgctttggaatcaaacatcatgatacgatgcactgcccatgcaacacttggcgcagtgtttctgtggattggttcagccatgatatggtcggctgtcacttcaggcaactgctctctgacaaggtcaagataatcacagctggtattaatataaatgttctcttttggaagaatatttgcaaagcggtcaaatgtttgttgaagctgagtacgacccacaccaaagaagtctataaattgctttggatgcttatctctactgcagggccatagtcttcgtcccttgccaccggcaagaattacgcaatagttgttctgtttcgtagtcattatctatttaagctaaccgaatttgtttctccaaagataccttttataactcatacctccaaatcttttattgtaaaatactgcaaatacacattaatcaaagtaatgtcattaaataattcctcaaaaatttgccaaatccagattttctctctacctttgcacccgttgttcaaacaacagccatgcccagatggcggaataggtagacgcgctggtctcaaacaccagtggggcaacccatcccggttcgagcccgggtctgggtacaataaatcccttgtgaatcgatgatttgcaagggatttttctttgtaggggtacttaaagtgtactttgtgattaatggataaaatcagaactcactcaaacctttattcagaactcactttcatctttaatcatactattaagtttaaaatttatttcctgtcattttaacattgtttgtaaaggctttgataatgaataacttgtgtctcttttggtagtgacagtagtgacaggaaattaaattattgtctacacaaagtgttaagttgctgttaattgaaagagaaaagttgcagaattccaaaagaacaccaacaacttatcttttttcttcgtaactggtgaaaccttcaatacgaatataaatcactttaaggttaacttaagaggtgttgtcgtattttgcttgaaaataattcgatataagagaaaggggacgatagaaaggggagatgacttaaagggaggtgttttctattaaagattgagtcaaggctcattagatgaatttattttttgatttgtaaatgtgctgaagataacttggtagattgtataacgcatttattttcagataattagttttagatataaaactttattctttgttgctaattgacttttcgtctacgatataattaa

SEQ ID NO: 1454 - DNA, 4000 bp, Escherichia coli
  misc_feature (736)..(736): n is a, c, g, or t
  misc_feature (3472)..(3472): n is a, c, g, or t
  misc_feature (3628)..(3628): n is a, c, g, or t
  misc_feature (3730)..(3730): n is a, c, g, or t
tttggtacttcttccagtaaagagtgataaaagttctcttgtacccggctttgcgatttcgttgtggcaagcaattcattgattcggtttagtgaatggctaagtgcattcatttctttatctgccgattgctcgttgaacagtatcatgctctctttatcttccatcgcatccaagaatattcttattttggcattgaatttattcaattgttttaccaaagctctgataaaaaaaagtgaaataatcaagaaaagacagcctagaataagggcggtatgtgtaataataagtgcgataccagctccggctacagcaattattaataagatgtagcttaggataaccatatatagatgtttgctgaataccatgatcatcagagcttaaagcgttttattttattgtaaagtgtctggcggctgatgcctaactgttcggctgttgctgtcagatttccatcgttttgacggatggctgtttctatggcctggcgttctacttcttccagattaggaacggtagtggagaattgtggactccaggtttgttttacgaaaatgtctttggaacggattacatctccttcacataaaataactgctttctcgatggtatgttgcaattcccggatatttcccggccaatgataagaacataatttctctaaagcatgttcatgcaggaagatttcttttttttcgtatttagcagcatagcgctgcataaaataatnaatgaacaaatgtatatcttccctccgttcgcgtaaaggcgggatttccagatgaatagtattcagtctgtacaataaatcctcacggaaagtcccggaatccaccatatcctgaatattcttgttggtagctgaaagcagccggatatccactgggattactttattactgccgatgcgtgtaatttttcggttttgtaatacggtgagcaactttgcctgcatggctaaagggagatttcctatttcatccataaacagggaactgccggatgccgcttcaaactttcccggccggctctcgtaggcatcggtaaaagaaccgcgctcatgcccgaacagttcactttcgaataaagattcactgattgctcccatatctaccgttaccatagaatgttcctttcgtgtggaaagccggtgtatttcctgtgccagcatttcttttcctgttccgttttctccggtaatcaatatattggcatctgtgcgtgccactttcactactatcttcattaactgctgcatggcaggggatgttcccacaatcatcggtgatttgtttctatcggggattctgtttttccttttcttaccgcttccaaaagcatcttttattttgcgcactaaggtccggttatcccaaggtttcaacaaaaaatcagttgcatcattctttaaagcctttactgccagttctacatccccgtatgctgtaagcatgactacgggtagtgcaggagctatctcacggattcgtttcagccaatataacccttcgttgccgttattgattcctgccgagaaattcatatcaagaataatcacatctatcggagaggtatttatgatagatatgatttgattcggatgatgggctgtctttatttcgctgaactccgtttccagtaataattccagtgaggccaatactcctttattatcatctactattaaaatcgttcctttttccatctcatttttgctttcagaggctaaaggtatctgcttttgattgtttctgcaaatgaggcgtccaattattggacgttttttattattttctgtaatgcttttatttatcataacggtgacttgacattggaatgtgtcttcagtccgtgttgtcagcgttccaatatcttccttggttcgttctggttttatagtgtttataatttggacgttataccgtctaaaatttggacagctaatttatattttattttgtaactggttgattattaatgttctgatcttcttggcatatcgtttgcttcctattctgtgtttaaattaaaatgcaatgagaaataacttgataattgtgtgtttgttgtccggtctgtctttgcctgtatgtgggcaaagtacactggacgattgcatacgttatgcttggaaacataatcctggtttcaagaatgtccaaatagacgtaaaggaagcacgaacagactatgtggctgctatgggtaaatttcttccttatgtttcagtacaggcggaagtgggcaggcatatcggacgttctgtcgatccggatactaatggatatacagccgattcatataatcaaggaactataggaatggatataactctttctttattcgaaggatttgcccggatcaatcgtttgcgatatacgcattggactaaaaaagagaaggagtgggatcatctggcaaagaaaaatgatttggcttatcgggtagctgaggcttattataaagcggtattggataaaaagctttcagaactggcagctgaacagcttcgtttgggagaacgttatctgaaacagacggaagcttttgtagaactggggttgaaatcgctttcggacttgcaggaagtaaaagcgcgtcatcaaggagatgtgttcagagagcgtatgtatgaaaaaaatcgtcagatgtcctttctttatttaaaggaaatactgggtatgaaagagggcgatgttttgtctgtttctttatcagtcagtgaggatacgctcttgttaatgcctcaagtagaggtagaagaagtctatttacggtccgtacacgtactgccggattataaacggatggaaatgtgggaacgcgctgcccgtaaggagtatgctgtgacccttggacagttcagcccgactatcttcgcccgtttctcatggggatctgatttttataattccttgttctcgttacatcaattgcgtgaccattggaataaatatataggagtaggtatttcattccctattcttagcggattagatcggaatgccggaataaggaagaagaaattaaacttgcaacgggtgcggaacagcatagaggaagagaagttacatttacgtaatgaaacggaacgaattgtactttcattacattcgggatgggaagagcatcgacaggcttccctgcaggtaaaagcagaaacgcaagtgctgaaagaaacggaacggaagtgggaggaagggcttgtttccgtgtttcagttgatggaagcacgaaatcgcctgcttgtcgctaaagcggaaaaaataagagtgcgtttgcagtacgaactgacatcgcgactaactatgtattatcggacaggaagttttattaaccattaaaaaatatggacacactaattgaacgtaaaaagcgtttcactcccaggcggatttatggaggtgcgggagtattattcatattggtattcgttttttattttatttttcgtgataccggttcntccatgaccattgacaagagccgtatcactatcgctacagttacagaaaatgagtttaatgattatgtccgtgtgattggacaagtacttcccagccgcatgatttacctcgatgctatagaaggcggaagagtggaggaacgccttcatgaaganggagcgatggtaaagaaaggggatgtgattctgcgcctgagtaatcctctgctgaatatcggtatcatgcaaagtgaagcagatctggcctatcaggaaaangagttgcgtaatactcgtataagtatggagcaggaacggttgagtctgaagcaggatcgtatcggtattcagaaagaattcattataaagaaacgtcgttacggacaatacaagcggctgatggaggggcaattgatagcgagggaggactatctccaagctacggaggaatatgaagcggtaaaagaacaattgtcggtattggatgagcggatccgtcaagatagtttgtttcgtttgactcagataagcagtttggacgagaatata

SEQ ID NO: 1455 - DNA, 4000 bp, Escherichia coli
  misc_feature (428)..(428): n is a, c, g, or t
  misc_feature (1082)..(1082): n is a, c, g, or t
  misc_feature (2528)..(2528): n is a, c, g, or t
  misc_feature (2531)..(2531): n is a, c, g, or t
  misc_feature (2540)..(2540): n is a, c, g, or t
  misc_feature (2617)..(2617): n is a, c, g, or t
  misc_feature (2636)..(2636): n is a, c, g, or t
  misc_feature (2639)..(2639): n is a, c, g, or t
  misc_feature (2657)..(2657): n is a, c, g, or t
  misc_feature (2666)..(2666): n is a, c, g, or t
  misc_feature (2668)..(2668): n is a, c, g, or t
  misc_feature (2671)..(2671): n is a, c, g, or t
  misc_feature (2699)..(2699): n is a, c, g, or t
  misc_feature (2705)..(2705): n is a, c, g, or t
  misc_feature (2720)..(2720): n is a, c, g, or t
  misc_feature (2753)..(2753): n is a, c, g, or t
  misc_feature (2765)..(2765): n is a, c, g, or t
  misc_feature (2767)..(2767): n is a, c, g, or t
  misc_feature (2783)..(2783): n is a, c, g, or t
  misc_feature (2789)..(2789): n is a, c, g, or t
  misc_feature (2807)..(2807): n is a, c, g, or t
  misc_feature (2816)..(2816): n is a, c, g, or t
  misc_feature (2944)..(2949): n is a, c, g, or t
  misc_feature (2956)..(2956): n is a, c, g, or t
  misc_feature (2958)..(2968): n is a, c, g, or t
  misc_feature (2973)..(2974): n is a, c, g, or t
  misc_feature (2977)..(2978): n is a, c, g, or t
  misc_feature (2983)..(2983): n is a, c, g, or t
  misc_feature (2988)..(2991): n is a, c, g, or t
  misc_feature (2994)..(3001): n is a, c, g, or t
  misc_feature (3004)..(3005): n is a, c, g, or t
  misc_feature (3011)..(3012): n is a, c, g, or t
  misc_feature (3015)..(3015): n is a, c, g, or t
  misc_feature (3020)..(3021): n is a, c, g, or t
  misc_feature (3024)..(3025): n is a, c, g, or t
  misc_feature (3032)..(3036): n is a, c, g, or t
  misc_feature (3039)..(3039): n is a, c, g, or t
  misc_feature (3044)..(3044): n is a, c, g, or t
  misc_feature (3049)..(3049): n is a, c, g, or t
  misc_feature (3052)..(3058): n is a, c, g, or t
  misc_feature (3060)..(3061): n is a, c, g, or t
  misc_feature (3063)..(3068): n is a, c, g, or t
  misc_feature (3071)..(3074): n is a, c, g, or t
  misc_feature (3086)..(3086): n is a, c, g, or t
  misc_feature (3088)..(3088): n is a, c, g, or t
  misc_feature (3092)..(3092): n is a, c, g, or t
  misc_feature (3095)..(3095): n is a, c, g, or t
  misc_feature (3104)..(3104): n is a, c, g, or t
  misc_feature (3125)..(3125): n is a, c, g, or t
  misc_feature (3128)..(3128): n is a, c, g, or t
  misc_feature (3134)..(3134): n is a, c, g, or t
  misc_feature (3140)..(3140): n is a, c, g, or t
  misc_feature (3161)..(3161): n is a, c, g, or t
  misc_feature (3167)..(3167): n is a, c, g, or t
  misc_feature (3185)..(3185): n is a, c, g, or t
  misc_feature (3194)..(3195): n is a, c, g, or t
  misc_feature (3199)..(3200): n is a, c, g, or t
  misc_feature (3205)..(3205): n is a, c, g, or t
  misc_feature (3207)..(3207): n is a, c, g, or t
  misc_feature (3212)..(3212): n is a, c, g, or t
  misc_feature (3216)..(3216): n is a, c, g, or t
  misc_feature (3221)..(3221): n is a, c, g, or t
  misc_feature (3225)..(3225): n is a, c, g, or t
  misc_feature (3227)..(3228): n is a, c, g, or t
  misc_feature (3231)..(3231): n is a, c, g, or t
  misc_feature (3234)..(3234): n is a, c, g, or t
  misc_feature (3238)..(3239): n is a, c, g, or t
  misc_feature (3245)..(3246): n is a, c, g, or t
  misc_feature (3259)..(3259): n is a, c, g, or t
  misc_feature (3263)..(3263): n is a, c, g, or t
  misc_feature (3268)..(3269): n is a, c, g, or t
  misc_feature (3271)..(3273): n is a, c, g, or t
  misc_feature (3277)..(3278): n is a, c, g, or t
  misc_feature (3284)..(3285): n is a, c, g, or t
  misc_feature (3289)..(3289): n is a, c, g, or t
  misc_feature (3299)..(3300): n is a, c, g, or t
  misc_feature (3302)..(3302): n is a, c, g, or t
  misc_feature (3305)..(3306): n is a, c, g, or t
  misc_feature (3308)..(3310): n is a, c, g, or t
  misc_feature (3314)..(3314): n is a, c, g, or t
  misc_feature (3316)..(3322): n is a, c, g, or t
  misc_feature (3325)..(3325): n is a, c, g, or t
  misc_feature (3330)..(3333): n is a, c, g, or t
  misc_feature (3341)..(3341): n is a, c, g, or t
  misc_feature (3346)..(3347): n is a, c, g, or t
  misc_feature (3350)..(3352): n is a, c, g, or t
  misc_feature (3356)..(3361): n is a, c, g, or t
  misc_feature (3364)..(3367): n is a, c, g, or t
  misc_feature (3370)..(3371): n is a, c, g, or t
  misc_feature (3374)..(3375): n is a, c, g, or t
  misc_feature (3383)..(3386): n is a, c, g, or t
  misc_feature (3389)..(3389): n is a, c, g, or t
  misc_feature (3393)..(3397): n is a, c, g, or t
  misc_feature (3400)..(3400): n is a, c, g, or t
  misc_feature (3404)..(3404): n is a, c, g, or t
  misc_feature (3407)..(3408): n is a, c, g, or t
  misc_feature (3411)..(3413): n is a, c, g, or t
  misc_feature (3419)..(3421): n is a, c, g, or t
  misc_feature (3424)..(3427): n is a, c, g, or t
  misc_feature (3430)..(3430): n is a, c, g, or t
  misc_feature (3432)..(3432): n is a, c, g, or t
  misc_feature (3434)..(3434): n is a, c, g, or t
  misc_feature (3436)..(3436): n is a, c, g, or t
  misc_feature (3439)..(3441): n is a, c, g, or t
  misc_feature (3447)..(3447): n is a, c, g, or t
  misc_feature (3450)..(3451): n is a, c, g, or t
  misc_feature (3454)..(3454): n is a, c, g, or t
  misc_feature (3458)..(3463): n is a, c, g, or t
  misc_feature (3467)..(3477): n is a, c, g, or t
  misc_feature (3481)..(3482): n is a, c, g, or t
  misc_feature (3485)..(3485): n is a, c, g, or t
  misc_feature (3488)..(3489): n is a, c, g, or t
  misc_feature (3493)..(3493): n is a, c, g, or t
  misc_feature (3498)..(3499): n is a, c, g, or t
  misc_feature (3502)..(3505): n is a, c, g, or t
  misc_feature (3508)..(3509): n is a, c, g, or t
  misc_feature (3515)..(3522): n is a, c, g, or t
  misc_feature (3525)..(3526): n is a, c, g, or t
  misc_feature (3529)..(3529): n is a, c, g, or t
  misc_feature (3535)..(3541): n is a, c, g, or t
  misc_feature (3544)..(3545): n is a, c, g, or t
  misc_feature (3551)..(3552): n is a, c, g, or t
  misc_feature (3555)..(3555): n is a, c, g, or t
  misc_feature (3559)..(3562): n is a, c, g, or t
  misc_feature (3568)..(3568): n is a, c, g, or t
  misc_feature (3571)..(3571): n is a, c, g, or t
  misc_feature (3577)..(3580): n is a, c, g, or t
  misc_feature (3583)..(3590): n is a, c, g, or t
  misc_feature (3595)..(3596): n is a, c, g, or t
  misc_feature (3599)..(3605): n is a, c, g, or t
  misc_feature (3608)..(3609): n is a, c, g, or t
  misc_feature (3615)..(3625): n is a, c, g, or t
  misc_feature (3629)..(3629): n is a, c, g, or t
  misc_feature (3634)..(3636): n is a, c, g, or t
  misc_feature (3639)..(3642): n is a, c, g, or t
  misc_feature (3652)..(3655): n is a, c, g, or t
  misc_feature (3658)..(3658): n is a, c, g, or t
  misc_feature (3661)..(3667): n is a, c, g, or t
  misc_feature (3670)..(3670): n is a, c, g, or t
  misc_feature (3673)..(3674): n is a, c, g, or t
  misc_feature (3677)..(3677): n is a, c, g, or t
  misc_feature (3684)..(3690): n is a, c, g, or t
  misc_feature (3695)..(3699): n is a, c, g, or t
  misc_feature (3703)..(3705): n is a, c, g, or t
  misc_feature (3708)..(3708): n is a, c, g, or t
  misc_feature (3713)..(3713): n is a, c, g, or t
  misc_feature (3716)..(3716): n is a, c, g, or t
  misc_feature (3719)..(3727): n is a, c, g, or t
  misc_feature (3730)..(3734): n is a, c, g, or t
  misc_feature (3737)..(3738): n is a, c, g, or t
  misc_feature (3741)..(3743): n is a, c, g, or t
  misc_feature (3745)..(3749): n is a, c, g, or t
  misc_feature (3755)..(3758): n is a, c, g, or t
  misc_feature (3762)..(3764): n is a, c, g, or t
  misc_feature (3771)..(3772): n is a, c, g, or t
  misc_feature (3775)..(3776): n is a, c, g, or t
  misc_feature (3782)..(3786): n is a, c, g, or t
  misc_feature (3789)..(3794): n is a, c, g, or t
  misc_feature (3796)..(3797): n is a, c, g, or t
  misc_feature (3799)..(3806): n is a, c, g, or t
  misc_feature (3810)..(3817): n is a, c, g, or t
  misc_feature (3820)..(3820): n is a, c, g, or t
  misc_feature (3824)..(3824): n is a, c, g, or t
  misc_feature (3827)..(3828): n is a, c, g, or t
  misc_feature (3831)..(3833): n is a, c, g, or t
  misc_feature (3839)..(3839): n is a, c, g, or t
  misc_feature (3844)..(3844): n is a, c, g, or t
  misc_feature (3847)..(3852): n is a, c, g, or t
  misc_feature (3856)..(3857): n is a, c, g, or t
  misc_feature (3864)..(3867): n is a, c, g, or t
  misc_feature (3872)..(3877): n is a, c, g, or t
  misc_feature (3883)..(3885): n is a, c, g, or t
  misc_feature (3889)..(3898): n is a, c, g, or t
  misc_feature (3902)..(3906): n is a, c, g, or t
  misc_feature (3911)..(3918): n is a, c, g, or t
  misc_feature (3921)..(3921): n is a, c, g, or t
  misc_feature (3923)..(3930): n is a, c, g, or t
  misc_feature (3937)..(3938): n is a, c, g, or t
  misc_feature (3941)..(3943): n is a, c, g, or t
  misc_feature (3948)..(3949): n is a, c, g, or t
  misc_feature (3952)..(3956): n is a, c, g, or t
  misc_feature (3961)..(3963): n is a, c, g, or t
  misc_feature (3971)..(3971): n is a, c, g, or t
  misc_feature (3979)..(3979): n is a, c, g, or t
  misc_feature (3984)..(3985): n is a, c, g, or t
  misc_feature (3988)..(3996): n is a, c, g, or t
  misc_feature (4000)..(4000): n is a, c, g, or t
atcatgcgaccttgccttttgtgctggcgctggctgagcaaggggtgataggcgccttaaaaagcgatcggcatcttcgaaatggtcttgccacctaccaaggtcagttgacgtcaaaagcggttgccgaggcgcatcaattgtcttttgagcggccccaggggcttggattcgagtaacccaagcccctgggttgaaaatcgggcgactcggcgacaggatttcaggccaacgagtgacataaggcgcctgccacaaccgctccttagacaaacgcgcgtgacttggctataaacaaagtctcatccaatcaattggagcgcgccatgcccttatctgaattaaccaccatgacactgagccttgaggaacacgtggcggtcgtgactatttgccgaccggatgcacgcaatgctttgaatcgcctngcttacgccgagttagaagcggtttttcgggcgttgcaggccgacgaacaagtccgctgcattatcctgacgggtacggatccagccttttgctcgggcgatgatgtcaaggaactgatgacaggcgatgccagcgcgtcacatgccagattgcgtgccgtacgaccaggcattacgcctgccgccgccgccattttggactgtgatcgaccgattatcgccgccgttaatggcgcggcggtgggttggggtatggacctggcgctcatggcagatttcagaatcgcctcagataaagcgaaattcggagagctatttgtaaaacggggattggtctcggatgtcggcggactcacccgactcccgcatttggtcgggccgcaaaaagcggcagagttgttgtatacaggggacattattgatgcgcaggaggcgatgaaaattggcttgttgttagcgtgtgagcctcatgatggcttgctggctgcggcccataacttggcgcgaaaaatcgcggacaatccaccgctagcggtgcgctacttgaaggaaggcttgcgccggagcttttatggcgattatcacgacatggggtcctgggtttctcaaacgttaggggtgctcttccaaacggaagatcatcgcgaaggggtngcgagtttcttggaaaagcggcctgccaaatttaaagggcgctagcgtgttgcaggggctttgcagcgccgggcagtctgtagtcaacataaggatttgcaaaataagggtttgcaaaaaaagcgcctctgaatagcgccgccttcaaatgaaaagtcgggtgtaatggattaagtcgccagcgcaacactcggcaatcgttaggatctttctgctgcgtcacgaattccagaacccttgctgtctctagcaaggttgataacgtgcttttgggaatgcgcgcttttgtcgcaatatcgtgactgctcaagcagaacttgggtcggttaaaaagggatcgccatagaaccatatccgcgcgatggtattgccctgatagcttaccttcaaagggtaaatgcatcaggctatattgactcacggtgctgaacagagggtctcttactcgaaagccaaagcggtcatcggtttcggtaaacggcgcgtctgacgcgatgagaatgttgcgaatcttctcgatctggtgcgttgttggcagcagttgatcgccaacaacccgataggttccgcagcgcaggaaataagcgagcaaacgatcaatcagttttgggtcgataggaagcgtgtttttgatgtcgatgaccgtcagggactggctcttctcgaaccagtacaacatcaaaagctctttgatcacaatgccgggcaggctgcgtttggtcgttttttgaccgagatttagattcaggaaaaaccgtataaagtcatcgaattgcgtcgagtcaaaagcaggcgagccttgcgccttggatgctaacaagggcgttgccaggggatcctgatttgagcgtattgcgccttcgtgctctagcatcatattaaccttctgaaggagttaaggttctcctaaccctatctaaaaatcacgcggttggctaccgaaattgaacggttccaacgccgttcgaggttggcggcgatttaatgggatcaagtcatcggaaaagcctacaaggcgcctccgaagtccttggtttggccgcgtacggttactttgacgcggctgctgaatgaaacaattaagcggaaggcagaagctgtctcgggcgacagcctcatcggactccgactgaattcaacgcaaggatgagttcatcttgagtggcgtacaaggtcttgtcattgggtttgtatgacagcaggctgggctggcgcaatggcctgaatcattggctctagtggggctattgaaatgccgctcgggcggtcacgaccgcatagaatctactcaaattgggtagatcaaaaaagtcttggccaacatttttggcaaaccccatcacaatcgcgagcgtcatatcgggaatcgcatagcggtcccctaacaggaactgattattcgcgaggtgcgcgtccagcaacaccgcggtatctctggcagcaagngcngagacctcnccccattctttgacgcaggtttcccggtctttgtaataaccggtaaggttacgaaaaccttgtgcaaccggcatcanaaaattgagatccactcgncgngcccacatttcaatcttngcgcgctcnantgnggattcaccgaacaaattgggcgctggntagagnccttctaaatacagncagatcgcctggctttccgataggaaggtgccntcgtccagttcnantaccggtacgcgcccnaatggntttttgcgccggtattcntctgtcagnttttccccggcccttaaatcgatttcggttgtcggaatgtcgatacctttctctttcatgaaaatggcaacgcgtttgccgttgggcgaagcgctcattgtgtaaaggtgcatgggattaaccttttnnnnnngggtttnannnnnnnnnnnttttnnttnnggggnaattnnnnggnnnnnnnnaanngggttnnccnaaaannggnnaaggccnnnnnggnccggnaaagnttnnnnnnngnntnnnnnnccnnnnttctaatccggngngganagnaaatcgagngcaatcgcctcagcgactttnatnccatcnatcccngcggacaaaatgccgccggcntagccngcgccttcaccggcaggntataagccnntggnnttgangntttgntaanccttnccgngnnggnttnaaannggggannaggttcgggtttnaacnccggnnannngggnntccttnntggnaaagcctttnncntgnngnnngaangnnnnnnnggnttccnnnngggcctcnttggnnaannngggnnnnnnttnnnnaannttnnccaatttnnnnccngggnnnnnggngggnttnnccnnncccaannnggnnnnggncngntnggnnnggaaanccnnaangcgnnnnnngggnnnnnnnnnnncccnnccnccnngttnaaaannggnnnnttnnaatttnnnnnnnnggnnaancccggnnnnnnnggnnccgggnnaancccnnnngggttnaancccaannnnaannnnnnnnttggnnttnnnnnnnttnngggaannnnnnnnnnncccnttggnnnccnnnnggccgggttnnnnggnggnnnnnnnaanggnnccncccgggnnnnnnnaaaannnnnaaannnttnggccnttnttnnnnnnnnnaannnnnttnnaannngnnnnncccaannnngggnnnccctttnnttnnccaaannnnnccnnnnnnannannnnnnnngggnnnnnnnnccnaaanccnnttnnnaagggnttggnttnnnnnnaaannttttccnnnnccaannnnnnaaaggnnncccnnnnnnnnnncccnnnnnccaannnnnnnnggngnnnnnnnngggtttnnccnnnggccnnggnnnnnccggnnntttggccngggttttnggccnnggnnnnnnnnngggn

SEQ ID NO: 1456 - DNA, 4000 bp, Escherichia coli
  misc_feature (333)..(333): n is a, c, g, or t
  misc_feature (728)..(728): n is a, c, g, or t
  misc_feature (1986)..(1986): n is a, c, g, or t
  misc_feature (2540)..(2540): n is a, c, g, or t
  misc_feature (2723)..(2723): n is a, c, g, or t
  misc_feature (2750)..(2750): n is a, c, g, or t
ataggcgtaatattttttatccctttgtatttgggttttggagttgggctttcggggtcttcaattttcaggtaatgggaggagaggaagaggttgctgcataaaacggcccctgtgataaagagcatatgaaacggtggacttaactgttgttgaatgattagactaccaattccggcccctaaaaatccacctaaactaaaaaaaccatgtgccgctgacatcaaattttgtttgtcgcgctgctcaatgatcgatactacagcattcatcgatatatctgtaaagccagaaaaaacaccaattaaaaataaacttccgcaaagggaggtntaattgggggccagtaggggcaagttaaaagccagtgttaataagacaatccctacttgtgtagaacgtccttctttaatttttttattcaaaaaaggaacaacaggaatagacagaagtaaacccaaagcagaaaaaaaaagtgccgtgcccagctctgcttcattgagcactaattttgatttgacataaggcaagtacaacacccatgtgcccaccataatattcattgacgcaaagacccatgaaggcgcaaaatagtgcaaacgggtaaggataagccctaatgatttcatctaaataaaaatagaaaaaagatttactttttgcctaaatcaccttctttaactcaaaacaaaattggggggcattgggagaaattaagcttcactatnaggggtaaaaataacgagaaaatggaagttaatgataagattttcggaaaaagtaaagcattatcaattgccatttgagtatatttagtctattctgaataaaaattagagtgatgcatatgcggattggaatattgggccccataccaagggatacgatcactacccatagaggagaaaaaataaaaaaatatggaggagttatccaccctactataggactgagtaaattactcggagaagaagacgccctcgttcctgttgctcatatcaataagacagatgaagaacccattttaaatttgctcagtaattattcgaatattgaaaccacacatatttcctccaaagacgatgaaggctctatcgtagaattggtttttataaaccagaacgatagaatagaaacccaggcaggagccatgaaacccattgtttcagaagaccttagtgggatagactgttctgttcttgtatgtgtacccatcaccgattacgaaatccctttaaaaactttaaaacaaattaaatcctcctcagaagtattggtaatttttgatgcccacggaccgaccacacaggttgacaataaggggaatcgcttacgcgtccattggcttgacatgatggattggcttccttatatcgatgtgctgaaaatgaatttagaagagtcacagtattgttattttttgcctggtgaaattcaagactatgacgtaaacagaagagaccatctggatgcttttgccgaacaggtacttaaagcgggtgtgaaacacctttatataaccctggacagtgagggctgtaattggtatacaaaagttaaaggaaaaacaagcacagtttttattcctgcctatcctgtagaccatgtagtggatactacaggatgtggcgattcttttgcgggaggcttagcctatggttttggacgtcattcggacccttacctcgccgctcaatatgccaatatacttggagccatgcgtacccaaggaaaaacatttgaagtctttaaagaccttcaaactactgagcaaatgatagcgcgtttctatggctcagaaaacaaaaaaaactaaaattcaaatcagcggacctcttcattaagtaggggccttgaaaggattttattttgtagcgaatggggaagtgctgaagcgtttttcctacttcctagagataaaaaatctctagtagccttctttaactaaagaaaaacaaggttttaaaattttaaaagttaattttnccgcagattccaaaagattgaaaaacaacatgattagacaaaaccaggaacgcgtggttctttctaatatccagcctcaacttgaagaggggaattatgctgtcaagcgcattgtggggcagcagcttctcgtaactgcagacatactgtgtgacgggcatgacttcttagccgcagcattgttgtacaaacacgaatcccaacgtaattggacaagcgtaaggatgaaaccgctcgaaaacgacagtatgcaagctgcatttacagcaacaaaacaagggagctatttttataaaatagaaggatgggtagatgagcctttaaattggttatacggtatagaaaagaaaatagaagccgatcttaatgttacttctgaactccttgagggagcggtttacctaagggaaatagtgaaaaacaaggatacaaaagaaggaacaaagtggcacaaactcattcaactcctagaagatgaaaagtcctatcaaaaagccgttgaagcagtaaaggatcccgaacttaagtccttgtttacaagtcatccttcgaantttttaaaggctacctctaaagaattcccgttgtatgtagaccgtaaaaaagccctttttagtacctggtatgaattttttccacgctcagcagggacagcacccggtacgcatggaacatttaaagattgtgaaaaactgttgccccgaattgccaaaatggaattcgatacgctttatttnccccctattcaacccataggggaggtnaataggaagggaaaaaacaatgcgactgatgcaggggaaggggatgtgggatccccttggggaattggttcacaatatggaggccacaaagaccttcatcctgaattgggcaccttatccgattttaaggcattagtaaaaaaagcaaaccaactgggtattgaaatagcaatggattttgccctgcaagccgcacccgatcacccatgggtaaaagctcatccagcgtggtttaaatggcgccccgatggtagtattcagtatgctgaaaatccccctaaaaaataccaagatatactacccctttatttcgaaaccagtgattggaaaaacctttgggatgagttgttgtcctgtgcgctctattgggtagaggaagtaggaattaaaatttttagagtagacaacccgcacactaaaccttttaagttttggaattggttgattgctcaggtaaagaaaaaacacccagatgtcctctttttagcagaagcatttacgcgccctaaaattatggatcagctggcaaaagaggggtttactcagggttattcttattttacttggcgcttttctaagcaggaactcactgaatacatggaacaacttaccaagggacctcaaaaagaattttaccgacccaacttctggcccaataccccagacatcaatccctatcatttacaaggagccaatgaagcccaacacctgattcgttattttttagcggccactctcagctccaatgtaggtatttatggacctgtttttgaaatgatgcattctgaagccgtccccggaaaagaggaataccacaacagtgaaaaatacgaattcaaacagtgggattgggaagcagaaaataaaattatggttctgattaaaaaaattaatgaggcgcgaaaaatattaccttctcttcagcagaccaatcaaattgaattttgtgaaatccataacgacaagctgatagggtatctaaaaaaagacgagaataattcttgctatactttaatgattgtctctctcgattcctattatacccaagagggcagtgtaaaaattcccctttcacaaataggattgaatccgcaagccaactttactgtaacggatgtcataacaggaaatcaatatcaatggggacccgactggaattatgtcaaaatacatccctcattgccttttcatttgtttaaactttcaatctgatgcaagacaagcttaaaaaagactttcaaaaaagaccc

SEQ ID NO: 1457 - DNA, 4000 bp, Escherichia coli
  misc_feature (742)..(742): n is a, c, g, or t
  misc_feature (1595)..(1595): n is a, c, g, or t
  misc_feature (1613)..(1613): n is a, c, g, or t
  misc_feature (1985)..(1985): n is a, c, g, or t
  misc_feature (3042)..(3042): n is a, c, g, or t
aaaaatattacaatcaaattttattgctccaatagcatttaaaattggactaactctttatgatttcttgggtcaacgcaaaaaagatcaaagacatactttgatttcaaaagaagatacatttggtttatttcctaaactcaaaaaaaacaaattaacaaaaagtttcattttccaagatgcccaaaccgaagatgcaaaattagtactcacattgttgagaaatgccgtagaaataaataatgcaactgcactaaattatgtaaaaataaccgacattattagaactggtgacaggtataaagttctgttaatcgacgagataaataataaagagtatacggtcgagtccaagaagataattgctgccacaggtattcataatttaccaggaatgtacaagagtaaatcttccaaaattaaactaagtggaggagcacatttaattttagagggagaccccctagggattggtaaaaatggtgttctattacctcaaactgaagacaatagagtcatgtttgtcttaccctggacaggaaatacaatcgttggtacaactgatacagaagaattttcaggctctttagatagaccgtatgcaaactctgaagacaaagcctatttaataaggcacataaaaaaatactttaatatcgaagaagttaaatatatttcttcctggactggtttgagagctttaatagacagctctgatacaaattctaagaatatttctagnggacatttctataaagatatagatgaaaactttatacaaatttcaggaggtaagcttacaggttttagagttattgcaaaagaaagtcttgaacaactcttttctcaaaattttgagttaaacaagcaagagtttgttgacagtatcttaaatcttgaaagtcagtataagtataaggatttacagctatgccttaatcactactgtgttgttaaacctacagattatttactcagaagaactcgtatcagctggtttaaccaaaatggaggaaaatcttttttggataaagtaatggtcaattttgactcaactttatatttcgaagagacaattgaagaactgcaagatgagggtttgctttagatttagaacaatttttttagtttttattaataacagtttttaacgatactctgtcgtcattaagaaaccagcaccgatcataccaaggcctccccataaataccatctagatacagagccaggaagaagagttaggtagttcaagactattaagagaacacctaaaaccattaaagaggtcatagttacaacaaaccaccttggcgatggtcctttatctccactaagctgcgtagatatttttttagatttagttggttgagagttgttaattcttttttttgaaactggcatattgaaaattgtatcctaattatcgtttattacaataactttatttctagaaatactaattaaaccatccttcattagtgattcaacgacctcttctgtaactttgctggtcatctctaattctttactaagaagtgccatagtcacacctttttctaatagaagaatttttaaaacacgtcctcttttttgnctcatggatccttcaaanttttttgatgttttaatttcttgaacaatatattttttacacgaaagctcaagtggacaaatttcacatttaggatttcgagaagtacaaagcgttgatccaagatccattaagccttgattaaagtctctagaattaaaattctttaaaagtaagtcagtgtttttctctagaaaaatatcaacattatcagttctgaaaaatcttttaataattctttttatattggtatcaactgcaataatttttttctcatatgcaaagctgagaattgctgaatttgtgtatggtcctacaccaggaagaattgtaaagtctggatatagttcatcaaaactatattttgatagtatttttgaagactcgtgaagncggatagctctattgttgtaacccaatcctgaccataattttaaaacctcttttttactgtcttttgccatatctttaggtgttgggtattttctaataaattttttataaaattcatctgctctatctatttgagtttgctgagaaagcgtttcaattagaagtatcttccatggattacttgagtctctccattcaaaagatctacgattttttttataccaatttttgagttcttttttaaaaaaatttatattagttgtcaaagcttaattctacaaaaccttcaggatctaaaaagcttccttcttctggattttgacctgaaaccctaccgccggtgtcaccacttgccgaaggcaataatccaatttcttgaagaatattagatgcctcctggtacgtataaccaattaagtttggaacctctgcttttaaacccaatgaaacaattattgaaattatttcctccggagtaactatttcacctgcccctgggatggtgtgagaaactagtccttcgttaacgtcttcagaatattcttctaatatttcatattcaaaaccaagtgtttctaaaatttgtgtcgcatcctcaggagattttcttgagagatcacttatttcaattaagcttggcccagatgatattactaaatctacagttgatccaggactcatttttttcccagcaataggattttgggaaatcacgaatcctctaggaatattatcatcatttacttccagtttctgacctacaacaaaatcactttcttcaattacatacaccgctctatccgtttcaaggtctattacatacggaataggaaaagcttcttgtccaacagagacaataattgttaccaatgtatcaggattcgttacagtatttgctaaaggttgagttcttatgactgccccagctggaactgtaggatgtgctgaattctcaattcctactgtgaatccaagtaattgtaagtcattcaaagcctgagtctgactacttcccgttagatcaggtatctctattactgtgggagtaccaccatcnacaggaagtccagtaaatatttgtgtgagaccccatacagttccaaacacaagcccaattgacaggactagagctggtagagtaaatctaaattttattttaggatttgttaagttaacaagattttcttgagtttcttgcatttgtagatgtcttctttgctgtagtaggacggctctaagatcctctgcatttttatacctatctttggggtatttatgtaacagctttaatacagcattctctaaacccttaggtatatcttttctatagacacttaatttctttggtttttcagtaaggtgtttggttgcagtcgcaatgggggtttctccttcgaatggtggtctcccagcaataagttcatacataacagtacctagagaatataaatcagactcaacagaaaccggttttccttgggcctgttcgggagaaatgtaacttgctgttcctaaaatagatccagttttagtaatatcactatcctcattttgaatagacacaattccaaaatcagttacttttacttttccagaaggggtaatcatgatgttacccggtttaatatctctatgtacaagacctctattatgggcagcttgtagtccatcagagacttgtgcaccaataaacaaaatatcaccaatgctgattgtcttctttttagcgattattgaagttagagtgttcccttcaatatactccattacaaaaaatggctcatcctcaattccccaatcaaatatttgaacaatatttgggtgatttagattagcaaccgtttgagcctctcttttaaacctttctacgaatgtctcttgttgaacatagtttggtttaagagttttaattgcaaccatccgtttaagttgcctatcctcagctttataaacaaaggccatcccaccctcaccaaggagttcaagaattttatatcgatcttttattatttgtc

SEQ ID NO: 1458 - DNA, 4000 bp, Escherichia coli
  misc_feature (26)..(26): n is a, c, g, or t
  misc_feature (38)..(38): n is a, c, g, or t
  misc_feature (383)..(383): n is a, c, g, or t
  misc_feature (438)..(438): n is a, c, g, or t
  misc_feature (449)..(449): n is a, c, g, or t
  misc_feature (1222)..(1222): n is a, c, g, or t
  misc_feature (1285)..(1285): n is a, c, g, or t
  misc_feature (1984)..(1986): n is a, c, g, or t
  misc_feature (1992)..(1992): n is a, c, g, or t
  misc_feature (2011)..(2011): n is a, c, g, or t
  misc_feature (2025)..(2025): n is a, c, g, or t
  misc_feature (3162)..(3163): n is a, c, g, or t
  misc_feature (3295)..(3295): n is a, c, g, or t
cattcctatttattatggcagttggngtattaatcgtngcagcagttgtattcgtagaacaggcacaacgacgtattccagttcagtatgcaaagcgtcaagtaggacgtcagcaatacggtggaactagcacctatattccaatcaaggtaaaccaatctggtgttatcccggtaatttttgcttcctcacttttgtatataccttctttgatcgttaacttcagcggcagccaagctggctgggcgacttgggtttcaaagaacttagttaatggcgataacttcttctatatcggtgtttatgcattattaattgttttcttcacctacttctatgttgcaatcacatttaatccagatgaggtttctgacaacatgaancagtacggtggctttattccaggaattagagctggtaagccaacctctgattacntgcaatatgtnttatcaagaattactgcgcccggtgcgctttatctttcaattgttgccatcattccatttattgcattaattttgttccaggcttcacaaaacttcccatttggtggaactgctattttgatcgttgttggtgttggtctagatactgccaagcagattgaatctcaactacaacaacgttcttatgaggggttcttgcgctaatgcgattaatcctggttggaccaccaggtgctggtaaaggaacacaagcagttcatctagctgctcattacaaaattccacatatctccaccggtgatattttccgtgctaatttaaaaaatggcaccgaacttggtaaacaagcacaaactttcatggatcgtggggagttagtcccagattctgtgaccaatgaaatggttagagatcgacttggaaataatgatgttgccaatggctttttattagatggctttcctcgtaataccaatcaagcgcaagttctagatcaaatcttggtagaaaagaagatgccattggatgctgtactggaattaaaaattgataatgctgaaattgttaaacgattatctggccgtcgcacctgtcgtggctgtggtgcttcatcccatgttgagtttgaaaagccaaaggtggcaggagtttgtgataaatgccaaggtgagctttatcaacgtgaggatgacaaggaagaggttgttactcgccggcttgaaatctataccgatcaaactgcgccaattgttgagttttataattcaaccggnctattaaaaattatttcagcccttggtgatgtcgctgagattaccaaaaaagctatctcaacnttaggttagtaaatatggctattgaggttaaagatctatcgcatttaaagttgatgcgaaaagcaggattagtagttgctgatactttgaaattacttaagcaatctgcccaaattggcatgacaactttggagttagatgagatcgcagcaaataatttagctaaacatggcgcaacatcatcctttttgggttatcacggatttccagctgttatctgtgcttcagtaaatgaagaggtagtgcatggaattccaaataaaagaaaactagtatctggtgatattttatctattgattttggcgccatagttgatggctggcatggtgatgctgcgatctcatttggtttaggtgaaattgatctggctaatcaaaagctaatggatgtttgccaagagtcaatgtggcgaggaattgcagcaggtaaaaaaggcgcaaagctaactgatatttcagctgcaattgaaggttacataaattcacaaggcaaatatggaattttgcgtgagtatggtggccatggaattggcagtgcgatgcatcaagagccacatattctaaattttggcccagctggtaatggacctgagttagtagttggtatggcacttgcaattgaaccaatgattaccagaggtaatgagcgcactaaagttttaagtgatgattggacagttgtctcacatgattcatcannnggtgcncattttgaacatacctacncaatcactcccganggcaaaatctttgttttaaccgccgaagatggtggaaaagagcagctagccagattgggtgttgaagtctcagatttgctctagctgggcccagattttcccgcatagatttgaagcactttgagcggatttttcttttttcctcaccccgcctaaactatccctcctgcctcgcaaggggtaaacctaatttagaacagataagtaggtatcgcttggccaagaaagacggtgcaattgaaatcgaaggcactgttgctgaagcactaccgaatgcaatgttccgagttgagttaacaaatggacacaaagttttagcacatatcagtggaaagatgcgacagaactacattcgtattttgccagaagataaagtgatcgtagaacttagtccgtatgacctcaccagaggtcgaattatttatcgttacaaataaataatttttaatctttaagttgttagaaaggtaatcgtgaaggtcaaacctagcgtgaaaaagatttgcgacaagtgcaaagtcattcgtcgtaatggtcgcgtaatggtgatctgcgaaaacctacgtcataaacaacgtcagggttaaataaaaaaacgcgtgatgtaacttaattagggtcaaacttaattaagaccctcagtccgaaaggctgaggccaggtaagaaattatctggaggcattgcgaaggacctttcggataaaagaaacaggttagcgatatggcacgtcttgttggtgtcgatcttccccgcgaaaagcgtgttgaggtcgcacttacctatattttcggaatgggtcttacccgtgcgcaggcaacacttgctgccaccggtatctcaccagatatccgcgttaaagatttacaagagccagatttggcaaagcttcgtgagtttattgaagcaaattacaaaattgagggtgaccttcgtcgtgaggtcgctggcgacatccgtcgcaaagttgaaattcaaagctaccaaggatcacgtcaccgcaagggattgccagtccgcggacaacgtactcacaccaacgctcgtactcgtaagggtccacgtgttgcaatcgctggtaagaagaaggagaccaagtaatggccgccgagaagactaaaccagcaaaggaagcagnnaaggctgcacctaagaaaattaaagcacgtaagaaggataagaaaaatgttgccttcggtcatgcttacatcaagagcacattcaacaacaccattgtttcaattaccgatccagcaggtggtgtaattgcntggtcatcatctggtcaagttggatttaaaggttctcgtaaatcaactccatttgctgcacaaatggcagctgaggctgctgctcgtaaagcacaagagcatggtttaaagaaggttgatgtatttgttaagggacctggttcaggccgggaaactgcaattcgttcattacaagcagcaggtcttgaggttggagccatcgcagatgtaactccagcacctcataacggttgccgtccacgtaaaccacgtcgagtataaggaaagggagaaaactatggctcgctataccggtgcagattgcaaaagatgccgtcgcgaaaaagtaaagctcttccttaagggctctaaatgtgatggaccaaagtgtccaattgagtcacgtccatatccaccaggacaacatggtcgcgctcgctcaaaggattctgagtacttactacagatgcgtgagaagcaaaagtgcgcacgtatttacggaattctagaacgtcagttccgtggttactacgaagaggctaaccgtctgcaaggtaagactggtgaaaatcttttggtactacttgaaactcgtttagacaacgtagttttccgcgctggctttgcaaagagccgtgacatggcacgtcagttagttcgccacggtcacttcttagtaaatggcaagagcgtaaatattccatcatttcgcgtaacaccaatgga

SEQ ID NO: 1459 - DNA, 4000 bp, Escherichia coli
  misc_feature (2000)..(2000): n is a, c, g, or t
agaagcctttcaaggcatcaccaccgaacaagaagagaatcaatactaccacgaatacagtggctgaagtaatgatggtacgagataaggtattattgatcgccaagttgatcaagcgagtgtctgaacgctcacctttgttgttggtcaagaattcacgaatacggtcaaatacaattaccgtatcgttgattgagtaacccaacaaggtcaacaatgccgcaatcaaatgttggtcaaaatccgttgggaaaggaacaacaccatccaagatggcaaacatcgacaacacaaccaaaacgtcgtgaatcaatgcaattgtagcacccataccataagccacactgcggaaacggaagacaatgtataagaagataccaaccacagtaagaattaccaaaaaggcactcttatcgcgggtactggttgcaatcgctgcacctactttggatgtagacaatactggatcttctccggtcatctcaaaacctttcaaagcatccaatacatcagcgcgaacagaatctctcgctgcttgtccttctgcatcaatcatgtaagtagttactattctgaactgacccttgcttccgaaagttttcacttcgttgctagactctttcaaattgttatccaaagccgtcttaatggcttcagtttgatagtttttgtcagcatcgaactgaatcacataagaatgcccacccttgaagtcaataccggtactaattccacccttcataacgaaggcagcgatacccgcaacgataaccaaagctgaaatcatgtagtactttttacggttacccacgaagtcaatatttgaattcttcatgaaacctttgttccaaggagcatcaaatttgatttccaaccctttgtcggcacgacggtctaacaacaaacgagtgataaacaatgctgtgaacattgaactgaaaataccaatcacaaggatcactgcgaaaccgtaagctggtcctgcaccggcgaaggtcaaaatgaaacctgccaacaatgtggtaatgtttgaatcgatgatggcactcaacgcatgcttgaaaccatcggcaattgcagtcttcaaactcttaccaatttccaattcgtctttaatacgctcataaatcagtacgttggcatctaccgccatacctactgtcaagataataccagccataccaggcaaggtcaatgccgcacccaaactagccaatacacccataatcaagaatacgttacccaaaacggcaacaattgccatccaacctgcacggctgtagtaaagaatcataaataatatggtggcgataaaaccaaacagcaaagaattcaaaccattgttgatagactcttgtcccaaagaagctcctacttgctcactggcaacaatcttggcaggcgcaggcaatttaccggctttcaacacgttcgccaagtcattggcttcacggatatcaaagtttccggtgatctgactgttaccaccgctaattttctggttaactacaggggctgaataaacacgatcatccaacacaacggcaatgtatttacctatgttacgacctgtcacttgagcccactgggtacccgctttggcggtcatttccatcgatacttccaattcacctgttggtgaagtatttacacgggcatcagaaatgatgttctcttcttctgcagacaacgctgcatttccatcgcgatctaatttcaagaaatacacgaaatattcgtcagaatttgccgcttctttaccatcagcttcataatcacggggcttggcactaaaggccaatttcgcactctccaaacgcaatactgctgcgtaacgctcgtcttccatcattttggtcaacatcgcacgatctgctttctttaccacagcaactgccgaacctggtccgtcattgccgaatgaacgcaatatcttcgccaaaggacttccattggcttcgtcttttttatcttttttatctttggtgttcgtgctcgcnacttttggactatccacagcaacggggccgtcagcagttgttgttgcaggagccacagcaggcgcagtatttgcaacgacaggagcaacagatgaatcaatgacagtgctatcaacctcttctgcttttggtgccaaaggagccaatttgctcgccttgtacaatgcattcaaaatgcgacttccatctctgcgctggccatcattgccatacacttcgtaaaattccaatttcgcactcttttcaaccaattcttccatacgacgggggttgtctacaccaggcaattcaacgctgatacgaccgccgtcaattttttggatggtaggctgggtaacgtttgattggttgatacgtttttcaaccacttcatatacacgatccacagcgctgctggtttcagctctcaagaagttcactacttctgcttcactgctattggattgaattgtgcttttatttcctttgatgaacaagttggccaaattgcggttggggttgttctttttgaaatttgctacgaaggcatcaacgaaatcagaacctttatcgcgaacatccgcattggcttgctcaatcgcacgggccaaatctttgtctttggtatcgttcgacaacacgcgaacaacggcacctttatccacttcaaggattacgttcataccaccacgcaaatccaaaccgaggtttacttcgcgctgcttacattcgaaataagtgtagcccgccaagcccacgctgtaaatttcttcattaccgaggctgtcgatgtaacggcgataggcctctttggagtcgcctcctttatcggcaactttggcagcaaacgccttagcttctttttcgaatccttgggctttccaagtaaacgacaattggaacacacaggctagcgccagtacaatcgaaaatcctacgatggttttattggttttcatcactatctataactatgcaaaaataagaaccgcgaaaataagcaaaaaataacagttaactaccttcctatgagaaggcttgcaatttttgcaacaataatttgatttctgtcgctgaataatcgttcatgcagcgaaaatgccctttcggacagccatcaaaacccagttttgtgcaggggtggcatgataaattttggggcagtaaatgcagcaccttttcgttgtttttgccggccgcgaaccccaatcccggatgcgtgtttccccaaatgaccaacaatggtttcccataggccgctgccacatggctaaaacccgtatctccgccaaccaccatatttgattgagcgatgcaccgcgcagaagtaggcaaatcaaacacccccacccgatcaattaactgatcaccaaattgttgcaacaaacaaccggccaactccttttcatcgttcccaccaattaacacccattttcgagcatcacctagaaacaccttttcccaaaccacttgcggaattttcttggttgcataagtaccacccaatatagccacaccgtaaccatcgcccagtcccaaatccacggtttctgttccaccctgagcatctagcccttctgattcttcgagtgattcgtaactgggcaacccaccccggaaatcatccaatgcaatcatggataattttttatgctgcgtttcttgctgcttgccattctcacgtgaaaaccacttggacaaacccacaggattctcttcactgagcgtccgaagcaactcattcgcagcctccaagtaacgctcttgtacgtgcgaaacatgaaaccgcgaagatttcgtctttacaaacaaccaccgttgaaatcgttttttgtcatacgaggcagcaggccaatccaaatgaaaggctcgggtagcatcgaagtacaacagctgagacaatgtattcagcgagcgccaattcttgtgcaaatccaaaatgccatcgtatttttctgctttcaacttttcccaaagccccggttctccccacgtataaaatttgtcaaccgcatcaccat

SEQ ID NO: 1460 - DNA, 4000 bp, Escherichia coli
  misc_feature (1929)..(1929): n is a, c, g, or t
  misc_feature (1940)..(1941): n is a, c, g, or t
  misc_feature (1967)..(1967): n is a, c, g, or t
  misc_feature (1971)..(1971): n is a, c, g, or t
  misc_feature (1976)..(1976): n is a, c, g, or t
  misc_feature (1983)..(1983): n is a, c, g, or t
  misc_feature (1985)..(1986): n is a, c, g, or t
  misc_feature (2002)..(2002): n is a, c, g, or t
agaagagactgcgttaacagaagaactggaagcagtttttgacatgggtgaaaaagggtttgttgccacagaagaaattatccagcaagtaatggatttacgtgaatgtgacgaagatgaagcaaaacgcttcgtagctttgggagtacatttaggatgtacattcggtgatttgaatgatacatttgaagaatgttcctatggtgaacaactatactgtgcaaatggtattgattattatattggcacagaagatgaactgaccaatatagctagtgatagagtacataatgatgatgaatacgcgtatttatggcgtgaagctgtggcggctcaaagaactaccgattcgttgagtgattggttgaattcaatcataagtgaggatggttggtgctcggtacttaattcttgggatggacggtatgaagaatataagattgctgaggaatatatttgtgtttgtaggtcataaattgtcatggaatacatgcttgttacggacaaggtgaaatcagtggcaataaacgatgattaatatgggacataaaaagacgattgattattggagacacccaaccaaaagggaaatcaagttcggtgagggagctattcattggttaacagtggatattgaaaaagttcagaagccagacggaagtttgaagaaatggtttattcatacagacggactaaggtacaatcgaccatagttaaagtgatgtctgtaaagcaaaggctgttctaacaaaatagagcagccttttgtgttaaacaatggttaaagtggacaactattcacaccatataaaacaataaaatctattcacattaaaacagtaataaatatgccattgaaaattgagaatatcaagttggcaggaaccaagtttgatggtcgcgctaagttgtccccagaacaacgtcaggctattcaaattttggcccgtgaaggatatagccaaagaaggttggctgctatgttcaatgttagcaagcggcttatacaatctatactatctcctcctgttcgcaagcactctaaacaatatccaacagaatattggacagagttaaaacggaagtgtcgaaaaaagaaaattgatttatataaaaatggaaagatcaagtttaataacaagctgaaaaataaatgaaacgcaagcgtatcaagtatgtagctaacattgattttggctatcgttcaattactgatgcaaagcaatatataaaaatattcttgaaatcgcttctttcgcaaatagggttacaactaggaatagactatatcgtaacagctaatcatttgcgaattagacatgtgaaaaatattacaggaaaaataactaccacacttaaagagatattcccagtattcaatttttattggaagactccaagactattggtgtggttctagaatcaatattaataataatttacaagtatggaaaagcattctatttcggttttaggagccgacaagaaacagtatgaaatcgcagatttcagagcaagaggtatgaattatactaatgctattggcattatcgtaacaacagaatttatgagccgtattttggcgtttgacacctggcaagaacgatggggaaacaccgatagggtcttgactgaagaacagaatgaatccgttgccatgcaaactttctccggtttggacctaaccaaacgtattgtagaaggacaggctggtattgacggaatgactgctgccaaacgttgttggaactatcaaaaaggtggcttccagtggtatttgccttgtttgatggagctaggagttctttgcgcatatcgtgatgagataaacaaagcaatgaaagaaattggatgtcccgatgaatgtttacttcctacagaagattctgatgaaacttgggtttggagtagcagtgagaacagtcagtncaacagctggnncgtgtactttagtaatggcaacttcnacancagcngcaagtncnncagtggcatggtgagngcggttgcagcatttcagccttcgccgagcctgttgacaggcgaggcaaaaagtaacgattgtctgcatagtgacgaagctcttataaacatgttacgtgaacgtggttataaaggcgaattgactaagaccttgactatttaatattatcgccacccatatttgatatggtatgggtggcaaaatattctttaacagcatggaaacatttgaaaagattatagaacaatacacacaaagcgaagtgtgtatgggagaattgttagctaatatttcggcagatggcatgtctattgaagacgcttttgaattgtatataaaagctatgaattatgctgaaaaagatgaattttatcaattagctgacagagaagtgaaattattaacagctaagaatgaagatgacaaacagccattaaaacaactgttagattcgctaagcatatcttgatataattgaatatgaataaatactattttgtaaatataggtgcggaggtaatatggcatcctgtaaatagtgacgagaagaaagttatgcaagtgtgcacctctgctcctcatccggttgaaaatgacacattagtttctctaattttttctgataaaaaggggaacgtaaaagtaaaggccgtcgaattaactccaaaattgactgacttcaatcaagggtactggtgtgcacttcaagatgcagtaagtaatggtgcctctgatacggttattcaggaaatgctacgcagtgccggatttacatactgggaatgttactggcatatacaaaattctgattttcagtcagaaaaaatatggtcgattattcgtggaatgttttgccaaaatccagattatattgattggaatggtgctgattatccaataaaaacggtagtaatctttgaaaatactcctgatgaagaaaaggtgactgtatctatcgagcgattagcgcgacaattattagatgatatgggtaattggagtacacgagaagcagaatctgtagatgaacagatttatttctatctggatgaagagacctttaacatgcctgatgaagatattgtagaatacttgaaaaaacaatgaaattactttatatagatttattttgtggtgccggtggaaccagcacaggggtagaaaaagcccgtttagagaacgaacaatgcgctaaggtaatagcatgtgtaaatcatgataaaaatgcgattgcaagtcatgctgctaatcatccggacgctcttcattttacagaagatattcgtacactaaatttatctcctttagtttcccacctacaaaaatgcagagctgaatatcctgaagcattgatagttttatgggcttcgttggaatgtactaacttctcgaaggctaaaggtggtcaaccacgagatgcagatagtagaacacttgcagagcacttgtttcggtatattgaggctattaacccagactatattcaaattgagaatgtagaagagtttatgtcatggggagatttggatgagtatggtaaacccattagtcgtgataaaggtaaatcttatttgagatggttggataacgtaaggtcttatggctacaaatttgaatataaaatattaaattcagcagactatggagcttacacttccaggaagagatttttcggaatatttgcgaaagggagtttacctattgtttttccggagcaaacccattctaaaaagccagaccaaaaattaaagaactggaaggcagtacgagatgtgttagactttgatgatgaaggaaaaagtatttttggtcgcaaaacacctttagtagattcttctttattaagaatttatgcaggacttattaagtttgtagcaggtggaaaagatgccttcatggttaagtataactcaatgagtaaagctggaaagtacaatgctccgggagttgatgatccatgtccagtaatatctactcaaaatcgacttggggttgcttgcataaatcgtttaaata

SEQ ID NO: 1461 - DNA, 4000 bp, Escherichia coli
  misc_feature (142)..(142): n is a, c, g, or t
  misc_feature (145)..(146): n is a, c, g, or t
  misc_feature (148)..(148): n is a, c, g, or t
  misc_feature (150)..(151): n is a, c, g, or t
  misc_feature (154)..(154): n is a, c, g, or t
  misc_feature (156)..(156): n is a, c, g, or t
  misc_feature (158)..(159): n is a, c, g, or t
  misc_feature (161)..(161): n is a, c, g, or t
  misc_feature (164)..(164): n is a, c, g, or t
  misc_feature (166)..(167): n is a, c, g, or t
  misc_feature (172)..(172): n is a, c, g, or t
  misc_feature (174)..(174): n is a, c, g, or t
  misc_feature (177)..(177): n is a, c, g, or t
  misc_feature (180)..(181): n is a, c, g, or t
  misc_feature (183)..(188): n is a, c, g, or t
  misc_feature (191)..(195): n is a, c, g, or t
  misc_feature (198)..(201): n is a, c, g, or t
  misc_feature (205)..(206): n is a, c, g, or t
  misc_feature (208)..(208): n is a, c, g, or t
  misc_feature (210)..(210): n is a, c, g, or t
  misc_feature (213)..(218): n is a, c, g, or t
  misc_feature (220)..(221): n is a, c, g, or t
  misc_feature (223)..(223): n is a, c, g, or t
  misc_feature (227)..(227): n is a, c, g, or t
  misc_feature (232)..(233): n is a, c, g, or t
  misc_feature (235)..(236): n is a, c, g, or t
  misc_feature (238)..(240): n is a, c, g, or t
  misc_feature (242)..(242): n is a, c, g, or t
  misc_feature (245)..(245): n is a, c, g, or t
  misc_feature (248)..(248): n is a, c, g, or t
  misc_feature (251)..(251): n is a, c, g, or t
  misc_feature (258)..(258): n is a, c, g, or t
  misc_feature (261)..(261): n is a, c, g, or t
  misc_feature (266)..(266): n is a, c, g, or t
  misc_feature (268)..(268): n is a, c, g, or t
  misc_feature (270)..(270): n is a, c, g, or t
  misc_feature (278)..(282): n is a, c, g, or t
  misc_feature (285)..(285): n is a, c, g, or t
  misc_feature (289)..(296): n is a, c, g, or t
  misc_feature (300)..(300): n is a, c, g, or t
  misc_feature (326)..(326): n is a, c, g, or t
  misc_feature (395)..(395): n is a, c, g, or t
  misc_feature (2066)..(2066): n is a, c, g, or t
  misc_feature (2726)..(2726): n is a, c, g, or t
  misc_feature (2729)..(2729): n is a, c, g, or t
  misc_feature (2733)..(2733): n is a, c, g, or t
  misc_feature (2735)..(2735): n is a, c, g, or t
  misc_feature (2771)..(2771): n is a, c, g, or t
  misc_feature (2786)..(2786): n is a, c, g, or t
  misc_feature (2801)..(2801): n is a, c, g, or t
  misc_feature (2816)..(2816): n is a, c, g, or t
  misc_feature (2825)..(2825): n is a, c, g, or t
  misc_feature (2834)..(2834): n is a, c, g, or t
  misc_feature (2854)..(2854): n is a, c, g, or t
  misc_feature (2867)..(2867): n is a, c, g, or t
  misc_feature (2883)..(2883): n is a, c, g, or t
  misc_feature (2897)..(2897): n is a, c, g, or t
  misc_feature (2903)..(2903): n is a, c, g, or t
  misc_feature (2912)..(2912): n is a, c, g, or t
  misc_feature (2942)..(2942): n is a, c, g, or t
  misc_feature (2990)..(2990): n is a, c, g, or t
  misc_feature (2993)..(2993): n is a, c, g, or t
  misc_feature (3011)..(3011): n is a, c, g, or t
  misc_feature (3030)..(3030): n is a, c, g, or t
  misc_feature (3041)..(3042): n is a, c, g, or t
  misc_feature (3044)..(3046): n is a, c, g, or t
  misc_feature (3050)..(3053): n is a, c, g, or t
  misc_feature (3057)..(3058): n is a, c, g, or t
  misc_feature (3062)..(3063): n is a, c, g, or t
  misc_feature (3067)..(3069): n is a, c, g, or t
  misc_feature (3071)..(3071): n is a, c, g, or t
  misc_feature (3073)..(3074): n is a, c, g, or t
  misc_feature (3076)..(3076): n is a, c, g, or t
  misc_feature (3078)..(3079): n is a, c, g, or t
  misc_feature (3081)..(3084): n is a, c, g, or t
  misc_feature (3088)..(3088): n is a, c, g, or t
  misc_feature (3092)..(3092): n is a, c, g, or t
  misc_feature (3097)..(3098): n is a, c, g, or t
  misc_feature (3102)..(3111): n is a, c, g, or t
  misc_feature (3113)..(3113): n is a, c, g, or t
  misc_feature (3115)..(3122): n is a, c, g, or t
  misc_feature (3124)..(3125): n is a, c, g, or t
  misc_feature (3127)..(3127): n is a, c, g, or t
  misc_feature (3129)..(3130): n is a, c, g, or t
  misc_feature (3132)..(3132): n is a, c, g, or t
  misc_feature (3134)..(3134): n is a, c, g, or t
  misc_feature (3136)..(3136): n is a, c, g, or t
  misc_feature (3139)..(3139): n is a, c, g, or t
  misc_feature (3142)..(3146): n is a, c, g, or t
  misc_feature (3148)..(3148): n is a, c, g, or t
  misc_feature (3150)..(3150): n is a, c, g, or t
  misc_feature (3152)..(3153): n is a, c, g, or t
  misc_feature (3155)..(3155): n is a, c, g, or t
  misc_feature (3158)..(3162): n is a, c, g, or t
  misc_feature (3164)..(3164): n is a, c, g, or t
  misc_feature (3168)..(3170): n is a, c, g, or t
  misc_feature (3172)..(3172): n is a, c, g, or t
  misc_feature (3174)..(3174): n is a, c, g, or t
  misc_feature (3176)..(3179): n is a, c, g, or t
  misc_feature (3181)..(3181): n is a, c, g, or t
  misc_feature (3184)..(3186): n is a, c, g, or t
  misc_feature (3188)..(3191): n is a, c, g, or t
  misc_feature (3195)..(3196): n is a, c, g, or t
  misc_feature (3198)..(3199): n is a, c, g, or t
  misc_feature (3202)..(3202): n is a, c, g, or t
  misc_feature (3207)..(3207): n is a, c, g, or t
  misc_feature (3209)..(3209): n is a, c, g, or t
  misc_feature (3213)..(3213): n is a, c, g, or t
  misc_feature (3215)..(3215): n is a, c, g, or t
  misc_feature (3218)..(3219): n is a, c, g, or t
  misc_feature (3221)..(3222): n is a, c, g, or t
  misc_feature (3224)..(3224): n is a, c, g, or t
  misc_feature (3230)..(3231): n is a, c, g, or t
  misc_feature (3234)..(3234): n is a, c, g, or t
  misc_feature (3237)..(3238): n is a, c, g, or t
  misc_feature (3242)..(3244): n is a, c, g, or t
  misc_feature (3246)..(3247): n is a, c, g, or t
  misc_feature (3249)..(3250): n is a, c, g, or t
  misc_feature (3252)..(3252): n is a, c, g, or t
  misc_feature (3256)..(3256): n is a, c, g, or t
  misc_feature (3258)..(3258): n is a, c, g, or t
  misc_feature (3261)..(3263): n is a, c, g, or t
  misc_feature (3270)..(3270): n is a, c, g, or t
  misc_feature (3273)..(3274): n is a, c, g, or t
  misc_feature (3279)..(3279): n is a, c, g, or t
  misc_feature (3281)..(3281): n is a, c, g, or t
  misc_feature (3289)..(3289): n is a, c, g, or t
  misc_feature (3299)..(3299): n is a, c, g, or t
  misc_feature (3303)..(3303): n is a, c, g, or t
  misc_feature (3307)..(3307): n is a, c, g, or t
  misc_feature (3310)..(3311): n is a, c, g, or t
  misc_feature (3313)..(3314): n is a, c, g, or t
  misc_feature (3318)..(3319): n is a, c, g, or t
  misc_feature (3328)..(3330): n is a, c, g, or t
  misc_feature (3332)..(3333): n is a, c, g, or t
  misc_feature (3335)..(3335): n is a, c, g, or t
  misc_feature (3340)..(3340): n is a, c, g, or t
  misc_feature (3344)..(3344): n is a, c, g, or t
  misc_feature (3346)..(3346): n is a, c, g, or t
  misc_feature (3348)..(3348): n is a, c, g, or t
  misc_feature (3351)..(3351): n is a, c, g, or t
  misc_feature (3353)..(3353): n is a, c, g, or t
  misc_feature (3359)..(3359): n is a, c, g, or t
  misc_feature (3364)..(3364): n is a, c, g, or t
  misc_feature (3366)..(3366): n is a, c, g, or t
  misc_feature (3368)..(3368): n is a, c, g, or t
  misc_feature (3374)..(3374): n is a, c, g, or t
  misc_feature (3379)..(3380): n is a, c, g, or t
  misc_feature (3382)..(3382): n is a, c, g, or t
  misc_feature (3385)..(3386): n is a, c, g, or t
  misc_feature (3388)..(3388): n is a, c, g, or t
  misc_feature (3390)..(3391): n is a, c, g, or t
  misc_feature (3393)..(3394): n is a, c, g, or t
  misc_feature (3399)..(3399): n is a, c, g, or t
  misc_feature (3401)..(3402): n is a, c, g, or t
  misc_feature (3404)..(3405): n is a, c, g, or t
  misc_feature (3407)..(3409): n is a, c, g, or t
  misc_feature (3411)..(3411): n is a, c, g, or t
  misc_feature (3413)..(3415): n is a, c, g, or t
  misc_feature (3417)..(3419): n is a, c, g, or t
  misc_feature (3425)..(3427): n is a, c, g, or t
  misc_feature (3429)..(3430): n is a, c, g, or t
  misc_feature (3435)..(3436): n is a, c, g, or t
  misc_feature (3438)..(3438): n is a, c, g, or t
  misc_feature (3442)..(3443): n is a, c, g, or t
  misc_feature (3445)..(3445): n is a, c, g, or t
  misc_feature (3448)..(3448): n is a, c, g, or t
  misc_feature (3453)..(3453): n is a, c, g, or t
  misc_feature (3457)..(3457): n is a, c, g, or t
  misc_feature (3469)..(3469): n is a, c, g, or t
  misc_feature (3472)..(3473): n is a, c, g, or t
  misc_feature (3476)..(3476): n is a, c, g, or t
  misc_feature (3482)..(3483): n is a, c, g, or t
  misc_feature (3487)..(3488): n is a, c, g, or t
  misc_feature (3490)..(3490): n is a, c, g, or t
  misc_feature (3492)..(3492): n is a, c, g, or t
  misc_feature (3495)..(3495): n is a, c, g, or t
  misc_feature (3497)..(3498): n is a, c, g, or t
  misc_feature (3500)..(3500): n is a, c, g, or t
  misc_feature (3505)..(3507): n is a, c, g, or t
  misc_feature (3509)..(3509): n is a, c, g, or t
  misc_feature (3511)..(3511): n is a, c, g, or t
  misc_feature (3515)..(3515): n is a, c, g, or t
  misc_feature (3519)..(3519): n is a, c, g, or t
  misc_feature (3521)..(3522): n is a, c, g, or t
  misc_feature (3528)..(3528): n is a, c, g, or t
  misc_feature (3534)..(3534): n is a, c, g, or t
  misc_feature (3536)..(3536): n is a, c, g, or t
  misc_feature (3538)..(3538): n is a, c, g, or t
  misc_feature (3541)..(3541): n is a, c, g, or t
  misc_feature (3548)..(3548): n is a, c, g, or t
  misc_feature (3551)..(3551): n is a, c, g, or t
  misc_feature (3556)..(3556): n is a, c, g, or t
  misc_feature (3558)..(3564): n is a, c, g, or t
  misc_feature (3568)..(3568): n is a, c, g, or t
  misc_feature (3570)..(3570): n is a, c, g, or t
  misc_feature (3572)..(3574): n is a, c, g, or t
  misc_feature (3576)..(3576): n is a, c, g, or t
  misc_feature (3578)..(3580): n is a, c, g, or t
  misc_feature (3584)..(3585): n is a, c, g, or t
  misc_feature (3590)..(3590): n is a, c, g, or t
  misc_feature (3607)..(3607): n is a, c, g, or t
  misc_feature (3610)..(3616): n is a, c, g, or t
  misc_feature (3620)..(3620): n is a, c, g, or t
  misc_feature (3622)..(3623): n is a, c, g, or t
  misc_feature (3632)..(3633): n is a, c, g, or t
  misc_feature (3636)..(3637): n is a, c, g, or t
  misc_feature (3642)..(3642): n is a, c, g, or t
  misc_feature (3647)..(3647): n is a, c, g, or t
  misc_feature (3649)..(3650): n is a, c, g, or t
  misc_feature (3652)..(3652): n is a, c, g, or t
  misc_feature (3660)..(3660): n is a, c, g, or t
  misc_feature (3662)..(3663): n is a, c, g, or t
  misc_feature (3667)..(3671): n is a, c, g, or t
  misc_feature (3675)..(3675): n is a, c, g, or t
  misc_feature (3678)..(3678): n is a, c, g, or t
  misc_feature (3681)..(3681): n is a, c, g, or t
  misc_feature (3684)..(3685): n is a, c, g, or t
  misc_feature (3688)..(3688): n is a, c, g, or t
  misc_feature (3694)..(3696): n is a, c, g, or t
  misc_feature (3700)..(3700): n is a, c, g, or t
  misc_feature (3705)..(3708): n is a, c, g, or t
  misc_feature (3710)..(3710): n is a, c, g, or t
  misc_feature (3716)..(3716): n is a, c, g, or t
  misc_feature (3722)..(3723): n is a, c, g, or t
  misc_feature (3726)..(3728): n is a, c, g, or t
  misc_feature (3731)..(3731): n is a, c, g, or t
  misc_feature (3734)..(3735): n is a, c, g, or t
  misc_feature (3737)..(3743): n is a, c, g, or t
  misc_feature (3747)..(3749): n is a, c, g, or t
  misc_feature (3753)..(3753): n is a, c, g, or t
  misc_feature (3755)..(3755): n is a, c, g, or t
  misc_feature (3757)..(3758): n is a, c, g, or t
  misc_feature (3760)..(3760): n is a, c, g, or t
  misc_feature (3764)..(3764): n is a, c, g, or t
  misc_feature (3766)..(3766): n is a, c, g, or t
  misc_feature (3768)..(3768): n is a, c, g, or t
  misc_feature (3774)..(3777): n is a, c, g, or t
  misc_feature (3780)..(3786): n is a, c, g, or t
  misc_feature (3788)..(3789): n is a, c, g, or t
  misc_feature (3791)..(3792): n is a, c, g, or t
  misc_feature (3794)..(3794): n is a, c, g, or t
  misc_feature (3796)..(3796): n is a, c, g, or t
  misc_feature (3798)..(3798): n is a, c, g, or t
  misc_feature (3801)..(3802): n is a, c, g, or t
  misc_feature (3807)..(3807): n is a, c, g, or t
  misc_feature (3809)..(3809): n is a, c, g, or t
  misc_feature (3818)..(3818): n is a, c, g, or t
  misc_feature (3820)..(3823): n is a, c, g, or t
  misc_feature (3829)..(3830): n is a, c, g, or t
  misc_feature (3832)..(3832): n is a, c, g, or t
  misc_feature (3834)..(3834): n is a, c, g, or t
  misc_feature (3837)..(3839): n is a, c, g, or t
  misc_feature (3843)..(3843): n is a, c, g, or t
  misc_feature (3845)..(3850): n is a, c, g, or t
  misc_feature (3852)..(3852): n is a, c, g, or t
  misc_feature (3856)..(3858): n is a, c, g, or t
  misc_feature (3860)..(3860): n is a, c, g, or t
  misc_feature (3863)..(3863): n is a, c, g, or t
  misc_feature (3866)..(3866): n is a, c, g, or t
  misc_feature (3868)..(3868): n is a, c, g, or t
  misc_feature (3871)..(3877): n is a, c, g, or t
  misc_feature (3879)..(3879): n is a, c, g, or t
  misc_feature (3882)..(3882): n is a, c, g, or t
  misc_feature (3885)..(3898): n is a, c, g, or t
  misc_feature (3901)..(3902): n is a, c, g, or t
  misc_feature (3905)..(3909): n is a, c, g, or t
  misc_feature (3912)..(3912): n is a, c, g, or t
  misc_feature (3914)..(3919): n is a, c, g, or t
  misc_feature (3921)..(3923): n is a, c, g, or t
  misc_feature (3929)..(3930): n is a, c, g, or t
  misc_feature (3932)..(3934): n is a, c, g, or t
  misc_feature (3936)..(3936): n is a, c, g, or t
  misc_feature (3940)..(3960): n is a, c, g, or t
  misc_feature (3962)..(3964): n is a, c, g, or t
  misc_feature (3966)..(3968): n is a, c, g, or t
  misc_feature (3970)..(3974): n is a, c, g, or t
  misc_feature (3976)..(3977): n is a, c, g, or t
  misc_feature (3979)..(3979): n is a, c, g, or t
  misc_feature (3981)..(3981): n is a, c, g, or t
  misc_feature (3983)..(3993): n is a, c, g, or t
  misc_feature (3995)..(3995): n is a, c, g, or t
  misc_feature (3997)..(3998): n is a, c, g, or t
  misc_feature (4000)..(4000): n is a, c, g, or t
acgggatcatcttacctcaggttggcaggatgaaaccatcacagacttagaggtaaggttcctgtttgaaggcacacctgaagtttcgggttaagggaaccgttaaagggacaaagtgctataaggaatatataggaacctntcnntntnnggntnannangcncnntatantngcncgnnannnnnnagnnnnngtnnnnacanntntntgnnnnnncnntngcanacacnnannannntnacnctngcncccccantgncccanancncaccctgnnnnngcnatannnnnnnntttngcgggattatcgacaagagactgtancgtaagcatagagaacttctgatcgatctaggatgaacatgctgccgacacccactccgaacatgaaanccgtcaagttaaacatcggtgctcgtctacggcaattcatttataaccgcgatcgcccactcaatgtaatttaatcgccgttctagcgaccaattagcagggggtgactttgctaaagtacccacatttgatgacttgtctgttagcttcaccagagcggcttcaggggacttcttgcactcattttctaactgaagctctttgcgccgttgttttggtagtgacttgtcgtcagttagtttgctaacaaatcctgtgatgcggttgccgaataattcagcaataactgttaagttggttgggtggcagtcttcaaccacatcgtgtagccatgcagctgctattgcttcttctgatttatcccattttgcaacaagggatgaaacttcttccaggtgcatagtatatggttctttggcagcacctttacggcactgaccagcgtgacgcacacgagcaaaccgcgcggcgcgattatccccaaaacttcgggcagtagatggatcacaggtagacaccaacatatgctgtgttttcatccaatccttggccgcaggggtatcgtttgtccgatacgtggagggagatataaatagattggcgggcccaaaaggggtgtcggttttgacatatttgggtttgctctgaacaatcagtgcggactagggttttaaaaacggatccacctgcatgctgtctgggatgggtgcctgcatcagcgataatatcgtcggcgcaagggacaattgatccaaggtgtcaagcggcccacaataggttgcatcgccaaagtaatacaaagcgaattcgcgttgtagcgggtcgtcaccaccgtgatggccccgtccgtcttggccgtgatcggcggtgataatgatgtcatatcccatttgacgccattgcctgatccagggggccaacatttcatccatcacaaagcaggcattatccatttctgggcaatcatgatgaaaacgatgccccatactgtccaatgtgcaggtatgcaaaattccatagtccagcaaaaatcgttggcaaagcatggttaaggttgcgaataaatcggcatccgagggcgtcatttgatttatcaagccatagcctgacatggtgtgaaaccggccgtggttaattgttgcgctttctggttcgtcgtattcaatatcacgcaaaggatcaaatgggctgcggttaaaaaattccgaccaaaaactatgcgtgacggcgccggtgacatagttgactgcgcgcagttgcgaaaacacatctggctggttcagcctaaatacggtgttgtttcccgttgcgccatggatttgaggtctgacccctgtgtggattgaggcgtagcaactggccgaagtactgggcagcacagaccgcatcacccagcggcgggcgtcgcctgaatgcacccagccttctaaattgccaaataatctggtccaattgcgcagtggcactccgtcaataatgacgaccaataacttgcctgccattttcacaatccattctgcgaatttcactagcctgattagacatcggaaccaaaaattggtcaacaccttgaagagctagcttaaaaatctattctcgttgatagtgagtttttagacttgcatttagtaaaagcgatatgtttaaactgatctcaaacggagactgatnatgttgaaaaaaaccacatttaagatcgttgcggctagcgcatgtatatttcctttcgccctgaacgctgaagatggcttctttactgataaacttccatccattgtgaaaaatatcgcggaagggattgaggttggtaaaggcggacaggcaacacgctctgaggtgcagaagtattctcttggtgttgcaaacgacgcaatagatagaaccgaacagcgtatattatcaaacaccaactttactcatttcgatcttacattgggttcggacgtgatgggcattgatggcgcagacgcgaagactaagacagaagcgatgacggtctaccgtctccatgaagataagaatatgttcctgttcaatcaggcgtctatcgttggctttgatggaagaaccaccttgaaccttggtcttggggttcggcacatcaatgatgctgagacagtcattatgggcgcaaacgcattttacgattatgaactagacagcgaacacaagcgcagtggtttcggtgttgagttgctgacatccatgcttgagttccgtgcaaataagtacaacgcaatatctggcacgattaactacaagggtatcgatgagacagcacttgatggtcacgacataaagttgtctgcaaacatgccctacttctactcntcnaacntntacttcaagcaaagtgagttcaaggacaatgcaggntacagcaccaaagcngatgagtggggtgtncaagctgaagtcgcncctaacttngttcttggngttgcttcacagaagaaganaggtagctcagcncaaacggttgcctccntcagctacagtatnccactnggtggacgngcacagccagcaaagcaaatgcaagacggngtgtggtcaaccaagctaaagccgatccgcgaaaagctgtatcaaccngtncagcgtgaaaaccgtatnatgaaaaaagccatcaaanttggcgtaacnntnnntggnnnntaannatgnncaannnantnncncnntnnnntatnattntttgnngcannnnnnnnnnancnnnnnnnngnntnanntntncntcngannnnntnantnntnctnnnnncncgannncngnannnnantcnnntnnnnttanncnngangcaantnaagntnaanntnntnatttanntgnatnnacgnnngnncnnancgtnantcnnnattttangannaattntncgagctgngtgtctttantttngganagnncnngcanntctgttacnnngnncnatggnatgnangnttntntcaatnaagangntncacttnaaganncnacnnananncnngggtncnncnnannngngnnnannnttgcannnannactanntntacnntnaantacantgtngctaccgaaganaannctntaaacnnaggnncngntananntngttannnananggcngcancnntgatgntggggncncnagnaatttancangttcnannnnnnntggncntnnngngnnngctnnctcancagagtctttacttganttnnnnnnnaacnanncaggttcannggnnactancaacnannanccgaacgncnntgcnnnnntagntgnaantannganaccttnnncctntttgnnnntnatagcnccaaannaannnatnccnntnnnnnnnatannnctgntnanngnccananangcttgnnnnacnnnnnnntnntnntncnanganngtttnanccaatacancnnnnattganncncntannncttnannnnnngncgtnnngntangcntngcnnnnnnngnatnagnnnnnnnnnnnnnngannttnnnnntanannnnnngnnngttgtnntnnngntgcnnnnnnnnnnnnnnnnnnnnntnnntnnntnnnnnannancnannnnnnnnnnncntnnan

SEQ ID NO: 1462 - DNA, 4000 bp, Escherichia coli
  misc_feature (1324)..(1324): n is a, c, g, or t
  misc_feature (1974)..(1974): n is a, c, g, or t
  misc_feature (1985)..(1985): n is a, c, g, or t
  misc_feature (2895)..(2895): n is a, c, g, or t
  misc_feature (2986)..(2986): n is a, c, g, or t
  misc_feature (2989)..(2990): n is a, c, g, or t
  misc_feature (3175)..(3175): n is a, c, g, or t
ccatgacaattgcagggtgacattctaccaagtcagcaatggtatcaatgacgctcccagaaatatatccttcctgcgcctgcgctaaatgcagtagagataatgtggctgatttcttatccggatattgggaaaatattctatccactttatccggattggcaaaaataaacttttcttggggagtggccatggtgttcaacgatccaattctcctgcgataacgttcgtgctcccgataattgccggtgcatcggatagcatatgtccctcaatcagtttgggaaaaattgaataattcatcagtgacggcggacgtgtgcggaccctgtagggcaccctgcctccatcggaaacaatgtaaaaaccaagctctccattgggagattccgtagctacataggcctctccaatgggtggtgtcattcctctattacgcatagtaatctcaaaatgatatatcaatccttctattgaattataaacctcatcttttgggggaagactaaaacctaaatccggatcaaccataacatcgcctgcaggcattttatccaaagcttggcggcagattttcacagattgacgcatttcctccattctaaccaaatatctgtcaaatacatctccatttaatgcaatggccacatcaaaatcgaattcctcatacctggaatatggctcttgcacacgaatatcccaatcaatacccgatgcccgtgccatgggtcccgagagtccgtaagatatggcatcttcttttgatattattccgatatccttggtccgatcctgccagatacgatttttatttaaaagggtctcaatatcccgggcaaccacatccacattatcaagaactttgataacggcttcatcaaatttgtccggaatatcccgcattaaacctccaaccaaagtatagctggttgtaagccgcgtacctgttgctatctcaaacaggtcataaatatcttccctgagccgaaatccgtacagaaaagcagtcagggctcccaagtccactgccagcattcccacattcaaaatatgatcagcaattctgctcagttcgcacattagtacacgaatatattctgtacgtttagaaacttcaagccccatgagtttttctgctgtcaaagcataagctacattgttacagagcggggacagataattcatgcggtctgtaatagttatgtattggttataatcaaggtattcgcccagtttttcaaatccggaatggagataaccaatttcgggggtgcccttgataacagtttccccttccagttccataataatacgcagagtaccntgagtagatggatgctgggggccaaagttgagaaccatccgctcggtatccattggctgatctgctccctgcaccattattgtgcagcctctttatttattccacgtttaaccaccggaaaatcatctctttctttccttcccaaacgcggataatcttttcgtaatggatggccttgaaaatcgtccgggttcatgatgcggattagattgggatggcctttaaatgatatcccaaaaaggtcatatatttctctttcctgccaatcggcagttttccatagagattctgcggatggtaattcgggttgatcttcaggcacgtatgcttttatggttactctttctgcagtttcgtgtgacagcaggtggtaaacaacagcaaagcgctcaaaaccgcccagcgttaaattatctatagcggtaatatcagccaggaagttaaatccattgtccctgaacaattttagaacatctaagttataggacccttgaatatgaatgatatcttcccctgcaaactgggtggtatcaagggtgacactcgggaacttatcatggaccttggtaataatttttgaaaggagcatttatttcccccgagtagtcgaataatcagaaaatttttctgtttccactaatttctgcagnttaattaaacnctccactactccttcgggacgtggagggcagccggggacataaacatcgactggtataaatttgtctacaccctgaatgacactataggtatcaaatacaccgccagttgatgcgcaagcgcccatagcaataacccattttggttcgggtatctgttcataaattcgaatcagaaccggcatcatttttattgaaattctaccagcaacaatcagtaaatcggactgccgcggcgaaaaacgtatggcttcggcgccaaacctagctatatctgtacgggcagctaataccgccatgaattctatcccacagcaggcagtaccaaaaggcataggccaaagggaatgttttctgccccaattgacagcgctttccagtgtggtggttaaaatgtttgatttaatatcatccggctgcatatcttgtctccgttatttatgtctgtacagtttaatgtgtgtccatacacatgttattcaaatgtcttaatctgccttataagaataagcttaaatttaggtaggttaatcccaatcaagcgctccctttttccagacataaacgtagccaaatgtgaggatagcaagaaatacaaccatttcaataaaaataaattttccaaatggcaggaaatcacggtaaacaaccgcccaggggaaaagaaatactatctcaatatcgaagattataaatatcagcgcaatcagaaaatatttaatggatatgcggactcttgtttttcccactaaatcaacaccggattcatagggcatatctttgacaatatttttcactctggggccaaaataatgggaggcaagcagagatataaacacaaatccaaaagctagaatgaacaccaccagtatagggaaataattttcaatcatattataattttactcttanaactcatttattatcttttctcaatctccgtttacgctcttcatggcgtaccctaccttcctcaaagcgctgtttttccacatctgtttcnggnnttaccattggaactccctggggtttgccattgtcatttaaggaaacaaaggtcaggtaggcagaagaagtgtggtagatagcgccggttttcggattttcagattcaatccgcacccccacttccatagaagatttaccggtataattcaccgaggattttaatatcatgatatcacccattttnaccggggccagaaaatccaattgatctacactggcggtgacaactgcggtacgggcatgtttgtaggcagacatggcggcacacatatccataagatgcataaccctgccacccagtacattacctaataaattggtatcattagggagaaccaactcatgcataatgacttgggtatccttgagagcttttgtttccattcagagattatcctttccagagatttatagatttttcaataaagccaataagaggttcccaataaataaagaagagaatgttctgggcagaaaataatataatagaccaatttacaaccgggtgagcttcaattttatttacctcaccttctacatcgactaggtacatacttttgacaattttaaaataatagtacagcgagaccactgaatttaaaatggcaaccacagccagccagtagaattgttgatgtttaaataactcagcaaagatataaaattttcctacaaacccagccgttggcggcaaaccggtaagggaaatgagtgtcagcgccatgaaggcacatagaaccgggtttttcctactcagcccatcccaatcgttaatatgatgggcattaagtttattggaggcaaatatagccatgtaaaaggcggcgagattcataaagaggtaaataaaaaggtacagcatgatagcgcgtactgcgtcagggctgattatggcaaatgccatcaacataaagcctacatgtgaaatagtggaatacgccagcaatctctttacatcttcctgctgaactgccagcaggttgcccagggtcatggttatggctgaggc

SEQ ID NO: 1463 - DNA, 4000 bp, Escherichia coli
  misc_feature (1)..(5): n is a, c, g, or t
  misc_feature (7)..(12): n is a, c, g, or t
  misc_feature (14)..(16): n is a, c, g, or t
  misc_feature (18)..(21): n is a, c, g, or t
  misc_feature (23)..(23): n is a, c, g, or t
  misc_feature (25)..(25): n is a, c, g, or t
  misc_feature (27)..(27): n is a, c, g, or t
  misc_feature (32)..(48): n is a, c, g, or t
  misc_feature (50)..(52): n is a, c, g, or t
  misc_feature (54)..(93): n is a, c, g, or t
  misc_feature (95)..(98): n is a, c, g, or t
  misc_feature (100)..(114): n is a, c, g, or t
  misc_feature (116)..(118): n is a, c, g, or t
  misc_feature (120)..(125): n is a, c, g, or t
  misc_feature (129)..(139): n is a, c, g, or t
  misc_feature (141)..(144): n is a, c, g, or t
  misc_feature (146)..(162): n is a, c, g, or t
  misc_feature (165)..(186): n is a, c, g, or t
  misc_feature (188)..(191): n is a, c, g, or t
  misc_feature (194)..(195): n is a, c, g, or t
  misc_feature (197)..(198): n is a, c, g, or t
  misc_feature (200)..(201): n is a, c, g, or t
  misc_feature (203)..(209): n is a, c, g, or t
  misc_feature (211)..(222): n is a, c, g, or t
  misc_feature (224)..(231): n is a, c, g, or t
  misc_feature (233)..(238): n is a, c, g, or t
  misc_feature (240)..(240): n is a, c, g, or t
  misc_feature (242)..(257): n is a, c, g, or t
  misc_feature (259)..(269): n is a, c, g, or t
  misc_feature (272)..(273): n is a, c, g, or t
  misc_feature (275)..(282): n is a, c, g, or t
  misc_feature (284)..(289): n is a, c, g, or t
  misc_feature (292)..(321): n is a, c, g, or t
  misc_feature (323)..(334): n is a, c, g, or t
  misc_feature (336)..(337): n is a, c, g, or t
  misc_feature (339)..(340): n is a, c, g, or t
  misc_feature (342)..(356): n is a, c, g, or t
  misc_feature (358)..(362): n is a, c, g, or t
  misc_feature (364)..(364): n is a, c, g, or t
  misc_feature (366)..(372): n is a, c, g, or t
  misc_feature (374)..(379): n is a, c, g, or t
  misc_feature (381)..(385): n is a, c, g, or t
  misc_feature (387)..(389): n is a, c, g, or t
  misc_feature (391)..(397): n is a, c, g, or t
  misc_feature (399)..(405): n is a, c, g, or t
  misc_feature (407)..(408): n is a, c, g, or t
  misc_feature (411)..(427): n is a, c, g, or t
  misc_feature (429)..(431): n is a, c, g, or t
  misc_feature (433)..(437): n is a, c, g, or t
  misc_feature (439)..(459): n is a, c, g, or t
  misc_feature (461)..(462): n is a, c, g, or t
  misc_feature (464)..(467): n is a, c, g, or t
  misc_feature (469)..(486): n is a, c, g, or t
  misc_feature (488)..(495): n is a, c, g, or t
  misc_feature (497)..(508): n is a, c, g, or t
  misc_feature (510)..(517): n is a, c, g, or t
  misc_feature (519)..(522): n is a, c, g, or t
  misc_feature (524)..(524): n is a, c, g, or t
  misc_feature (526)..(530): n is a, c, g, or t
  misc_feature (532)..(533): n is a, c, g, or t
  misc_feature (535)..(548): n is a, c, g, or t
  misc_feature (550)..(558): n is a, c, g, or t
  misc_feature (560)..(560): n is a, c, g, or t
  misc_feature (562)..(572): n is a, c, g, or t
  misc_feature (574)..(576): n is a, c, g, or t
  misc_feature (580)..(580): n is a, c, g, or t
  misc_feature (583)..(584): n is a, c, g, or t
  misc_feature (586)..(594): n is a, c, g, or t
  misc_feature (596)..(608): n is a, c, g, or t
  misc_feature (610)..(612): n is a, c, g, or t
  misc_feature (614)..(619): n is a, c, g, or t
  misc_feature (621)..(622): n is a, c, g, or t
  misc_feature (624)..(629): n is a, c, g, or t
  misc_feature (632)..(633): n is a, c, g, or t
  misc_feature (635)..(639): n is a, c, g, or t
  misc_feature (642)..(645): n is a, c, g, or t
  misc_feature (647)..(649): n is a, c, g, or t
  misc_feature (651)..(656): n is a, c, g, or t
  misc_feature (658)..(659): n is a, c, g, or t
  misc_feature (661)..(664): n is a, c, g, or t
  misc_feature (666)..(666): n is a, c, g, or t
  misc_feature (668)..(670): n is a, c, g, or t
  misc_feature (672)..(674): n is a, c, g, or t
  misc_feature (677)..(687): n is a, c, g, or t
  misc_feature (689)..(698): n is a, c, g, or t
  misc_feature (701)..(702): n is a, c, g, or t
  misc_feature (704)..(708): n is a, c, g, or t
  misc_feature (710)..(712): n is a, c, g, or t
  misc_feature (714)..(716): n is a, c, g, or t
  misc_feature (718)..(719): n is a, c, g, or t
  misc_feature (721)..(723): n is a, c, g, or t
  misc_feature (726)..(728): n is a, c, g, or t
  misc_feature (730)..(737): n is a, c, g, or t
  misc_feature (740)..(753): n is a, c, g, or t
  misc_feature (756)..(763): n is a, c, g, or t
  misc_feature (765)..(767): n is a, c, g, or t
  misc_feature (769)..(772): n is a, c, g, or t
  misc_feature (774)..(776): n is a, c, g, or t
  misc_feature (778)..(780): n is a, c, g, or t
  misc_feature (783)..(788): n is a, c, g, or t
  misc_feature (790)..(793): n is a, c, g, or t
  misc_feature (795)..(798): n is a, c, g, or t
  misc_feature (800)..(808): n is a, c, g, or t
  misc_feature (810)..(818): n is a, c, g, or t
  misc_feature (820)..(824): n is a, c, g, or t
  misc_feature (827)..(829): n is a, c, g, or t
  misc_feature (831)..(834): n is a, c, g, or t
  misc_feature (839)..(840): n is a, c, g, or t
  misc_feature (842)..(845): n is a, c, g, or t
  misc_feature (847)..(847): n is a, c, g, or t
  misc_feature (849)..(849): n is a, c, g, or t
  misc_feature (851)..(852): n is a, c, g, or t
  misc_feature (854)..(863): n is a, c, g, or t
  misc_feature (865)..(870): n is a, c, g, or t
  misc_feature (872)..(878): n is a, c, g, or t
  misc_feature (880)..(885): n is a, c, g, or t
  misc_feature (887)..(887): n is a, c, g, or t
  misc_feature (889)..(893): n is a, c, g, or t
  misc_feature (895)..(896): n is a, c, g, or t
  misc_feature (898)..(898): n is a, c, g, or t
  misc_feature (900)..(906): n is a, c, g, or t
  misc_feature (909)..(913): n is a, c, g, or t
  misc_feature (915)..(915): n is a, c, g, or t
  misc_feature (918)..(926): n is a, c, g, or t
  misc_feature (928)..(933): n is a, c, g, or t
  misc_feature (935)..(935): n is a, c, g, or t
  misc_feature (937)..(942): n is a, c, g, or t
  misc_feature (944)..(944): n is a, c, g, or t
  misc_feature (946)..(948): n is a, c, g, or t
  misc_feature (951)..(952): n is a, c, g, or t
  misc_feature (954)..(955): n is a, c, g, or t
  misc_feature (957)..(957): n is a, c, g, or t
  misc_feature (959)..(960): n is a, c, g, or t
  misc_feature (962)..(963): n is a, c, g, or t
  misc_feature (965)..(968): n is a, c, g, or t
  misc_feature (971)..(978): n is a, c, g, or t
  misc_feature (980)..(983): n is a, c, g, or t
  misc_feature (985)..(996): n is a, c, g, or t
  misc_feature (998)..(998): n is a, c, g, or t
  misc_feature (1001)..(1002): n is a, c, g, or t
  misc_feature (1005)..(1005): n is a, c, g, or t
  misc_feature (1013)..(1013): n is a, c, g, or t
  misc_feature (1015)..(1026): n is a, c, g, or t
  misc_feature (1029)..(1029): n is a, c, g, or t
  misc_feature (1032)..(1033): n is a, c, g, or t
  misc_feature (1035)..(1036): n is a, c, g, or t
  misc_feature (1038)..(1052): n is a, c, g, or t
  misc_feature (1054)..(1061): n is a, c, g, or t
  misc_feature (1063)..(1072): n is a, c, g, or t
  misc_feature (1074)..(1075): n is a, c, g, or t
  misc_feature (1077)..(1077): n is a, c, g, or t
  misc_feature (1079)..(1083): n is a, c, g, or t
  misc_feature (1086)..(1088): n is a, c, g, or t
  misc_feature (1090)..(1091): n is a, c, g, or t
  misc_feature (1096)..(1096): n is a, c, g, or t
  misc_feature (1098)..(1099): n is a, c, g, or t
  misc_feature (1102)..(1108): n is a, c, g, or t
  misc_feature (1110)..(1116): n is a, c, g, or t
  misc_feature (1118)..(1122): n is a, c, g, or t
  misc_feature (1124)..(1137): n is a, c, g, or t
  misc_feature (1139)..(1144): n is a, c, g, or t
  misc_feature (1146)..(1154): n is a, c, g, or t
  misc_feature (1157)..(1160): n is a, c, g, or t
  misc_feature (1162)..(1165): n is a, c, g, or t
  misc_feature (1167)..(1172): n is a, c, g, or t
  misc_feature (1175)..(1175): n is a, c, g, or t
  misc_feature (1177)..(1180): n is a, c, g, or t
  misc_feature (1184)..(1184): n is a, c, g, or t
  misc_feature (1186)..(1187): n is a, c, g, or t
  misc_feature (1190)..(1196): n is a, c, g, or t
  misc_feature (1198)..(1198): n is a, c, g, or t
  misc_feature (1201)..(1202): n is a, c, g, or t
  misc_feature (1204)..(1208): n is a, c, g, or t
  misc_feature (1215)..(1217): n is a, c, g, or t
  misc_feature (1219)..(1228): n is a, c, g, or t
  misc_feature (1230)..(1230): n is a, c, g, or t
  misc_feature (1233)..(1233): n is a, c, g, or t
  misc_feature (1237)..(1237): n is a, c, g, or t
  misc_feature (1239)..(1240): n is a, c, g, or t
  misc_feature (1242)..(1246): n is a, c, g, or t
  misc_feature (1248)..(1248): n is a, c, g, or t
  misc_feature (1250)..(1256): n is a, c, g, or t
  misc_feature (1261)..(1265): n is a, c, g, or t
  misc_feature (1268)..(1272): n is a, c, g, or t
  misc_feature (1274)..(1274): n is a, c, g, or t
  misc_feature (1277)..(1282): n is a, c, g, or t
  misc_feature (1285)..(1285): n is a, c, g, or t
  misc_feature (1288)..(1295): n is a, c, g, or t
  misc_feature (1299)..(1299): n is a, c, g, or t
  misc_feature (1302)..(1302): n is a, c, g, or t
  misc_feature (1305)..(1307): n is a, c, g, or t
  misc_feature (1310)..(1310): n is a, c, g, or t
  misc_feature (1314)..(1318): n is a, c, g, or t
  misc_feature (1320)..(1322): n is a, c, g, or t
  misc_feature (1326)..(1326): n is a, c, g, or t
  misc_feature (1329)..(1338): n is a, c, g, or t
  misc_feature (1341)..(1341): n is a, c, g, or t
  misc_feature (1839)..(1839): n is a, c, g, or t
  misc_feature (1848)..(1848): n is a, c, g, or t
  misc_feature (2427)..(2427): n is a, c, g, or t
  misc_feature (2433)..(2433): n is a, c, g, or t
  misc_feature (2436)..(2436): n is a, c, g, or t
  misc_feature (2442)..(2442): n is a, c, g, or t
  misc_feature (2472)..(2472): n is a, c, g, or t
  misc_feature (2544)..(2544): n is a, c, g, or t
  misc_feature (2550)..(2550): n is a, c, g, or t
  misc_feature (2595)..(2595): n is a, c, g, or t
  misc_feature (2685)..(2685): n is a, c, g, or t
  misc_feature (2688)..(2688): n is a, c, g, or t
  misc_feature (2881)..(2881): n is a, c, g, or t
  misc_feature (2899)..(2899): n is a, c, g, or t
  misc_feature (3052)..(3052): n is a, c, g, or t
  misc_feature (3058)..(3058): n is a, c, g, or t
  misc_feature (3214)..(3214): n is a, c, g, or t
  misc_feature (3580)..(3580): n is a, c, g, or t
  misc_feature (3601)..(3601): n is a, c, g, or t
  misc_feature (3619)..(3619): n is a, c, g, or t
  misc_feature (3640)..(3640): n is a, c, g, or t
  misc_feature (3649)..(3649): n is a, c, g, or t
  misc_feature (3652)..(3652): n is a, c, g, or t
  misc_feature (3655)..(3655): n is a, c, g, or t
  misc_feature (3706)..(3706): n is a, c, g, or t
  misc_feature (3709)..(3709): n is a, c, g, or t
  misc_feature (3715)..(3715): n is a, c, g, or t
  misc_feature (3805)..(3805): n is a, c, g, or t
  misc_feature (3823)..(3823): n is a, c, g, or t
  misc_feature (3825)..(3825): n is a, c, g, or t
  misc_feature (3998)..(3998): n is a, c, g, or t
nnnnnannnnnnannnannnnanananaaaannnnnnnnnnnnnnnnntnnnannnnnnnnnnnnnnnnnnnnnnnnnnnnnnnnnnnnnnnncnnnngnnnnnnnnnnnnnnntnnntnnnnnntttnnnnnnnnnnnannnntnnnnnnnnnnnnnnnnnaannnnnnnnnnnnnnnnnnnnnnannnnttnntnntnntnnnnnnngnnnnnnnnnnnntnnnnnnnntnnnnnntntnnnnnnnnnnnnnnnntnnnnnnnnnnnaanntnnnnnnnntnnnnnnttnnnnnnnnnnnnnnnnnnnnnnnnnnnnnntnnnnnnnnnnnngnnannannnnnnnnnnnnnnncnnnnnanannnnnnntnnnnnntnnnnntnnntnnnnnnntnnnnnnntnnttnnnnnnnnnnnnnnnnnannngnnnnngnnnnnnnnnnnnnnnnnnnnntnntnnnntnnnnnnnnnnnnnnnnnntnnnnnnnntnnnnnnnnnnnntnnnnnnnntnnnncntnnnnntnnannnnnnnnnnnnnnannnnnnnnnanannnnnnnnnnntnnnaaanatnngnnnnnnnnntnnnnnnnnnnnnngnnntnnnnnnanntnnnnnnttnncnnnnntcnnnnannntnnnnnntnnannnntnannnannntannnnnnnnnnntnnnnnnnnnnttnngnnnnntnnntnnntnnannntannnannnnnnnnacnnnnnnnnnnnnnnttnnnnnnnntnnntnnnntnnntnnnttnnnnnntnnnnannnngnnnnnnnnntnnnnnnnnnannnnnaannntnnnnaaaannannnntnananntnnnnnnnnnntnnnnnncnnnnnnntnnnnnntnannnnnannantnnnnnnnttnnnnntntcnnnnnnnnntnnnnnntntnnnnnntntnnnaannannananntnntnnnnccnnnnnnnncnnnnannnnnnnnnnnntntcnnttnccccttgncnnnnnnnnnnnntanaanntnncnnnnnnnnnnnnnnntnnnnnnnnannnnnnnnnngnnantnnnnnaannnannaaaanannaannnnnnntnnnnnnntnnnnnannnnnnnnnnnnnnannnnnnannnnnnnnnaannnnannnnannnnnnttntnnnnttancnnttnnnnnnngnttnngnnnnngaaggannnannnnnnnnnncnttntccngnntnnnnntntnnnnnnncaatnnnnnatnnnnnanaannnnnnttntcnnnnnnnnactnctnctnnntanaccnnnnncnnngccnttnnnnnnnnnnttnaacgcacaaaaaaactctctcgaagtgagagagtttgtaaagttcttatttgagaccgtattttttgttgaaacgatccacacgtccgtctgcttgagtgaatttttgacgacctgtgtagaatgggtgagaatcagaagtgatttccacacgtagtaatgggtattcgtttccgtcttcccatacaactgtttcacttgaagtctttgttgaacctgataagaatttgaatcctgtagttgtatccatgaaaactactggacgatattctgggtgaattccttgtttcatttctattcctcctgccctgaattatttgctaatccagagttatttattttcgcatgcataatgcaacacgaatataataacatgctcaaattgaatttgcaatagttttattcatcccctaattcaagtccgggaattgcgtttaaatccatatttgcaaagtctttttgcatgtattttgtataggctgcagcaccaatcatcgcngcattatcnccgcaaagtgataatggcgggatggaaaatgtgactgctgggtagtgttcttccatcatctgcgtcatcgctgtacgaagacccttattagctgccactcctcctgctaacacgaattgttttacaggataggcttcaagagcgcgtcttgttttttcgacaagaacttctacgacactggcttggaaacttgcggctaaatcttcagggacaatctcttcgcctttttgtttggcgttatgcacacgattgatgaccgctgatttcaatccactaaaactgaaatcgaagtggtcttcatgaatcatcgcacgtgggaagtcataagtatccgttccaagatgagctagttcgtccattttctttccaccaggatatggcaagttcagaatacgaccaatcttatcgtaagcttcccctgcagcatcatctcttgtttctccgataatttggaactcgccatcttctggcatatacacaagttccgtatgtccaccacttactacaagcgccattagtggaaattgcaaaggttccacgagttggttggcgtaaatgtgtcctgccatgtggttcacngcaatnagnggtttnccactcgctaaagctaaagccttcgctgcngaaatcccaatgagaagggctccgacaagtcctggaccatacgtcaccgcgatggcgtccatgtcatccaangttttncctgcttttgcaagagcttcgtcaatgacttgtgtaatttgttcnacgtgatggcggctagcaatctctggcacaaccccaccaaaacgcatatgacttttaatttgagaggctacaatatttgaaaggatggtnttnccgttttgaatcacggctgcacttgtctcatcacaactactttcaattgctagaatcaatgtttctttcatattgctcctcctatctttgttctatttctaagcgatattcaatcgcatcttcaactgggtcactgtaataatcacttctcgtatggaaggcttcgaaccctagaatttcatataaatattgngcacgcttgttgctttcncgcacttctaggaaaacaactttcacgtctttttgcttcaaatcgtataaggccatttgccataaacgttgcgcgagacctttaccttgatagtctttcgcaatcacgatattcgtaatcgttgcctcgtccaatacgctttggactccaagnaatccnactagttggcgttgcatccatactccgtaatacgtgtttgttggattttctaaatcggcaaggaaactctcggcactccaattatttggatgctcgtagttttcttgcactaatgtgactaatgcctccgccatcgctaaatcagctggatgtaancttgtaaatgaatactctgatgaatggaatgaagacggtgtttttggcggtaatgcatagagcatttccacggcatcttcattttcaggagtgtagtaattttcctttgtaccaacaacttcgtatccatttttacgatagagcttaatggcttttgtattcgacacgcgggcttcgagcgtaatttctttcttgtcgagcgcgcgggcgattttttctaatgctttcaataataaagttgcgacattcaagaagcgataatcgtgtagtacagcaacattcgtgatatgtaaatctgttccctctgtcgttctcgctccgatgaaaccaacgatttcctcttccacttccagcacaatataaatngcagctggattatgtgcgacntctttttcaagaacatcntttgcccatggagactctccntcataagcngcnttntccacttcaaaaatgcgagtggcatcttctggaagaccgattctgattttngcntgcgcnccgtttccaagaatcactcttttttcaaagttctcaaactggtcgcgaatcggatccatctgttgcgcttcttctaaaaacagtgctttnattttttcaaaccactgnangaagcgttctttaaactcgttccacatacactgaccccttttctaaaggatgctcagcttgccaattttcttctgcttctgccagtttcaagtacattgggacgaagacgtccgcgtcaacagcttccttatttcttcctaattcgataagcgatgttgcgtgaggaatcgcntc

SEQ ID NO: 1464 - DNA, 4000 bp, Escherichia coli
  misc_feature (2351)..(2352): n is a, c, g, or t
  misc_feature (2354)..(2355): n is a, c, g, or t
  misc_feature (2358)..(2359): n is a, c, g, or t
  misc_feature (2364)..(2365): n is a, c, g, or t
  misc_feature (2367)..(2369): n is a, c, g, or t
  misc_feature (2371)..(2374): n is a, c, g, or t
  misc_feature (2376)..(2377): n is a, c, g, or t
  misc_feature (2380)..(2381): n is a, c, g, or t
  misc_feature (2384)..(2384): n is a, c, g, or t
  misc_feature (2386)..(2390): n is a, c, g, or t
  misc_feature (2392)..(2396): n is a, c, g, or t
  misc_feature (2398)..(2423): n is a, c, g, or t
  misc_feature (2425)..(2437): n is a, c, g, or t
  misc_feature (2439)..(2454): n is a, c, g, or t
  misc_feature (2456)..(2460): n is a, c, g, or t
  misc_feature (2462)..(2476): n is a, c, g, or t
  misc_feature (2478)..(2494): n is a, c, g, or t
  misc_feature (2496)..(2496): n is a, c, g, or t
  misc_feature (2499)..(2503): n is a, c, g, or t
  misc_feature (2505)..(2506): n is a, c, g, or t
  misc_feature (2508)..(2511): n is a, c, g, or t
  misc_feature (2513)..(2514): n is a, c, g, or t
  misc_feature (2517)..(2518): n is a, c, g, or t
  misc_feature (2521)..(2521): n is a, c, g, or t
  misc_feature (2523)..(2526): n is a, c, g, or t
  misc_feature (2529)..(2529): n is a, c, g, or t
  misc_feature (2531)..(2532): n is a, c, g, or t
  misc_feature (2534)..(2534): n is a, c, g, or t
  misc_feature (2536)..(2537): n is a, c, g, or t
  misc_feature (2541)..(2542): n is a, c, g, or t
  misc_feature (2544)..(2545): n is a, c, g, or t
  misc_feature (2547)..(2554): n is a, c, g, or t
  misc_feature (2556)..(2558): n is a, c, g, or t
  misc_feature (2561)..(2572): n is a, c, g, or t
  misc_feature (2574)..(2578): n is a, c, g, or t
  misc_feature (2580)..(2592): n is a, c, g, or t
  misc_feature (2594)..(2596): n is a, c, g, or t
  misc_feature (2598)..(2600): n is a, c, g, or t
  misc_feature (2602)..(2602): n is a, c, g, or t
  misc_feature (2604)..(2605): n is a, c, g, or t
  misc_feature (2607)..(2609): n is a, c, g, or t
  misc_feature (2611)..(2611): n is a, c, g, or t
  misc_feature (2613)..(2614): n is a, c, g, or t
  misc_feature (2619)..(2620): n is a, c, g, or t
  misc_feature (2623)..(2623): n is a, c, g, or t
  misc_feature (2625)..(2626): n is a, c, g, or t
  misc_feature (2629)..(2629): n is a, c, g, or t
  misc_feature (2631)..(2632): n is a, c, g, or t
  misc_feature (2634)..(2635): n is a, c, g, or t
  misc_feature (2637)..(2643): n is a, c, g, or t
  misc_feature (2646)..(2656): n is a, c, g, or t
  misc_feature (2658)..(2683): n is a, c, g, or t
  misc_feature (2685)..(2692): n is a, c, g, or t
  misc_feature (2694)..(2694): n is a, c, g, or t
  misc_feature (2696)..(2696): n is a, c, g, or t
  misc_feature (2698)..(2704): n is a, c, g, or t
  misc_feature (2706)..(2706): n is a, c, g, or t
  misc_feature (2709)..(2713): n is a, c, g, or t
  misc_feature (2715)..(2715): n is a, c, g, or t
  misc_feature (2717)..(2727): n is a, c, g, or t
  misc_feature (2729)..(2731): n is a, c, g, or t
  misc_feature (2733)..(2741): n is a, c, g, or t
  misc_feature (2743)..(2750): n is a, c, g, or t
  misc_feature (2752)..(2757): n is a, c, g, or t
  misc_feature (2759)..(2767): n is a, c, g, or t
  misc_feature (2770)..(2770): n is a, c, g, or t
  misc_feature (2772)..(2772): n is a, c, g, or t
  misc_feature (2774)..(2775): n is a, c, g, or t
  misc_feature (2777)..(2777): n is a, c, g, or t
  misc_feature (2780)..(2784): n is a, c, g, or t
  misc_feature (2786)..(2790): n is a, c, g, or t
  misc_feature (2792)..(2798): n is a, c, g, or t
  misc_feature (2800)..(2800): n is a, c, g, or t
  misc_feature (2802)..(2809): n is a, c, g, or t
  misc_feature (2812)..(2813): n is a, c, g, or t
  misc_feature (2815)..(2815): n is a, c, g, or t
  misc_feature (2817)..(2818): n is a, c, g, or t
  misc_feature (2821)..(2821): n is a, c, g, or t
  misc_feature (2823)..(2824): n is a, c, g, or t
  misc_feature (2827)..(2827): n is a, c, g, or t
  misc_feature (2829)..(2830): n is a, c, g, or t
  misc_feature (2832)..(2833): n is a, c, g, or t
  misc_feature (2835)..(2839): n is a, c, g, or t
  misc_feature (2841)..(2841): n is a, c, g, or t
  misc_feature (2843)..(2845): n is a, c, g, or t
  misc_feature (2847)..(2848): n is a, c, g, or t
  misc_feature (2851)..(2852): n is a, c, g, or t
  misc_feature (2854)..(2857): n is a, c, g, or t
  misc_feature (2859)..(2861): n is a, c, g, or t
  misc_feature (2863)..(2863): n is a, c, g, or t
  misc_feature (2865)..(2869): n is a, c, g, or t
  misc_feature (2871)..(2885): n is a, c, g, or t
  misc_feature (2887)..(2891): n is a, c, g, or t
  misc_feature (2896)..(2896): n is a, c, g, or t
  misc_feature (2898)..(2902): n is a, c, g, or t
  misc_feature (2904)..(2905): n is a, c, g, or t
  misc_feature (2907)..(2908): n is a, c, g, or t
  misc_feature (2910)..(2913): n is a, c, g, or t
  misc_feature (2915)..(2916): n is a, c, g, or t
  misc_feature (2919)..(2920): n is a, c, g, or t
  misc_feature (2922)..(2925): n is a, c, g, or t
  misc_feature (2928)..(2935): n is a, c, g, or t
  misc_feature (2937)..(2939): n is a, c, g, or t
  misc_feature (2941)..(2945): n is a, c, g, or t
  misc_feature (2947)..(2950): n is a, c, g, or t
  misc_feature (2952)..(2953): n is a, c, g, or t
  misc_feature (2955)..(2997): n is a, c, g, or t
  misc_feature (2999)..(3006): n is a, c, g, or t
  misc_feature (3008)..(3010): n is a, c, g, or t
  misc_feature (3012)..(3025): n is a, c, g, or t
  misc_feature (3027)..(3031): n is a, c, g, or t
  misc_feature (3033)..(3034): n is a, c, g, or t
  misc_feature (3036)..(3051): n is a, c, g, or t
  misc_feature (3053)..(3090): n is a, c, g, or t
  misc_feature (3092)..(3094): n is a, c, g, or t
  misc_feature (3096)..(3097): n is a, c, g, or t
  misc_feature (3099)..(3103): n is a, c, g, or t
  misc_feature (3105)..(3106): n is a, c, g, or t
  misc_feature (3108)..(3109): n is a, c, g, or t
  misc_feature (3111)..(3123): n is a, c, g, or t
  misc_feature (3126)..(3129): n is a, c, g, or t
  misc_feature (3131)..(3144): n is a, c, g, or t
  misc_feature (3146)..(3156): n is a, c, g, or t
  misc_feature (3158)..(3159): n is a, c, g, or t
  misc_feature (3161)..(3170): n is a, c, g, or t
  misc_feature (3172)..(3175): n is a, c, g, or t
  misc_feature (3177)..(3190): n is a, c, g, or t
  misc_feature (3192)..(3193): n is a, c, g, or t
  misc_feature (3195)..(3198): n is a, c, g, or t
  misc_feature (3200)..(3202): n is a, c, g, or t
  misc_feature (3204)..(3211): n is a, c, g, or t
  misc_feature (3213)..(3264): n is a, c, g, or t
  misc_feature (3266)..(3315): n is a, c, g, or t
  misc_feature (3317)..(3322): n is a, c, g, or t
  misc_feature (3324)..(3328): n is a, c, g, or t
  misc_feature (3330)..(3343): n is a, c, g, or t
  misc_feature (3345)..(3348): n is a, c, g, or t
  misc_feature (3350)..(3400): n is a, c, g, or t
  misc_feature (3402)..(3405): n is a, c, g, or t
  misc_feature (3407)..(3433): n is a, c, g, or t
  misc_feature (3436)..(3437): n is a, c, g, or t
  misc_feature (3440)..(3446): n is a, c, g, or t
  misc_feature (3448)..(3451): n is a, c, g, or t
  misc_feature (3453)..(3454): n is a, c, g, or t
  misc_feature (3456)..(3459): n is a, c, g, or t
  misc_feature (3461)..(3463): n is a, c, g, or t
  misc_feature (3465)..(3477): n is a, c, g, or t
  misc_feature (3479)..(3530): n is a, c, g, or t
  misc_feature (3532)..(3533): n is a, c, g, or t
  misc_feature (3535)..(3538): n is a, c, g, or t
  misc_feature (3540)..(3541): n is a, c, g, or t
  misc_feature (3543)..(3546): n is a, c, g, or t
  misc_feature (3548)..(3548): n is a, c, g, or t
  misc_feature (3552)..(3552): n is a, c, g, or t
  misc_feature (3556)..(3558): n is a, c, g, or t
  misc_feature (3560)..(3560): n is a, c, g, or t
  misc_feature (3562)..(3562): n is a, c, g, or t
  misc_feature (3564)..(3566): n is a, c, g, or t
  misc_feature (3568)..(3570): n is a, c, g, or t
  misc_feature (3575)..(3578): n is a, c, g, or t
  misc_feature (3581)..(3582): n is a, c, g, or t
  misc_feature (3584)..(3588): n is a, c, g, or t
  misc_feature (3590)..(3590): n is a, c, g, or t
  misc_feature (3592)..(3596): n is a, c, g, or t
  misc_feature (3598)..(3614): n is a, c, g, or t
  misc_feature (3616)..(3618): n is a, c, g, or t
  misc_feature (3620)..(3622): n is a, c, g, or t
  misc_feature (3624)..(3625): n is a, c, g, or t
  misc_feature (3627)..(3627): n is a, c, g, or t
  misc_feature (3629)..(3632): n is a, c, g, or t
  misc_feature (3634)..(3637): n is a, c, g, or t
  misc_feature (3642)..(3644): n is a, c, g, or t
  misc_feature (3646)..(3647): n is a, c, g, or t
  misc_feature (3649)..(3659): n is a, c, g, or t
  misc_feature (3661)..(3676): n is a, c, g, or t
  misc_feature (3678)..(3681): n is a, c, g, or t
  misc_feature (3685)..(3685): n is a, c, g, or t
  misc_feature (3689)..(3696): n is a, c, g, or t
  misc_feature (3698)..(3702): n is a, c, g, or t
  misc_feature (3704)..(3712): n is a, c, g, or t
  misc_feature (3714)..(3714): n is a, c, g, or t
  misc_feature (3716)..(3722): n is a, c, g, or t
  misc_feature (3724)..(3727): n is a, c, g, or t
  misc_feature (3729)..(3733): n is a, c, g, or t
  misc_feature (3735)..(3736): n is a, c, g, or t
  misc_feature (3738)..(3739): n is a, c, g, or t
  misc_feature (3741)..(3750): n is a, c, g, or t
  misc_feature (3752)..(3753): n is a, c, g, or t
  misc_feature (3755)..(3755): n is a, c, g, or t
  misc_feature (3757)..(3764): n is a, c, g, or t
  misc_feature (3767)..(3767): n is a, c, g, or t
  misc_feature (3769)..(3771): n is a, c, g, or t
  misc_feature (3773)..(3776): n is a, c, g, or t
  misc_feature (3778)..(3778): n is a, c, g, or t
  misc_feature (3781)..(3782): n is a, c, g, or t
  misc_feature (3784)..(3786): n is a, c, g, or t
  misc_feature (3789)..(3790): n is a, c, g, or t
  misc_feature (3792)..(3799): n is a, c, g, or t
  misc_feature (3801)..(3802): n is a, c, g, or t
  misc_feature (3804)..(3804): n is a, c, g, or t
  misc_feature (3806)..(3810): n is a, c, g, or t
  misc_feature (3812)..(3813): n is a, c, g, or t
  misc_feature (3816)..(3818): n is a, c, g, or t
  misc_feature (3822)..(3822): n is a, c, g, or t
  misc_feature (3824)..(3825): n is a, c, g, or t
  misc_feature (3827)..(3829): n is a, c, g, or t
  misc_feature (3831)..(3836): n is a, c, g, or t
  misc_feature (3838)..(3844): n is a, c, g, or t
  misc_feature (3846)..(3853): n is a, c, g, or t
  misc_feature (3855)..(3859): n is a, c, g, or t
  misc_feature (3861)..(3861): n is a, c, g, or t
  misc_feature (3863)..(3863): n is a, c, g, or t
  misc_feature (3865)..(3871): n is a, c, g, or t
  misc_feature (3873)..(3874): n is a, c, g, or t
  misc_feature (3876)..(3886): n is a, c, g, or t
  misc_feature (3888)..(3889): n is a, c, g, or t
  misc_feature (3891)..(3893): n is a, c, g, or t
  misc_feature (3896)..(3903): n is a, c, g, or t
  misc_feature (3905)..(3912): n is a, c, g, or t
  misc_feature (3914)..(3919): n is a, c, g, or t
  misc_feature (3921)..(3922): n is a, c, g, or t
  misc_feature (3924)..(3927): n is a, c, g, or t
  misc_feature (3932)..(3932): n is a, c, g, or t
  misc_feature (3934)..(3934): n is a, c, g, or t
  misc_feature (3936)..(3936): n is a, c, g, or t
  misc_feature (3939)..(3943): n is a, c, g, or t
  misc_feature (3945)..(3945): n is a, c, g, or t
  misc_feature (3947)..(3950): n is a, c, g, or t
  misc_feature (3952)..(3952): n is a, c, g, or t
  misc_feature (3954)..(3954): n is a, c, g, or t
  misc_feature (3957)..(3960): n is a, c, g, or t
  misc_feature (3963)..(3998): n is a, c, g, or t
ccgcggccgccagggcgccgatgcggcgcgcgcacgactgaaaagatgcaaatttccttttcgcgtccctgaaagccgtcaatcgtattgacatcaatcattttcgcgcggctgcctagcttttcttcgagtcgttttcgaatgtttctcacttgagccttgtatggagatataacagccacgttttcgtcttcggcaatttctgggaaatgtttaaacaactgttgaataaggcacacggcgaaatccgcttcgtcgtcgttggcccacgaatgcccagcggtttcgtattccttgcctttgatgtcaaagaacacgaatggtctgaacggtctaaacttgtgccacggtcgcgacgtgagcttcaacattccagggccatcgacgagttcgtcttcgtaaaaggtttccgaaggaaattgacgaattgctgggtgcatgcggtattgcgttttgagcatgtgcaccggatacgcgctcatttgcaagcgcttgaacatcgacatgtcgtacttgtggtcaaccgcggtcgagctaagtaccgtggcgggcaactgtcgcggatctccaactaaaaatacctgcttcgcaccgtagcacaaaggcacgagcgtcgagggttcaaccgcttgtgcggcttcgtcgataatcacggcgtcaaacggtttgctcatgcgcgcaaacattccagacccggaaaatgacaaagtactacacaccaccgttgcttcttctaatatcgcttgcttcaatcgatcgcgttcaattgcagcctcaaattttcgaacggcgtcgccgtgcgcgcccatttcgccgacgcgctgctgcacgagttcttccatggacactgattgcacagaatggtgcacgctcacaccgacacgaacgatagtgggcgaatatgtcgaccctgagccatcgatgaggccattttgaatgattctcaacacaatttcgtcaagggctgaattcgatggcgcgcaaaccaaaattttcaatcgtttgtacgcgtcagatcccaggaggtgcgcctgctgcgtctgtggcgccgccggcactctcgcgctcgtgatactttcactgctcggacgatcgccgtgcgtttcatggaatgtcttattctgtgcaactaacggtggtgcatcgcgaggatttgacacaccagcgagccaaggtgacgcgcgcgcccattctgtctttttctcctccaacgtaagatgcgtcgacgcggctcgcattctcgcgtacgattcaaaatccacgtgcgttctcgagcccgagctcggtgtggaatgtaacaacaccgataatagcgacaaaatcgtacgcgttttccctgtaccaggtggaccttgaatcagcacgagagggtcgcgattcagcgccgcgcccaaagccttcacttgcgagtcgttgtacgcgtgctcgatttctctcttcaagccgtctggcattgtccacgcattcttggacgttgccgcttccaccgcttccgtgggcttggctttgagaatcgtcgacgcgtacggaagagctggaaaagcgtgaatagcgagccattcgcgcgtcacggtggagaggttggccaaatttttcaagtaccatcgttgccctttaacggcggttaaagcgttacgcacagttctgaaacgcttatagtcgtgctcgctgtgctttcccgatttcgcgttggcgtcatccgattttgctcgcttcgccgaatcacgtcgcgcttctgcactcgacgcgtccggcaaatgtaatcgtacgatgagcacgtttttcgcgtctcgcccttcaaccaccccgagcgcgtgcgcctctctcgccttttcatacgccgcctcgtcgttcgcgtcatccacgcacgcgcgtgaaagcaaaacaagatcattatcatggaattcactcgcatccgtgtctacgagagcaaatttggcgctatgaaactcctccgcgcgcgaggcggtaaccacgccgcagactcggctccttcgctctttgtcatcatcctcacctcgacgaacgatcgccgcggcttcttccaataataacggttcatacgtttccacgtattccctcgccgacgtaaacgtcagcggtacgtccacgcatcgcacgtgatgtgccgtagacgacgtcgcatctctggtggcggcggtcgccgcgtccccatcgtcatcctcgcgttcaccctccccggcgccgcgtatggcaaagtaatcccacgccaacacccggcgctggagcgaacttaaatgactttccacgtgattcatcaataaatcgctcgcgacgcgggatcccacaccgcggcgcactgtgtggtggtggtggtcgtggtatccaannanncanncacgnncnnncnnnncnnccnnccncnnnnncnnnnncnnnnnnnnnnnnnnnnnnnnnnnnnncnnnnnnnnnnnnnannnnnnnnnnnnnnnnannnnngnnnnnnnnnnnnnnngnnnnnnnnnnnnnnnnngncgnnnnngnngnnnncnncgnnggngnnnncgncnncncnngcgnngnngnnnnnnnngnnngcnnnnnnnnnnnngnnnnngnnnnnnnnnnnnngnnngnnngngnngnnngngnnggcgnnggngnnggngnngnngnnnnnnncgnnnnnnnnnnnannnnnnnnnnnnnnnnnnnnnnnnnngnnnnnnnngntngnnnnnnngncgnnnnngngnnnnnnnnnnngnnngnnnnnnnnnannnnnnnnannnnnngnnnnnnnnncgngngnngnggnnnnngnnnnngnnnnnnngngnnnnnnnnganngngnngangnnggngnngnngnnnnngngnnngnnggnnannnngnnngngnnnnngnnnnnnnnnnnnnnngnnnnngtggngnnnnngnngnngnnnngnnggnnannnngannnnnnnncnnnannnnnannnngnngnnnnnnnnnnnnnnnnnnnnnnnnnnnnnnnnnnnnnnnnnnntnnnnnnnnannngnnnnnnnnnnnnnngnnnnngnngnnnnnnnnnnnnnnnngnnnnnnnnnnnnnnnnnnnnnnnnnnnnnnnnnnnnnncnnngnngnnnnngnngnngnnnnnnnnnnnnncgnnnncnnnnnnnnnnnnnncnnnnnnnnnnncnncnnnnnnnnnntnnnncnnnnnnnnnnnnnngnngnnnngnnnannnnnnnnannnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnncnnnnnngnnnnngnnnnnnnnnnnnnngnnnncnnnnnnnnnnnnnnnnnnnnnnnnnnnnnnnnnnnnnnnnnnnnnnnnnnngnnnncnnnnnnnnnnnnnnnnnnnnnnnnnnntgnnttnnnnnnntnnnntnntnnnntnnntnnnnnnnnnnnnntnnnnnnnnnnnnnnnnnnnnnnnnnnnnnnnnnnnnnnnnnnnnnnnnnnnncnncnnnncnntnnnncnctcnctcnnncncncnnncnnncaccnnnncanncnnnnncncnnnnncnnnnnnnnnnnnnnnnncnnncnnncnnangnnnngnnnnagacnnngnnannnnnnnnnnncnnnnnnnnnnnnnnnngnnnngcgngcgnnnnnnnngnnnnngnnnnnnnnngngnnnnnnngnnnngnnnnngnngnngnnnnnnnnnncnngncnnnnnnnncgncnnngnnnngngcnncnnncgnngnnnnnnnngnngngnnnnngnnggnnncggngnngnnngnnnnnngnnnnnnngnnnnnnnngnnnnngngngnnnnnnnanngnnnnnnnnnnnannannncgnnnnnnnncnnnnnnnncnnnnnngnngnnnnggagngngnggnnnnngngnnnngngngannnncgnnnnnnnnnnnnnnnnnnnnnnnnnnnnnnnnnnnnaa

SEQ ID NO: 1465 - DNA, 4000 bp, Escherichia coli
  misc_feature (1467)..(1467): n is a, c, g, or t
  misc_feature (1992)..(1992): n is a, c, g, or t
  misc_feature (2370)..(2370): n is a, c, g, or t
  misc_feature (3245)..(3246): n is a, c, g, or t
  misc_feature (3249)..(3255): n is a, c, g, or t
  misc_feature (3257)..(3259): n is a, c, g, or t
  misc_feature (3261)..(3261): n is a, c, g, or t
  misc_feature (3264)..(3264): n is a, c, g, or t
  misc_feature (3269)..(3269): n is a, c, g, or t
  misc_feature (3272)..(3272): n is a, c, g, or t
  misc_feature (3275)..(3284): n is a, c, g, or t
  misc_feature (3290)..(3290): n is a, c, g, or t
  misc_feature (3292)..(3297): n is a, c, g, or t
  misc_feature (3299)..(3299): n is a, c, g, or t
  misc_feature (3301)..(3307): n is a, c, g, or t
  misc_feature (3309)..(3312): n is a, c, g, or t
  misc_feature (3314)..(3333): n is a, c, g, or t
  misc_feature (3335)..(3337): n is a, c, g, or t
  misc_feature (3339)..(3340): n is a, c, g, or t
  misc_feature (3342)..(3345): n is a, c, g, or t
  misc_feature (3347)..(3347): n is a, c, g, or t
  misc_feature (3349)..(3352): n is a, c, g, or t
  misc_feature (3355)..(3355): n is a, c, g, or t
  misc_feature (3357)..(3357): n is a, c, g, or t
  misc_feature (3359)..(3363): n is a, c, g, or t
  misc_feature (3365)..(3365): n is a, c, g, or t
  misc_feature (3367)..(3368): n is a, c, g, or t
  misc_feature (3373)..(3373): n is a, c, g, or t
  misc_feature (3375)..(3376): n is a, c, g, or t
  misc_feature (3378)..(3379): n is a, c, g, or t
  misc_feature (3382)..(3383): n is a, c, g, or t
  misc_feature (3386)..(3390): n is a, c, g, or t
  misc_feature (3392)..(3400): n is a, c, g, or t
  misc_feature (3402)..(3418): n is a, c, g, or t
  misc_feature (3420)..(3421): n is a, c, g, or t
  misc_feature (3423)..(3423): n is a, c, g, or t
  misc_feature (3425)..(3426): n is a, c, g, or t
  misc_feature (3431)..(3431): n is a, c, g, or t
  misc_feature (3433)..(3446): n is a, c, g, or t
  misc_feature (3448)..(3448): n is a, c, g, or t
  misc_feature (3452)..(3454): n is a, c, g, or t
  misc_feature (3456)..(3457): n is a, c, g, or t
  misc_feature (3460)..(3463): n is a, c, g, or t
  misc_feature (3465)..(3469): n is a, c, g, or t
  misc_feature (3471)..(3475): n is a, c, g, or t
  misc_feature (3477)..(3484): n is a, c, g, or t
  misc_feature (3486)..(3491): n is a, c, g, or t
  misc_feature (3493)..(3494): n is a, c, g, or t
  misc_feature (3497)..(3500): n is a, c, g, or t
  misc_feature (3502)..(3504): n is a, c, g, or t
  misc_feature (3506)..(3510): n is a, c, g, or t
  misc_feature (3514)..(3526): n is a, c, g, or t
  misc_feature (3528)..(3530): n is a, c, g, or t
  misc_feature (3533)..(3539): n is a, c, g, or t
  misc_feature (3541)..(3543): n is a, c, g, or t
  misc_feature (3545)..(3546): n is a, c, g, or t
  misc_feature (3548)..(3548): n is a, c, g, or t
  misc_feature (3550)..(3550): n is a, c, g, or t
  misc_feature (3552)..(3573): n is a, c, g, or t
  misc_feature (3575)..(3577): n is a, c, g, or t
  misc_feature (3579)..(3582): n is a, c, g, or t
  misc_feature (3584)..(3584): n is a, c, g, or t
  misc_feature (3586)..(3589): n is a, c, g, or t
  misc_feature (3592)..(3593): n is a, c, g, or t
  misc_feature (3595)..(3596): n is a, c, g, or t
  misc_feature (3598)..(3602): n is a, c, g, or t
  misc_feature (3604)..(3604): n is a, c, g, or t
  misc_feature (3610)..(3610): n is a, c, g, or t
  misc_feature (3612)..(3614): n is a, c, g, or t
  misc_feature (3616)..(3631): n is a, c, g, or t
  misc_feature (3633)..(3634): n is a, c, g, or t
  misc_feature (3636)..(3638): n is a, c, g, or t
  misc_feature (3640)..(3642): n is a, c, g, or t
  misc_feature (3644)..(3649): n is a, c, g, or t
  misc_feature (3653)..(3653): n is a, c, g, or t
  misc_feature (3656)..(3656): n is a, c, g, or t
  misc_feature (3658)..(3660): n is a, c, g, or t
  misc_feature (3663)..(3667): n is a, c, g, or t
  misc_feature (3669)..(3670): n is a, c, g, or t
  misc_feature (3672)..(3673): n is a, c, g, or t
  misc_feature (3676)..(3678): n is a, c, g, or t
  misc_feature (3680)..(3681): n is a, c, g, or t
  misc_feature (3683)..(3683): n is a, c, g, or t
  misc_feature (3685)..(3685): n is a, c, g, or t
  misc_feature (3687)..(3688): n is a, c, g, or t
  misc_feature (3691)..(3691): n is a, c, g, or t
  misc_feature (3693)..(3698): n is a, c, g, or t
  misc_feature (3700)..(3701): n is a, c, g, or t
  misc_feature (3703)..(3719): n is a, c, g, or t
  misc_feature (3721)..(3723): n is a, c, g, or t
  misc_feature (3725)..(3730): n is a, c, g, or t
  misc_feature (3733)..(3734): n is a, c, g, or t
  misc_feature (3736)..(3736): n is a, c, g, or t
  misc_feature (3739)..(3740): n is a, c, g, or t
  misc_feature (3745)..(3745): n is a, c, g, or t
  misc_feature (3747)..(3748): n is a, c, g, or t
  misc_feature (3750)..(3758): n is a, c, g, or t
  misc_feature (3761)..(3764): n is a, c, g, or t
  misc_feature (3770)..(3771): n is a, c, g, or t
  misc_feature (3773)..(3773): n is a, c, g, or t
  misc_feature (3775)..(3776): n is a, c, g, or t
  misc_feature (3778)..(3778): n is a, c, g, or t
  misc_feature (3781)..(3781): n is a, c, g, or t
  misc_feature (3783)..(3785): n is a, c, g, or t
  misc_feature (3788)..(3789): n is a, c, g, or t
  misc_feature (3791)..(3797): n is a, c, g, or t
  misc_feature (3799)..(3799): n is a, c, g, or t
  misc_feature (3803)..(3803): n is a, c, g, or t
  misc_feature (3805)..(3811): n is a, c, g, or t
  misc_feature (3814)..(3814): n is a, c, g, or t
  misc_feature (3816)..(3820): n is a, c, g, or t
  misc_feature (3822)..(3832): n is a, c, g, or t
  misc_feature (3834)..(3840): n is a, c, g, or t
  misc_feature (3842)..(3852): n is a, c, g, or t
  misc_feature (3855)..(3856): n is a, c, g, or t
  misc_feature (3859)..(3872): n is a, c, g, or t
  misc_feature (3874)..(3876): n is a, c, g, or t
  misc_feature (3881)..(3891): n is a, c, g, or t
  misc_feature (3893)..(3893): n is a, c, g, or t
  misc_feature (3895)..(3896): n is a, c, g, or t
  misc_feature (3898)..(3899): n is a, c, g, or t
  misc_feature (3901)..(3902): n is a, c, g, or t
  misc_feature (3904)..(3904): n is a, c, g, or t
  misc_feature (3906)..(3910): n is a, c, g, or t
  misc_feature (3912)..(3918): n is a, c, g, or t
  misc_feature (3920)..(3920): n is a, c, g, or t
  misc_feature (3923)..(3929): n is a, c, g, or t
  misc_feature (3931)..(3931): n is a, c, g, or t
  misc_feature (3933)..(3939): n is a, c, g, or t
  misc_feature (3941)..(3941): n is a, c, g, or t
  misc_feature (3943)..(3952): n is a, c, g, or t
  misc_feature (3954)..(3955): n is a, c, g, or t
  misc_feature (3957)..(3962): n is a, c, g, or t
  misc_feature (3964)..(3964): n is a, c, g, or t
  misc_feature (3966)..(3966): n is a, c, g, or t
  misc_feature (3968)..(3970): n is a, c, g, or t
  misc_feature (3972)..(3972): n is a, c, g, or t
  misc_feature (3975)..(3976): n is a, c, g, or t
  misc_feature (3978)..(3984): n is a, c, g, or t
  misc_feature (3986)..(3993): n is a, c, g, or t
  misc_feature (3995)..(3996): n is a, c, g, or t
  misc_feature (3998)..(4000): n is a, c, g, or t
gcaagtgttaccgtcgatattgcaaaacgtcctcgacgaagctacggacgctttggaggacatcgccaacggcctcgaaaataaactccgcaacttggtggaacatgtctggggtacggttgcgagctcgtcgtccgaagtcgtatcgttcatcgaaaataacgtcaagggttcaatatgcgcatcgtcgagttccacggcatcgctcggagccgcgcgcgaagagcgacgactcgccctcgtaaatgacattcatcgcggcgtgcgcgctgcgttccggggcgactcgactccgacgcactcagcgcgtccaatcgttcctaatctaggcgctgggcagtgttgctatcacatcccgttcgcgtgtagcagcgaggtggatttcccaatgccttggccgaaggccttggagaatatatcggactcaccgggtgccgtcgttgtgaacatgccgggcctggaattcaacatctgtggcgagatcacgcagtttaaggtggacgagaaagttgcgacgaaactggtgaatgcttttggtgatatgttcgaagcgctctttgcagcactttacgaagagagcggactgaaaaaagtcgtggatgacgtgaaagatctgacaaaggacatgtttgggtcgtcggcggcgctcggatcgtatgatcgaccgtctttctccaccgacgaccgcaaacatctgttgaggaaatacgtcgaagtcaaaaaccggatggcagagacggagacaatcgttctggaggaacttttgaaaatatctgacaccattcattcgcccgaatacttgacgcatacaacacggacgccgtcgcgcgatgacgtgccgtctctgggcggcgagaacttgttcgaaaaggtcctgaatgatttcgccgacgatttgcagacggctcttaaatctatggcagacacgacagtcgtgaaggcggatatgtcaatcaacgtgaaaggagacacgtccatcaatgcgaaggcgagcgtctacaagatcggcgacatcatcgacaagctcgatattccaaatagctttgcgggcgtccacgtcgcccctctgtttcccggtttaaccgcggcgcttcaatacgacgtgttgctttcgatgccatattacgtcaacatcgacatggaggcatcttttgccttgggtctcgatatcgatatcccgatatctctcgaactttcgaatacaccaaacttcgccatgggctcgcccgccgtgaacttggttccgacgtacaccgcagccggtaagtcgagcgcgcaggtaggcgcgagtgttgagataaagaaaggctggatagcgctgtgcgcggggactcactgcgtcggcccatggatcaaagcgcgccaagacgtctacgtcggggtcgacacctgggctttcgccaactgcgactcgggatatggcgagctcgtgccaaaatggaccgacggattctcttattcgagcanaaatcaagcagcatgcgcaggttcactcgcaggcgctggtggctacgcgcaagtgccgaagacgggcaatattctcgctcaggtactgttcgcccccatgccgatcatgccctcgggcgcgagcgccgcctcgcaatccgcggcgcgtctcggcgacgacgacgacgagtgcgaggctcagccaatgggtatgatactggccgattacaccaacaccgtgcataacgccgtcatggcgggcggcgataactggtacacgacggatttgtttgccgagtgcccgtccgcgggcaagtgccccgcgccgtcaccgccgcaaccgtacacgccaacggcgaacacaaagcttgccaagtacaacgcccggtgctgcggcaactccggcgattcgcgctgcgccgcagcgatcgaaggtacgtacgaaacgctctgcgcccagctctgcgacgcctgcgcgggttgtgtcgccttcgactaccaagccagcacgaacaaatgcggcttcagcaaaagcgatagcacggnggaccgggagggattcacgcacttcggtcacggcgcgacgcccgcgtccaaatcttccctcggctctcgcatgcgtttcagcgcgcgcgcgtcgtcgccaacgtcaccatccgcgctcaccgccgtcttcgtcgtcgccttcgccgccgccttcgcctcggccgcgtttcgccgccgccgcctcgacgacgctcgccgcgcgcgcgtcgacgattacggcgcgttcgactgatcgacgcgtccctccggcgcgtctcgcgctcgagcgttcgagtcgatcatcgctccactcatccgtgtattttctcatatttcctcacattttctccatcgcgcgcctccccgccgtctcgcgcgtcgcgctcggcccggttcgcngggcgcggtcgccgccggcgcgattctggattttggattctcgtttcgccgcactcgtcgtcgcgctttgccgcgcgcaccgacgcgcgcgcccgagaacgagcgcggctcgagaacgcggacgcgcaccgacgccgtcgcgcgaacgtcgcgcgcgcggcgcgcgtcgacgacgctcgaaggcgacgcgacgccatgaagctcgtgcggtttttgcagaaactctccaacgaaagcgtgacgatagagctcaagaacggcaccacggcgcacgggacgatcatgggtgcgtgcacgatgacgacgacggcgcgcgacgcgcgaggacgacgcgcgaggacgaacgagagaagcgcgaatgcgaaacgcgggaaacgcggcgacgatcgggacgcggcgagaagactcgacgggagacgagacgcgagagggacgagacgcagggcgagcgacgcgagcgaagactgacgagcgcgaaaatcacggcgtcgcgcgcgatcgacaggcgtggacgtgagcatgaacacgcacctgaagcaggtgaagctcacgctcaagggtaaaaacccgacggcggtcgaacacctgagcgttcgagggaacacgattcggtattacatccttccggactctttgaatctggacactttgttagtagacgacacgcccaagcaagggaaaccgcgcgcgaaggcggcggcgagcgccggtcgagggcgcggtcgcggtcgagggcgcgggcgcgcgcggccgacgtagtcggtccgccgtcggcgtccgagcgcgtagtcgccgcgtcgcgcgcgattcgacgtcgagcgcgccgtcgcgccgcagttgtttgttttatacgatatccagcgattagatctccnncgnnnnnnngnnngncgncgcgncgnccnnnnnnnnnncgtcgncnnnnnntntnnnnnnnannnnannnnnnnnnnnnnnnnnnnngnnncnncnnnncncnnnnccncncnnnnncncnngcgcncnngnncgnncgnnnnncnnnnnnnnncnnnnnnnnnnnnnnnnncnncncnnccgcncnnnnnnnnnnnnnngncgcnnngnngcnnnncnnnnncnnnnncnnnnnnnncnnnnnngnngcnnnngnnngnnnnngaannnnnnnnnnnnncnnncgnnnnnnngnnnannangngnnnnnnnnnnnnnnnnnnnnnntnnntnnnncncnnnncgnngnngnnnnngngggggngnnngnnnnnnnnnnnnnnnngnngnnnannngnnnnnncgcnggngnnngcnnnnncnncnncgnnncnncngngnncgngnnnnnngnngnnnnnnnnnnnnnnnnncnnngnnnnnncgnngncgnnggggngnngnnnnnnnnngcnnnncggcgnngngnngncgngnnnggnngnnnnnnngngggngnnnnnnnggngnnnnngnnnnnnnnnnngnnnnnnngnnnnnnnnnnnacnncgnnnnnnnnnnnnnngnnnccgcnnnnnnnnnnngngnngnnanngngnnnnnannnnnnnangannnnnnnanannnnnnnanannnnnnnnnngnngnnnnnngncncnnngnggnngnnnnnnnannnnnnnnannannn

SEQ ID NO: 1466 - DNA, 4000 bp, Escherichia coli
  misc_feature (33)..(33): n is a, c, g, or t
  misc_feature (48)..(48): n is a, c, g, or t
  misc_feature (219)..(219): n is a, c, g, or t
  misc_feature (236)..(236): n is a, c, g, or t
  misc_feature (663)..(663): n is a, c, g, or t
  misc_feature (797)..(797): n is a, c, g, or t
  misc_feature (978)..(978): n is a, c, g, or t
  misc_feature (1506)..(1506): n is a, c, g, or t
  misc_feature (2619)..(2619): n is a, c, g, or t
  misc_feature (2961)..(2961): n is a, c, g, or t
  misc_feature (3018)..(3018): n is a, c, g, or t
  misc_feature (3378)..(3378): n is a, c, g, or t
  misc_feature (3644)..(3644): n is a, c, g, or t
  misc_feature (3675)..(3675): n is a, c, g, or t
  misc_feature (3795)..(3795): n is a, c, g, or t
  misc_feature (3804)..(3804): n is a, c, g, or t
  misc_feature (3966)..(3966): n is a, c, g, or t
gcgacgtcgccaagcatggtttccacgcgggtngtggccaccacaacntggggttcgttgtcgtctagggagccgtagcggatggacaccagttcgccttcgacgtccttgtacaccacctcgatgtcggagacggcggtttccagcaccggcgaccagttgaccaggcggtgcgcgcggtagatcatgcctcggtcaaaaagttccttaaagatggtntgcaccgcgcgcgacancccctcatccagggtaaaacgctcgcgggaccagtcgacggaatccccgatggcgcgcatctgctcgccgattttgcccccgtattcgttcttccactcccagaccttggcgacgaactcatcgcgatcgtaatcgtagcgatccttcccctccgtcttcttcagcatcgcctcgactttggtctgcgtcgcgatgcccgcgtgatccatccccggaagccacagcacctcaaacccctgcatgcgcttcctcctcgccaacgcatccatgagcgtatggtccagcgcatgccccatatgaagctgccccgtcacgttcggcgggggcagcacaatcgaaaagggcggcttctccgacgtcacgtcggcggtgaagtagccacgatcaagccactgctggtacaacgcagcctcaacggccttcggntcccagcttttcggcagggcgtcggcacggcttgtggaatggttcggggtgtttttgtcagtcacccttgccataatagcttgtgcccacctcgccgaactgccactgaggggcttatcgacgccgcgggcacncgcaccgcgccaactgcaggtttacagcaggccgagggaggcaacggcgtcgcgttcctcctgcagttccgcgatgttggcggcaatgcgctccttctggaagtcgctgagttccaggccctgcacgatctcccacgcaccattgcgggataccgtggggaagccgaagatcaggccctcnggcacaccgtaggagccgtccgacggaatggctgcggatgcccacttctcggtgccctgaacccagtcgcgcatgtgatcaatcgcggaggaggcagcggaggctgcggaggacttaccacgcacctcaatgatctcagcgccgcgcttagccacgcgcggaatgaactcattcacgtaccaatcctggtccaccagatcggacaccttgtcgccaccaacggtggcgtaggtgatgtcggggaactgcgtggccgagtggttgccccagattgccacctgttcaaaatcggtggaatccttgcccagcttctcggccagttgggaaaggctgcggttgtggtccagacgcatcatggcgttgaaacgttccgccggaatgtccttggcgtgagcctgggcaatcagggcgttggtgttggctgggttgcccaccacaagcacgcgaatatcgtcggccgcatgatcgttgagggcagtgccctgggggccaaagatcttgccgttggcggcgagcaggtcagagcgntcctcacccttgccacgtggcttggcgccaaccaggaaggcggcgttggcaccgtcaaatgccttgttggcatcgtcggtgacggtgatcttcttgaccaatgggaacgcggaatccagcagttccatggccacaccctctgtcgcaccaagcgcgggggtgatttccaaaagattcagctcgataggagtgtcctgcccgtacacatcaccgttggcgatgcgccacagcagggagtaggcgatctggccggcagctccagtcacagcaatctttttcggggcggcagtcatagtcgagacaatccttactttttagcgaacacggggcgtgagacggcccactatcccaggaaattcgagcatgccgtcacacactgctttctacactagcgggtgttttaccatcacgtcactgatcgcgcgcgaaaagcttgcgatgaacatgcacttagttgatatgtcatctcgcgtcaacggactgctgataccacattttgcgcatgcccgctactccacgtcacagcgatatcccacatcgatacccctttcggactgtccggttttttctgaacagacacccacaacaaacaccaccaaaaatttttatcggaaagatttcccgattcgggtgtgattttatagacaagagggtatttttcaccccggccagtgaagtcactgcatgtgattattattaccttgcagctcaggcgtgtattgaatcggttcattactaaaacgtcggcatatatttaacagtttcgcggaaccccctagacaccccaaaatattgcgagaaaatgatgccggtttagctcgcgaaaacatcatacatgtgccataattttatggtctagttacaaaatcacccccgttacacccacacggtcacccgtcacaacctgcggtttttccgaaatcagaaatcgatttcccactgaacaataaattcaggcacgattaacttagctggtaaaaccagcatgcctccaggaaaggaacaatcatgaaccgcccagcagcggaccaagatacaaccacgtcaaacatagacaaggtcgtcgaggtcgcgctggaaacattcgcccgtcaggggttcgaggacacacgnttggaaaacatcgcccacgattcgggcatgtccaagcgcatgatccactatcactttggtgacaagcggggtctgtatattcgcgctctacggttagcaatctcacagctccgcccggaaccccaggcgctggagttggattcaaccgtgcctgtcgacggtgtgcgcaaagtagtggaagccatcttccgccaaatggccgcacacccgaacgctatccgtctcctccttctagagaacctttttggccaagctgatatggccaattccaacccattagccgaccaatccagcgtcctcctgcaaatggacaaactacttatgatgggtcaggacgccggngccttccgccccggcatttctgcgctggatgtgtataccatcatctcctccatgtgngtgttcaggatcgcttacccagcggccttcaagaacttgtaccacatcaacttgaaggacgaggaaaacaatgtgggtatgcagcgacttgttgtcgatgccgtcctcgctttcctcacctcaaacatgcgcaactcgggcgggatgagttacctgactgtcgaaacctcgaatgacttcaacggccacgacggcaacggcagcggcaacatctacaacgaactcgacgacgccaccagcttcatcgaataacgctgtagagaacaacacacgtggccccgcacgctttcacaacgtgcggggccacgtgcttattggttttaggccgtcttttctgacgacgccgcgaccagctccggngcacccaacttccgcgccgccccctcggtgataatcacctcgccaatatcttcacgatccggcaggtcatacatgatgggtacaagcacttcctccatgatggctcgcagaccacgagcgccggtattgcgctccaacgcctgatctgcaatggcctccagtgcttctggggtgaaggtcagtttcacgccatccatctcaaaaagcttctcgtactgccgcaccaaggaattcttcggctcggtgagcacgcgcaccaacgatgntcgatccaggttggtcaccgtagccaccacnggcagacgaccaatgaactcggggatcagaccgaacttcaccagatcctccggcagcacgtccttaaacacgttcaccgtatcgacgtccgtgactgaccgcacctctgcaccaaagccnaggcccttnttgcccacgcgatcctggatcaccttctccaggccagcaaacgcgccagccaccacaaacagaatgttggaggtatccagctgaataaaatcctggttcgggtgtttacgccctccctgcggcggcaccgaggcggttgtgccttccagaatcttcaacaangcctgctgaacaccctcgccggagacatcgcgag

SEQ ID NO: 1467 - DNA, 4000 bp, Escherichia coli
  misc_feature (703)..(703): n is a, c, g, or t
  misc_feature (1177)..(1177): n is a, c, g, or t
  misc_feature (1189)..(1189): n is a, c, g, or t
  misc_feature (1378)..(1378): n is a, c, g, or t
  misc_feature (1457)..(1457): n is a, c, g, or t
  misc_feature (1484)..(1484): n is a, c, g, or t
  misc_feature (1517)..(1517): n is a, c, g, or t
  misc_feature (1564)..(1564): n is a, c, g, or t
  misc_feature (1807)..(1807): n is a, c, g, or t
ttgtctcaaaattacttgcatgattatagttaaaaccatcaatatttaattttaaacaaaaagatcattaatggaataagagataattaattagatggaagaagattctcaagaaggtattatttcattagtgaattcaatttttaatgtaggagaatttacaaaaacggaattcactttagaatttaaaattacagatgttaaatttaaaacaaaatttgaagatttagcaagagctttagaaagtaggaattatgtttgtaaattattaaaaaaagatgatggaatttatattgaaattcaaaaatttacaataaaaaaatccagaaagtggctaaatgcaacttggacaccgagattattgtttgcaattgttatttcatttgtaatgattgatggttactatagaacatctggaacaaatgcaattattgaaattggagatccattccaaatggcaattgtttatacgcttgctcttttaggaattttaggaacacatgagcttggacatatcgttgcagcaaaagcacatagattaaaaacaagttggccatactttatcccaggtttaccaatactaggaattccaacatttggtgcatttattcaatcaaaaggattaacaattaatcgaagtattttatttgacgtagctattgcagggccaattgcaggacttgtaattacaataattgtttcnctatatggggcatatactgcaccaattttagatcaaggaatagctgaaggattatttgcagaacaaattctagtagagtgggaacagggggagccattactaatgactgcaagtttggcagtatttggtaaaggaggaccaggtcacgaagtgatcatgacacctgtaatgtttgcggcatggattggatttttaattacgtttttgaatttacttccagcatggcaacttgatggtggacatatggcaagaacattgttaggtcaaaaaatccacaggtatgcaacttatggaagtatgttagtacttgttttgctaaattattggttaatggcaatcttaattttagtaatgtcaaccaagaatccgagtgcaactccacttgatgacatatctccacttacaaaaaatagaaaacttgcatatattggaattataatattagcagttctatgtgcaccattaccatcaggnttattttcaggnattctaccttagaaaaagtcttgcaccatcagttacaactgcaactttttgtctagcaccttgtgtttttaaaatataatccatagaatatttaattccaggtaaagaaatcatatcaagtttttttgcataaaattcaggtaaaatagatatcaaaccaatttgaaagtttttttgtatttctgaaanaaatagtaagttttccattccatcaacatattttgtaggattttttaattgttccaaagttaatctgtcttcaatatantgttgaattgcatcagaacctaaaccncttttacattcagcaactaaaattgcgagaccntcttttttgatagcatttgagcagttccaaagtgaagataaagaatntcctaaagtatcattacttgcatccttaccagtactcattatcatagttttatgttcaccaacatctttaatcgaatttgattctaaaattttagttgtggaaagtgttttagaaggatgatcaatagtaaaatcaagtattccttcagagtttgaaataatttcaattgcttgaatttcaaaattatcagcaaacttttttgcttcagttaaactttcagtgtattgtccaggtgttggaanattactttgtctttttgcatatgcagaaagcatagattcagtaccaaattttttgataagacgagttgcaacagtttcataaccaaatagaccatcaaatcccatctctcccataaatacaagatttgaattggaaatatcaacatcatcaaattcattaattgaacttccttcaggtaatccggatttaactaaatttagaatttttttctcagctaatatttttgggaatggttttgatttttgttcacataatgtaaataaagatgaaataattttcagaattgatttagagttatgtaatactactaattccattggtttggataaatctaaagaattgagtttttcagaaatggcagaatcatccataattttaccatcagaatcaattttttgctctaaattttcagcctttatatctaaaaccacgtctgtgatcccataattcaaccaaatttcaggcataatagatactaaatacaaaccaaaataaatccaatgtagtgaaatatgatatggaatttgtgaaagaatttgtgacctttttacatcaaaaagagataataaaatttggagattttacactagccagtggaaaaagtagttcatattatgtggatttaagattagttccaagttatcctcaagaatttagaatgatggtaaagtatctagaaaatcaaattacagaagatattggattagagaattttgaaagtattgtttcagttcccacaggaggattagttattgcatcagcattagcaattgaaacagtaaaaccactaatctatgttagaagcaaaccaaaggattatggtacttcaaaatcggttgaaggaaaaattcatgatggaatgaaagttgtaatgatagatgatgttgcaactacaggtggttcagttctaaatgcaacaaaatcattaacagaagtaaatgttccagtaaaagatgcatatgtaattgtagacagaatggaaggggctacagaagctttacaagagcttggagtaaaaatgcattcaattttaaacatattacaaattgccgaagtattgtatgaacaaaaattaattggtgtagatattctagataaagtaaaacagcaaattagtaaatgagtttgggcagctcagacaaatgccttccaatcatcaatttcagatataactctgattcttcattgcagccaataatttgtgtatagactcattttaaaactaattgaaaataatgggcccgaagggctttgatcccttggctcaccggttatgagccggttactctaccaggctgagttacgggccctaaagtcataaattttttttgaggtataaaatgttatgaggttaacagtattcttcataacaactgtcaagtaacaggttttgtgctgaaacagatttttcagcaatttcaattagattacttgtatcagcatttgatttttctaagatatttctccaagatgcagtatgtctaatgtcagcttcagtgtggagtttaaagtattcagttgcattatcatttgttatttgataaaattcagataaaccatctaattttgtttgactaatttttggaatttctttttcaaatgcatacattgcacatgcaccaccatcaaaagtagtcattaattcagataagtcagatactgcttttttggttttatctaatcctgaatatgaaattaattcatcattagagataccaagttctcctgcaaagctaatccaaggttttatgtgatcagattcttcttgttgattttcagttaattcagtgattacagaatttggtgctttttcaataatcggagtcataaattcaggaactgcttttacaagttgaaagtattcctttgaatatcctgctaaagattcttgagttaattttccatcagaccacatttcataaaatgggtgttttagtaggcttctttcttcaataatttgatcaattttctgaattaggttcataattcaacaataattctgccaatacaaaaatctttgttgtgtaccaaaagattttatgatctaagagaagaattttcatgggttccagtggtgtagaccggtcaagcatactgccctttcaaggcagtgatcccgggttcaaatcccggctggagcaccatctctttagtaaaaatccctacaaaagcaccaagatttaattagtaat

SEQ ID NO: 1468 - DNA, 4000 bp, Escherichia coli
  misc_feature (27)..(27): n is a, c, g, or t
  misc_feature (51)..(51): n is a, c, g, or t
  misc_feature (99)..(99): n is a, c, g, or t
  misc_feature (105)..(105): n is a, c, g, or t
  misc_feature (174)..(174): n is a, c, g, or t
  misc_feature (234)..(234): n is a, c, g, or t
  misc_feature (243)..(243): n is a, c, g, or t
  misc_feature (297)..(297): n is a, c, g, or t
  misc_feature (332)..(332): n is a, c, g, or t
  misc_feature (334)..(334): n is a, c, g, or t
  misc_feature (435)..(435): n is a, c, g, or t
  misc_feature (797)..(797): n is a, c, g, or t
  misc_feature (848)..(848): n is a, c, g, or t
  misc_feature (881)..(881): n is a, c, g, or t
  misc_feature (1013)..(1013): n is a, c, g, or t
  misc_feature (1019)..(1019): n is a, c, g, or t
  misc_feature (1055)..(1055): n is a, c, g, or t
  misc_feature (1161)..(1161): n is a, c, g, or t
  misc_feature (1166)..(1166): n is a, c, g, or t
  misc_feature (1173)..(1173): n is a, c, g, or t
  misc_feature (1175)..(1175): n is a, c, g, or t
  misc_feature (1193)..(1193): n is a, c, g, or t
  misc_feature (1196)..(1196): n is a, c, g, or t
  misc_feature (1205)..(1205): n is a, c, g, or t
  misc_feature (1211)..(1211): n is a, c, g, or t
  misc_feature (1244)..(1244): n is a, c, g, or t
  misc_feature (1252)..(1253): n is a, c, g, or t
  misc_feature (1267)..(1267): n is a, c, g, or t
  misc_feature (1304)..(1304): n is a, c, g, or t
  misc_feature (1325)..(1325): n is a, c, g, or t
  misc_feature (1367)..(1367): n is a, c, g, or t
  misc_feature (1450)..(1450): n is a, c, g, or t
  misc_feature (1517)..(1517): n is a, c, g, or t
  misc_feature (1601)..(1601): n is a, c, g, or t
  misc_feature (1728)..(1728): n is a, c, g, or t
  misc_feature (1787)..(1787): n is a, c, g, or t
  misc_feature (2236)..(2236): n is a, c, g, or t
  misc_feature (2270)..(2270): n is a, c, g, or t
  misc_feature (3355)..(3355): n is a, c, g, or t
ggtttgtagttcgcaagaagggcattnagctttggaaaattaaattgcggngcatctaaacgaaggtttacataaataaagccattccaaagttgaacnttgtgntgatgaagatgacaatttttagaatcaaacccggcgttcttcatacgggcagctcgtattaaagaaccntcaagatcataggcccaagcgtgataagagcagacaaagcgatgcacgtttcctcttccntcagcaagnggcataccacggtgtcggcacacatttgcaagaatacctatgtcaccatccgcntggcgaacaataagaagaggctcgttcaaaagatntncagtgaaaaaatcgcctgaattagggatctcatcttggcggccaaggcagtgccatccagagttaagaacggtagacacctcatgctcgaaacgattttgngatgtgtaaaaggcaccgggcatgctcatcggccgatcaggtggaagcttggctatctcttgcaacttaatggagaggtcttgcatgtttagcttacttttgtaaacggctggaaatccggatccattcggctcatcagatattgagcaaaatcaaaatttggacgctcaaggtgagatagatgccccggttctgcaccatcagctgagagaccacgaaagactttttccgtgcacccacgatcctcaacgtttacttcatctagtagtgtttttaactccaatagattctgttgggcgtctgcatcatccttataatcatcagacatccctccaccgaattggatatggactttacctggncctttgggatgtaagctaagataccagaagtagcccggcgtaagtgtgatnaataggctagggtatatggccaaaaggtatgtngttcttctttcatcgccgtgaagacgattatttttcggatgtgccatggctatgcgcaaactgtcatcttttaagattgtatggtaattgaaagctttttcgcctggtggacatatcatttcgtcaagtttngaaagnccaccgatcgtaccagcatgacaaacaggaagatgntaactttccataaagttttctgccaatactttccaattagtatcccagagatgctcttcaaagaaagtttcggagtagtctgtcatgttgtaaccttcaactaatngctcnactcctntnagttcttcggaaatgttnctnggagatggnttaagngtaatgaacacccagccgagccattcctcgcangcaattannggtaaactataacnatctttgcaaaaagctgtgttgccattcattgcgggngcgcctcttagagaaccatcnagattataggtccaggcatggtaagggcagacaatacttttngtcttaccgcgcccctcaagaagcgtagacattcgatggcggcagacattagaaaaagcacgtatagagttcttctgatctcntaatacgattattggctggtcagctagctcacaggtaacataatcaccaggttctgccagtgcgctngcccgacccacacaaaaccaatcttttttaaaaatatttttcaactctgattcaagaaaagactctgaggtatatacctctggnggcattgcgtgcgcttgttcaaaaggtaaagacacattagcacgtagggattcaataggatccgataaagctttcttgggagtcgacatgatttggttaccttgcaaaactgtatgaatagataatnatggttataacgccttcaatctagctaatttgcgacatgcctttatttcaaacagtatnttaatccttggccagattgtatttgctaacatattaaaagttagacttaaagttcgaatcaataagcttagtatatctagaaattattaagtaatatcggtaactttgtgcacttatgtgtggataataatgctttcgttgtggataaccttgttagttacttttttttgcttggatactgataagatttggtcaaaagtaagagcaagctggttggggggaacgtaattcattttactgccacaatcgaaacataagctggtaagggcttgaaagttatctttcattttccgctaaggcttgggcgaattatatgacgcaagttatttaatttgcagatttgtagggcaacctattatgaggttttgataatcccgattggtttgcataggcgtctctagatttatctagaggcgcctatgtattttttaccttaatgatattcaacntaagaatttgttacttccttcctctattttatgngaaagtaacagttactgttaaattgctttagttctctgcaccaattttaatccttggaccccaagtagtgcctagtatcattaacagtattacaagggtaagaagtaccgaaggaatatccgcaaacatgggtggctccattaaatagtcaccactagtaacgcccgaattatttaaccatgctttaccctgaatcgatagttccactcccgattcttgtagttctgctagcctcgccgcagtatttgtatcaaatagaactctccatcctgcaagctgaaggctaaaaaatgctacaaacacgccaaaaatagatgttaatatttttgctgctatgtttcctccagattcgtttgtaaccctagccgcccgcagggcaatgaaaattaatatagctaaagcaaccatatacatcccattattgatgtaattaaggctattatgctctaaaatttcaaattcactcatatttaaatccttacttttatgattttggaatagtgtacgaaacttctttcatttttttggacgaaattaccaactctgggcctgtccagcaggtcaccgttttgatttcactaactgctcccccgaggtatgctgacatcacaagagccatgtaatcggtttgtttttcaaagtcgcttattactacaacctcatagtcctgaccgatcaagccgtaaaatcctaaaaacttacctccagcactttctacagctgctttcaaactggcggttcgatcttcgccatttctcatcatactcatggcgacatcttctttgtaattcacataagttaatcgtactgtcattttatattcccaatttttgtaaatatataactgacaacacaaacaaatatttgctcaagtacactaactgtactttgtgtgggctaagcttgtgcaaaagactttttaagtcgcttcttgagttctcttgttggagaaaaagtaaattaaggccaaaataacgatgatgccccctataattgtgagaaattggggactttcagttgtaaatgtccatacccacaatggtcccaatatagtttctaaaagcataataatactgacatttgangccggtgtcattcgcgaggctcttgatagaagtatgaatgataatggaagaattaataagccagttattgatatataaaacatgcctttcagattaatttctgatgcgcttggccaaaaataaaacgccaataatccgcataaaattcccccagtcccgagtgccagtgggaatgcaacttccttatcttttcttataattacgaaattacaagcaaggctgaaggctactacaaggccgcataggccacctaatatggaggataggttaaatatatcatacgagttgatatcacctattacagatagagttacacctaaaaagactatgacaactatagcccaagttctcatatcaaccgcttcttttaatactactgcacccaagataattgagaaaacgggaacagtagctactgcgattaaaacgatcgctacgggagcaaggtagatgccatatgcaaaacaaaaaacgtttgccatttgaacaaagacaagggcaacaaagcttttacgccatatttttggctttaccccacttcttgataaaataaatgggcaaagccctattataaaaaagatacttccagcttgggttgcccgccaagcgaccatttgaccaccagacagttctgataacctcatc

SEQ ID NO: 1469 - DNA, 4000 bp, Escherichia coli
  misc_feature (2004)..(2004): n is a, c, g, or t
  misc_feature (3131)..(3131): n is a, c, g, or t
catctcaatcaatataaacccaaatttggaacatttttccgggatcattccgtgtggagaagcagacttcggcgttacaagtattaatgagttgggcgtctcagtaactatggatgactttgaccgagcactaaaaaataacttttttagactttgcaaataatctcgcatgcggcaattacgaacattgtgaattactcataatttgattaaacaaagataaatgattcaaaagggacaaagcagaaaagttttctgctgaatttgaggagaataccatggcagacgcagccattcaaggagccgaacacaacgacgatagagggttttttactcgctggtttatgtcaacgaaccacaaagacatcggcatactatatctagtagtttctgcttttgtgggttttatagctgttgctttcactgtttatatgcggctggaacttatgaatcctggcgttcaatatatgtgtttggagggcgcgcgattaactgcagctgccgtaggtgactgtacaccgaatggtcatttgtggaacgtattaattactggtcacggtattcttatgatgttctttgtagttatccccgccttatttggtggttttggaaactattttatgccgctacaaatcggttctccggatatggcgttcccaagaatgaacaacttgtcattttggctgtatgttaccggcacgtcactggcaatttgttcggtattatctccaggaggtaacggacaattgggttctggtgtaggatgggtattatatccgccgttatcagtaaacgagagtggtatgtctatggatctggccatattcgctgtccacgtatctggagcgtcttcgatccttggcgcgataaatatgataaccacattcctaaatatgcgcgcaccaggaatgactttatttaaagttcctctgttttcatggtcaatctttgtaaccgcatggcttatcctacttgccttaccagtcctcgctggagcgattacaatgcttctgactgacagaaatttcggaactacattcttcgatcctgcaggcggaggtgatccgatactttaccaacatattttatggttctttggacatcctgaagtttacatcataattctcccaggttttggaatcattagtcacgtcatagctacatttgctagaaagcctgtttttggttacctaccgatggtatgggccataatagcaattggagcattgggtttcgttgtatgggcacaccatatgtatacggtgggaatgtccttaacgcagcagtcctactttatgttagctacaatggtcatagccgttcctacgggcgttaaagttttttcttggattgctacaatgtggggtggctctatagaatttaaaacccctatgctttgggcatttggatttttatttcttttcaccgtaggtggtgtaaccggaattgtattagcccaggccggtgtcgatcgcgcatatcatgatacatattacgttgtggctcattttcattacgtaatgtcgctcggtgctgtctttgcaatatttgcaggtatctacttttacttttcaaaaatgacagggcgcgcttatcccgaatgggcgggtaaattacacttttggatgatgtttattgggtctaatttgacattcttccctcagcacttcttagggcgtcaaggtatgccgagaagatacatcgactatcctgaagcatttgcttactggaacgtaatatcttcatacggagcatttcttgctttcgcttcatttctattctttttcggtataatattttattcattgtttttcggcgcccgacaaaatgctgcaaacccatggaatgaatacgctgatactttagaatggactttaccgtccccaccaccggagcatactttcgaaattttgcctgagcaaaaagattgggataagtcagaagctcactaaactgcacctttgtctcttttagtaacttgagacaaaggccctcttaagagcngctacaaaaaacattgatacttttgtaattgtaaaatgccttacgtttggagttgtaaagaagagcctgagtattgtttagagctttggccccatagctcgcttcctaataaaggatttgctatattcattataattacatttataatgctgaatttcccgctatatggccttcttggcactaaatacttttgggtcatattcaccttcctattcgttatgctggcttctgtttggtatgcattaagaagaaattataaagaccgaagaatcttggaaaagttaacgatcacatcagaactttgccggctccttagacaaaacccgaccggtgaacaccaaagttgggaatgtaacagatattggactaaaatttcactacatgagacaggtgggcccgtaccaaattatatcaccttgtccggcggtggccgtgtcgttgaaataggatcttttttatcagaaccagaaagaaaagacctttatttggaattaataaaggtgattaagaaatttaagtaataattaatttgatagtttccgtttgactattggaccaacacttccaaagtccatctgccctgtaaatcgttcttttaggcacgccattacgcgacccatatctctaatagaggaagcaccctgctcatctattactttggttacctctatctcaatctcttcactattaagttgccgaggcaaaaaatactcaattacttgtatttctgataactctcgttcggataaatccaacctaccagcttcctcataggttttagcgctttcctggcgttgacgggtcattttcccaagaattccaagtatttctgagtcgtcaaccccttcttcaacaccctccgctctagccgatatatctcgatctttgatcgcggcggttatcaaccgcaatgtagacaatcgtaattgagccttttccttcatagcttctttcagtgcggaatttatttcatttcgaagcgacatagtaccctccagaaaaggtaaaaacgtttttcttttttcattacatcatatcatcaacatccacatcaataaattaacatcaatctaaactcaagcttgaccattacaatgtctgagaatacggtctcgacgatttacatnttggagaatcaaggatgaaagattcttatgggaccaagcctactgcttgtctcgcactgtctgatggaacagttttttatggtgaaggctttggctcaactggacaaaaaaccgccgaattatgttttaacacatctatgactggatatcaggaaattttgaccgacccttcttatgctggccaaattgtgacttttacttttccgcatatcggaaacgtgggggtcaatctagaagataatgaagccaacatgccgttcgcttctgggatggtagtaaaatggcgcccaactttagcttcaaattggagatcacaacaaaatctaattgaatggttagaaaacaatgagcttatcgctattggtggaattgatacaagaagactaactaggataataagaaaacaaggagctccacatgttgcgatagagcacaatacagatggtgattttgatactgatagccttatcaatgatgctagaaacttcgcggggctttcaggcctcgatcttgcaaagaatgttacctcaagcaagacatatagttggagtcaagaccgctggagatggtctggagggtacagtaacattgaaaaaagcaaagcacgggttgtcgccatagactttggagttaaagaaaatatacttaggtgtttaacagcaattaaatgtgaagtaattgttctaccagccactgcaaccgctgaagaagttctagcttacgatccagatggtgtatttttatctaacggccctggggatccggaagcgacaggtaagtattctataaatatgattaaagaattattaaagcttcctgagttaccaatatttggtatttgccttgggcatcaaatgctcgcgttggct

SEQ ID NO: 1470 - DNA, 4000 bp, Escherichia coli
  misc_feature (229)..(229): n is a, c, g, or t
  misc_feature (274)..(274): n is a, c, g, or t
  misc_feature (367)..(367): n is a, c, g, or t
  misc_feature (370)..(370): n is a, c, g, or t
  misc_feature (379)..(379): n is a, c, g, or t
  misc_feature (807)..(807): n is a, c, g, or t
  misc_feature (881)..(881): n is a, c, g, or t
  misc_feature (1431)..(1431): n is a, c, g, or t
  misc_feature (1505)..(1505): n is a, c, g, or t
  misc_feature (1700)..(1700): n is a, c, g, or t
  misc_feature (1724)..(1724): n is a, c, g, or t
  misc_feature (1733)..(1733): n is a, c, g, or t
  misc_feature (1775)..(1775): n is a, c, g, or t
  misc_feature (2475)..(2475): n is a, c, g, or t
  misc_feature (2487)..(2487): n is a, c, g, or t
gagagccattggtatggcagagcgagcgctgcagttaatgattaaacgcagccttactagatctccctttggaaaagagctagcacgccaaggagtgattcaagagtggattgcaaaggcgcgtattgatatcgagcaggctcgcctactggtcttaaaaacagcgtggatcattgataatcaaggggcaaaggctgcgcgcaaagaaattgctgctattaaagtagtngttcctagaatggcagaggagataatcaataacgccattcaagcncatggcggagcaggtgttagccaagatactccccttgcagctatgtatgcaggagttcgaactttaagaattgttgatgggccagatgaagtncanatccgcganattgcaaggttagagctcaagtcctatctgccatgagtgatctcactccagttagagatgaagatgcatttgatatcggcaaagttcacacctggcttgcgccatatatagctcagagtgatataccagaagttttccaatttagatctggcgcatcaaatctgacctacttacttaaatatcctgatcgcaagttagttcttcgtcgtcccccagttggaacaaaagcagtttctgcccatgatatgaagcgagaatttctaattcaatctcgtctcaagtcggtatttgacttagttccgaatgtaattgcgctctgcgatgatcagagcattcttggttctgatttctatgtgatggaggcagttcaaggcgagatatttcgcagagatgttccagagacgttaacaaaagtagatatctccgtnatggctgactcgttagtttcgggtcttgccaggcttcacttagttgatgcctctgtattggcagaacttaatanagggcaaggctatgtagctcgccaagtagagggttggtcaagaagatatcgaaacgcactaactgatgatgtttatgatggcgaagatgtaatggcctggcttgatgctaataaaccagatgatgttggttcatgcatcattcacggtgattggcggatagataacatggtctttgatctaggcaagaaaaagctagtcggagtgctggattgggagctagccacagtcggtgatccgcttatggatctaggctccgcccttgcttattgggtcgatagagatgatgagccaatgtttgcctcacttcgccgtcaacctagccatcttgaggcaatgccgacacgaaaagaattcattgcaaagtaccttgagctaagtgatagaaagtgtgatgacttcacattctatgaagtctttggattatttagattaaccgtaattatccaacaaatctgggctcgatataaagcaggtcagaccacaaatcctgcctttaaaggattcggcatgggagttaacattttgattaatcgtgcgcaaggattgatntcatgaaagctggacggataacaatctcaactagaaagtttgaagttaaagaagttccaactcccaccgctggnattggagaggttcgcatcaaagtaggcgcagctggagtctgtctctctgatgttcacttacttgatggcactctctcccctggttatctaaaaggtgatgaagtaactattggccatgaggtggcaggaaccattgatcaaatcggtgctgaagtctctgaatgcaaagtaggagatcgagtaattgttatcgcnggacagcgaaatgttgcaaatcanattacaacncttggttttgattacgatggtggttatgccgagtatgtaatnactaaagcctcgctaaccgtcaagattcctgactcactcccctttgaagaagctgcaatcatccccgatgcagtatcgactccctgggctgcgatttcatcaactgcgaagatgcgagcaggtgagagcgctgcagtatttggaattggcggccttggaattcacgcagtccagctccttaaaatcattggctgcagcaaaataattgccattgatcctcgccgagaagcccgtgaaaaagccataaaattaggggcccactttgcctttgacccaagtgatgaagagctaaaaaagcatagggggctaaacgctgtctttgattttgcaggagtcacatcggtaagaaagcagggactttcactacttggcgagctgggcagattggtaattattggaatagctaatgaagcgatcactattccaaatgatatggcctttacctatatgagaacccaactccttggacattatggatctgagcgccatcacaccgaagaacttgtcgagatggttagggatggaagattaaagctatctgactcagttactcaaattctctcacttgatcaagcagctcttgcgctagaaacacttgagaagaaaatcggtaatccaatccgcatagttctaaaaccataaaaaatcctagccaaaaattacttggaagttttttagagcttaccgactaaaagttctnctagtatgatcnaaatatcacttgatgcaatctttactggctagattcgtactggcaagctaaggataacatttcgatcagagcgctctccctcattattttcaattgcaaaaattccgccgcgcctttgccaatcattaagcgagagaattcttgatagaccggagagttcatttacctcatcaagccttagatgttcatagtcaggaagtatcgagccgtggtgattaaagacagtactggcaatacagatctcatctctatcgtttatgaaaatctcaataattcgcccctgctgcggccaatcaatcagcgatgaagtttcgatttgataaaaaccattctgactattcggaccaaagtaggcgatacgatgacggtgagtatggccacagatccatgcaatgacagcaggattggaaattaggtagctctcaatttcgggccctaaaacacgttttcccgatggactgtacccgttatagatatcttgaattggatgatggctagtaattacgatatatcgatcttttatttgctctacttgctctttgagccaaataaattgtgcttcatcaattgagccttgccaaccgccaaatggatttactgtatctaaggcaaggatggttactgattcatagtcttttctccaatactttatgtcactgcctaaatactcacttgaaattccattatcttcatcttcacgataaaaattgatgttccatgcacttggagtgagaaaatctctagaatcatcagcgcttactttcaaaatctttggagcgattggagagggataagcagcaggtccttgttccgatactttagaaagcgctcctagcgcttcttcatctggtagctcaaaaatcttctcctctgacttcactgattgccgcagctcttcatttggggcgacagtgccttgaagaagtgcgtcatgatttccatgtactgctaggaatggatatttaagccctgaggagtgaaagggttgagagacagcatttaatagctctgggattgtgggaaagccatatagatccctagggaaatcatctctttcgccttttggtgttccatgtggattccagaaaaacggagagtaaaaatctcctcccaccccctgccatttatcttttgctccactatctgctcgaagttttccaccaactaataaagtagtgagccaatctaattcattggattgcgcattatcggttaagtctcctgtaattactacagcgctaatggctgtttttgttataggtgctaaatcaattcgatttattgcctgcactgcgctctctagtacttgtgtggtcaatatttcgtgagcccgataagttccaattaaggttccaatgacacttgatgctgggtgatgtgggtctgcataacgatctaggtattcaactctggcaggtgattgagcatcgcagatatgtgtatcagtaatgtgaatcaaatttattagggacttcttcacggcgcctaatggttgtccaagatgattatctac

SEQ ID NO: 1471 - DNA, 4000 bp, Escherichia coli
  misc_feature (1)..(8): n is a, c, g, or t
  misc_feature (11)..(11): n is a, c, g, or t
  misc_feature (13)..(13): n is a, c, g, or t
  misc_feature (15)..(18): n is a, c, g, or t
  misc_feature (21)..(25): n is a, c, g, or t
  misc_feature (27)..(32): n is a, c, g, or t
  misc_feature (35)..(43): n is a, c, g, or t
  misc_feature (45)..(46): n is a, c, g, or t
  misc_feature (48)..(48): n is a, c, g, or t
  misc_feature (52)..(53): n is a, c, g, or t
  misc_feature (55)..(58): n is a, c, g, or t
  misc_feature (60)..(62): n is a, c, g, or t
  misc_feature (65)..(66): n is a, c, g, or t
  misc_feature (68)..(74): n is a, c, g, or t
  misc_feature (76)..(76): n is a, c, g, or t
  misc_feature (78)..(82): n is a, c, g, or t
  misc_feature (84)..(84): n is a, c, g, or t
  misc_feature (87)..(91): n is a, c, g, or t
  misc_feature (93)..(95): n is a, c, g, or t
  misc_feature (97)..(100): n is a, c, g, or t
  misc_feature (102)..(102): n is a, c, g, or t
  misc_feature (105)..(109): n is a, c, g, or t
  misc_feature (111)..(111): n is a, c, g, or t
  misc_feature (113)..(118): n is a, c, g, or t
  misc_feature (120)..(123): n is a, c, g, or t
  misc_feature (125)..(125): n is a, c, g, or t
  misc_feature (127)..(129): n is a, c, g, or t
  misc_feature (131)..(137): n is a, c, g, or t
  misc_feature (140)..(140): n is a, c, g, or t
  misc_feature (142)..(143): n is a, c, g, or t
  misc_feature (145)..(146): n is a, c, g, or t
  misc_feature (148)..(149): n is a, c, g, or t
  misc_feature (151)..(156): n is a, c, g, or t
  misc_feature (158)..(158): n is a, c, g, or t
  misc_feature (160)..(160): n is a, c, g, or t
  misc_feature (162)..(162): n is a, c, g, or t
  misc_feature (164)..(167): n is a, c, g, or t
  misc_feature (169)..(170): n is a, c, g, or t
  misc_feature (172)..(174): n is a, c, g, or t
  misc_feature (177)..(186): n is a, c, g, or t
  misc_feature (189)..(189): n is a, c, g, or t
  misc_feature (192)..(193): n is a, c, g, or t
  misc_feature (195)..(196): n is a, c, g, or t
  misc_feature (199)..(200): n is a, c, g, or t
  misc_feature (203)..(203): n is a, c, g, or t
  misc_feature (206)..(211): n is a, c, g, or t
  misc_feature (213)..(215): n is a, c, g, or t
  misc_feature (218)..(218): n is a, c, g, or t
  misc_feature (222)..(223): n is a, c, g, or t
  misc_feature (225)..(228): n is a, c, g, or t
  misc_feature (231)..(234): n is a, c, g, or t
  misc_feature (236)..(236): n is a, c, g, or t
  misc_feature (238)..(238): n is a, c, g, or t
  misc_feature (241)..(241): n is a, c, g, or t
  misc_feature (246)..(246): n is a, c, g, or t
  misc_feature (249)..(265): n is a, c, g, or t
  misc_feature (267)..(272): n is a, c, g, or t
  misc_feature (274)..(275): n is a, c, g, or t
  misc_feature (277)..(279): n is a, c, g, or t
  misc_feature (283)..(283): n is a, c, g, or t
  misc_feature (288)..(289): n is a, c, g, or t
  misc_feature (291)..(292): n is a, c, g, or t
  misc_feature (294)..(294): n is a, c, g, or t
  misc_feature (297)..(301): n is a, c, g, or t
  misc_feature (303)..(305): n is a, c, g, or t
  misc_feature (308)..(313): n is a, c, g, or t
  misc_feature (315)..(315): n is a, c, g, or t
  misc_feature (317)..(319): n is a, c, g, or t
  misc_feature (321)..(321): n is a, c, g, or t
  misc_feature (324)..(325): n is a, c, g, or t
  misc_feature (327)..(330): n is a, c, g, or t
  misc_feature (332)..(334): n is a, c, g, or t
  misc_feature (339)..(339): n is a, c, g, or t
  misc_feature (341)..(343): n is a, c, g, or t
  misc_feature (346)..(357): n is a, c, g, or t
  misc_feature (360)..(361): n is a, c, g, or t
  misc_feature (363)..(365): n is a, c, g, or t
  misc_feature (367)..(368): n is a, c, g, or t
  misc_feature (370)..(370): n is a, c, g, or t
  misc_feature (372)..(378): n is a, c, g, or t
  misc_feature (380)..(381): n is a, c, g, or t
  misc_feature (383)..(385): n is a, c, g, or t
  misc_feature (390)..(390): n is a, c, g, or t
  misc_feature (392)..(392): n is a, c, g, or t
  misc_feature (394)..(395): n is a, c, g, or t
  misc_feature (397)..(399): n is a, c, g, or t
  misc_feature (401)..(403): n is a, c, g, or t
  misc_feature (405)..(405): n is a, c, g, or t
  misc_feature (408)..(410): n is a, c, g, or t
  misc_feature (414)..(414): n is a, c, g, or t
  misc_feature (416)..(420): n is a, c, g, or t
  misc_feature (422)..(424): n is a, c, g, or t
  misc_feature (426)..(426): n is a, c, g, or t
  misc_feature (428)..(430): n is a, c, g, or t
  misc_feature (436)..(441): n is a, c, g, or t
  misc_feature (443)..(443): n is a, c, g, or t
  misc_feature (445)..(446): n is a, c, g, or t
  misc_feature (450)..(452): n is a, c, g, or t
  misc_feature (454)..(456): n is a, c, g, or t
  misc_feature (460)..(464): n is a, c, g, or t
  misc_feature (466)..(466): n is a, c, g, or t
  misc_feature (468)..(470): n is a, c, g, or t
  misc_feature (472)..(476): n is a, c, g, or t
  misc_feature (479)..(480): n is a, c, g, or t
  misc_feature (482)..(482): n is a, c, g, or t
  misc_feature (484)..(486): n is a, c, g, or t
  misc_feature (488)..(488): n is a, c, g, or t
  misc_feature (490)..(491): n is a, c, g, or t
  misc_feature (493)..(493): n is a, c, g, or t
  misc_feature (495)..(496): n is a, c, g, or t
  misc_feature (499)..(499): n is a, c, g, or t
  misc_feature (501)..(501): n is a, c, g, or t
  misc_feature (503)..(508): n is a, c, g, or t
  misc_feature (513)..(515): n is a, c, g, or t
  misc_feature (518)..(519): n is a, c, g, or t
  misc_feature (521)..(521): n is a, c, g, or t
  misc_feature (524)..(533): n is a, c, g, or t
  misc_feature (535)..(537): n is a, c, g, or t
  misc_feature (542)..(542): n is a, c, g, or t
  misc_feature (544)..(544): n is a, c, g, or t
  misc_feature (547)..(550): n is a, c, g, or t
  misc_feature (553)..(558): n is a, c, g, or t
  misc_feature (560)..(567): n is a, c, g, or t
  misc_feature (569)..(570): n is a, c, g, or t
  misc_feature (574)..(575): n is a, c, g, or t
  misc_feature (577)..(580): n is a, c, g, or t
  misc_feature (582)..(584): n is a, c, g, or t
  misc_feature (588)..(591): n is a, c, g, or t
  misc_feature (593)..(596): n is a, c, g, or t
  misc_feature (598)..(599): n is a, c, g, or t
  misc_feature (601)..(608): n is a, c, g, or t
  misc_feature (610)..(611): n is a, c, g, or t
  misc_feature (613)..(614): n is a, c, g, or t
  misc_feature (616)..(622): n is a, c, g, or t
  misc_feature (624)..(627): n is a, c, g, or t
  misc_feature (629)..(632): n is a, c, g, or t
  misc_feature (634)..(634): n is a, c, g, or t
  misc_feature (636)..(636): n is a, c, g, or t
  misc_feature (638)..(639): n is a, c, g, or t
  misc_feature (641)..(642): n is a, c, g, or t
  misc_feature (644)..(647): n is a, c, g, or t
  misc_feature (650)..(651): n is a, c, g, or t
  misc_feature (654)..(656): n is a, c, g, or t
  misc_feature (659)..(663): n is a, c, g, or t
  misc_feature (665)..(669): n is a, c, g, or t
  misc_feature (671)..(672): n is a, c, g, or t
  misc_feature (674)..(678): n is a, c, g, or t
  misc_feature (682)..(682): n is a, c, g, or t
  misc_feature (685)..(686): n is a, c, g, or t
  misc_feature (688)..(690): n is a, c, g, or t
  misc_feature (692)..(692): n is a, c, g, or t
  misc_feature (694)..(694): n is a, c, g, or t
  misc_feature (697)..(697): n is a, c, g, or t
  misc_feature (701)..(705): n is a, c, g, or t
  misc_feature (707)..(708): n is a, c, g, or t
  misc_feature (710)..(716): n is a, c, g, or t
  misc_feature (720)..(721): n is a, c, g, or t
  misc_feature (723)..(727): n is a, c, g, or t
  misc_feature (730)..(731): n is a, c, g, or t
  misc_feature (733)..(733): n is a, c, g, or t
  misc_feature (736)..(736): n is a, c, g, or t
  misc_feature (741)..(741): n is a, c, g, or t
  misc_feature (745)..(749): n is a, c, g, or t
  misc_feature (751)..(752): n is a, c, g, or t
  misc_feature (754)..(755): n is a, c, g, or t
  misc_feature (758)..(759): n is a, c, g, or t
  misc_feature (761)..(764): n is a, c, g, or t
  misc_feature (766)..(768): n is a, c, g, or t
  misc_feature (770)..(772): n is a, c, g, or t
  misc_feature (774)..(780): n is a, c, g, or t
  misc_feature (782)..(783): n is a, c, g, or t
  misc_feature (788)..(790): n is a, c, g, or t
  misc_feature (792)..(797): n is a, c, g, or t
  misc_feature (799)..(813): n is a, c, g, or t
  misc_feature (817)..(819): n is a, c, g, or t
  misc_feature (822)..(822): n is a, c, g, or t
  misc_feature (824)..(824): n is a, c, g, or t
  misc_feature (826)..(827): n is a, c, g, or t
  misc_feature (830)..(830): n is a, c, g, or t
  misc_feature (832)..(833): n is a, c, g, or t
  misc_feature (835)..(835): n is a, c, g, or t
  misc_feature (838)..(846): n is a, c, g, or t
  misc_feature (848)..(849): n is a, c, g, or t
  misc_feature (851)..(853): n is a, c, g, or t
  misc_feature (856)..(856): n is a, c, g, or t
  misc_feature (858)..(862): n is a, c, g, or t
  misc_feature (865)..(865): n is a, c, g, or t
  misc_feature (868)..(868): n is a, c, g, or t
  misc_feature (870)..(870): n is a, c, g, or t
  misc_feature (874)..(877): n is a, c, g, or t
  misc_feature (880)..(882): n is a, c, g, or t
  misc_feature (884)..(884): n is a, c, g, or t
  misc_feature (892)..(892): n is a, c, g, or t
  misc_feature (894)..(894): n is a, c, g, or t
  misc_feature (896)..(897): n is a, c, g, or t
  misc_feature (900)..(901): n is a, c, g, or t
  misc_feature (904)..(907): n is a, c, g, or t
  misc_feature (910)..(910): n is a, c, g, or t
  misc_feature (912)..(913): n is a, c, g, or t
  misc_feature (918)..(919): n is a, c, g, or t
  misc_feature (921)..(923): n is a, c, g, or t
  misc_feature (926)..(929): n is a, c, g, or t
  misc_feature (931)..(937): n is a, c, g, or t
  misc_feature (940)..(949): n is a, c, g, or t
  misc_feature (952)..(953): n is a, c, g, or t
  misc_feature (955)..(955): n is a, c, g, or t
  misc_feature (959)..(961): n is a, c, g, or t
  misc_feature (963)..(964): n is a, c, g, or t
  misc_feature (968)..(968): n is a, c, g, or t
  misc_feature (972)..(974): n is a, c, g, or t
  misc_feature (978)..(978): n is a, c, g, or t
  misc_feature (980)..(980): n is a, c, g, or t
  misc_feature (983)..(983): n is a, c, g, or t
  misc_feature (985)..(985): n is a, c, g, or t
  misc_feature (992)..(993): n is a, c, g, or t
  misc_feature (995)..(995): n is a, c, g, or t
  misc_feature (997)..(999): n is a, c, g, or t
  misc_feature (1001)..(1001): n is a, c, g, or t
  misc_feature (1003)..(1004): n is a, c, g, or t
  misc_feature (1006)..(1007): n is a, c, g, or t
  misc_feature (1012)..(1013): n is a, c, g, or t
  misc_feature (1015)..(1016): n is a, c, g, or t
  misc_feature (1019)..(1022): n is a, c, g, or t
  misc_feature (1024)..(1024): n is a, c, g, or t
  misc_feature (1027)..(1027): n is a, c, g, or t
  misc_feature (1032)..(1032): n is a, c, g, or t
  misc_feature (1034)..(1036): n is a, c, g, or t
  misc_feature (1039)..(1040): n is a, c, g, or t
  misc_feature (1042)..(1042): n is a, c, g, or t
  misc_feature (1046)..(1047): n is a, c, g, or t
  misc_feature (1049)..(1049): n is a, c, g, or t
  misc_feature (1051)..(1051): n is a, c, g, or t
  misc_feature (1055)..(1058): n is a, c, g, or t
  misc_feature (1061)..(1061): n is a, c, g, or t
  misc_feature (1063)..(1065): n is a, c, g, or t
  misc_feature (1067)..(1067): n is a, c, g, or t
  misc_feature (1070)..(1074): n is a, c, g, or t
  misc_feature (1077)..(1077): n is a, c, g, or t
  misc_feature (1082)..(1083): n is a, c, g, or t
  misc_feature (1085)..(1085): n is a, c, g, or t
  misc_feature (1091)..(1092): n is a, c, g, or t
  misc_feature (1096)..(1097): n is a, c, g, or t
  misc_feature (1101)..(1103): n is a, c, g, or t
  misc_feature (1110)..(1110): n is a, c, g, or t
  misc_feature (1114)..(1114): n is a, c, g, or t
  misc_feature (1117)..(1119): n is a, c, g, or t
  misc_feature (1129)..(1129): n is a, c, g, or t
  misc_feature (1135)..(1135): n is a, c, g, or t
  misc_feature (1157)..(1157): n is a, c, g, or t
  misc_feature (1166)..(1166): n is a, c, g, or t
  misc_feature (1180)..(1180): n is a, c, g, or t
  misc_feature (1189)..(1189): n is a, c, g, or t
  misc_feature (1195)..(1198): n is a, c, g, or t
  misc_feature (1204)..(1206): n is a, c, g, or t
  misc_feature (1213)..(1213): n is a, c, g, or t
  misc_feature (1219)..(1219): n is a, c, g, or t
  misc_feature (1221)..(1221): n is a, c, g, or t
  misc_feature (1240)..(1240): n is a, c, g, or t
  misc_feature (1243)..(1243): n is a, c, g, or t
  misc_feature (1249)..(1249): n is a, c, g, or t
  misc_feature (1255)..(1255): n is a, c, g, or t
  misc_feature (1260)..(1260): n is a, c, g, or t
  misc_feature (1321)..(1321): n is a, c, g, or t
  misc_feature (1348)..(1348): n is a, c, g, or t
  misc_feature (1375)..(1375): n is a, c, g, or t
  misc_feature (1411)..(1411): n is a, c, g, or t
  misc_feature (1564)..(1564): n is a, c, g, or t
  misc_feature (1567)..(1568): n is a, c, g, or t
  misc_feature (1570)..(1570): n is a, c, g, or t
  misc_feature (1585)..(1586): n is a, c, g, or t
  misc_feature (1594)..(1594): n is a, c, g, or t
  misc_feature (1645)..(1645): n is a, c, g, or t
  misc_feature (1666)..(1666): n is a, c, g, or t
  misc_feature (1729)..(1729): n is a, c, g, or t
  misc_feature (1735)..(1735): n is a, c, g, or t
  misc_feature (1738)..(1738): n is a, c, g, or t
  misc_feature (1885)..(1885): n is a, c, g, or t
  misc_feature (1985)..(1985): n is a, c, g, or t
  misc_feature (1991)..(1991): n is a, c, g, or t
  misc_feature (2001)..(2001): n is a, c, g, or t
  misc_feature (2464)..(2464): n is a, c, g, or t
  misc_feature (3004)..(3004): n is a, c, g, or t
  misc_feature (3016)..(3016): n is a, c, g, or t
  misc_feature (3019)..(3019): n is a, c, g, or t
  misc_feature (3038)..(3041): n is a, c, g, or t
  misc_feature (3045)..(3045): n is a, c, g, or t
  misc_feature (3048)..(3049): n is a, c, g, or t
  misc_feature (3051)..(3051): n is a, c, g, or t
  misc_feature (3054)..(3054): n is a, c, g, or t
  misc_feature (3059)..(3062): n is a, c, g, or t
  misc_feature (3065)..(3065): n is a, c, g, or t
  misc_feature (3068)..(3076): n is a, c, g, or t
  misc_feature (3078)..(3079): n is a, c, g, or t
  misc_feature (3082)..(3082): n is a, c, g, or t
  misc_feature (3086)..(3086): n is a, c, g, or t
  misc_feature (3088)..(3088): n is a, c, g, or t
  misc_feature (3090)..(3090): n is a, c, g, or t
  misc_feature (3093)..(3095): n is a, c, g, or t
  misc_feature (3099)..(3099): n is a, c, g, or t
  misc_feature (3102)..(3102): n is a, c, g, or t
  misc_feature (3104)..(3109): n is a, c, g, or t
  misc_feature (3111)..(3114): n is a, c, g, or t
  misc_feature (3116)..(3119): n is a, c, g, or t
  misc_feature (3121)..(3121): n is a, c, g, or t
  misc_feature (3123)..(3123): n is a, c, g, or t
  misc_feature (3125)..(3126): n is a, c, g, or t
  misc_feature (3130)..(3130): n is a, c, g, or t
  misc_feature (3133)..(3136): n is a, c, g, or t
  misc_feature (3138)..(3139): n is a, c, g, or t
  misc_feature (3141)..(3145): n is a, c, g, or t
  misc_feature (3147)..(3147): n is a, c, g, or t
  misc_feature (3150)..(3152): n is a, c, g, or t
  misc_feature (3154)..(3160): n is a, c, g, or t
  misc_feature (3162)..(3174): n is a, c, g, or t
  misc_feature (3177)..(3178): n is a, c, g, or t
  misc_feature (3180)..(3180): n is a, c, g, or t
  misc_feature (3184)..(3190): n is a, c, g, or t
  misc_feature (3193)..(3194): n is a, c, g, or t
  misc_feature (3197)..(3204): n is a, c, g, or t
  misc_feature (3207)..(3210): n is a, c, g, or t
  misc_feature (3212)..(3216): n is a, c, g, or t
  misc_feature (3218)..(3218): n is a, c, g, or t
  misc_feature (3222)..(3222): n is a, c, g, or t
  misc_feature (3224)..(3226): n is a, c, g, or t
  misc_feature (3228)..(3229): n is a, c, g, or t
  misc_feature (3231)..(3240): n is a, c, g, or t
  misc_feature (3242)..(3252): n is a, c, g, or t
  misc_feature (3258)..(3261): n is a, c, g, or t
  misc_feature (3263)..(3265): n is a, c, g, or t
  misc_feature (3271)..(3272): n is a, c, g, or t
  misc_feature (3274)..(3274): n is a, c, g, or t
  misc_feature (3277)..(3277): n is a, c, g, or t
  misc_feature (3279)..(3282): n is a, c, g, or t
  misc_feature (3284)..(3284): n is a, c, g, or t
  misc_feature (3286)..(3292): n is a, c, g, or t
  misc_feature (3294)..(3295): n is a, c, g, or t
  misc_feature (3298)..(3298): n is a, c, g, or t
  misc_feature (3300)..(3303): n is a, c, g, or t
  misc_feature (3305)..(3305): n is a, c, g, or t
  misc_feature (3308)..(3308): n is a, c, g, or t
  misc_feature (3311)..(3314): n is a, c, g, or t
  misc_feature (3316)..(3316): n is a, c, g, or t
  misc_feature (3321)..(3321): n is a, c, g, or t
  misc_feature (3324)..(3329): n is a, c, g, or t
  misc_feature (3332)..(3334): n is a, c, g, or t
  misc_feature (3336)..(3337): n is a, c, g, or t
  misc_feature (3341)..(3341): n is a, c, g, or t
  misc_feature (3344)..(3344): n is a, c, g, or t
  misc_feature (3346)..(3346): n is a, c, g, or t
  misc_feature (3348)..(3349): n is a, c, g, or t
  misc_feature (3351)..(3351): n is a, c, g, or t
  misc_feature (3353)..(3355): n is a, c, g, or t
  misc_feature (3359)..(3361): n is a, c, g, or t
  misc_feature (3363)..(3363): n is a, c, g, or t
  misc_feature (3365)..(3368): n is a, c, g, or t
  misc_feature (3370)..(3370): n is a, c, g, or t
  misc_feature (3372)..(3375): n is a, c, g, or t
  misc_feature (3377)..(3379): n is a, c, g, or t
  misc_feature (3381)..(3385): n is a, c, g, or t
  misc_feature (3387)..(3387): n is a, c, g, or t
  misc_feature (3389)..(3392): n is a, c, g, or t
  misc_feature (3394)..(3395): n is a, c, g, or t
  misc_feature (3397)..(3398): n is a, c, g, or t
  misc_feature (3400)..(3401): n is a, c, g, or t
  misc_feature (3403)..(3404): n is a, c, g, or t
  misc_feature (3406)..(3408): n is a, c, g, or t
  misc_feature (3410)..(3415): n is a, c, g, or t
  misc_feature (3417)..(3419): n is a, c, g, or t
  misc_feature (3421)..(3436): n is a, c, g, or t
  misc_feature (3439)..(3440): n is a, c, g, or t
  misc_feature (3442)..(3443): n is a, c, g, or t
  misc_feature (3445)..(3445): n is a, c, g, or t
  misc_feature (3447)..(3448): n is a, c, g, or t
  misc_feature (3450)..(3453): n is a, c, g, or t
  misc_feature (3456)..(3459): n is a, c, g, or t
  misc_feature (3461)..(3464): n is a, c, g, or t
  misc_feature (3466)..(3468): n is a, c, g, or t
  misc_feature (3473)..(3476): n is a, c, g, or t
  misc_feature (3478)..(3481): n is a, c, g, or t
  misc_feature (3483)..(3490): n is a, c, g, or t
  misc_feature (3493)..(3493): n is a, c, g, or t
  misc_feature (3495)..(3495): n is a, c, g, or t
  misc_feature (3497)..(3502): n is a, c, g, or t
  misc_feature (3504)..(3507): n is a, c, g, or t
  misc_feature (3509)..(3509): n is a, c, g, or t
  misc_feature (3511)..(3512): n is a, c, g, or t
  misc_feature (3514)..(3516): n is a, c, g, or t
  misc_feature (3518)..(3520): n is a, c, g, or t
  misc_feature (3522)..(3523): n is a, c, g, or t
  misc_feature (3525)..(3525): n is a, c, g, or t
  misc_feature (3527)..(3527): n is a, c, g, or t
  misc_feature (3531)..(3531): n is a, c, g, or t
  misc_feature (3534)..(3534): n is a, c, g, or t
  misc_feature (3536)..(3536): n is a, c, g, or t
  misc_feature (3538)..(3538): n is a, c, g, or t
  misc_feature (3540)..(3542): n is a, c, g, or t
  misc_feature (3545)..(3548): n is a, c, g, or t
  misc_feature (3550)..(3552): n is a, c, g, or t
  misc_feature (3558)..(3559): n is a, c, g, or t
  misc_feature (3562)..(3566): n is a, c, g, or t
  misc_feature (3569)..(3569): n is a, c, g, or t
  misc_feature (3572)..(3572): n is a, c, g, or t
  misc_feature (3574)..(3576): n is a, c, g, or t
  misc_feature (3581)..(3581): n is a, c, g, or t
  misc_feature (3583)..(3583): n is a, c, g, or t
  misc_feature (3586)..(3586): n is a, c, g, or t
  misc_feature (3588)..(3588): n is a, c, g, or t
  misc_feature (3590)..(3591): n is a, c, g, or t
  misc_feature (3593)..(3596): n is a, c, g, or t
  misc_feature (3599)..(3602): n is a, c, g, or t
  misc_feature (3604)..(3607): n is a, c, g, or t
  misc_feature (3611)..(3611): n is a, c, g, or t
  misc_feature (3613)..(3614): n is a, c, g, or t
  misc_feature (3617)..(3617): n is a, c, g, or t
  misc_feature (3624)..(3625): n is a, c, g, or t
  misc_feature (3627)..(3627): n is a, c, g, or t
  misc_feature (3630)..(3630): n is a, c, g, or t
  misc_feature (3633)..(3634): n is a, c, g, or t
  misc_feature (3637)..(3639): n is a, c, g, or t
  misc_feature (3641)..(3641): n is a, c, g, or t
  misc_feature (3643)..(3646): n is a, c, g, or t
  misc_feature (3648)..(3650): n is a, c, g, or t
  misc_feature (3653)..(3656): n is a, c, g, or t
  misc_feature (3659)..(3670): n is a, c, g, or t
  misc_feature (3672)..(3672): n is a, c, g, or t
  misc_feature (3674)..(3675): n is a, c, g, or t
  misc_feature (3678)..(3679): n is a, c, g, or t
  misc_feature (3681)..(3683): n is a, c, g, or t
  misc_feature (3685)..(3686): n is a, c, g, or t
  misc_feature (3688)..(3688): n is a, c, g, or t
  misc_feature (3690)..(3692): n is a, c, g, or t
  misc_feature (3694)..(3694): n is a, c, g, or t
  misc_feature (3696)..(3696): n is a, c, g, or t
  misc_feature (3699)..(3701): n is a, c, g, or t
  misc_feature (3703)..(3703): n is a, c, g, or t
  misc_feature (3705)..(3707): n is a, c, g, or t
  misc_feature (3709)..(3711): n is a, c, g, or t
  misc_feature (3714)..(3717): n is a, c, g, or t
  misc_feature (3719)..(3720): n is a, c, g, or t
  misc_feature (3723)..(3724): n is a, c, g, or t
  misc_feature (3726)..(3726): n is a, c, g, or t
  misc_feature (3728)..(3728): n is a, c, g, or t
  misc_feature (3730)..(3732): n is a, c, g, or t
  misc_feature (3734)..(3741): n is a, c, g, or t
  misc_feature (3743)..(3744): n is a, c, g, or t
  misc_feature (3746)..(3746): n is a, c, g, or t
  misc_feature (3749)..(3753): n is a, c, g, or t
  misc_feature (3755)..(3755): n is a, c, g, or t
  misc_feature (3757)..(3758): n is a, c, g, or t
  misc_feature (3760)..(3760): n is a, c, g, or t
  misc_feature (3762)..(3763): n is a, c, g, or t
  misc_feature (3766)..(3779): n is a, c, g, or t
  misc_feature (3781)..(3793): n is a, c, g, or t
  misc_feature (3795)..(3800): n is a, c, g, or t
  misc_feature (3802)..(3804): n is a, c, g, or t
  misc_feature (3806)..(3809): n is a, c, g, or t
  misc_feature (3811)..(3812): n is a, c, g, or t
  misc_feature (3814)..(3818): n is a, c, g, or t
  misc_feature (3820)..(3822): n is a, c, g, or t
  misc_feature (3824)..(3824): n is a, c, g, or t
  misc_feature (3827)..(3842): n is a, c, g, or t
  misc_feature (3844)..(3853): n is a, c, g, or t
  misc_feature (3855)..(3864): n is a, c, g, or t
  misc_feature (3866)..(3869): n is a, c, g, or t
  misc_feature (3873)..(3873): n is a, c, g, or t
  misc_feature (3875)..(3892): n is a, c, g, or t
  misc_feature (3894)..(3896): n is a, c, g, or t
  misc_feature (3898)..(3900): n is a, c, g, or t
  misc_feature (3902)..(3905): n is a, c, g, or t
  misc_feature (3907)..(3908): n is a, c, g, or t
  misc_feature (3910)..(3912): n is a, c, g, or t
  misc_feature (3915)..(3920): n is a, c, g, or t
  misc_feature (3922)..(3922): n is a, c, g, or t
  misc_feature (3924)..(3925): n is a, c, g, or t
  misc_feature (3927)..(3928): n is a, c, g, or t
  misc_feature (3930)..(3940): n is a, c, g, or t
  misc_feature (3942)..(3945): n is a, c, g, or t
  misc_feature (3947)..(3954): n is a, c, g, or t
  misc_feature (3957)..(3968): n is a, c, g, or t
  misc_feature (3970)..(3976): n is a, c, g, or t
  misc_feature (3978)..(3979): n is a, c, g, or t
  misc_feature (3981)..(3992): n is a, c, g, or t
  misc_feature (3994)..(4000): n is a, c, g, or t
nnnnnnnnccntngnnnnggnnnnncnnnnnnccnnnnnnnnnanngncccnntnnnnannnaanncnnnnnnncngnnnnncnggnnnnntnnncnnnngncannnnncngnnnnnncnnnncntnnngnnnnnnnttncnnannanncnnnnnngncngncnnnncnncnnnaannnnnnnnnnggncgnnannaannaanccnnnnnncnnnttncggnngnnnncannnngnangcnaaggncgnnnnnnnnnnnnnnnnncnnnnnntnntnnncccngaaannanncnggnnnnncnnncgnnnnnntncnnngnggnngnnnncnnnaaaantnnnttnnnnnnnnnnnnttnngnnnannancnnnnnnngnncnnnaaaangncnntnnngnnncnggnnnaaangnnnnngnnntngnnnaaaaannnnnncntnnaaannntnnntttnnnnncngnnncnnnnncgnngnannngnannangnnggncntnnnnnnggaannnaanncnttnnnnnnnnnnannngcccntnggnnnnccnnnnnncnnnnnnnntnnaaanngnnnngnnnaaannnntnnnngnnannnnnnnnanncnngnnnnnnncnnnncnnnnangnanntnncnnnnccnnccnnnacnnnnncnnnnncnntnnnnntttnaanngnnnancnccnggtnnnnncnntnnnnnnnaaanngnnnnnccnnanggntaaantttnnnnntnnannaanncnnnnannncnnngnnnnnnncnnccccnnncnnnnnngnnnnnnnnnnnnnnnaaannnttngngnnacngnngnaannnnnnnnncnncnnngangnnnnngtnggntnaaannnnttnnntnaaactttntncnnaannttnnnnggncnncgggnnannnccnnnngnnnnnnnccnnnnnnnnnnaanncntttnnntnncccnaaannnaggncnggnanaaaccanngntnnncntnncnntaaannannccnnnnanttnttcgncnnnggnngncccnntnangggnnnnccntnnnanttnnnnnggnaaatnnanaaaagnnaaanntttnnnaaagagngaanaannntatgaactanaccganatcaacgccaaaatcgtggacngctgggtgnaaaacggctgggantggggcaancccatnnnncacgannngtttganaaagcnanaaacggcgaatggggcgtntanctcacnccgacnaaaancgtgccgcacgaatggttcggcgagatgcgcggcaagaaaattctgggtttagccagcggnggcgggcagcagattcccgttttcacngcgctcggcgcagactgcaccgtgctngattattccacggagcagctaaagcgcgaagaagangtcggcaagcgggagggctatactccaaagtgcgtccgcgccgatatgacaaagcccctgccgtttgaagacgggacctttgacctcatttttaacccggtttcaaattgttatgtagaagaactggagccgatctggaaagagtgcgcccgngtnntnaagccgggcggcgtnntgcttgtngggtttgataacggcatcaattacctttttgatgacgacgaaacgaagatnacgaacacgctgccgtataancccttaaaagacgaagcactctataaaaagtcgctggagctcgattacggcgtgcagttttcncacacnctngacgaagaaatcggcggccagctgcgcgcgggatttatgctgacggatatttatgaagacacaaacggcggaggctttctgcacgagcacggcgtgccctgctttgtcgcaacgcgctgtgtgaaaaagtaatagctgaataaaaancgtaaaaagcacggctttcccgaaaaacggcggaaaagctgtgctttttaaattttgccgcaaaaatattttttgaaatcgcacattcaaaaataagagnataaangagaaaaacnaagaataaacgagattagaattcgcagcttaaaaaaccgcaaaaaagcgcttgacaagccgtttttcgtgtggtactatcatttagcgcccatgggaaagctatgggcattttcagagatttcgtatcgcagcgcacaaagcgtttgccggtaccgagataatttaaatcaattttggaggtaaacgctatgtccacttatatggccaaggctggtcaggttgaccgcaaatggtatgtaattgacgctgcaggcaagccgctcggccgcgttgcagcacaggccgcagttcttctccgcggcaagcacaagcccacctttaccccgcacgttgactgcggtgaccacgtcatcatcatcaactgcgctgaggctgtcctcaccggcggtaaggctgaaaagaagtattattatcatcacacgggttatatcggccacctcaaggctgtccgttatgacaccntgatgcgcacaaagccggaaaaggcgatggagcttgctgttcacggcatgatcccctcgaacaccatcggcagagctgcagaagcaagacttcgtgtctacgccggcagcgagcacaagcacgaggcgcagaagccgacggcttgggaactttaataggaggtaaacgaatatgtacgataaggcaccttatttctacggcaccggcagaagaaaaagctccgttgcacgtgtaagaatttaccagggcaccggtaaggtcacgatcaacgaccgcgatatcgacgattatttcggccttgataccctcaagacgatcgttcgtcagccgctcgttctcaccggtaccgaagagaagttcgacatcgtttgccgcgttgcaggcggcggtgttaccggtcaggccggtgctatccgccacggtatctccagagctctgctccagtacgattccgagaacctccgcgctacgctgaagaaggccggtttcctcacccgtgacccgagaatgaaggaaagaaagaagtacggtctcaaagcngctcgtcgcgcnccncagttctccaagagataannnncccnacnnancanttcannnntgntcnnnnnnnnngnnacnatgngntnttnnnggcnttntnnnnnntnnnnannnngntntnntttntcnnnntnngnnnnnanttnnncnnnnnnnannnnnnnnnnnnngannanaaannnnnnnacnngcnnnnnnnnacnnnntnnnnntnaaanannngnncnnnnnnnnnngnnnnnnnnnnntttttnnnngnnnttttcnncnttntnnnntncnnnnnnnanngtntnnnntnccnggnnnntnttttnaannnnnnggnnngnnttgncangntnngncnnnaccnnntncnnnntntnnnntnnntnnnnntngnnnntnntnngnntnnannngnnnnnntnnngnnnnnnnnnnnnnnnntgnncnntncnnannnnctnnnngnnnnannnaggcnnnncnnnngnnnnnnnnganantnnnnnnannnntnanncnnncnnnanncngnattntgntncngnnnctnnnnannntgcgcnntgnnnnnctnagngnnnaccgngncancngnngnnnngannnncnnnngctnanngcnatgtgcnncncgntgnngannntntnnnntnnnatnnnnctnnnnnnnnnnnngntnnttnntnnnannangnnnangncgnnntntnnntnnncannnntnncanntncncnnncnnnnnnnncnncngtnnnnncngnngncnnaannnnnnnnnnnnnngnnnnnnnnnnnnntnnnnnnannnannnncnncnnnnnannngnccnnnnnnnnnnnnnnnncnnnnnnnnnngnnnnnnnnnnannnncacnannnnnnnnnnnnnnnnnntnnnannncnnnntnngnnnaannnnnngntnntnnannnnnnnnnnnannnngnnnnnnnnacnnnnnnnnnnnngnnnnnnnannannnnnnnnnnnngnnnnnnn

SEQ ID NO: 1472 - DNA, 4000 bp, Escherichia coli
  misc_feature (15)..(15): n is a, c, g, or t
  misc_feature (106)..(106): n is a, c, g, or t
  misc_feature (338)..(338): n is a, c, g, or t
  misc_feature (1569)..(1569): n is a, c, g, or t
  misc_feature (1705)..(1705): n is a, c, g, or t
  misc_feature (1735)..(1735): n is a, c, g, or t
  misc_feature (1774)..(1774): n is a, c, g, or t
  misc_feature (1987)..(1987): n is a, c, g, or t
  misc_feature (1991)..(1991): n is a, c, g, or t
  misc_feature (2004)..(2004): n is a, c, g, or t
  misc_feature (2008)..(2008): n is a, c, g, or t
  misc_feature (2184)..(2184): n is a, c, g, or t
  misc_feature (2194)..(2194): n is a, c, g, or t
  misc_feature (2197)..(2197): n is a, c, g, or t
  misc_feature (2203)..(2203): n is a, c, g, or t
  misc_feature (2215)..(2215): n is a, c, g, or t
  misc_feature (2218)..(2218): n is a, c, g, or t
  misc_feature (2230)..(2230): n is a, c, g, or t
  misc_feature (2235)..(2235): n is a, c, g, or t
  misc_feature (2260)..(2260): n is a, c, g, or t
  misc_feature (2264)..(2265): n is a, c, g, or t
  misc_feature (2280)..(2281): n is a, c, g, or t
  misc_feature (2299)..(2299): n is a, c, g, or t
  misc_feature (2313)..(2313): n is a, c, g, or t
  misc_feature (2329)..(2329): n is a, c, g, or t
  misc_feature (2332)..(2334): n is a, c, g, or t
  misc_feature (2338)..(2338): n is a, c, g, or t
  misc_feature (2342)..(2342): n is a, c, g, or t
  misc_feature (2344)..(2344): n is a, c, g, or t
  misc_feature (2353)..(2353): n is a, c, g, or t
  misc_feature (2359)..(2359): n is a, c, g, or t
  misc_feature (2364)..(2364): n is a, c, g, or t
  misc_feature (2371)..(2371): n is a, c, g, or t
  misc_feature (2389)..(2389): n is a, c, g, or t
  misc_feature (2407)..(2407): n is a, c, g, or t
  misc_feature (2412)..(2413): n is a, c, g, or t
  misc_feature (2424)..(2425): n is a, c, g, or t
  misc_feature (2739)..(2739): n is a, c, g, or t
  misc_feature (2844)..(2844): n is a, c, g, or t
  misc_feature (2864)..(2865): n is a, c, g, or t
  misc_feature (2871)..(2871): n is a, c, g, or t
  misc_feature (2880)..(2880): n is a, c, g, or t
  misc_feature (2885)..(2885): n is a, c, g, or t
  misc_feature (2889)..(2889): n is a, c, g, or t
  misc_feature (3782)..(3782): n is a, c, g, or t
  misc_feature (3792)..(3792): n is a, c, g, or t
  misc_feature (3806)..(3806): n is a, c, g, or t
  misc_feature (3809)..(3809): n is a, c, g, or t
  misc_feature (3812)..(3812): n is a, c, g, or t
  misc_feature (3815)..(3815): n is a, c, g, or t
  misc_feature (3821)..(3821): n is a, c, g, or t
  misc_feature (3823)..(3823): n is a, c, g, or t
  misc_feature (3830)..(3830): n is a, c, g, or t
  misc_feature (3833)..(3833): n is a, c, g, or t
  misc_feature (3836)..(3838): n is a, c, g, or t
  misc_feature (3845)..(3851): n is a, c, g, or t
  misc_feature (3856)..(3856): n is a, c, g, or t
  misc_feature (3858)..(3859): n is a, c, g, or t
  misc_feature (3861)..(3861): n is a, c, g, or t
  misc_feature (3863)..(3863): n is a, c, g, or t
  misc_feature (3865)..(3866): n is a, c, g, or t
  misc_feature (3874)..(3874): n is a, c, g, or t
  misc_feature (3878)..(3878): n is a, c, g, or t
  misc_feature (3880)..(3880): n is a, c, g, or t
  misc_feature (3882)..(3882): n is a, c, g, or t
  misc_feature (3884)..(3884): n is a, c, g, or t
  misc_feature (3886)..(3887): n is a, c, g, or t
  misc_feature (3889)..(3889): n is a, c, g, or t
  misc_feature (3892)..(3893): n is a, c, g, or t
  misc_feature (3895)..(3895): n is a, c, g, or t
  misc_feature (3897)..(3897): n is a, c, g, or t
  misc_feature (3899)..(3899): n is a, c, g, or t
  misc_feature (3902)..(3907): n is a, c, g, or t
  misc_feature (3913)..(3920): n is a, c, g, or t
  misc_feature (3922)..(3929): n is a, c, g, or t
  misc_feature (3931)..(3932): n is a, c, g, or t
  misc_feature (3934)..(3943): n is a, c, g, or t
  misc_feature (3945)..(3954): n is a, c, g, or t
  misc_feature (3956)..(3958): n is a, c, g, or t
  misc_feature (3960)..(3962): n is a, c, g, or t
  misc_feature (3964)..(3964): n is a, c, g, or t
  misc_feature (3967)..(3974): n is a, c, g, or t
  misc_feature (3976)..(3982): n is a, c, g, or t
  misc_feature (3984)..(3985): n is a, c, g, or t
  misc_feature (3987)..(3988): n is a, c, g, or t
  misc_feature (3990)..(3997): n is a, c, g, or t
  misc_feature (3999)..(4000): n is a, c, g, or t
gttaaataaatatcncctgcatcgcccgtgccgtcagccagacttggaatgttagttgtagcgttccaagttcctttgaattccattacagttgacggaagttgcnctgctggtatttttccgccattatccaaagtcgctactccgctattagcacctttttcgcttgcctgaatataagtttttaagtctgagatttggctttctgttatgcttatccctgtgcttttatcccaagctgtgaatactgggtctgtttcgctttgcaaggctgttgcgattaaactatggtcaaatgaactaagatgtcctgatagggagtttgaagccgaattganagggtcgtaaagtcctgcgtggtcgccccaaccataggcggtattccaattttctatttgagtagcatttgtaaatttattggttgtagcagcatcatctaagtcgtcagggtccaaagttttccattcattatcaaaatctacattagaagctttggccaaaacttgtccagtagttcctcccgtaatagcaccgtttccctttaaagataataactgccagtaagttgtgtcagtcggcaggttgccagttgactcttgaattgcaacataagaagaaccaagataagaaacgctttccccagtgttatatgtaacatcagcagcataaacacctttaggcgttattcctcctgtgaagttaagatgaactgggttgtcaattagttttactatttccatattataatattgttacaccagtaaatattccatctgtataaattagtgtttctgtagccaccgttgctcctgctaacttatagacgatagaagttagaacgccatcggtatagacgagttctttagtatcgtgcttagggatgtttagacctgctattgactgaatagtttcttcggtggctggtgtcattcttacctctctgccattgatgagcctcttgataccaacaacatctggtccacctccaccaccaaatgacttatcattgagtttctgcaagagttttgtaacttctcttaactgactgactgctttctcgtcgcttcgtggtgttagctctttaatctgcttctcaggaagtgggtattcttttggtagatcgattctcttctgctctggtatctcgattgaatcgatcgaagacacaattgacttcaagagagagacgactttcgaaagatcaactggctcattctttagctttctgagatctgacgataagctcgtaattgctctctcaatcttcgatgtatcaagcttcgtctctttagcagatatcttcttcagaatcctcttgacgtctactagaacattcgagagagacgtaacgtctgtcttctcaaacttgagattattcagagcatctacgatctctttattgcttgtaggttctagcgtcttcgctacatcattaaatgcatttatgactctattgacgtttgtctctagatttgttacgatcattccttccatagaaaatgcttaattctgcccagaagccagaaacttctgagcagtataaacaacctattaaacagcaatctggangtccaagaaagttctagcaccgtcagcaaatgtcttgtagccgtataaggcatcaatcaagaagttgacagtcttctgtcttggttctgggcgtggatcaggattgatatcgctttggataaccatatcaacaccnttctttctgccagcatagcagtgaatcatnttcttgctccagatatttgaagcatgagtcaaagtctcngtaacagataagcgaccagagcctgtacagactaagttaacagaagtgccagaagcagaagcaacgactctccagccgattaacttcttcctgtcagcatcagaaacctcagtataagtagtaccagcaccagcagcattgttgatagcagcgatcaagttagctctcgaagcagcagcgttagcaccggctaaaacttcaccagcaacagcngggnttgagcttagagnaganacaaacttgaatacaacgcctccaatcgaaacagtatcagtagcagtaacatcttgagctagagatagagaagcagtgaaagtcaagttgttagaacgataagttctgaaaccaacgatagggccagaatagccgttcttgaaagtagtaccggtcatctcgatattcttacctancaaagtttgnttngcaatngataagacgtanggntcagtgactagnactangtctccgttatcttcaacatcgttngcanntaacttagcacctanntctgagaagacctgagcnaagttagttgtggncagagcgataccgttnccnnnagtnccancnatatcaccntcgtcnaatgnatcgaangcatttagagtctgaccnaggatgtcagcatccatntaccnncgtaatttcanngtgcactctttagcagcaagttcaccaatcttgcgtgggccgttctgtaacttatcccagctatcaagtttgaagtcagcagacttctgtttgtcaattgtcaactgctcgttagaatcaccaacaccgttgatagtacgatcagtgtaccgagtgacgtctctcacatagatgtcagagaagtcagcaatggaacgactaacagttttaccttcagttaactgtgactgtaagcgagtgttgccaactacaaaaccaaccatcgtcttaccaagaatgtcctggtagcgaggtacaaatgcttccttaaatgnagttaaagcagacatagttaattagcttattgaccttgtgaatctaaccactcgtagtacttagtacgagattctggatttgccaatactttcttataagtctcntcgtccatcgtagcgaagtnnacattntctggtgcnttagnactngcaccttgagaaccagcttctggagagtctttcttcgttttcttctctttcgttgcattaggatagaattcttttcgaatgtcttcaagagtctttagatgtaagaagtctttgctaaatgcaatcttctgaaagacatccttctttccagctagttctggatacttagaagcgattgacttttcaaaatctgcttcgaatagagcaatgctctcttcagctagattgttcttagcaaccggcttaatcttctcctcaacttcttgaagaacttcttccttcgtcttcgtttgaatcatctttacgaatttcttggctacatctagctcgataccagcagcttgagcgaattcatcaatgtctttgtttgttaaatcaccagagagttgctccttcagagccttaaagtctctctttaattcaagaaagacgctaagaggaactgtgtcacttgaagactctttcttagccttcttctctccagtcggccgataagatgtgtctggttcatcgccttcttcatcttcgtcgtcctcggtgtctttaggatcaccttctccttcctggtctttctttcccgactgaccagattcgtcgtcttcgtgagaatcgagtccattcataatttcttcgattggctcactgttgctcttttcattgggcataaattagtagatcactaatcgagatagctatcaaggttgctaacctgtaataaccagtttcaagacgtagcggtctgtatttaataattaacttaaaagcgaggtaatagcggagaagtctgaacgtttagcttattagcataagcaatcgctgactccttcgggttctcgacaccatctttctcagaataaactctgagtaaacctttctctgaagaatagacaccntaagcatctntcttcgaagacatngcnctnacnacgaancnagcagcnacngtnnnttcttcnnnnnnnacagntnncngntnntcgtctangtcntngncntnntnttnntngncnttnnnnnnttgtcnnnnnnnnannnnnnnnannannnnnnnnnnannnnnnnnnngnnntnnnancannnnnnnnannnnnnntnntnntnnnnnnnncnn

SEQ ID NO: 1473 - DNA, 4000 bp, Escherichia coli
  misc_feature (597)..(597): n is a, c, g, or t
  misc_feature (697)..(697): n is a, c, g, or t
  misc_feature (899)..(899): n is a, c, g, or t
  misc_feature (941)..(941): n is a, c, g, or t
  misc_feature (1667)..(1667): n is a, c, g, or t
  misc_feature (1961)..(1961): n is a, c, g, or t
  misc_feature (1963)..(1964): n is a, c, g, or t
  misc_feature (1992)..(1992): n is a, c, g, or t
  misc_feature (2018)..(2018): n is a, c, g, or t
  misc_feature (2628)..(2628): n is a, c, g, or t
  misc_feature (3111)..(3111): n is a, c, g, or t
  misc_feature (3123)..(3123): n is a, c, g, or t
  misc_feature (3578)..(3578): n is a, c, g, or t
  misc_feature (3644)..(3644): n is a, c, g, or t
cgcgagaccatctcgcgcgaagcagaaatcacctacacccacaagaagcagtccggtggttccggtcagttcgccgaagtgaagatgatcctgatgccaaccgagccaggcgaaggctattccttcgagagccgcatcgttggtggtgccgttccgaaagaatacatcccgggcgtcgaaaaagggatcaactcggtcatggactccggtcctttggcgggcttcccggtcatcgacttcaaggttgctctgatcgacggtaaattccacgacgttgactccagcgttcttgcgtttgaaatcgcggcccgtatgggtatgcgcgaaggcatgcgtaaagctggtgcgaaactgctcgaaccgatcatgaaagtcgaagttatcactcctgaggattacacaggcgggatcatcggcgatctgacatcgcgtcgcggtcaggttcagggtcaggacacacgcgggaacgcaatcgcgatcgacgcacaggtgccgctggccaacatgttcggctacatcaacacgctgcgttcgatgtcgtcgggtcgtgcgaacttcaccatgcagttctcgcactacgaacctgttccgcagaanatctctgacgagatccaagcgaaattcgcgtaactggcgcgttgcaataactgggacggcggggataaccccgccctacccaaaccgtagggtgggtgtncaacccaccgcccaatttgaaaaccaaggaggccaccatggctaaggcaaagtttgaacgtaataaaccacacgttaacatcggtaccattggtcacgttgaccacggcaaaaccacgttgaccgcggcgatcaccaagtacttcggcgacttccgcgcctatgaccagattgacggcgcgcccgaagaaaaagcacgcggnatcaccatctcgaccgcacacgttgagtatgagaccgaaggncgtcactacgcccacgtcgactgcccaggccacgctgactatgtgaaaaacatgatcaccggtgcggcgcagatggacggcgcgatcctggttgtgaacgctgctgatggccccatgccacagacccgcgagcacatcctgctgggccgtcaggtcggcatccccgccatggttgtctacatgaacaaagtagaccaggtggacgatgaagagctgctggaactggttgaaatggaaatccgcgaactgctgtcttcctacgactacccaggcgacgacatccctgtgatcccaggttccgctctggcggcgatggaaggccgtgacgagaacatcggcgagaactccatccgcaagctgatggaagaagtcgacaactacatcccgacaccagagcgcgctgttgaccagccgttcctgatgcctgtggaagacgtcttctcgatctccggtcgtggtacagttgtgaccggccgtgttgagcgtggcgtgatcaacgttggcgacgaaatcgaaatcgttggcatccgcgacaccaagaaaaccacatgtaccggcgttgaaatgttccgcaaactgctggaccgtggggaagctggcgacaacatcggcgccctgctgcgcggtatcgaccgtgaaggcgttgagcgtggtcaggttctgtgtaagccaggttcggttaagccgcacaccaagttcacagccgaagcctatatcctcaccaangaagagggtggccgtcacacgccgttcttcgcgaactaccgtccacagttctacttccggaccacagacgttacaggtaccgttcagctgccagaaggcactgaaatggttatgcctggcgacaacctgcagttcgacgtggagctgatcgcccccatcgcgatggaagacggtctgcgcttcgcgatccgcgaaggcggtcgtaccgttggcgcgggcgtggtttccaaaatcaccgagtaagccaacccgcgggtcaccccgcgcaccggcaacaagacgaaggccgctccnanncggggcggcctttttcgtggcttggggncgggcggtgctggctgtgacactacngctttgaccgctgattgcggtcgtactgggcggattcgagcgaaacctcggattccccccttgccacatggcgcgactcgacctatagagcgcaagtctcagcggggtgcgtttttacgcgccccgtttgatttacgacaaaacgcaatgaagggccgtgatgaggcgtctcttcctcttcgtttctactcccaatgagggatgatgacatatggcacaaagccaaaatatccgcatccgtttgaaggcgttcgattaccgcgtgctggatgcgtccacacaggaaatcgttaacaccgccaagcgtaccggtgcatctgttcgcggcccaatcccgctgccgaacaagatcgaaaaattcacagttctgcgtggcccacacgttgacaagaaatcccgtgaccagttcgaaatccgcacgcacaagcgtctgctggatatcgttgatccgaccccccagaccgtggacgcgctgatgaagctcgacctggccgctggtgtggacgtcgagatcaagctgcagtcataagcgtaggagggtaataatatgttgcgctcaggcgttattgcaaaaaagatgggcatgacccgtttgttcatggaagacggnaagcagatccctgtgaccgttcttcagctcgacaaactgcaggttgtggctcagcgtacccccgagaaggacggctacacagctgttcagcttggtgcaggtacagccaaggccaagcggacgtcgcaggccatgcgtggtcactttgctgcggcaaaggttgaacccaagcgtaaggttgcggagttccgtgtggaccccgaagccatgttgaatgttggcgaagaaatcatcgccgatcactactttgctggtcagtatgttgacgttgcaggcacctccatcggtaaaggttttgccggtgcgatgaaacgccacaactttggcggtctgcgtgcgacacacggtgtttcgatctctcaccgttcgcatggttcgacaggtcagtgtcaggatccaggcaaggttttcaaaggcaagaaaatggccggtcacatgggtgctgcccgtgttaccacgcagaacctcgaagttgtcaaaacngacagcgcacgnggtctgatcatggtcaaaggcgccgtaccaggctccaaaggtggttgggtgactgttaaggacgcggtgaaaaagccgttcccagcagacgcgatcctgcctgccgctttgaaatccgccgctgacgaagccgcgaaagccgctgaagaagccgccgcagcagccgctgcagaggccgaagcagaagcagcacgcttggcagaagagcaagcagcgaccgaagctgccgcacttgccgaagccgaagcatccattgagtcggacaagaaggaaggtgacgaatgaaacttgatgtcatcaaactcgacggcggcgcagccggttcggtagacttggacgaggccctgttcggtcttgagccacgcgccgacattctgcaccgtgttgtccgctggcagcgtaacaacgcgcagcagggtacgcacaaggtcaagacacggtccgaggtcagctantcgaccaagaagatctatcgtcagaaaggcaccggcggcgcacgccacggcgcacgttctgcaccnatcttccgttcgggtggtatctacaagggtccaacccctcgtagccacggccacgacctgaccaagaagttccgcaaactgggtctgcgccacgctttgtcttccaaggcaaaaaccggcaacctggtcatcatcgacgatgccacatccgatgggaaaacagctgctttggccaaacaggttaagaacctgggctggaaacgcgcgttgatcatcgacggtgcctcggtaaatgagaacttcttgcaagccgcgcgcaacatcgaaggtctggatatcctgccgacgatgggtgcaaacgtctatgacatcctcaagcgtgacactctcgtgatcaccaaagcggggatcgaagc

SEQ ID NO: 1474 - DNA, 4000 bp, Escherichia coli
  misc_feature (2874)..(2874): n is a, c, g, or t
cacggtcacaatctgcgctgatggcaacggccgcaatgccccgttgagcgcccacaacatgctccaccgccgccttatattcggtggccagcccgccatgcgctacgataacgatacctatcaactgctcaaaaccttagagtctgaagtgtccgacggagccgcctgttccagcagctctctatgccgtatgctcacatgccagccgcgcaattgcaattctttctgtaacatttcgaccattgtgacggatcgatgtttgccgcccgtacagccaaagccaatggccagatgcgaccgcccctccgccacatgggctgggatcacaagatcgatcaaatcgagcactttttgcttgaaagccggaaaattactatcctcggccacataggcctgcaccttcgggtttcgtccatcttctgctctgagagtctcatcccaataaggattgcgcaggaagcgacaatcaaacatcatatcaatgccccgcggtgtgccacgtttatacgagaaggactgcacagaaatcgccattggattgcctttgtccggagcaaaataacgggtgacctccgcgcgcaggtcatggggcgacaattgggtggtatcgatcaaaacattggccctgacccgcgccggctgcatcaaatccaaatccagctgtatccccgcaagcgccgcgccatctggcgacagatggtgccgacgtcgcgtttcggagaagcggcggatcagaacatcctccgaacaatccaaatacaggacctcaagagtcaaagacggattggcagacaatgtcgcaattgtatccatcatttgcgcggtcgagaaatcgcgatttcgggtatcaaggcctagagccattggccgacttaagcccggctgttcgaacaacctcggtgcaaggctcaaaggcatattatcaatagattcaaagcccgcatcttccaaagcattgatcgcagtggttcgcccggccccagatgggccggtcacgagcacaacatgcaccggttgcgttttgtcagtcataggctgcaaatccattttgaagcaaaagcaggagcgccgcagcccgcggcacgtccggcccaccgggaataaccgagactctatgccccaatcttgtgacttcttgaacaaaaggcaagcggcgatcactatattgtgacagatctatgcagaattttagggacgcctcggacctatgcgcgcaggatataaggccaagaccgcgcgcctcgatacgccctgcgacggcgtcaggcgcctgaaggagcaacccattttgcgaagcgcgcagccagacgcgatcatctgaaaccaactgcgccccgagcgccagcatttcaatcgcgaggctggatttgccagcgcctgaagggcctaatatcaacaacccgcaaccgccgaccgacacggcggagccatgcaacagcaacgcctcatcgtcattgctgtaatttctccaagcctcaaagctcatgacatcacaccggcaggccaaacaaaaagcgcgccccaaacgcctgccccgcgccagcaggctgaaccggttctgcgcgaatgacccctgaatgggccgcaacgatctgtgccgcctccgcaagacccgcagtaaactcggccacgccctgatcgcccaatgtggccaagtttccggtcccaaatagggtttggctcaaaccctccggcaacggtgggcctgtgtcttcgaccacgaccaaaaccatgccatcttgaatccgcgtccagatccgaatctcgtccccccaggcgcatctttgaatggcattcgacagaaaagccgacaggatcgagcccacactcgtgggcaggccctcaatgatcacaggcacttttggtgtcgattgcgtcaagacaagaccgcgagtaaccgcggaggggcgcagcgccgccacccgggacgtaatcagcgaaatcagttcaaacctttccttcttgcccatcttgcgcctgggcagctctggggcagcggcgggtgcaggcgctgccgcctgggtgagcggagcggtgacccgctccaagcgcagcaaatcattgtcaatcacatccaagagttttgccgatgtcgaagggtccttttgaagacgcagagctttgatcgcggatttcatcgaggccatcgggttgttgatttcgcccgtcacctctgcgacagcggcctctgcctctctaatgcgtatgaaaagcgcgccgatcgtatggtgcagcgcctcggacagacgaccaatactgtctctgcgctgcggcaaattcggcgctgtgatatttttggcggcaaccccgtggcgcagctgattagaaaaccgctccacagagtccgccatgcggttgaccggtccgaacatcacccaagcgctcaccaccgaaagaacaatcgcaagagccacggctgttaaaagcaagcgcaaggccaattccagaaccatcttccgccccgccggatcgccagccttgcctggatatccaagagcaatgccacccaccatctcctgacgatgcaggatcggtaccgccacccagatctcggactcgctgctttgactctggatatgtcgcgggaaccctgggccatttagcaccgccgcaatcatcgacgccaccccgtccgaccgatccagcgccttggtcacctgcggagagatttgccgataaatttccgccaaatgatccaacagtacaggtgacgacggtccaagccagacgggccaggcgcgggggagggccatggcaggttgcgccttaaggctgtttcctggcgtgaggcttcgctgttcccccagcgggccgaaggcgatcacctcagcaccggcaggcaaggtgagcttgtcaaacagcccgtcaagatcnaccccgtcaccttgcacaaaatccaccggcacgcgatgcggcaatcgcccctcaaccacctgcgcaagcaaaagcacctcagaagtcaattgcgcccgtttgacatcgcggtcgtcagggtggagctgcagcagccaaaacgcgcccacggctggcagcaaaagcaccagcagatggaaaaatgtgatccggcgggtcatgggcgataggagaagccccataaaccatcggtttcggcggtagacgatgagatcattcattgcgaccatccaaaccgcacaaaaatatgggcaaagattggggcttaggcttcattatatcggtaaccgataccatagagtgtttcaattgcatcaaagtctccgtctacccgtcgcatcttttttcgcagccgtttgatatggctgtctattgttcggtcatcgacatagacctgatcatcataggccacatccatcagttgatcgcggcttttgacaaagcccggcctgaccgccagcgtcttcagcaaagcaaattccgtcacggtcaacgcaacggccatgccgcgccaagtcaccccgtggcgcatcgggtccatcgacaaaggaccacgcaccatgatggtcgtctcgtccgcctctaaagcttgatcgccccccagcacgtcccatcgtcgcaaaagcgcgcggatacgttcgagcaagacccttggtgaacttggttttttcacataatcatcggcccccatgcgcaggcccaacacttcgtcaatctcatcctcttttgtggtgcaaaacatcacggggatgttcgacacatgcctcagccgctgcaccacatccatgccatcgaggcctggaagcttgacgtccagcaccaaaatatcgggcaaggactttgacaaagactcccaagcggcaagcccatcggaatggcattcaacttcaaacccttccgcttcaagcatcatggagagagacatcatgtgactgcgatcatcatcgacaagaactattcttggcatgggtatcgtcctctgatcggctcaacattttaacactgatatctgccaccactttctttagttttgccgatctgtgcaacatgtaactacgaatcagcctcaaactcgcagcactatgat

SEQ ID NO: 1475 - DNA, 4000 bp, Escherichia coli
  misc_feature (835)..(835): n is a, c, g, or t
  misc_feature (2133)..(2133): n is a, c, g, or t
  misc_feature (2149)..(2149): n is a, c, g, or t
  misc_feature (2153)..(2153): n is a, c, g, or t
  misc_feature (2398)..(2398): n is a, c, g, or t
  misc_feature (2659)..(2659): n is a, c, g, or t
  misc_feature (2734)..(2734): n is a, c, g, or t
  misc_feature (2824)..(2824): n is a, c, g, or t
  misc_feature (2860)..(2860): n is a, c, g, or t
  misc_feature (2881)..(2881): n is a, c, g, or t
  misc_feature (2935)..(2935): n is a, c, g, or t
  misc_feature (2938)..(2938): n is a, c, g, or t
  misc_feature (2953)..(2953): n is a, c, g, or t
  misc_feature (2972)..(2972): n is a, c, g, or t
  misc_feature (3064)..(3064): n is a, c, g, or t
  misc_feature (3091)..(3091): n is a, c, g, or t
  misc_feature (3193)..(3193): n is a, c, g, or t
  misc_feature (3205)..(3208): n is a, c, g, or t
  misc_feature (3211)..(3211): n is a, c, g, or t
  misc_feature (3217)..(3217): n is a, c, g, or t
  misc_feature (3226)..(3226): n is a, c, g, or t
  misc_feature (3241)..(3241): n is a, c, g, or t
  misc_feature (3268)..(3268): n is a, c, g, or t
  misc_feature (3286)..(3286): n is a, c, g, or t
  misc_feature (3292)..(3292): n is a, c, g, or t
  misc_feature (3301)..(3301): n is a, c, g, or t
  misc_feature (3325)..(3325): n is a, c, g, or t
  misc_feature (3388)..(3388): n is a, c, g, or t
  misc_feature (3405)..(3405): n is a, c, g, or t
  misc_feature (3424)..(3424): n is a, c, g, or t
  misc_feature (3436)..(3436): n is a, c, g, or t
  misc_feature (3448)..(3448): n is a, c, g, or t
  misc_feature (3451)..(3451): n is a, c, g, or t
  misc_feature (3538)..(3538): n is a, c, g, or t
  misc_feature (3547)..(3547): n is a, c, g, or t
  misc_feature (3643)..(3643): n is a, c, g, or t
  misc_feature (3658)..(3658): n is a, c, g, or t
  misc_feature (3688)..(3688): n is a, c, g, or t
  misc_feature (3697)..(3697): n is a, c, g, or t
  misc_feature (3712)..(3712): n is a, c, g, or t
  misc_feature (3727)..(3727): n is a, c, g, or t
  misc_feature (3786)..(3786): n is a, c, g, or t
  misc_feature (3799)..(3799): n is a, c, g, or t
  misc_feature (3801)..(3801): n is a, c, g, or t
  misc_feature (3809)..(3809): n is a, c, g, or t
  misc_feature (3869)..(3873): n is a, c, g, or t
  misc_feature (3877)..(3879): n is a, c, g, or t
  misc_feature (3881)..(3884): n is a, c, g, or t
  misc_feature (3886)..(3889): n is a, c, g, or t
  misc_feature (3891)..(3891): n is a, c, g, or t
  misc_feature (3894)..(3901): n is a, c, g, or t
  misc_feature (3903)..(3912): n is a, c, g, or t
  misc_feature (3914)..(3920): n is a, c, g, or t
  misc_feature (3922)..(3922): n is a, c, g, or t
  misc_feature (3925)..(3935): n is a, c, g, or t
  misc_feature (3937)..(3938): n is a, c, g, or t
  misc_feature (3940)..(3940): n is a, c, g, or t
  misc_feature (3942)..(3942): n is a, c, g, or t
  misc_feature (3944)..(3945): n is a, c, g, or t
  misc_feature (3947)..(3949): n is a, c, g, or t
  misc_feature (3951)..(3954): n is a, c, g, or t
  misc_feature (3956)..(3957): n is a, c, g, or t
  misc_feature (3959)..(3977): n is a, c, g, or t
  misc_feature (3980)..(3984): n is a, c, g, or t
  misc_feature (3986)..(3995): n is a, c, g, or t
  misc_feature (3997)..(3997): n is a, c, g, or t
  misc_feature (4000)..(4000): n is a, c, g, or t
ctttatccctataatataagtagatagtcagacgagtagtgacgtcaggctcatctcacaaacaaataacatgtagaaatggccttttcgttttatctaatttccgaagaaacgaagggctattttgctatttctagacaaataagcgccacaagtgctccaaaggatatcatgactgataaaatcccaaggataatcataatgattttataaccactcataagcaaccctcccttcaaaaacgaagagaggcccaacctcgcctaactatcctaagtctattatagaacgaactaatatgcgatacaataagcattatattatataaatatacgaataaactaataaaagccaagttattcctaactatgaatagcttggcttttacattatgtaaataagttaaaaatatatcagaaatctaatatgcgtatttaggagctttcaaaagctaatgaaatatcagtccaataataatcagaatcggagccaggtaagaaacacaaaaataacaatagctaaaacaataatagtgccatacattaatatccctagctttataacaaaatctatactataaaagataaatgtccccactaaagattggtctttcaaagaaaagtaccaagctttcactctataataaatttttggtttatcaaacgctggatatagtttctcatgccacaaaataagccacggtaaaacccaaatattcccaaaggtaaatatcaatactggcaaataatcccttaatggatatgcttctaatacatatcgatcatagagcaatgtatagaaagcccaaatagagattccccaaataagtaaaagnacaagctttattaggagtccaaaaacaagttttatctttaatctatgtttattcactgttttaaccactctagtgccatacataaatattacaactcatcatcataagatagtccaaagatctttttatagatcaaattaggcaatttatatttttcatcaccaaattcagcaggtagaatcatagcttttagattttctgcatatatacgttgttggcgaatttgtccattattgtaataggtaccgccatcattaacggtccctgtaattcctgaacttccttgctttgcacgccaaatagagatatatggggtcttatcaccttgttttaaacttctatcatgatcattaatcaaatggcgcaaagaacgatccatttggtaatcgtattgtactgaaagtccttgaatcatattcgcagcaggcatggaaacataaatgacggcttcaatacgacgatggccattcggcgccgttacagacttaacagatgaaagatccaaatattttccatctcctcttccagagtcagcactcgaatcgatgtgttcaaatcgttctgcgtttaataagtcagcttgtgatacggcttggatttgcattggcaacacgaggcagcttagtaaccatagtgaaagtaaatatatgcgtttcatcatccacctcattgggccacaatatcatcaaaatgctgctgatatacagatacaaacatagcatccgctatatcatatataatagtattattacggttaagtgggaccttacgcgtatcgtttacataatgcattggctttgtcgccccatcaaatgtatatctcgctacatctacccctgtcatagctaaaccagacttactttcactagcctcaatcaaagccagcatagacgggctcggattcatgatacgagacgaatgaataagtgtcgctaacgaatagttagtatcataatccacggtgagctgtctctcattgatgatagattgataagacgtatccatcacaatatagtaagtcccgcgcaaggaatactgtggcggtgcatagcgtagggcctcaatcgaataagtgtttaaatagatatacaagccaccactctctatgggcccattcatcgactgagaataaacaagcttaaactgtggcgacgttttcaattcctgataagtaattgcctctgtaggcatggtgaaagccagcaacacaagagctagcatcaaaatacgttgaatcataaaaacctctctcaaaaaatgaatcttgtctctcaataaaataagcacagtcttattancataagtatactatgnaaanaaggctgtgcctatgattaataattttatattttagttcctaatatatatacattctccaacgttccaagaaactcctctttgtattttccccagtttttatggataattaaactatacttgatatatgcaccgcaagtagtaagggtgatttagtatgaatctctagatagtgtaaatttttggaggtgtcatatggattctctgactattatttgggttattgtttgcgcctatttattactnaatttattagtcggcgtgtattgtcatattcgtgtaaaagatagtactgactatctactcgcaggtcgtcgtattggggttcttatgacggcaggcacattagcagctacggaaatcggtggtgggagcaccgtaggtgtagcagcgaaagcgtatggttcttggggtttatctgcaggttggtacgtcgtatctgcagggattggtgttattctcgttgctttcatcgcaccgctcttacggcgtgccatggcaacaacngtaccggagatcatcggccgtcgtttcggcgcgtctagccatctcattacttccattctgtccatgctggcaacnattacactagcaggcgtacagattacagcaactgcaaccattattagcgttctcaccggactttcaacagagctcgccatcctcatctgnggcgcggtactcgtaatttacaccatgtccggcggnatgtggagcgtaacgatgacngacgttatccatttcttcgttctcgttgggggcttctccctcgcggtgccgttngtnttgcacaatgtgggnggctgggaatcggtagtgncaaaattgccacctgaacagctaggctttacaaaggtgggttggaaaaccatcatcggccttgtcatcatgtacttcatgaccttctccacngggcaagagtcagttcaacggtacttngcagcgaaaaatgaaagaacggccgttctcggttctatcatttgcgggattattatggctctattcgcctttgttcctgccgtattaggccttgtagcattngctgaattcccnnnnatngaagcnaacaatgcngtggcaacggtagcncttaacctcatgcctccagtaatggcnggcttcgttatggccgcngtcgtntcggccacnctttcatcaggcgcaggcgacctnttaggcgccgcaactgtatttaccaaggatattgtggaacatcattttggtaaaagcctcacngatgctcagctcactanatatagccgtctatgcgtnctattcctcggnatcatcgccatnatnatctccctcgtaagcaaagccatcattccgatgctcgtatttgctttcacaatgagatccgctggcccattcgccgcattcctactnggcctcacntggaaaaatgcaacagctggcgctggcatttggtccatcgtgctcggctccatcgcaggcgtgtactgggaattcgttggcaacccatatggcatnatgtccatcatcttnggttccatcgtcagcctcatcgtctttgtngctgtggtnttcattgaaagatcnatgggtaaaccaccngctcctccggctatacctgatgatgtaaaagaaatataatcaatttgttataatctgtnacttaataatagncntaaaagtnctataaaattacaattataaaaccaaaaactcctatcggtgaaagccaataggagttttnnnnntttnnnannnncnnnncnaannnnnnnncnnnnnnnnnntnnnnnnnanttnnnnnnnnnnnannancntnntnnnannnnannannnnnnnnnnnnnnnnnnnacnnnnngnnnnnnnnnnanttn

SEQ ID NO: 1476 - DNA, 4000 bp, Escherichia coli
  misc_feature (1985)..(1985): n is a, c, g, or t
  misc_feature (1988)..(1988): n is a, c, g, or t
  misc_feature (2004)..(2004): n is a, c, g, or t
  misc_feature (2038)..(2038): n is a, c, g, or t
  misc_feature (2989)..(2989): n is a, c, g, or t
  misc_feature (3164)..(3164): n is a, c, g, or t
gatttttcatcatcaagcgggatcgccgcaatatcatcctgcgtgcccgccgctggctcatataaactactgccatccgctgcgatatgcagcgcacggcccgatttaatcaccaaatcaacggcgttttgtatcacggttagggttttcaatcccagaaagtcgaattttaccagaccggcctgttccacccatttcatattgaactgcgtggcgggcatatccgatctggggtcctgatacaggggcaccagcgcatccagcggccgatcaccaatcaccaccccggccgcatgggtcgaagcattgcgcagcaacccctcgacctgttgcccataagtaagcaaacggtccacaacctcttcattttgcgcctcttcgcgcaaacgtggctcatcggccaaggctttttcaatgctgacaggcttcaccccttccaccggaatcattttggaaaggcggtcgacttgaccatagggcatttgcaaaacccgcccgatatctcgaacagcagcttttgataaaagcgccccaaaggtgatgatctggcccactttatcacggccatatttttcttgaacatattggatcacctcatcgcggcgatccatacagaaatcgatatcaaaatcgggcatgctcacgcgttctggatttaaaaaccgttcaaacaaaagcgaatagcgcagcggatccaaatcggtaatggtcagcgaataagccaccaaactgcccgccccagatccacgtccgggaccaaccggtatgttcttttccttcgcccatttgataaaatctgccacgatcagaaaatagcctggaaagcccatgccttcgataatcttcaactcaaattcaagacgcttttcataggcctccaccgtatccgcatgcggaataatcgccaaccgcgcggccaagcccgcttgcgcctggcgccgtaattcctgaacctcatcagttgcaaattttggcaaaatcggatcccgccgataagccatgaaggcgcagcggcgtgcgatttctagcgtattggcaacggcttcgggaagatcagcaaagagcgtcaccatttcttgtggcgttttgaaataatgctgcgcgcttagccgacggcggggtgcttgctgatccacataagccccttcggcgatgcaaatcaatgcgtcatgcgcctcatacatgtcgggtttggggaaatatacatcattggtggccaccaaaggcaaatccatgcgatacgcaaactcgatgaatacggcctctgtcaaccgttcggcctcgggaagccccgtctccccgggatggcgctgcaactcaacatacaggcgatccccataaatttctgaaaattgctgcatcaacgcttctgctgctggcgcttggcccgctctgagcaagcagcccacaggaccatctgcgccccccgttaagcagattagatctttatgaaatcgcttcaaatcctctaagctgacttgcggcagctcgccatcagccttgagatataagcaagagttcaatttgagtaagttttcatatcccgtttccgattgcgccagcagcacgatcggcgccggcggtggtttgcgcccacccaacggcacaggcgcataagccagatcaatctgacagcccagaatgggttgtacaccggccgcactggcagaaaccgaaaattcaagcgcagcgaataaattattgctatctgtcagcgcaacggccggcatcgccatgttttggcataaatccggaagctttttcagccgcatcgccccttcaagaagggaatactcgctgtgcaatctcagatggatgaattgggcattttttgtcatacatttagaatagaccagccgcggcacgaccccaatgccttatttcaaaatttgccctaaaaatcaccaatttggaaataaagagccctctggcacccttccttgaaaataaatcttgccaggatggtaaatcggcggctaactttnctncaatcatactcaaacnttctacgccgcatcgaaggttttgagataggcanatatggtaaggcggcaggtttaacccgatgaacatatcgtttcttctgaatggagagacagtggccctgacgaatatcagtgctacaacaagctttttggattggctgcgtgaaacgcgtggactgacgggaaccaaagaaggctgcaatgaaggcgattgcggggcctgcacagtggtggtgataaccccagaggccgtccaagcgctgaatgcctgtattctcttattgccacaattacagggtaaagccgtgcgcaccgtggaagctttggggcaaggcgacgcattgcacccggtgcaaagcgcgatgatcgacgcgcatggaagccaatgtggcttctgcacgccgggatttatcgcctcaatggccgccgcgcagatcaatcaagatgaagatcatgcaaccacgctggcgggtaatttatgccgctgcacgggctatgcgcccattttacgcgccgccgaagccagcgcccgcttgtcacagcccgactggctgcgcagcgaccgacaaaaattggccgcgttggatctgcagcatgaacaaccctatctgccaggctccagcgatgccttggccagcctattgcttgcagagccggaaacggttttggtcgccggtgcaaccgatctggcattatggatcacgaaagatctgcgcaaccccgccccattggcgtttttacatcaagcaaaagatctggcgcaaattgaagataacggcgatcatattcgtatcggtgctatggtgtctatcgaagccctgcgcctatgggcgcaaacgcatttgccgcattatagcgagatgttgcgacgctatggatcaacgcaagtgcgcatggcggccacattgggtggtaatatcgccaatgggtcgcccattggagacaatgcgcccgccttgatcgcgcttggtgctaaactggtgctgcgccgcggtgcagatcgncgcgagattgatttggaaacattcttcctgagctatggcaaacaggatctgcaaaaggcagaatttgttgaggctattttgctgccaaagctgggcgcatctgtgtattgctataagctttcgaaacgctttgatcaggatatttctgcggtatgcggatgttttaatattgggntcaaagaaggttatgtagaacgcgcgcggatttgctttggcggtatggctggcacgccgcagcgcgcatataaaacagaggctgctctgctgggccaaccatggcaagaaagcagccttgaaacctgtcgcgcagctttgacagctgattttcagcccctcagcgatatgcgcgcctctgccgcctatcgccaagacgctgcctatgggctgttgctccgttgttttcttgaaagccaagattgtgccgtgaacctgatgggagtaaacgcatgagccacggccacccgtttccccatgatgccgcccatctgcacgtgaccggtgccgcgcgctaccttgatgatctgccttgccccgccaattgcctgcacctagcgtttgggctttccagcatcgcctcggggcaaatcaccgatctgggcttagatcaggtgcgcgcccatgaaggcgtgatcgccgtcttaacagccgaagatctgccattttcaaacgatgtctcgccggcagcaggcgatgaaccgcttttaagcgagggccccgttcattatagcggccaaccgatttttttggtgattgcgaccagccacttgagcgcgcgcaaagccgcgcgcttggcaaaggtcacctatgaggaacacgaggcgatcctgtcgatagaccaagccctcgccgccaatagccgctttgaggatggtccccgcatctaccaaaaaggtgatcctagcgcggctatagcgcaggccgcgcataaaatccaaggtgagattgtgataggggggcaagaacatttttaccttgaaggccaagccgcgctggccctgccgcaagatgatc

SEQ ID NO: 1477 - DNA, 4000 bp, Escherichia coli
  misc_feature (2787)..(2787): n is a, c, g, or t
  misc_feature (3219)..(3219): n is a, c, g, or t
  misc_feature (3318)..(3318): n is a, c, g, or t
  misc_feature (3448)..(3448): n is a, c, g, or t
  misc_feature (3556)..(3558): n is a, c, g, or t
  misc_feature (3568)..(3568): n is a, c, g, or t
  misc_feature (3573)..(3573): n is a, c, g, or t
  misc_feature (3579)..(3579): n is a, c, g, or t
  misc_feature (3587)..(3588): n is a, c, g, or t
  misc_feature (3594)..(3594): n is a, c, g, or t
  misc_feature (3597)..(3597): n is a, c, g, or t
  misc_feature (3599)..(3599): n is a, c, g, or t
  misc_feature (3617)..(3617): n is a, c, g, or t
  misc_feature (3621)..(3621): n is a, c, g, or t
  misc_feature (3627)..(3627): n is a, c, g, or t
  misc_feature (3629)..(3629): n is a, c, g, or t
  misc_feature (3686)..(3686): n is a, c, g, or t
  misc_feature (3693)..(3693): n is a, c, g, or t
  misc_feature (3695)..(3695): n is a, c, g, or t
  misc_feature (3712)..(3712): n is a, c, g, or t
  misc_feature (3733)..(3733): n is a, c, g, or t
  misc_feature (3735)..(3735): n is a, c, g, or t
  misc_feature (3741)..(3741): n is a, c, g, or t
  misc_feature (3771)..(3771): n is a, c, g, or t
  misc_feature (3794)..(3795): n is a, c, g, or t
  misc_feature (3867)..(3867): n is a, c, g, or t
  misc_feature (3921)..(3921): n is a, c, g, or t
  misc_feature (3924)..(3924): n is a, c, g, or t
  misc_feature (3942)..(3942): n is a, c, g, or t
  misc_feature (3951)..(3951): n is a, c, g, or t
  misc_feature (3962)..(3962): n is a, c, g, or t
ccagtctgggcgattgccaaccattagttcaattcgtttttgtccccaatttggaatccacttaacattcaatatttcatcgttaaccttatctcttaggttttttttcgtcattgagacaaaccattgtggtgttgcacgaaagataactggtgttttatgtctccagcaatgcggataggagtgggtaataggctcatgtttgaccaacgtaccatggctttcaagtagtcctataatcgttgcattagccttaaaaataaattctcctgcaacgccctctgtagaatctatgaatacacctcttccatctactggacagtctacaggaaggttgtattgcaagccaaccacatagtcatcctgaccatgagctggcgcagtgtgaacagctccagttcctgtttcagtggtcacatgctctccaagaataactgggacttgtttgtcataaaatggatgctgaagcataagcccctcaagttcagagcccttatatgttttacttagttttttgaagtctttgactccatatctttcaagagaagactcaagtaaatcatcagacaaaatatagagggacttaccaacatcaactagagcataatcaagatcgggatgaagtgaaacagcttcattagccggaagtgtccaaggcgtagtggtccaaataataagagctacaggtttatcattctcaaaaaaatcaccaatgacgttgaaggcaacatcaaccgtatcagaacctttgtctttgtactcaacttcagcttcagcgagagcagatgagcactctgtgcaccaatgaacaggcttaaagcctttagtaagatggccattttttacaatttttccaagtgcacgaacaatatcagcttcatatttaaaatttttagttaagtaagggttatcccaatctccaaaaattcctaatcgcttaaaatcaactttttgtttttcaatttgcttatctgcatactctctgcaagcagctcgaaactcgtcagcagaaattttatgtccaacttttcctttctttttttcaaccatgtgctcaattggcagaccatgacaatcccagccagggacataaggagcatcataacccgacaaggttttgctttttacaataacatctttaaggactttattaacagcatgtccgatatgaatatcgccatttgcataaggggggccgtcatgcaaaacgaatagtggcttgcctttaaatttttgacgaatttgttgatgaatatctttgtcttgccaatctttaagaaaagacccttctcgatttgccaggttagccttcattggaaaatcagtagcaggcaagtttaaggtgtttttgtagtcagacattccaggatatattattactatctaaaaacgccattatacttgacacataaggtttatcaagattgataatcccttgcaaatgtaaattaaaaacttctaaaagggcactgattaaactctataaattcactgacttgaggagcgcttgcacctgtttcggtttgagatattctgattgatttgcacgcaaattttctggcaaacgtatatcactaaatcttgttctaataagtcgagaaactttaaaatctaatgcttcccatagcctccttacttctctttttctgccctctctaacaaccacatgataccaacgattagcaccctctccgcctccaagagtgactcgatgaaattttgcaaagccgtcatctaactctaagccagatgtgagctgtttgatatgctcattttctacctttcccaaaactcgaactgcatactctctatctatttctgagctaggatgcattaatttatttgctaaatctccattattggtgaaaagaagtagccctgaagtattcagatccaaacggcccaccataacccatcgcgtattctctggaagaaaatcaaaaacactttttcggccttcttcatctttatttgagcatataaccccagcttgtttatttaggattagcacttttgtttcttcctctgcataacgctgaagatctattaaccttccatcaatggtaactttatcagttacaagggctttatctccaagcttagcttcttggttattgattgaaattctgccttgctcaattaatctttctgcccagcgccttgagccatatcctgcatttgcaataagtttctgtaatctttcagacatgaatttacagcttaatttagtaggttatgcccatagcatctcgaacttcttccatagtagtttttgccactattcgggctctttcagagccctcaaagattatttcttgaataaggttagggttggcctcatacttcgttatttcttgttgaatgggatctaattctgaattgatagagtctacaatcggctttttacactcaatgcaccctattttagctttagtacagccttcctttacccagttcagtgtctcatcagaagaataaatttgatgcatctgccaaacagggcatttatttggatctccagcatctgtaagcttaatacgagcaggatctgttggcattctatttaccttttgcttaactgattcaggctcttctcttaatgagatcgtattattataggacttagacattttttgaccatccagaccaggcatttttgatgctttcgtaagaagcgcctcaggctcagtaagtataatttttcccaggccttcaataaaacctaagagtctttctctatctccaagggtaatgttttgctgctctccgagaagcgcttttgccttnaacaaagattcatcatcacccgtctcttgataggtttttcttagttctctatatagtttagattgcttcttacccatctttccaatcgctaattcagctttctcttcaaaatcagactctctgccgtagacataattaaaacgtctagcaacctctcttgtgaactcaacatgcgcaacttgatcctctcctacaggaacaagaccagccttatagatcaatatgtcagcactttgaagaagtggataacctaaaaaaccgtaagtagacaagtccttagattttaatttttcttgctgatctttaaacgatgggaccctctctaaccaactaaggggggttgtcatagatagtagcaaatgaagctccgcatgctcagggactttagactgaacaaacagtgtcgaagtgtttgggttaaggccagttgcnaaccagtcaacaaccatatctgagacattcttttctaagtcaatcctatcagaatagtgtgttgtaaatgcatgccaatcagctacaaaataataagantcatattcattttgaagtctggcccagtttttaagaacaccatggtaatgcccaagatgaagttggccagtaggacgcattcctgatagtacgcgatgatctttcattttatttatttaaggattaaatntttaattgaattatcccatagattggctatagctttctaagccatctaaaaccaaattatcaaagagctctatagatttgggaagttcttttttaatttcttttgccnnncctccacaancagtnacaacnccatcagnnaagttngantnaaaactttcaatttgatnattnatagcncnaatcatcattgcataggttccttgcttccaagcatcatctgtattatttgctaagcnttttaantnaagacttaaatcactcnttttaaacttttcaaaactcncnctaagngctttcatacctggcattatgaggcctccntgatgaagtccattcttatcaannacatcaaaagtaatagcgctcccaatatcgattactaaaagcggattattaggaaaatgatttattgcgccnaacatagctgaaaaacgatctgcacctaacattgaaggatcatcatatgagagngtnagatttccaaatctcttntgaggtttnataatattgantgtctcaaaatgagtggaaatttcctgaacaatgtctg

SEQ ID NO: 1478 - DNA, 4000 bp, Escherichia coli
  misc_feature (100)..(100): n is a, c, g, or t
  misc_feature (421)..(421): n is a, c, g, or t
  misc_feature (475)..(475): n is a, c, g, or t
  misc_feature (580)..(580): n is a, c, g, or t
  misc_feature (613)..(613): n is a, c, g, or t
  misc_feature (725)..(725): n is a, c, g, or t
ctactaactcttgtaaattaagtcacttggaggaaaacccatgacagataatgacaaaaaagccgctctcaccgaacgccttgcaaaatgctacagcggngcagtttatgacgccctgcgcgagagagggatcgacaatactgttctgcccaaagacatccggccgattgacgatactcatgttcttgctggtcccgttttcacaatttcaggaacaccaaaacctgggattagtgctgatgatgctctgctggcttggacgggtttcctttcaacagcgccgtctggccatgtcgtagtttgcaatggccacaccgacgacatcgcgatgatgggggaactgtctgccgagacgctccagatgcgcggtgtgcgcggatatgtgaccaatggcgggtgtcgggacagcaatttcattcgnaacatcggtttccccgttttccatcgcttctacaccgcccgcgatgtggtgggngcatggtcggtcgacaaaatggaagtccctgtgcagatcggtgacgttgtcgttaagcccggggattttctgattgccgacattgatggggccatccttatcccnggtgaaatcgctgaagagatcgtggctgaggtngaggaagtgatgaacaccgagaacaaggtccgctcggctatccgtagcgggacggatccgaaggaagcctacttgacctacgggcgtttctgagcggtcaaactggcgtaanggcacttggagatacgaatatgcatattggtttgcctgaccagggctgttttgttctgcgggtctgaaatccagcagtttcaggcccttcggtttcacccgcccgatacgtaggtattgggcacgcgtccgcccgtcccatgacgggcgaacgctcagcacttgaccgaaatcaattcgatcaaacgcgacacgctctaacgatgtgggctaacgctatcagtcaggatcaattctgtcgggacgagagtgagtttagttggcgctgtcggatccgagatacggcttagcagatgttgaatgacaactctccccatctcttgcagatcaatgcttgtcgtactcagcggcggattagtgtgttgcaactcatcgatcccctcgttcgcgatcaacgagaaatcttctccaatttttttccccaacctctgcaaaccggctttcagtccaagggtgacgatagcattatatccgatggcagcagtcggcggatcttcgacatccagaattctcgccgctgcttcgtatccctgagcacgaacagggcggcattcgaaaacaagcgcacgatcaaactcttgacccgcttcgtcaaatgcttgcctgatgcctttcatgcgacggttaaatggggaaatattgactgtgccgccaacagcggcaatgcgtctgtgaccaaggttaagcagatgttttgccgccgtgtaacccgcaagtgtctcatcaaccacgactgaatcgatgggatagccactgatctctcgcgagacacacactattggggggctgaatttcttcatctcttccaggtcggtcgcctgagttcccatcgctggaaccaggacgatgccatctgcattgtactcagacattttcctgataaattcggattgtctctccaccttttcatccgtattgcacaggaagaccgttttcccttctttggcaagttcaccttcaatcgatcccagaagctcgctgaaggacgggtcggacacgttattaagcacgatacccaccgtgtcggtctttgacttcctcaaccctgccccggaacgctgatagacatagcctgattcgcgcagtgcttctttgaccctggcacgcgtctggtctgatattcggctgttttccttcatcgctaaagagacagttgcagtggaaagtcctaactgttttgcgatttgactaagggacggcttctgcattcttgctattttacctatggttatgattgcctagggtagtaatttccaacactttttaatgtaagccgcctcatgaagaattcaagttaatcgatttaatttgatttgtagaagttaatcgattaacttgtagtgacaccgacggaacgcagtttacgcattccggagcgcaagcgcagttttaacaggaggaaaactatgaaactcaaaaaatatgcattcggtatagtctcgggtctggcgttgtcagggctccttgcaacaacagcccttgccgacacggtcaggctgaaattggctgggacctatccagtcaaccactttggccacgggattgtcgaaaacatgatcaaagagattgaagacgcagacgtaggcgtgaaaatctcctatttcccggcctcacagttggggtccggcgaagagctgatcgaagatgcaattcgcggcaatatcgaccttgtacaagcgttcatctacgctcaggccgatcctcggctggaactcatgaacctgccagggttggtgacaacttttgacgagttgaaagcggtctatggagacccggagtccaagctgaatacgattctgggcgggatcatggacgacctggggctggtctatcttgccaatactggcgaagggttggtcggtattgtagcgaacgaaaaacctaccgattatgccggtttcggtgataagggcatgaacatccgcgtctggagttcagaggtcgccaaaaagaccaccgaaagcctcgggtaccggacgacaacgatgaactgggcggaggttctgccagcgctccaatctggcgtcatcgacggagcgatctgctgtacgccggaatgggcctattcgaccttcgcggccgccggagttgggaaatactttattcccgtgaacacggctatcgaagcgtcatcattctatgccagtggcaagtcctgggagaagctgaaccaggaacagcgtgacgttatccgggccgccgccgagagagccgccagcgttgcgatcaacacagcctgggagcgcaatgaaggcttcgtcgagcagttgaaagaagccggctgggaaatccttgagtacagccctgaagagcgcgctgcgatggtcgcccacatccaggaaaacgtttggccggaactggctgacgtggttgggcaggaccttatcgacgaactgacggccaattaaccaagattttcttaggttgctcataaattggggatgccgtgattgtctggcatccccctcttaacggggagtgaactttaaatggtactatttgaagatgcattgccacccggtctgagccggttcgttcggctgatggttcggatcaagtcggtcctggtgagcgtcgctctcccgatactgccgatcacattctttttcgtagtgctgtttcgctatgttctggaacgcgatctttttgcctacgaagaatggctcatgccaatctgcttctggatcttcttcctgggcagtgcgcttggcacttattacgacaaacagatcaacgccgatcttcttgatacagtcaccgaaaattcaacactgctgtggcttcgcaagctcgtgatccagatcatcgagttgtcgataacgctggtacttgtttactgggcttggctgatgattgcggatgagatcgcggcatatcctggatggaaaaccaccatcgccctgaagattccgtttattgttccacgctttggaattttcgtggggttcgtgtttatggcgttctacagcgccttgtcgatcttcctgatgctgcgcgtgggccccgaacgatatgccgaggccatggcgaaagcgcgacaggcggagcctgatgagcaggagattgtgacatggtaatcctcatcgccataatccttatctgcgtcctgctggcaatcggcgtctcggttccattggcctttggcggtgtgttgatcgttctggcctataccggagggtacgatgtctctgggttcttcgcgacgggccactggaagatgaattcagttatcctgctggccattcctcttttcatcatggctggcgatattatgca

SEQ ID NO: 1479 - DNA, 4000 bp, Escherichia coli
  misc_feature (1)..(8): n is a, c, g, or t
  misc_feature (10)..(19): n is a, c, g, or t
  misc_feature (21)..(30): n is a, c, g, or t
  misc_feature (32)..(38): n is a, c, g, or t
  misc_feature (40)..(52): n is a, c, g, or t
  misc_feature (55)..(59): n is a, c, g, or t
  misc_feature (61)..(65): n is a, c, g, or t
  misc_feature (67)..(70): n is a, c, g, or t
  misc_feature (73)..(73): n is a, c, g, or t
  misc_feature (75)..(78): n is a, c, g, or t
  misc_feature (80)..(83): n is a, c, g, or t
  misc_feature (85)..(86): n is a, c, g, or t
  misc_feature (89)..(91): n is a, c, g, or t
  misc_feature (93)..(94): n is a, c, g, or t
  misc_feature (97)..(97): n is a, c, g, or t
  misc_feature (100)..(103): n is a, c, g, or t
  misc_feature (109)..(110): n is a, c, g, or t
  misc_feature (112)..(112): n is a, c, g, or t
  misc_feature (115)..(118): n is a, c, g, or t
  misc_feature (122)..(122): n is a, c, g, or t
  misc_feature (127)..(127): n is a, c, g, or t
  misc_feature (130)..(132): n is a, c, g, or t
  misc_feature (142)..(142): n is a, c, g, or t
  misc_feature (149)..(149): n is a, c, g, or t
  misc_feature (158)..(158): n is a, c, g, or t
  misc_feature (160)..(160): n is a, c, g, or t
  misc_feature (163)..(163): n is a, c, g, or t
  misc_feature (167)..(168): n is a, c, g, or t
  misc_feature (178)..(179): n is a, c, g, or t
  misc_feature (181)..(181): n is a, c, g, or t
  misc_feature (185)..(186): n is a, c, g, or t
  misc_feature (194)..(194): n is a, c, g, or t
  misc_feature (203)..(203): n is a, c, g, or t
  misc_feature (212)..(212): n is a, c, g, or t
  misc_feature (1014)..(1014): n is a, c, g, or t
  misc_feature (1359)..(1359): n is a, c, g, or t
  misc_feature (1441)..(1441): n is a, c, g, or t
  misc_feature (1467)..(1467): n is a, c, g, or t
  misc_feature (2040)..(2040): n is a, c, g, or t
  misc_feature (2809)..(2809): n is a, c, g, or t
  misc_feature (2866)..(2866): n is a, c, g, or t
nnnnnnnngnnnnnnnnnnannnnnnnnnnannnnnnngnnnnnnnnnnnnnagnnnnngnnnnnannnnagnannnnannnngnngannnannagnagnnnnagcagnngnagnnnnagcngaagnagnnncagcagcagnagaagcngcagcagcngnagnagcnncagcagcagnngnagcnncagcagcngaagaagcnccagcagcngaagaagctccagcagcggaagaagctccagcagcggaagaagctccagcggaagataagtagagattacggataatctctccatcgaaagcaatggaagatgatgtagtcattatggggaaaattgttgggcctcatggcatcaaaggatggctaaaagtacatccttttacagaagagataggaacgctgagtaattaccctcaatggcttatatcaaaagatgaaaagcattgggttggccataaagttgaaactgcgacagttaaagataaaacgttgcttgtcaaattggtgggaatagatgaccgaaatggatctgatagcgtcaataaaaatatggttggcatattgaaagaagagttacctaaattagacgcagacacttattactggtctgatttgataggtttggatgtacagaatgaagctggatattattttggtagcatacaaacaatgatggaaacagggtcaaacgatgtgatggtaatcaaaggtgaaagagaatttttgataccgtacttgcctgatgtaattataaaagtagatctcgaggctaaaaaagttttagttgattgggatgaaaattactaaatcgttatttagattcgatttagttacattgatgcccgagatgtttcaagcattaactgattttggagtgactggtagagcatttaagtctggtgtgattgaaatgcatgtttgcaatccgagagagtttgcaaaggatgctcataacactatagatgataaatcgtacggtggtggtccaggaatgttgatgatggtagagccnttggtaaaggctattgagtttataaaagagaagcagcataaaaaagggttgaaaggcgctaaggtagttcatatgaccccgaggggtaagtcattggatcaccaattagtaagagaattgttagaagaagactcattaattattattgccagtcgatacgaaggtgttgatgaaagaattaatgactgggtagatgaagaaatatcggtaggagattatgttatgagtgggggtgaattgccagccatgacattaatggattgtatgataaggcaattacctggagttttaaatgatgatgaatcagcgaatcaggattcatttgtggacggattattagatcanccacactttacaagaccagagctttatagagggcttaaggttcctgaggttttaatgtcaggtgaccatgaaaaaataagantatggcgactgaaagaatcgctaagngaaacttggactaaacgtccagatttgttggccgaaaggttgttgacgaaagaggagtctcgactgctacaagaagttaaaagagagcaggaacaagacccttataactaaaaggaataaatgatggcgaatattatagaaacattagagaatgaagaaattgcacgacttggaaagaaaattccaaagtttgcacctggagatacactttctgttggagtaaacgttgttgaaggaacaaggtctagggttcagttatttgagggagtggttatttcaagacgaaatcgcggactcaattcatcattcatagtaagaaaaatttcctcaggtgaaggtgtcgaaagaacatttcagcttcattctccccaaatagaaagcattgaagtaaaaagacgtggtgatgttaaaagagctaagctattttatctgcgcgacctctcaggcaagtctgctcgtattaaagaaaggcttaaagtgcgtccaagcgatagtgaatttgaaactatcccagagggtgcagctccggccccagtagaggctccattagaagatatggccccagtagaggcnccagtagtagaagaaaaatctgctgaatagacaattcataaagtatgttaaaagccccaaattttggggcttttttttaaccttcttttctttgatatttaatttagaaaatcaatgaaatccaggtcgaatagatttagaataaaaagaatgcataaatcacacacacacataaggtaaatcttaattgcatcaaaaaattattgatgattttattgaccatttatggcttgaagatgggttgtctaaaaatacgctaaatagttatcgctttgatttgataattttcgatagctggcttggcgagcaaaaaaaaatagctatgatggatgtttctgaattagaaatacaagaatttttagcttttaaatttccatcatcaaaatcaaggagcatatctcggcttttggcaaccttaagaaggttttttcgctatcagctcagggagaaaaaaattcaaaaagacccaacacttaaaattcaaacaccaaaaattccaaaatcattaccaaagtcattgagcgaagaggaggtggaaagtcttttagatgcacctaacctagattcatcttccggcttaagagacagatctatgttggagttgctatatgcttgtggcttaagagtaacggagttggtcgatattcaattaacggaagttatccttagtgatggcgttattagggtgactggtaagggctctaaaacaagactggtaccaatgggagaggaagcggtagattggataaaaaaatatattgctgaagcncgggatgatattttaagaaaaaaaacatctaaattcttatttgttactaaccgaggnggagcaatgacgcggcaggctttttggtatgtaataaaaaaatatgccgtaattgctaatatcaataaaccaatgtcaccccatatcttgcgtcatgcatttgcaacccatttaattaatcatggagcagacttaagagtggtgcaaatgttattaggccacacagatatttccacaacacaaatttatactcatgtggcaagggagagattaaaaaaaattcaccaagaacaccatccgagagggtagttagcgctttaaaataacaccaacgaagtctgtactcggtagtatcttgttttttgcaatttttaattcaatagctttaatagcaaattgtctcttgatagttgagacaatttcttcacctagtgattctaataatttgtagctatgattatcaccaattgttacgataatcttctcaatttgggcataatctaatgtctcatcaatatcatcagaatcgaatggtgaatgtttattgagctcaatatcaatatcgatatgtagattttgatagtgctccctctcaaaatctgggacaccaatcttagtttttatctgtaggccgtgaagaaaaatatagttagacatgaaggcgtaggctttttgaaatataatgatcctatatgataaatcaaattctttttgttgccattgcttatttaattggctctctgtcttttggcattttagcgagtaaaatttttagcatttccgacccaagaactatgggatcaaaaaaccctggggcgaccaatgtgttacgaacaggcaacaaatatgctgctatcttcaccttgcttggtgatatgttaaaagcgactatggtagtagccccggcaatcgcttacgatatatcaggcttagaattagtagtgatttcgctggccgttctgctcggccatgtattcccaatctaccataagtttaggggtggaaaaggtgtagcgactgctttagggatcctgtttgcaattaattgggtcttagcgcttatagttttatttgtttggcttgtaatatttttgttatttaggtattcatctcttgcggcgattatttcatcattggctgcaccattgatcgcatactttcttaatcaaggccaaactattgtcattattgctg

SEQ ID NO: 1480 - DNA, 4000 bp, Escherichia coli
  misc_feature (77)..(77): n is a, c, g, or t
  misc_feature (255)..(256): n is a, c, g, or t
  misc_feature (260)..(261): n is a, c, g, or t
  misc_feature (263)..(264): n is a, c, g, or t
  misc_feature (266)..(266): n is a, c, g, or t
  misc_feature (268)..(268): n is a, c, g, or t
  misc_feature (273)..(274): n is a, c, g, or t
  misc_feature (276)..(276): n is a, c, g, or t
  misc_feature (279)..(280): n is a, c, g, or t
  misc_feature (283)..(283): n is a, c, g, or t
  misc_feature (285)..(286): n is a, c, g, or t
  misc_feature (288)..(288): n is a, c, g, or t
  misc_feature (294)..(295): n is a, c, g, or t
  misc_feature (297)..(297): n is a, c, g, or t
  misc_feature (300)..(303): n is a, c, g, or t
  misc_feature (306)..(310): n is a, c, g, or t
  misc_feature (312)..(316): n is a, c, g, or t
  misc_feature (319)..(321): n is a, c, g, or t
  misc_feature (323)..(325): n is a, c, g, or t
  misc_feature (329)..(334): n is a, c, g, or t
  misc_feature (337)..(337): n is a, c, g, or t
  misc_feature (341)..(343): n is a, c, g, or t
  misc_feature (345)..(348): n is a, c, g, or t
  misc_feature (350)..(350): n is a, c, g, or t
  misc_feature (353)..(353): n is a, c, g, or t
  misc_feature (355)..(355): n is a, c, g, or t
  misc_feature (357)..(360): n is a, c, g, or t
  misc_feature (362)..(365): n is a, c, g, or t
  misc_feature (368)..(368): n is a, c, g, or t
  misc_feature (370)..(371): n is a, c, g, or t
  misc_feature (373)..(373): n is a, c, g, or t
  misc_feature (375)..(375): n is a, c, g, or t
  misc_feature (377)..(381): n is a, c, g, or t
  misc_feature (383)..(383): n is a, c, g, or t
  misc_feature (385)..(385): n is a, c, g, or t
  misc_feature (389)..(389): n is a, c, g, or t
  misc_feature (394)..(394): n is a, c, g, or t
  misc_feature (396)..(398): n is a, c, g, or t
  misc_feature (400)..(404): n is a, c, g, or t
  misc_feature (407)..(407): n is a, c, g, or t
  misc_feature (409)..(409): n is a, c, g, or t
  misc_feature (414)..(414): n is a, c, g, or t
  misc_feature (416)..(416): n is a, c, g, or t
  misc_feature (420)..(421): n is a, c, g, or t
  misc_feature (424)..(426): n is a, c, g, or t
  misc_feature (429)..(429): n is a, c, g, or t
  misc_feature (433)..(433): n is a, c, g, or t
  misc_feature (435)..(437): n is a, c, g, or t
  misc_feature (441)..(442): n is a, c, g, or t
  misc_feature (446)..(447): n is a, c, g, or t
  misc_feature (451)..(451): n is a, c, g, or t
  misc_feature (453)..(453): n is a, c, g, or t
  misc_feature (457)..(459): n is a, c, g, or t
  misc_feature (461)..(463): n is a, c, g, or t
  misc_feature (465)..(465): n is a, c, g, or t
  misc_feature (468)..(470): n is a, c, g, or t
  misc_feature (472)..(472): n is a, c, g, or t
  misc_feature (474)..(474): n is a, c, g, or t
  misc_feature (477)..(477): n is a, c, g, or t
  misc_feature (483)..(483): n is a, c, g, or t
  misc_feature (488)..(490): n is a, c, g, or t
  misc_feature (493)..(494): n is a, c, g, or t
  misc_feature (498)..(498): n is a, c, g, or t
  misc_feature (504)..(504): n is a, c, g, or t
  misc_feature (514)..(517): n is a, c, g, or t
  misc_feature (521)..(521): n is a, c, g, or t
  misc_feature (526)..(527): n is a, c, g, or t
  misc_feature (529)..(532): n is a, c, g, or t
  misc_feature (534)..(534): n is a, c, g, or t
  misc_feature (536)..(536): n is a, c, g, or t
  misc_feature (539)..(539): n is a, c, g, or t
  misc_feature (547)..(547): n is a, c, g, or t
  misc_feature (549)..(551): n is a, c, g, or t
  misc_feature (556)..(556): n is a, c, g, or t
  misc_feature (558)..(561): n is a, c, g, or t
  misc_feature (563)..(563): n is a, c, g, or t
  misc_feature (566)..(566): n is a, c, g, or t
  misc_feature (568)..(569): n is a, c, g, or t
  misc_feature (572)..(574): n is a, c, g, or t
  misc_feature (577)..(579): n is a, c, g, or t
  misc_feature (582)..(584): n is a, c, g, or t
  misc_feature (591)..(592): n is a, c, g, or t
  misc_feature (594)..(598): n is a, c, g, or t
  misc_feature (604)..(604): n is a, c, g, or t
  misc_feature (608)..(609): n is a, c, g, or t
  misc_feature (612)..(613): n is a, c, g, or t
  misc_feature (615)..(616): n is a, c, g, or t
  misc_feature (618)..(618): n is a, c, g, or t
  misc_feature (621)..(623): n is a, c, g, or t
  misc_feature (627)..(630): n is a, c, g, or t
  misc_feature (632)..(633): n is a, c, g, or t
  misc_feature (636)..(638): n is a, c, g, or t
  misc_feature (640)..(640): n is a, c, g, or t
  misc_feature (646)..(646): n is a, c, g, or t
  misc_feature (649)..(650): n is a, c, g, or t
  misc_feature (653)..(654): n is a, c, g, or t
  misc_feature (657)..(659): n is a, c, g, or t
  misc_feature (662)..(664): n is a, c, g, or t
  misc_feature (666)..(666): n is a, c, g, or t
  misc_feature (668)..(674): n is a, c, g, or t
  misc_feature (677)..(680): n is a, c, g, or t
  misc_feature (682)..(684): n is a, c, g, or t
  misc_feature (686)..(687): n is a, c, g, or t
  misc_feature (691)..(693): n is a, c, g, or t
  misc_feature (695)..(695): n is a, c, g, or t
  misc_feature (697)..(703): n is a, c, g, or t
  misc_feature (705)..(705): n is a, c, g, or t
  misc_feature (710)..(712): n is a, c, g, or t
  misc_feature (714)..(716): n is a, c, g, or t
  misc_feature (718)..(719): n is a, c, g, or t
  misc_feature (721)..(721): n is a, c, g, or t
  misc_feature (723)..(727): n is a, c, g, or t
  misc_feature (730)..(731): n is a, c, g, or t
  misc_feature (735)..(737): n is a, c, g, or t
  misc_feature (743)..(745): n is a, c, g, or t
  misc_feature (747)..(749): n is a, c, g, or t
  misc_feature (751)..(751): n is a, c, g, or t
  misc_feature (754)..(754): n is a, c, g, or t
  misc_feature (756)..(756): n is a, c, g, or t
  misc_feature (758)..(764): n is a, c, g, or t
  misc_feature (766)..(766): n is a, c, g, or t
  misc_feature (768)..(768): n is a, c, g, or t
  misc_feature (771)..(772): n is a, c, g, or t
  misc_feature (774)..(776): n is a, c, g, or t
  misc_feature (778)..(781): n is a, c, g, or t
  misc_feature (786)..(786): n is a, c, g, or t
  misc_feature (788)..(789): n is a, c, g, or t
  misc_feature (791)..(791): n is a, c, g, or t
  misc_feature (793)..(793): n is a, c, g, or t
  misc_feature (795)..(805): n is a, c, g, or t
  misc_feature (807)..(809): n is a, c, g, or t
  misc_feature (812)..(812): n is a, c, g, or t
  misc_feature (814)..(816): n is a, c, g, or t
  misc_feature (818)..(819): n is a, c, g, or t
  misc_feature (821)..(822): n is a, c, g, or t
  misc_feature (824)..(824): n is a, c, g, or t
  misc_feature (826)..(826): n is a, c, g, or t
  misc_feature (830)..(830): n is a, c, g, or t
  misc_feature (832)..(832): n is a, c, g, or t
  misc_feature (834)..(836): n is a, c, g, or t
  misc_feature (838)..(841): n is a, c, g, or t
  misc_feature (843)..(843): n is a, c, g, or t
  misc_feature (845)..(846): n is a, c, g, or t
  misc_feature (848)..(848): n is a, c, g, or t
  misc_feature (851)..(854): n is a, c, g, or t
  misc_feature (856)..(858): n is a, c, g, or t
  misc_feature (860)..(861): n is a, c, g, or t
  misc_feature (863)..(863): n is a, c, g, or t
  misc_feature (865)..(866): n is a, c, g, or t
  misc_feature (868)..(868): n is a, c, g, or t
  misc_feature (870)..(870): n is a, c, g, or t
  misc_feature (873)..(874): n is a, c, g, or t
  misc_feature (876)..(876): n is a, c, g, or t
  misc_feature (879)..(879): n is a, c, g, or t
  misc_feature (881)..(883): n is a, c, g, or t
  misc_feature (886)..(888): n is a, c, g, or t
  misc_feature (890)..(897): n is a, c, g, or t
  misc_feature (899)..(903): n is a, c, g, or t
  misc_feature (905)..(905): n is a, c, g, or t
  misc_feature (909)..(909): n is a, c, g, or t
  misc_feature (912)..(913): n is a, c, g, or t
  misc_feature (915)..(922): n is a, c, g, or t
  misc_feature (924)..(928): n is a, c, g, or t
  misc_feature (931)..(931): n is a, c, g, or t
  misc_feature (933)..(935): n is a, c, g, or t
  misc_feature (937)..(941): n is a, c, g, or t
  misc_feature (943)..(947): n is a, c, g, or t
  misc_feature (951)..(951): n is a, c, g, or t
  misc_feature (953)..(954): n is a, c, g, or t
  misc_feature (956)..(956): n is a, c, g, or t
  misc_feature (960)..(963): n is a, c, g, or t
  misc_feature (965)..(967): n is a, c, g, or t
  misc_feature (972)..(972): n is a, c, g, or t
  misc_feature (974)..(974): n is a, c, g, or t
  misc_feature (976)..(977): n is a, c, g, or t
  misc_feature (980)..(981): n is a, c, g, or t
  misc_feature (983)..(985): n is a, c, g, or t
  misc_feature (987)..(987): n is a, c, g, or t
  misc_feature (989)..(992): n is a, c, g, or t
  misc_feature (994)..(995): n is a, c, g, or t
  misc_feature (998)..(998): n is a, c, g, or t
  misc_feature (1000)..(1004): n is a, c, g, or t
  misc_feature (1007)..(1010): n is a, c, g, or t
  misc_feature (1012)..(1012): n is a, c, g, or t
  misc_feature (1016)..(1019): n is a, c, g, or t
  misc_feature (1021)..(1021): n is a, c, g, or t
  misc_feature (1023)..(1027): n is a, c, g, or t
  misc_feature (1031)..(1034): n is a, c, g, or t
  misc_feature (1036)..(1038): n is a, c, g, or t
  misc_feature (1040)..(1040): n is a, c, g, or t
  misc_feature (1042)..(1042): n is a, c, g, or t
  misc_feature (1046)..(1053): n is a, c, g, or t
  misc_feature (1057)..(1057): n is a, c, g, or t
  misc_feature (1059)..(1060): n is a, c, g, or t
  misc_feature (1062)..(1064): n is a, c, g, or t
  misc_feature (1066)..(1066): n is a, c, g, or t
  misc_feature (1069)..(1074): n is a, c, g, or t
  misc_feature (1077)..(1081): n is a, c, g, or t
  misc_feature (1083)..(1086): n is a, c, g, or t
  misc_feature (1088)..(1088): n is a, c, g, or t
  misc_feature (1090)..(1091): n is a, c, g, or t
  misc_feature (1093)..(1093): n is a, c, g, or t
  misc_feature (1095)..(1097): n is a, c, g, or t
  misc_feature (1099)..(1099): n is a, c, g, or t
  misc_feature (1102)..(1103): n is a, c, g, or t
  misc_feature (1105)..(1109): n is a, c, g, or t
  misc_feature (1111)..(1111): n is a, c, g, or t
  misc_feature (1113)..(1120): n is a, c, g, or t
  misc_feature (1124)..(1125): n is a, c, g, or t
  misc_feature (1127)..(1128): n is a, c, g, or t
  misc_feature (1130)..(1130): n is a, c, g, or t
  misc_feature (1132)..(1132): n is a, c, g, or t
  misc_feature (1135)..(1135): n is a, c, g, or t
  misc_feature (1137)..(1137): n is a, c, g, or t
  misc_feature (1139)..(1139): n is a, c, g, or t
  misc_feature (1141)..(1141): n is a, c, g, or t
  misc_feature (1143)..(1143): n is a, c, g, or t
  misc_feature (1146)..(1148): n is a, c, g, or t
  misc_feature (1152)..(1157): n is a, c, g, or t
  misc_feature (1159)..(1159): n is a, c, g, or t
  misc_feature (1161)..(1163): n is a, c, g, or t
  misc_feature (1166)..(1166): n is a, c, g, or t
  misc_feature (1169)..(1171): n is a, c, g, or t
  misc_feature (1173)..(1173): n is a, c, g, or t
  misc_feature (1176)..(1178): n is a, c, g, or t
  misc_feature (1180)..(1180): n is a, c, g, or t
  misc_feature (1182)..(1182): n is a, c, g, or t
  misc_feature (1184)..(1187): n is a, c, g, or t
  misc_feature (1189)..(1189): n is a, c, g, or t
  misc_feature (1191)..(1193): n is a, c, g, or t
  misc_feature (1195)..(1198): n is a, c, g, or t
  misc_feature (1200)..(1203): n is a, c, g, or t
  misc_feature (1206)..(1206): n is a, c, g, or t
  misc_feature (1208)..(1213): n is a, c, g, or t
  misc_feature (1215)..(1217): n is a, c, g, or t
  misc_feature (1219)..(1221): n is a, c, g, or t
  misc_feature (1223)..(1225): n is a, c, g, or t
  misc_feature (1228)..(1231): n is a, c, g, or t
  misc_feature (1233)..(1233): n is a, c, g, or t
  misc_feature (1235)..(1235): n is a, c, g, or t
  misc_feature (1237)..(1238): n is a, c, g, or t
  misc_feature (1240)..(1241): n is a, c, g, or t
  misc_feature (1244)..(1250): n is a, c, g, or t
  misc_feature (1252)..(1256): n is a, c, g, or t
  misc_feature (1258)..(1261): n is a, c, g, or t
  misc_feature (1263)..(1263): n is a, c, g, or t
  misc_feature (1265)..(1270): n is a, c, g, or t
  misc_feature (1272)..(1272): n is a, c, g, or t
  misc_feature (1274)..(1274): n is a, c, g, or t
  misc_feature (1276)..(1279): n is a, c, g, or t
  misc_feature (1281)..(1285): n is a, c, g, or t
  misc_feature (1287)..(1289): n is a, c, g, or t
  misc_feature (1291)..(1294): n is a, c, g, or t
  misc_feature (1297)..(1303): n is a, c, g, or t
  misc_feature (1305)..(1316): n is a, c, g, or t
  misc_feature (1318)..(1326): n is a, c, g, or t
  misc_feature (1328)..(1329): n is a, c, g, or t
  misc_feature (1332)..(1336): n is a, c, g, or t
  misc_feature (1338)..(1348): n is a, c, g, or t
  misc_feature (1350)..(1350): n is a, c, g, or t
  misc_feature (1352)..(1352): n is a, c, g, or t
  misc_feature (1357)..(1357): n is a, c, g, or t
  misc_feature (1359)..(1361): n is a, c, g, or t
  misc_feature (1363)..(1363): n is a, c, g, or t
  misc_feature (1365)..(1365): n is a, c, g, or t
  misc_feature (1367)..(1368): n is a, c, g, or t
  misc_feature (1370)..(1370): n is a, c, g, or t
  misc_feature (1373)..(1373): n is a, c, g, or t
  misc_feature (1378)..(1379): n is a, c, g, or t
  misc_feature (1384)..(1385): n is a, c, g, or t
  misc_feature (1388)..(1388): n is a, c, g, or t
  misc_feature (1390)..(1390): n is a, c, g, or t
  misc_feature (1395)..(1396): n is a, c, g, or t
  misc_feature (1398)..(1398): n is a, c, g, or t
  misc_feature (1400)..(1400): n is a, c, g, or t
  misc_feature (1402)..(1404): n is a, c, g, or t
  misc_feature (1410)..(1410): n is a, c, g, or t
  misc_feature (1412)..(1415): n is a, c, g, or t
  misc_feature (1418)..(1418): n is a, c, g, or t
  misc_feature (1420)..(1421): n is a, c, g, or t
  misc_feature (1423)..(1427): n is a, c, g, or t
  misc_feature (1431)..(1431): n is a, c, g, or t
  misc_feature (1436)..(1436): n is a, c, g, or t
  misc_feature (1438)..(1438): n is a, c, g, or t
  misc_feature (1440)..(1441): n is a, c, g, or t
  misc_feature (1443)..(1444): n is a, c, g, or t
  misc_feature (1448)..(1449): n is a, c, g, or t
  misc_feature (1451)..(1452): n is a, c, g, or t
  misc_feature (1454)..(1456): n is a, c, g, or t
  misc_feature (1459)..(1460): n is a, c, g, or t
  misc_feature (1463)..(1463): n is a, c, g, or t
  misc_feature (1465)..(1466): n is a, c, g, or t
  misc_feature (1469)..(1470): n is a, c, g, or t
  misc_feature (1473)..(1476): n is a, c, g, or t
  misc_feature (1478)..(1479): n is a, c, g, or t
  misc_feature (1482)..(1484): n is a, c, g, or t
  misc_feature (1487)..(1487): n is a, c, g, or t
  misc_feature (1489)..(1497): n is a, c, g, or t
  misc_feature (1499)..(1499): n is a, c, g, or t
  misc_feature (1501)..(1501): n is a, c, g, or t
  misc_feature (1504)..(1505): n is a, c, g, or t
  misc_feature (1507)..(1508): n is a, c, g, or t
  misc_feature (1511)..(1512): n is a, c, g, or t
  misc_feature (1515)..(1515): n is a, c, g, or t
  misc_feature (1517)..(1517): n is a, c, g, or t
  misc_feature (1519)..(1519): n is a, c, g, or t
  misc_feature (1525)..(1525): n is a, c, g, or t
  misc_feature (1527)..(1527): n is a, c, g, or t
  misc_feature (1532)..(1532): n is a, c, g, or t
  misc_feature (1534)..(1536): n is a, c, g, or t
  misc_feature (1538)..(1540): n is a, c, g, or t
  misc_feature (1542)..(1542): n is a, c, g, or t
  misc_feature (1545)..(1546): n is a, c, g, or t
  misc_feature (1548)..(1548): n is a, c, g, or t
  misc_feature (1551)..(1551): n is a, c, g, or t
  misc_feature (1553)..(1554): n is a, c, g, or t
  misc_feature (1556)..(1556): n is a, c, g, or t
  misc_feature (1559)..(1561): n is a, c, g, or t
  misc_feature (1563)..(1563): n is a, c, g, or t
  misc_feature (1567)..(1567): n is a, c, g, or t
  misc_feature (1570)..(1571): n is a, c, g, or t
  misc_feature (1573)..(1576): n is a, c, g, or t
  misc_feature (1580)..(1583): n is a, c, g, or t
  misc_feature (1585)..(1585): n is a, c, g, or t
  misc_feature (1588)..(1589): n is a, c, g, or t
  misc_feature (1592)..(1592): n is a, c, g, or t
  misc_feature (1594)..(1594): n is a, c, g, or t
  misc_feature (1596)..(1596): n is a, c, g, or t
  misc_feature (1598)..(1598): n is a, c, g, or t
  misc_feature (1601)..(1601): n is a, c, g, or t
  misc_feature (1605)..(1607): n is a, c, g, or t
  misc_feature (1610)..(1610): n is a, c, g, or t
  misc_feature (1612)..(1615): n is a, c, g, or t
  misc_feature (1618)..(1622): n is a, c, g, or t
  misc_feature (1627)..(1629): n is a, c, g, or t
  misc_feature (1632)..(1636): n is a, c, g, or t
  misc_feature (1640)..(1640): n is a, c, g, or t
  misc_feature (1643)..(1647): n is a, c, g, or t
  misc_feature (1649)..(1650): n is a, c, g, or t
  misc_feature (1654)..(1656): n is a, c, g, or t
  misc_feature (1662)..(1662): n is a, c, g, or t
  misc_feature (1665)..(1665): n is a, c, g, or t
  misc_feature (1668)..(1671): n is a, c, g, or t
  misc_feature (1675)..(1676): n is a, c, g, or t
  misc_feature (1678)..(1678): n is a, c, g, or t
  misc_feature (1680)..(1681): n is a, c, g, or t
  misc_feature (1683)..(1683): n is a, c, g, or t
  misc_feature (1686)..(1687): n is a, c, g, or t
  misc_feature (1689)..(1690): n is a, c, g, or t
  misc_feature (1856)..(1856): n is a, c, g, or t
  misc_feature (1949)..(1949): n is a, c, g, or t
  misc_feature (1952)..(1952): n is a, c, g, or t
  misc_feature (1964)..(1964): n is a, c, g, or t
  misc_feature (1988)..(1988): n is a, c, g, or t
  misc_feature (1991)..(1991): n is a, c, g, or t
  misc_feature (3289)..(3289): n is a, c, g, or t
  misc_feature (3361)..(3361): n is a, c, g, or t
  misc_feature (3977)..(3977): n is a, c, g, or t
acattgccggatcatacaggccattttccttatgtgtgtcaactataacttctaaggtcaccgaacccttaagattnctatccaccacttcggtagctacacgtgaagcatgatcttctggaaaccattgcaaaggatagtgctcaaatctaagttgtgaagcaaagaaaattgccacgataatcatcactgaactaatagcaacaatcgcttttggatagcctgttgaaatacgactaatgcctaacagcatanngtcnntnntngngtgtnntnttnnatntnntncgctcnntnttnnnntannnnncnnnnnacnnntnnnagcnnnnnntancacnnnannnnanaanantnnnntnnnnacncnncnantnnnnnananaccnaaatntnnnannnnngananctcananaatnngannnacnatantnnngctnntgtnntcananaggnnntnnnantannnanancanaatgcnccatnnngtnntttnaagagntttttacatnnnnagantttgnnannnntntntanaaaatagncnnnagatnannnncnccncnngtnnngannnctnnnaaaaatnncnnnnnaatttnagtnncannanngnatnnngtannnntnntannnancaatgnaanngtnnctnnnatnnnanannnnnnngcnnnnannngnnaaannntncnnnnnnnangtttnnncnnntnngntnnnnnatnntgannntcgctnnncnnntnttncncnnnnnnntnanaanntnnnannnngcttngnntnangnnnnnnnnnnnannngcngnnncnntnngntntatntngnnntnnnntntnncnaannnntnnntnntntnntnanttnntntancnnnaannntnnnnnnnncnnnnnanaaanatnncnnnnnnnncnnnnnagntnnntnnnnntnnnnngcananncntctnnnncnnnctcancnannaanntnnncngnnnntnnaangnnnnntannnntntgtnnnnanannnnnagtnnnnannntntnatcnnnnnnnnaaantnngnnntntannnnnngannnnngnnnncncnntntnnntncgnntnnnnntnannnnnnnntttnngnnantnttnananananctnnnacannnnnncnannnttnttnnnanaannntntntnnnntnannnannnnannnncancnnnnnnannngnnngnnnatnnnnangntnntnntgnnnnnnntnnnnntnnnntnannnnnntnantnnnnannnnntnnngnnnnaannnnnnntnnnnnnnnnnnntnnnnnnnnnanngannnnntnnnnnnnnnnnangntgacncnnntngnanncnttntactnnaatcnngantntgganngncntnnnaacaantnnnntgntnntnnnnnaagnccaanancnntnnaaanncnnannnaannganannagnncannnncnnagnnnacntnnnnnnnnntntnaanntnnctnnaantntntttatngnatatnannntnnnanatnntntgnanntnttnnngngtantannannnnctannnntnatnnggntntngnatntatnnntgngnnnnaannnnncattnnnaannnnngtantgnnnnngnngtannntgatanttntannnntttnnananntnaannanngaatatggtgccgatggccagagtcgaactggcacgagcgtagctcactaccccctcaaggtagcgcgtctaccaattccgccacatcggcaataaaatttagtcaggtatgtcgctgagcggtacgtcgatcataggaacatcagacggtatagctggagtagcnattacctgatccataacactttgagtgttgttgctagcacttggctcgttagtagctagataagccaacgttaaagaagttaaaaagaaaccngtngcaacgcctgcngttaatttataaataaaagagctngcncctcgcgcgccaaatactgagcccgcagaacccgcgccaaatgcagcgccagcatcggcacctttaccatgttgcattaaaattagcgcaactagacccaacgccagcaacacatgaacaattaaaattacttgaaacgacataattaacccgctttacaaattcttaaaaaatcttcagcctttaatgaggcgccgccaatcagcccaccatcgatgtcttcacagccaatcagctcttctgcattggtagggttcatgctaccgccgtatagaatgggagtagattgagcaatatcggtgttattctcagctagcatcgaacgaataaaggcgtgtgcatcttgtgcctgctgtggtgttgcagtaacgccagtaccaattgcccaaactggctcataagcaatgataatatttttaaaggcatcaataccaacgcgatcaaccactgcttgaatttgacgagaaaccacgatttccatattacccgcctctctctcttctaaggtttcgccgatacagaaaagtggagttagtccgttatccagtgcagcttgtactttctcggcaacaatttcatcagtctctccgtataagcttctgcgctcggagtggccaacaatcacgtgctcggcgccaaattctttaatcatgtctgcgctcacttcgccagtaaaggcacctgaagcgttgacgttaaaattttgcgcacccagatgaacttgagagtgggtgattaaagcttccacttgcgataaataagggtaaggagcacaaacaataacctttgactcaacgtcggccattcctgaaagaatgcccattatcaatgtattaaccgcttcttttgaagcgttcattttccaattgcctgcaacgattacttgacgcataatgattgttcactgtaaaaaaggagcaatgttacgctatttggctataaaaatcaatcagtgctttgcctttgagccaaaataaagcgccaaagaaaccattaaaatacccaatgaaaaatacaacaaatcaagtgcgccggtaaaactcatggataacgatacttcgaagaaggttaccaccaaaatcataagaattactttggctaattttgcctttaaatcatctaacgaattgatcaccagaacttttgaagattgaccgctttctttggcctcatcaatatcactaataaacagctcatacaagcccaaggaaaatatcaataaaatggttgccaacaaaaacccatcaatagcaccaaccgtatgggccaccatttctatttttaaaagccttctgtcntctcctgatgctgaaaaataatcgggcgcatgggccagcaaaccagcaacatccacggcagtaatgacaaanaaaagcaaggacagtagcattgaagaaatcacagcagccaaaaccataaggcgagacccccacaacaatttttcaaaatatttttcgacaattcccatttttttaactccccgtgcacaacacaaagctttagtatatcattattaattttaaataaaaccccaatcctaatacagaaaatacaatggtaaaaataaacactaattttgtatttttatcgtcaggattaaacacataaaaacttatgtcaaaaacttgggaaaaatgtctaaccactctcagagacaccgttgatttacacacattcagcttgtggattcgacccctaaaagcacttgaagaccctatcactctatccttgttggcacctaacacttctgtacttgactatgttaacggtaatttaaaaaaagaaattaaagccgccatagcacagcacagcaaaaaccttgaggtttatattggtgtatctccacaaaaaaaaggcactgttcaaagcattaaacaacacaaaacgccattatttgcagattatacatttgacaacttagtactgggcggcgctaatcagattgcttatggcgccgcccaacagattgctgaaaacattaaaaancctctttacaacccttttattat

SEQ ID NO: 1481 - DNA, 4000 bp, Escherichia coli
  misc_feature (1985)..(1994): n is a, c, g, or t
  misc_feature (1996)..(1998): n is a, c, g, or t
  misc_feature (2000)..(2000): n is a, c, g, or t
  misc_feature (2002)..(2010): n is a, c, g, or t
  misc_feature (2012)..(2014): n is a, c, g, or t
  misc_feature (2052)..(2054): n is a, c, g, or t
  misc_feature (2057)..(2070): n is a, c, g, or t
  misc_feature (2072)..(2074): n is a, c, g, or t
  misc_feature (2076)..(2076): n is a, c, g, or t
  misc_feature (2078)..(2080): n is a, c, g, or t
  misc_feature (2117)..(2118): n is a, c, g, or t
  misc_feature (2120)..(2124): n is a, c, g, or t
  misc_feature (2127)..(2129): n is a, c, g, or t
  misc_feature (2131)..(2131): n is a, c, g, or t
  misc_feature (2133)..(2141): n is a, c, g, or t
  misc_feature (2143)..(2146): n is a, c, g, or t
  misc_feature (2183)..(2186): n is a, c, g, or t
  misc_feature (2188)..(2191): n is a, c, g, or t
  misc_feature (2193)..(2193): n is a, c, g, or t
  misc_feature (2196)..(2204): n is a, c, g, or t
  misc_feature (2207)..(2212): n is a, c, g, or t
  misc_feature (2249)..(2278): n is a, c, g, or t
  misc_feature (2318)..(2318): n is a, c, g, or t
  misc_feature (2320)..(2329): n is a, c, g, or t
  misc_feature (2331)..(2336): n is a, c, g, or t
  misc_feature (2339)..(2344): n is a, c, g, or t
  misc_feature (2382)..(2383): n is a, c, g, or t
  misc_feature (2385)..(2386): n is a, c, g, or t
  misc_feature (2388)..(2389): n is a, c, g, or t
  misc_feature (2394)..(2399): n is a, c, g, or t
  misc_feature (2401)..(2410): n is a, c, g, or t
  misc_feature (2430)..(2430): n is a, c, g, or t
  misc_feature (2432)..(2434): n is a, c, g, or t
  misc_feature (2436)..(2436): n is a, c, g, or t
  misc_feature (2439)..(2439): n is a, c, g, or t
  misc_feature (2441)..(2441): n is a, c, g, or t
  misc_feature (2448)..(2453): n is a, c, g, or t
  misc_feature (2455)..(2458): n is a, c, g, or t
  misc_feature (2460)..(2461): n is a, c, g, or t
  misc_feature (2463)..(2470): n is a, c, g, or t
  misc_feature (2472)..(2474): n is a, c, g, or t
  misc_feature (2476)..(2476): n is a, c, g, or t
  misc_feature (2478)..(2478): n is a, c, g, or t
  misc_feature (2482)..(2483): n is a, c, g, or t
  misc_feature (2487)..(2488): n is a, c, g, or t
  misc_feature (2492)..(2492): n is a, c, g, or t
  misc_feature (2494)..(2495): n is a, c, g, or t
  misc_feature (2498)..(2498): n is a, c, g, or t
  misc_feature (2502)..(2505): n is a, c, g, or t
  misc_feature (2508)..(2508): n is a, c, g, or t
  misc_feature (2512)..(2514): n is a, c, g, or t
  misc_feature (2516)..(2518): n is a, c, g, or t
  misc_feature (2520)..(2523): n is a, c, g, or t
  misc_feature (2525)..(2528): n is a, c, g, or t
  misc_feature (2530)..(2540): n is a, c, g, or t
  misc_feature (2542)..(2544): n is a, c, g, or t
  misc_feature (2548)..(2549): n is a, c, g, or t
  misc_feature (2552)..(2553): n is a, c, g, or t
  misc_feature (2558)..(2562): n is a, c, g, or t
  misc_feature (2568)..(2571): n is a, c, g, or t
  misc_feature (2574)..(2575): n is a, c, g, or t
  misc_feature (2579)..(2587): n is a, c, g, or t
  misc_feature (2589)..(2591): n is a, c, g, or t
  misc_feature (2593)..(2602): n is a, c, g, or t
  misc_feature (2607)..(2607): n is a, c, g, or t
  misc_feature (2648)..(2649): n is a, c, g, or t
  misc_feature (2657)..(2657): n is a, c, g, or t
  misc_feature (2659)..(2659): n is a, c, g, or t
  misc_feature (2663)..(2664): n is a, c, g, or t
  misc_feature (2668)..(2670): n is a, c, g, or t
  misc_feature (2673)..(2673): n is a, c, g, or t
  misc_feature (2713)..(2714): n is a, c, g, or t
  misc_feature (2721)..(2721): n is a, c, g, or t
  misc_feature (2724)..(2724): n is a, c, g, or t
  misc_feature (2728)..(2728): n is a, c, g, or t
  misc_feature (2730)..(2730): n is a, c, g, or t
  misc_feature (2737)..(2739): n is a, c, g, or t
  misc_feature (2779)..(2779): n is a, c, g, or t
  misc_feature (2784)..(2785): n is a, c, g, or t
  misc_feature (2787)..(2787): n is a, c, g, or t
  misc_feature (2793)..(2794): n is a, c, g, or t
  misc_feature (2796)..(2796): n is a, c, g, or t
  misc_feature (2798)..(2798): n is a, c, g, or t
  misc_feature (2800)..(2801): n is a, c, g, or t
  misc_feature (2804)..(2806): n is a, c, g, or t
  misc_feature (2826)..(2826): n is a, c, g, or t
  misc_feature (2828)..(2835): n is a, c, g, or t
  misc_feature (2837)..(2839): n is a, c, g, or t
  misc_feature (2842)..(2843): n is a, c, g, or t
  misc_feature (2845)..(2850): n is a, c, g, or t
  misc_feature (2852)..(2853): n is a, c, g, or t
  misc_feature (2855)..(2855): n is a, c, g, or t
  misc_feature (2857)..(2857): n is a, c, g, or t
  misc_feature (2859)..(2859): n is a, c, g, or t
  misc_feature (2861)..(2862): n is a, c, g, or t
  misc_feature (2864)..(2869): n is a, c, g, or t
  misc_feature (2872)..(2872): n is a, c, g, or t
  misc_feature (2874)..(2875): n is a, c, g, or t
  misc_feature (2878)..(2879): n is a, c, g, or t
  misc_feature (2882)..(2884): n is a, c, g, or t
  misc_feature (2888)..(2892): n is a, c, g, or t
  misc_feature (2894)..(2901): n is a, c, g, or t
  misc_feature (2903)..(2905): n is a, c, g, or t
  misc_feature (2908)..(2908): n is a, c, g, or t
  misc_feature (2911)..(2913): n is a, c, g, or t
  misc_feature (2915)..(2919): n is a, c, g, or t
  misc_feature (2921)..(2925): n is a, c, g, or t
  misc_feature (2927)..(2929): n is a, c, g, or t
  misc_feature (2932)..(2932): n is a, c, g, or t
  misc_feature (2935)..(2935): n is a, c, g, or t
  misc_feature (2937)..(2941): n is a, c, g, or t
  misc_feature (2944)..(2945): n is a, c, g, or t
  misc_feature (2948)..(2950): n is a, c, g, or t
  misc_feature (2954)..(2958): n is a, c, g, or t
  misc_feature (2960)..(2967): n is a, c, g, or t
  misc_feature (2969)..(2971): n is a, c, g, or t
  misc_feature (2974)..(2974): n is a, c, g, or t
  misc_feature (2977)..(2977): n is a, c, g, or t
  misc_feature (2980)..(2982): n is a, c, g, or t
  misc_feature (2988)..(2993): n is a, c, g, or t
  misc_feature (2995)..(2996): n is a, c, g, or t
  misc_feature (2999)..(3003): n is a, c, g, or t
  misc_feature (3005)..(3007): n is a, c, g, or t
  misc_feature (3010)..(3011): n is a, c, g, or t
  misc_feature (3014)..(3016): n is a, c, g, or t
  misc_feature (3020)..(3024): n is a, c, g, or t
  misc_feature (3026)..(3033): n is a, c, g, or t
  misc_feature (3035)..(3037): n is a, c, g, or t
  misc_feature (3040)..(3042): n is a, c, g, or t
  misc_feature (3044)..(3044): n is a, c, g, or t
  misc_feature (3047)..(3056): n is a, c, g, or t
  misc_feature (3059)..(3059): n is a, c, g, or t
  misc_feature (3061)..(3071): n is a, c, g, or t
  misc_feature (3073)..(3073): n is a, c, g, or t
  misc_feature (3076)..(3077): n is a, c, g, or t
  misc_feature (3080)..(3082): n is a, c, g, or t
  misc_feature (3086)..(3090): n is a, c, g, or t
  misc_feature (3092)..(3099): n is a, c, g, or t
  misc_feature (3101)..(3103): n is a, c, g, or t
  misc_feature (3106)..(3107): n is a, c, g, or t
  misc_feature (3109)..(3112): n is a, c, g, or t
  misc_feature (3115)..(3124): n is a, c, g, or t
  misc_feature (3126)..(3130): n is a, c, g, or t
  misc_feature (3132)..(3132): n is a, c, g, or t
  misc_feature (3134)..(3135): n is a, c, g, or t
  misc_feature (3137)..(3139): n is a, c, g, or t
  misc_feature (3142)..(3143): n is a, c, g, or t
  misc_feature (3146)..(3148): n is a, c, g, or t
  misc_feature (3152)..(3156): n is a, c, g, or t
  misc_feature (3158)..(3165): n is a, c, g, or t
  misc_feature (3167)..(3169): n is a, c, g, or t
  misc_feature (3172)..(3174): n is a, c, g, or t
  misc_feature (3176)..(3177): n is a, c, g, or t
  misc_feature (3182)..(3183): n is a, c, g, or t
  misc_feature (3186)..(3192): n is a, c, g, or t
  misc_feature (3194)..(3195): n is a, c, g, or t
  misc_feature (3198)..(3199): n is a, c, g, or t
  misc_feature (3201)..(3203): n is a, c, g, or t
  misc_feature (3205)..(3205): n is a, c, g, or t
  misc_feature (3208)..(3209): n is a, c, g, or t
  misc_feature (3212)..(3214): n is a, c, g, or t
  misc_feature (3218)..(3222): n is a, c, g, or t
  misc_feature (3224)..(3231): n is a, c, g, or t
  misc_feature (3233)..(3235): n is a, c, g, or t
  misc_feature (3238)..(3239): n is a, c, g, or t
  misc_feature (3241)..(3246): n is a, c, g, or t
  misc_feature (3248)..(3251): n is a, c, g, or t
  misc_feature (3253)..(3262): n is a, c, g, or t
  misc_feature (3264)..(3264): n is a, c, g, or t
  misc_feature (3266)..(3271): n is a, c, g, or t
  misc_feature (3274)..(3275): n is a, c, g, or t
  misc_feature (3278)..(3280): n is a, c, g, or t
  misc_feature (3284)..(3288): n is a, c, g, or t
  misc_feature (3290)..(3297): n is a, c, g, or t
  misc_feature (3299)..(3301): n is a, c, g, or t
  misc_feature (3304)..(3305): n is a, c, g, or t
  misc_feature (3307)..(3308): n is a, c, g, or t
  misc_feature (3310)..(3311): n is a, c, g, or t
  misc_feature (3313)..(3314): n is a, c, g, or t
  misc_feature (3316)..(3317): n is a, c, g, or t
  misc_feature (3319)..(3321): n is a, c, g, or t
  misc_feature (3323)..(3326): n is a, c, g, or t
  misc_feature (3328)..(3328): n is a, c, g, or t
  misc_feature (3330)..(3332): n is a, c, g, or t
  misc_feature (3334)..(3337): n is a, c, g, or t
  misc_feature (3340)..(3341): n is a, c, g, or t
  misc_feature (3344)..(3346): n is a, c, g, or t
  misc_feature (3350)..(3353): n is a, c, g, or t
  misc_feature (3356)..(3356): n is a, c, g, or t
  misc_feature (3358)..(3363): n is a, c, g, or t
  misc_feature (3365)..(3370): n is a, c, g, or t
  misc_feature (3372)..(3375): n is a, c, g, or t
  misc_feature (3377)..(3378): n is a, c, g, or t
  misc_feature (3380)..(3393): n is a, c, g, or t
  misc_feature (3395)..(3396): n is a, c, g, or t
  misc_feature (3398)..(3399): n is a, c, g, or t
  misc_feature (3401)..(3405): n is a, c, g, or t
  misc_feature (3407)..(3407): n is a, c, g, or t
  misc_feature (3409)..(3410): n is a, c, g, or t
  misc_feature (3412)..(3428): n is a, c, g, or t
  misc_feature (3430)..(3433): n is a, c, g, or t
  misc_feature (3436)..(3440): n is a, c, g, or t
  misc_feature (3445)..(3445): n is a, c, g, or t
  misc_feature (3449)..(3450): n is a, c, g, or t
  misc_feature (3452)..(3464): n is a, c, g, or t
  misc_feature (3467)..(3469): n is a, c, g, or t
  misc_feature (3472)..(3474): n is a, c, g, or t
  misc_feature (3477)..(3478): n is a, c, g, or t
  misc_feature (3481)..(3492): n is a, c, g, or t
  misc_feature (3494)..(3494): n is a, c, g, or t
  misc_feature (3496)..(3497): n is a, c, g, or t
  misc_feature (3500)..(3503): n is a, c, g, or t
  misc_feature (3505)..(3505): n is a, c, g, or t
  misc_feature (3507)..(3513): n is a, c, g, or t
  misc_feature (3515)..(3518): n is a, c, g, or t
  misc_feature (3520)..(3521): n is a, c, g, or t
  misc_feature (3523)..(3524): n is a, c, g, or t
  misc_feature (3526)..(3531): n is a, c, g, or t
  misc_feature (3533)..(3534): n is a, c, g, or t
  misc_feature (3537)..(3541): n is a, c, g, or t
  misc_feature (3543)..(3546): n is a, c, g, or t
  misc_feature (3548)..(3548): n is a, c, g, or t
  misc_feature (3550)..(3556): n is a, c, g, or t
  misc_feature (3558)..(3561): n is a, c, g, or t
  misc_feature (3563)..(3563): n is a, c, g, or t
  misc_feature (3565)..(3568): n is a, c, g, or t
  misc_feature (3570)..(3574): n is a, c, g, or t
  misc_feature (3579)..(3580): n is a, c, g, or t
  misc_feature (3583)..(3587): n is a, c, g, or t
  misc_feature (3589)..(3593): n is a, c, g, or t
  misc_feature (3595)..(3598): n is a, c, g, or t
  misc_feature (3600)..(3600): n is a, c, g, or t
  misc_feature (3602)..(3602): n is a, c, g, or t
  misc_feature (3604)..(3607): n is a, c, g, or t
  misc_feature (3610)..(3611): n is a, c, g, or t
  misc_feature (3613)..(3614): n is a, c, g, or t
  misc_feature (3616)..(3634): n is a, c, g, or t
  misc_feature (3636)..(3638): n is a, c, g, or t
  misc_feature (3641)..(3644): n is a, c, g, or t
  misc_feature (3646)..(3646): n is a, c, g, or t
  misc_feature (3648)..(3648): n is a, c, g, or t
gggaagcgaattatgggattcagaacagttgtcattaccaacccgtgtaagctaacgtataaaaatgattatttaatcatacgtggagaagatgtgaatatgatacatctttccgagatatcaacgctgttgatcgataccacaatggtatcgatcacagcttacctcctgtgtgaactggtaaaaaataagattaaagttgttttttgtgatgagcgtagaaatcctgtcagtgaattaattccatactatggctgtcacaatagcagtaaacgggttatgaaccagattctttgggatgattattataaaaaagcagtatggacagctattgtgcggcaaaaaataaaaaatcaggcattattgttgaaagcattagggaaacctgaatatgccaaattggagggatatatagaggaactggaatttttcgatgtaaccaatcgggaaggccatgctgcaaaagtatacttgaacagtttatttgggaaagatttttgccgagaagatccgaatgacattaatgctgcgctaaattatggatatgcggttatcctgtcaactttcaataaagagattgtgagtaagggttaccttacgcaacttgggattaggcataaaaatgaatttaacttttttaacttatcctgtgatttaatggagccctttcgtgtgctggttgatcatctggtttatatacatcaaacagagtattttgatagcaactacaagctgaaactggtagagatattaaatcagccggttcgcctagggggacgggaaaatatattaatgaatgcgattcagatttatatcgaaagtgtagttaaggccattgagacgaaagaattaaatcaattgttattatatgagtttgcatgagagagcgttttatgagaatattaatcttttttgatttgccggtagaaacatctgaggataggaaagagtatcgacgttttcgaaaattcctcataaaagagggtttcgtgatgatgcaggagtcggtctattccaaacttgccctcaatggttcggcgctggatttaattgtgaacaaaattaaacgggaaaagccgaaagagggcttggttcagattttgaatattacggaaaagcaatttgcttccatcattaatatctgtggcgaaaataaacagaatgtgattgagtctgcttcgaggttggttgttttatgaaactgcggattttcccattggaaaatgagataatttttggggattgggttaatgttctggagattaacaatcctaaactcttttcaaacattgtgtggagcattgatgccattattaatggggagaagggtaaggagcagatagttgccatcgatgaaacgggaattgttgatatgactaaagaatgcttgttattgatcgatccgcttcatttggattttgggcaaaaaaggttttccagtaaattgcttcaaatgatcgaagaaatgtataataatgattatgagctgaaggaaaagattttgcattatttatcggagataaactatcttttccaatctatttttgatgaattttcctttgacatctcttataaaaatgccggagttcaggattatctaaaaatgatttcaccgaagatcgatatgggaggaaacagaacaccgcttgagaatttatttgggttaattgatgtaataacagagtttagactggtcaaacttttatttttgtgtaatatgaaaagtttttttacgaataaagagcttgttgaactgtacaaatattcattatataaaaaaataaatcttttaatggtggaacctcgctgtgttagtgaattgctggaatacgaaaggaaggtggtggttgatgaagagtttgatgattttcttgtgggtcattaaaccattcaaaatggccggttttttcgttgaaaacaaatctctgaagcctataaaagatttgaggttttagagttgtgtcattctgaatggtattaaaacnnnnnnnnnngnnntnannnnnnnnnannngttttagagttgtgtcattctgaatggtattaaaaccnnnaannnnnnnnnnnnnncnnnancnnngttttagagttgtgtcattctgaatggtattaaaacnnannnnntgnnntngnnnnnnnnntnnnngttttagagttgtgtcattctgaatggtattaaaacnnnngnnnngngannnnnnnnnaannnnnngttttagagttgtgtcattctgaatggtattaaaacnnnnnnnnnnnnnnnnnnnnnnnnnnnnnngttttagagttgtgtcattctgaatggtattaaaacccanannnnnnnnnncnnnnnnatnnnnnngttttagagttgtgtcattctgaatggtattaaaacannannannggctnnnnnngnnnnnnnnnngttttagagttgtgtcattntnnntngtntnaaaacannnnnncnnnntnngnnnnnnnncnnntngntttnnagtnntgtnannctnaatnnnnttnaaannnannngnnnnannnnannnnnnnnnnnannntttnnagnngtgtnnnnntgaatnnnnttnnaacnnnnnnnnngnnntnnnnnnnnnntaacnagttttagagttgtgtcattctgaatggtattaaaacactnnagaacatntntgtnntgcnnncancgttttagagttgtgtcattctgaatggtattaaaacacnnggtacgnttngaantntcacggnnnggttttagagttgtgtcattctgaatggtattaaaacacnatttnnanaatcanncnangnntcnnngttttagagttgtgtcattntnnnnnnnntnnnaanncnnnnnntnnangntntnnannnnnngcngnnttnnagnnntgtnnnnntnnnnnnnntnnnaanacnnnannnnntnnnnntnnntcntcntnnnnnttnnagnnntgtnnnnntnnnnnnnntnnnaanacnagnnnatgttnnnnnngnngannnnntnnnttnnagnnntgtnnnnntnnnnnnnntnnnaannnangannnnnnnnnnagncnnnnnnnnnnntnttnnagnnntgtnnnnntnnnnnnnntnnnaanncnnnnggnnnnnnnnnntnnnnncnanntnnnttnnagnnntgtnnnnntnnnnnnnntnnnaannntnnatttnntgnnnnnnnanntgnncnnntnttnnagnnntgtnnnnntnnnnnnnntnnnaanncnnnnnncnnnntnnnnnnnnnngnannnnnnttnnagnnntgtnnnnntnnnnnnnntnnnaanncnncnntnntnnannncnnnncncnnncnnnnttnnagnnntgtnnnnttntnnnnnntnnnnnnannnntnnannnnnnnnnnnnnntnngnncnnnnntnanngnnnnnnnnnnnnnnnnngnnnnaannnnnacccnattnnannnnnnnnnnnnnatnnnttnnnganntgnnnnnnnnnnnntngnnttnnnncnannnnnnnannnnannanngnnnnnngnngtnnnnnannnntntnnnnnnnannnntntnnnnannnnnatcannatnnnnntnnnnntnnnnangntnnnnagnngnntnnnnnnnnnnnnnnnnnnnannnaannnnananattaatggccattacgaagttttagagttgtgtcattctgaatggtattaaaactgaaagcattatcattattgagcttggcatgttttagagttgtgtcattctgaatggtattaaaacgcggtttaagctgttcgaacagcaaatcaagttttagagttgtgtcattctgaatggtattaaaactacaatgcatgatcttgggatgtgttccgagttttagagttgtgtcattctgaatggtattaaaacaaaaatggaaagagataatcaaggattatagttttagagttgtgtcattctgaatggtattaaaaccgataatacagtcaccatccactggaataagttt

SEQ ID NO: 1482 - DNA, 4000 bp, Escherichia coli
  misc_feature (33)..(33): n is a, c, g, or t
  misc_feature (237)..(237): n is a, c, g, or t
  misc_feature (373)..(373): n is a, c, g, or t
  misc_feature (448)..(448): n is a, c, g, or t
  misc_feature (469)..(469): n is a, c, g, or t
  misc_feature (481)..(481): n is a, c, g, or t
  misc_feature (519)..(519): n is a, c, g, or t
  misc_feature (553)..(553): n is a, c, g, or t
  misc_feature (640)..(640): n is a, c, g, or t
  misc_feature (673)..(673): n is a, c, g, or t
  misc_feature (688)..(688): n is a, c, g, or t
  misc_feature (691)..(691): n is a, c, g, or t
  misc_feature (781)..(781): n is a, c, g, or t
  misc_feature (796)..(796): n is a, c, g, or t
  misc_feature (853)..(853): n is a, c, g, or t
  misc_feature (862)..(862): n is a, c, g, or t
  misc_feature (895)..(895): n is a, c, g, or t
  misc_feature (925)..(925): n is a, c, g, or t
  misc_feature (994)..(994): n is a, c, g, or t
  misc_feature (1035)..(1035): n is a, c, g, or t
  misc_feature (1078)..(1078): n is a, c, g, or t
  misc_feature (1093)..(1093): n is a, c, g, or t
  misc_feature (1105)..(1105): n is a, c, g, or t
  misc_feature (1141)..(1141): n is a, c, g, or t
  misc_feature (1144)..(1144): n is a, c, g, or t
  misc_feature (1207)..(1207): n is a, c, g, or t
  misc_feature (1213)..(1213): n is a, c, g, or t
  misc_feature (1222)..(1222): n is a, c, g, or t
  misc_feature (1276)..(1276): n is a, c, g, or t
  misc_feature (1284)..(1284): n is a, c, g, or t
  misc_feature (1342)..(1342): n is a, c, g, or t
  misc_feature (1351)..(1351): n is a, c, g, or t
  misc_feature (1363)..(1363): n is a, c, g, or t
  misc_feature (1375)..(1375): n is a, c, g, or t
  misc_feature (1411)..(1411): n is a, c, g, or t
  misc_feature (1441)..(1441): n is a, c, g, or t
  misc_feature (1770)..(1770): n is a, c, g, or t
  misc_feature (1821)..(1821): n is a, c, g, or t
  misc_feature (2009)..(2009): n is a, c, g, or t
  misc_feature (2352)..(2352): n is a, c, g, or t
  misc_feature (3505)..(3505): n is a, c, g, or t
  misc_feature (3976)..(3976): n is a, c, g, or t
gtaagattatcaacaatggttaaatgaggaaanaggttaaagtgctggaataccatagacacttcacttctaatttgtctaattttttgtgcgtcatcggtcaattctgttccagataccactatagagccctcttggaatttttctaagaaattaacacaccttatcagagttgatttaccacttcctgaaggcccacagacaacaattatttcaccttcctttatctctagattnatgttcttgagggcatgaaagtctccataccacttatttaagtcagatatttctatgatattggttttatttttatcgttgctcattttcttataacctttagtttttattttcagtattgaatcgtatttctaanttctttgagtagcgggacattgtatatagtatagcccacataacaatagtaacgaatacaaagccttctgtttcnctggcaagccaatatgggtcnttactagttagnttgaccatagcaagcatatcgaatagtccaataatcanaacaagcgttgtatctttaaataaagaaattgangagccaacaatatttggtattgatatttttaatgcttgtggaagaataattagtgcgtttttttggaaataactcaagcctattgcntcagctgcctcatattgacctcttggaatagcntgaagccctcctctnacnacttcagcaaagtatgcagcttgaaaaagagcaataccgataagcgctcttaagagcttatcaaaataatttcctgactctaagaatagngggagaacaaaagangccataaacaaaatagtgattaatggcacagctctaataaactcaataaataaagtngaaaatagnttgattacctttaaatctgattgtcttcctagngctagaaggactcctattggaaaagaaacnataatccctactgatgcaataattaatgtcagcaataagccgccccattgatcagttgaaacaggcatnaatattccaaagccaccagcaattaaaacataggaaaccantgggtaaaagatgattaatgataaagtgactctatttttgtanttatagttttttacnagcgggactatnacaaatagcaggccagttagtgcaaatactgtattnggnctccaggtctctgttcgaggatagaatccataggtatacatgtaaagcttttcataaatatanggccancaagccccnactctgccacagttttgattagttgccatttcctcactaaactttatttcaaanccaaaaangtttacagttccaaaactaaagcttgcattaaagaacatccagtcaagcaatggaggnatcataatntaaagcaaatanagcgatgcaagngtaagggctgaatttacccatgaagagaagagattngttctaagccatacaagtgcaccaatttgngatattggcggctttctagtagcttgttggtcaaatactggcataattatcttccctgaatttccatctttttattgacatagttcagcaataaagagataaatagtgaaatgactagataaacaagcatcgccatggctagaatttcgactgcctggccaacttgatttaaaacagttcctccaaaagtactcattaactctggatagccaattacggtagctaaagaagagttttttgtaagattcaaatactggttaattgttggcggtattgcaaccctaagggcttgtggcaaaataataagtttaagcgattgaacgggtgtnaagccaatcgcagctgcagcctctttttgtcccttgtcaactgcctcaatncctgatcgaatggcctcagcaatataggttgcagtataaacactaagagcaaacgttaatgctaaaaactctggcacaactgccattccaccctttaagttaaatttacctagaacggcaaagtcaaatgccagtggagatccaaataccagataaacaagaattggcagaccaagaattaaaccaantgaatatggccatgtactggtgtgaataccagttagttcatgcttcttcttataggatttcttaataaaataagctgcaatgattccaatgatgaatgcaaatactacgtataagaagccctcttcagggattggtttgggcagatacaaacctcgttgatttagaaatgcaagatcaaaaaatgatagactttgctttgggtgcggaaaaacattaataaataagttataccaaaataaaatttgaagaagtataggaatgtttctaaagagctctatgtagccccctgctagcttagcaacaagataattatttgaaagtcttgcgataccaataagaagncctattagcgtcgataaaatgattccaataaaggcgacaacaagtgtgttaattaatcccacataaaaaacagttaagtttgaagattcaggggtgtagtcaaccgcaatattgcctaaaaaagggagtatgtcaaagcctgctctgttttttaggaatgtaaatccagtttggatgcctctatcttcaatgttttgaaagaggtttcctattgctgtataaaaaagccctattaccaggacaaaggtaattacttggaataaaaaagacctgacttcgttgttataaagtagatctcgaaagtttgatcctctgtgttgagattttcctaaggattcgaggataagttttttcataaattgctaaaaatttgaatatgaatattttactaaatatagtgtttctaagtttgaaaaaatcaaaaaaaaaccagactgctaaagtatagcagtctggtttaggttctaactagataattgcttatctaaatggaggtgagtaaagaataccaccttgtgaccatagtgcgttaacaccacgagcaataccaattggagtagaaagtccaatgttacgctcgaagctttcagcatagttacctacttgcttaacgatttggtaagtccagtctggagtcagaccaacatactcatgagtgcttcctgaacgacccattaagcgctcacgctctgggttgttagaaacatcatcaacgttaccactgttaacaccaatttcttctgcagtaatcatagcgtttaaagaccatcttacaatgttgaaccattgatcgtcaccttgacgaacaacaggacctagaggctctttagaaatgatttctggaagtactacatgctctgaaggatcatttgcacctgcacgcattgagtaaagaccagaagcatcagttgttaatacatcacaacgtccagcatcatagttagttagagtttgagcattagtatctgatacaactgagttgtactcgattccatttgctttaccccagtcagctaagttcaattcagtagtagtacctgcttgaatacaaatagcagcaccacttaattccatagcactagaaacacctagagaagacttaaccataaagccttgtccgtcgtagtagttaacaccagcaaagttcaatccnaatgaagcgtcacgagtaattgtccaagtcgtatttctagacaacatatcgatctcaccagattgtagcgcagtgaatctttccttagcagttaatggtacaaatttaactttagttgcatcgccaagcgttgcagcagcaacagcacgacaaacatcaacgtcaataccagtccatgtaccagacgagtcagctgaagaaaaaccagcaagacctttagagacaccacaagatacgtgtcctttagcctgaacgtcgctcaaagtagaagcttgtacactaagtgcaccaacaactaacaatgaagcagcagacaattttaataattgtttcatatatatctccttaatgagtttcaaagtataaaaaaccttcacaattgaatgaggttcacagaaaattttaacactagttaaacaagtaatacaaattaattattaaaaaaaaatttaaatcaattcaactagcaangcttgatttttgctattaaagcga

SEQ ID NO: 1483 - DNA, 4000 bp, Escherichia coli
  misc_feature (1)..(2): n is a, c, g, or t
  misc_feature (5)..(5): n is a, c, g, or t
  misc_feature (8)..(12): n is a, c, g, or t
  misc_feature (14)..(14): n is a, c, g, or t
  misc_feature (16)..(20): n is a, c, g, or t
  misc_feature (22)..(31): n is a, c, g, or t
  misc_feature (34)..(34): n is a, c, g, or t
  misc_feature (36)..(37): n is a, c, g, or t
  misc_feature (39)..(45): n is a, c, g, or t
  misc_feature (48)..(52): n is a, c, g, or t
  misc_feature (55)..(61): n is a, c, g, or t
  misc_feature (63)..(77): n is a, c, g, or t
  misc_feature (80)..(82): n is a, c, g, or t
  misc_feature (84)..(94): n is a, c, g, or t
  misc_feature (96)..(108): n is a, c, g, or t
  misc_feature (110)..(112): n is a, c, g, or t
  misc_feature (114)..(125): n is a, c, g, or t
  misc_feature (127)..(148): n is a, c, g, or t
  misc_feature (150)..(152): n is a, c, g, or t
  misc_feature (154)..(154): n is a, c, g, or t
  misc_feature (157)..(157): n is a, c, g, or t
  misc_feature (159)..(161): n is a, c, g, or t
  misc_feature (163)..(165): n is a, c, g, or t
  misc_feature (169)..(170): n is a, c, g, or t
  misc_feature (172)..(178): n is a, c, g, or t
  misc_feature (180)..(201): n is a, c, g, or t
  misc_feature (204)..(204): n is a, c, g, or t
  misc_feature (207)..(223): n is a, c, g, or t
  misc_feature (225)..(225): n is a, c, g, or t
  misc_feature (227)..(233): n is a, c, g, or t
  misc_feature (235)..(238): n is a, c, g, or t
  misc_feature (240)..(241): n is a, c, g, or t
  misc_feature (243)..(245): n is a, c, g, or t
  misc_feature (247)..(253): n is a, c, g, or t
  misc_feature (255)..(256): n is a, c, g, or t
  misc_feature (258)..(258): n is a, c, g, or t
  misc_feature (260)..(260): n is a, c, g, or t
  misc_feature (262)..(266): n is a, c, g, or t
  misc_feature (269)..(274): n is a, c, g, or t
  misc_feature (276)..(276): n is a, c, g, or t
  misc_feature (280)..(281): n is a, c, g, or t
  misc_feature (283)..(291): n is a, c, g, or t
  misc_feature (294)..(299): n is a, c, g, or t
  misc_feature (301)..(307): n is a, c, g, or t
  misc_feature (309)..(312): n is a, c, g, or t
  misc_feature (316)..(323): n is a, c, g, or t
  misc_feature (325)..(325): n is a, c, g, or t
  misc_feature (328)..(333): n is a, c, g, or t
  misc_feature (335)..(341): n is a, c, g, or t
  misc_feature (343)..(349): n is a, c, g, or t
  misc_feature (352)..(352): n is a, c, g, or t
  misc_feature (354)..(365): n is a, c, g, or t
  misc_feature (367)..(375): n is a, c, g, or t
  misc_feature (378)..(381): n is a, c, g, or t
  misc_feature (386)..(386): n is a, c, g, or t
  misc_feature (390)..(391): n is a, c, g, or t
  misc_feature (394)..(396): n is a, c, g, or t
  misc_feature (400)..(403): n is a, c, g, or t
  misc_feature (409)..(409): n is a, c, g, or t
  misc_feature (412)..(413): n is a, c, g, or t
  misc_feature (416)..(416): n is a, c, g, or t
  misc_feature (419)..(424): n is a, c, g, or t
  misc_feature (427)..(438): n is a, c, g, or t
  misc_feature (442)..(448): n is a, c, g, or t
  misc_feature (457)..(461): n is a, c, g, or t
  misc_feature (464)..(464): n is a, c, g, or t
  misc_feature (469)..(469): n is a, c, g, or t
  misc_feature (568)..(569): n is a, c, g, or t
  misc_feature (613)..(613): n is a, c, g, or t
  misc_feature (1062)..(1062): n is a, c, g, or t
  misc_feature (1137)..(1137): n is a, c, g, or t
  misc_feature (1425)..(1425): n is a, c, g, or t
  misc_feature (2484)..(2486): n is a, c, g, or t
  misc_feature (2489)..(2491): n is a, c, g, or t
  misc_feature (2493)..(2493): n is a, c, g, or t
  misc_feature (2495)..(2497): n is a, c, g, or t
  misc_feature (2499)..(2500): n is a, c, g, or t
  misc_feature (2503)..(2503): n is a, c, g, or t
  misc_feature (2506)..(2506): n is a, c, g, or t
  misc_feature (2508)..(2510): n is a, c, g, or t
  misc_feature (2516)..(2517): n is a, c, g, or t
  misc_feature (2521)..(2522): n is a, c, g, or t
  misc_feature (2528)..(2532): n is a, c, g, or t
  misc_feature (2538)..(2540): n is a, c, g, or t
  misc_feature (2542)..(2542): n is a, c, g, or t
  misc_feature (2547)..(2547): n is a, c, g, or t
  misc_feature (2549)..(2552): n is a, c, g, or t
  misc_feature (2554)..(2554): n is a, c, g, or t
  misc_feature (2557)..(2566): n is a, c, g, or t
  misc_feature (2569)..(2569): n is a, c, g, or t
  misc_feature (2572)..(2574): n is a, c, g, or t
  misc_feature (2576)..(2577): n is a, c, g, or t
  misc_feature (2579)..(2580): n is a, c, g, or t
  misc_feature (2582)..(2582): n is a, c, g, or t
  misc_feature (2584)..(2585): n is a, c, g, or t
  misc_feature (2587)..(2587): n is a, c, g, or t
  misc_feature (2590)..(2590): n is a, c, g, or t
  misc_feature (2595)..(2595): n is a, c, g, or t
  misc_feature (2599)..(2600): n is a, c, g, or t
  misc_feature (2602)..(2602): n is a, c, g, or t
  misc_feature (2605)..(2607): n is a, c, g, or t
  misc_feature (2611)..(2615): n is a, c, g, or t
  misc_feature (2617)..(2617): n is a, c, g, or t
  misc_feature (2619)..(2619): n is a, c, g, or t
  misc_feature (2621)..(2622): n is a, c, g, or t
  misc_feature (2625)..(2626): n is a, c, g, or t
  misc_feature (2628)..(2628): n is a, c, g, or t
  misc_feature (2630)..(2630): n is a, c, g, or t
  misc_feature (2633)..(2633): n is a, c, g, or t
  misc_feature (2637)..(2643): n is a, c, g, or t
  misc_feature (2645)..(2648): n is a, c, g, or t
  misc_feature (2650)..(2652): n is a, c, g, or t
  misc_feature (2656)..(2657): n is a, c, g, or t
  misc_feature (2661)..(2662): n is a, c, g, or t
  misc_feature (2665)..(2666): n is a, c, g, or t
  misc_feature (2672)..(2673): n is a, c, g, or t
  misc_feature (2675)..(2675): n is a, c, g, or t
  misc_feature (2677)..(2677): n is a, c, g, or t
  misc_feature (2680)..(2680): n is a, c, g, or t
  misc_feature (2682)..(2684): n is a, c, g, or t
  misc_feature (2686)..(2691): n is a, c, g, or t
  misc_feature (2693)..(2693): n is a, c, g, or t
  misc_feature (2696)..(2696): n is a, c, g, or t
  misc_feature (2698)..(2698): n is a, c, g, or t
  misc_feature (2701)..(2702): n is a, c, g, or t
  misc_feature (2704)..(2705): n is a, c, g, or t
  misc_feature (2708)..(2708): n is a, c, g, or t
  misc_feature (2712)..(2715): n is a, c, g, or t
  misc_feature (2718)..(2718): n is a, c, g, or t
  misc_feature (2722)..(2722): n is a, c, g, or t
  misc_feature (2724)..(2726): n is a, c, g, or t
  misc_feature (2728)..(2728): n is a, c, g, or t
  misc_feature (2730)..(2731): n is a, c, g, or t
  misc_feature (2734)..(2735): n is a, c, g, or t
  misc_feature (2740)..(2744): n is a, c, g, or t
  misc_feature (2748)..(2749): n is a, c, g, or t
  misc_feature (2751)..(2752): n is a, c, g, or t
  misc_feature (2754)..(2756): n is a, c, g, or t
  misc_feature (2758)..(2760): n is a, c, g, or t
  misc_feature (2764)..(2764): n is a, c, g, or t
  misc_feature (2768)..(2769): n is a, c, g, or t
  misc_feature (2771)..(2771): n is a, c, g, or t
  misc_feature (2774)..(2774): n is a, c, g, or t
  misc_feature (2776)..(2776): n is a, c, g, or t
  misc_feature (2779)..(2781): n is a, c, g, or t
  misc_feature (2783)..(2783): n is a, c, g, or t
  misc_feature (2785)..(2787): n is a, c, g, or t
  misc_feature (2789)..(2789): n is a, c, g, or t
  misc_feature (2792)..(2796): n is a, c, g, or t
  misc_feature (2798)..(2798): n is a, c, g, or t
  misc_feature (2801)..(2802): n is a, c, g, or t
  misc_feature (2804)..(2806): n is a, c, g, or t
  misc_feature (2808)..(2809): n is a, c, g, or t
  misc_feature (2811)..(2811): n is a, c, g, or t
  misc_feature (2813)..(2814): n is a, c, g, or t
  misc_feature (2816)..(2819): n is a, c, g, or t
  misc_feature (2823)..(2823): n is a, c, g, or t
  misc_feature (2826)..(2827): n is a, c, g, or t
  misc_feature (2829)..(2829): n is a, c, g, or t
  misc_feature (2834)..(2837): n is a, c, g, or t
  misc_feature (2844)..(2850): n is a, c, g, or t
  misc_feature (2852)..(2855): n is a, c, g, or t
  misc_feature (2859)..(2859): n is a, c, g, or t
  misc_feature (2863)..(2865): n is a, c, g, or t
  misc_feature (2868)..(2868): n is a, c, g, or t
  misc_feature (2870)..(2871): n is a, c, g, or t
  misc_feature (2873)..(2873): n is a, c, g, or t
  misc_feature (2880)..(2880): n is a, c, g, or t
  misc_feature (2884)..(2888): n is a, c, g, or t
  misc_feature (2890)..(2898): n is a, c, g, or t
  misc_feature (2900)..(2901): n is a, c, g, or t
  misc_feature (2904)..(2904): n is a, c, g, or t
  misc_feature (2907)..(2908): n is a, c, g, or t
  misc_feature (2910)..(2911): n is a, c, g, or t
  misc_feature (2913)..(2916): n is a, c, g, or t
  misc_feature (2918)..(2918): n is a, c, g, or t
  misc_feature (2920)..(2922): n is a, c, g, or t
  misc_feature (2924)..(2925): n is a, c, g, or t
  misc_feature (2927)..(2927): n is a, c, g, or t
  misc_feature (2930)..(2934): n is a, c, g, or t
  misc_feature (2936)..(2936): n is a, c, g, or t
  misc_feature (2939)..(2940): n is a, c, g, or t
  misc_feature (2942)..(2943): n is a, c, g, or t
  misc_feature (2946)..(2948): n is a, c, g, or t
  misc_feature (2950)..(2950): n is a, c, g, or t
  misc_feature (2952)..(2953): n is a, c, g, or t
  misc_feature (2955)..(2955): n is a, c, g, or t
  misc_feature (2957)..(2963): n is a, c, g, or t
  misc_feature (2965)..(2971): n is a, c, g, or t
  misc_feature (2973)..(2973): n is a, c, g, or t
  misc_feature (2975)..(2978): n is a, c, g, or t
  misc_feature (2982)..(2984): n is a, c, g, or t
  misc_feature (2986)..(2986): n is a, c, g, or t
  misc_feature (2988)..(2993): n is a, c, g, or t
  misc_feature (2995)..(2995): n is a, c, g, or t
  misc_feature (2997)..(3001): n is a, c, g, or t
  misc_feature (3003)..(3003): n is a, c, g, or t
  misc_feature (3005)..(3005): n is a, c, g, or t
  misc_feature (3007)..(3008): n is a, c, g, or t
  misc_feature (3010)..(3014): n is a, c, g, or t
  misc_feature (3017)..(3017): n is a, c, g, or t
  misc_feature (3019)..(3022): n is a, c, g, or t
  misc_feature (3024)..(3024): n is a, c, g, or t
  misc_feature (3029)..(3047): n is a, c, g, or t
  misc_feature (3052)..(3061): n is a, c, g, or t
  misc_feature (3065)..(3066): n is a, c, g, or t
  misc_feature (3068)..(3069): n is a, c, g, or t
  misc_feature (3071)..(3072): n is a, c, g, or t
  misc_feature (3075)..(3080): n is a, c, g, or t
  misc_feature (3083)..(3086): n is a, c, g, or t
  misc_feature (3088)..(3095): n is a, c, g, or t
  misc_feature (3099)..(3101): n is a, c, g, or t
  misc_feature (3104)..(3122): n is a, c, g, or t
  misc_feature (3127)..(3154): n is a, c, g, or t
  misc_feature (3158)..(3164): n is a, c, g, or t
  misc_feature (3166)..(3167): n is a, c, g, or t
  misc_feature (3169)..(3170): n is a, c, g, or t
  misc_feature (3172)..(3172): n is a, c, g, or t
  misc_feature (3174)..(3177): n is a, c, g, or t
  misc_feature (3179)..(3183): n is a, c, g, or t
  misc_feature (3185)..(3195): n is a, c, g, or t
  misc_feature (3197)..(3199): n is a, c, g, or t
  misc_feature (3201)..(3210): n is a, c, g, or t
  misc_feature (3212)..(3212): n is a, c, g, or t
  misc_feature (3216)..(3216): n is a, c, g, or t
  misc_feature (3218)..(3218): n is a, c, g, or t
  misc_feature (3221)..(3235): n is a, c, g, or t
  misc_feature (3237)..(3242): n is a, c, g, or t
  misc_feature (3245)..(3253): n is a, c, g, or t
  misc_feature (3255)..(3258): n is a, c, g, or t
  misc_feature (3261)..(3261): n is a, c, g, or t
  misc_feature (3263)..(3271): n is a, c, g, or t
  misc_feature (3273)..(3284): n is a, c, g, or t
  misc_feature (3286)..(3288): n is a, c, g, or t
  misc_feature (3292)..(3300): n is a, c, g, or t
  misc_feature (3302)..(3305): n is a, c, g, or t
  misc_feature (3307)..(3310): n is a, c, g, or t
  misc_feature (3312)..(3312): n is a, c, g, or t
  misc_feature (3314)..(3314): n is a, c, g, or t
  misc_feature (3317)..(3320): n is a, c, g, or t
  misc_feature (3322)..(3326): n is a, c, g, or t
  misc_feature (3330)..(3333): n is a, c, g, or t
  misc_feature (3335)..(3335): n is a, c, g, or t
  misc_feature (3337)..(3339): n is a, c, g, or t
  misc_feature (3341)..(3341): n is a, c, g, or t
  misc_feature (3344)..(3345): n is a, c, g, or t
  misc_feature (3350)..(3351): n is a, c, g, or t
  misc_feature (3353)..(3353): n is a, c, g, or t
  misc_feature (3355)..(3355): n is a, c, g, or t
  misc_feature (3358)..(3358): n is a, c, g, or t
  misc_feature (3360)..(3360): n is a, c, g, or t
  misc_feature (3362)..(3362): n is a, c, g, or t
  misc_feature (3368)..(3368): n is a, c, g, or t
  misc_feature (3371)..(3371): n is a, c, g, or t
  misc_feature (3373)..(3375): n is a, c, g, or t
  misc_feature (3377)..(3378): n is a, c, g, or t
  misc_feature (3381)..(3381): n is a, c, g, or t
  misc_feature (3387)..(3388): n is a, c, g, or t
  misc_feature (3391)..(3393): n is a, c, g, or t
  misc_feature (3395)..(3396): n is a, c, g, or t
  misc_feature (3401)..(3401): n is a, c, g, or t
  misc_feature (3416)..(3416): n is a, c, g, or t
  misc_feature (3420)..(3422): n is a, c, g, or t
  misc_feature (3426)..(3426): n is a, c, g, or t
  misc_feature (3430)..(3430): n is a, c, g, or t
  misc_feature (3435)..(3435): n is a, c, g, or t
  misc_feature (3438)..(3438): n is a, c, g, or t
  misc_feature (3441)..(3441): n is a, c, g, or t
  misc_feature (3446)..(3446): n is a, c, g, or t
  misc_feature (3450)..(3450): n is a, c, g, or t
  misc_feature (3452)..(3452): n is a, c, g, or t
  misc_feature (3454)..(3454): n is a, c, g, or t
  misc_feature (3456)..(3456): n is a, c, g, or t
  misc_feature (3462)..(3462): n is a, c, g, or t
  misc_feature (3466)..(3467): n is a, c, g, or t
  misc_feature (3469)..(3469): n is a, c, g, or t
  misc_feature (3472)..(3473): n is a, c, g, or t
  misc_feature (3475)..(3475): n is a, c, g, or t
  misc_feature (3477)..(3477): n is a, c, g, or t
  misc_feature (3481)..(3481): n is a, c, g, or t
  misc_feature (3486)..(3486): n is a, c, g, or t
  misc_feature (3491)..(3491): n is a, c, g, or t
  misc_feature (3494)..(3498): n is a, c, g, or t
  misc_feature (3500)..(3500): n is a, c, g, or t
  misc_feature (3502)..(3503): n is a, c, g, or t
  misc_feature (3509)..(3510): n is a, c, g, or t
  misc_feature (3513)..(3513): n is a, c, g, or t
  misc_feature (3515)..(3515): n is a, c, g, or t
  misc_feature (3525)..(3525): n is a, c, g, or t
  misc_feature (3528)..(3529): n is a, c, g, or t
  misc_feature (3531)..(3535): n is a, c, g, or t
  misc_feature (3546)..(3546): n is a, c, g, or t
  misc_feature (3550)..(3550): n is a, c, g, or t
  misc_feature (3556)..(3556): n is a, c, g, or t
  misc_feature (3560)..(3560): n is a, c, g, or t
  misc_feature (3565)..(3567): n is a, c, g, or t
  misc_feature (3569)..(3569): n is a, c, g, or t
  misc_feature (3571)..(3572): n is a, c, g, or t
  misc_feature (3574)..(3576): n is a, c, g, or t
  misc_feature (3580)..(3581): n is a, c, g, or t
  misc_feature (3583)..(3584): n is a, c, g, or t
  misc_feature (3587)..(3588): n is a, c, g, or t
  misc_feature (3594)..(3594): n is a, c, g, or t
  misc_feature (3597)..(3597): n is a, c, g, or t
  misc_feature (3602)..(3602): n is a, c, g, or t
  misc_feature (3604)..(3604): n is a, c, g, or t
  misc_feature (3606)..(3606): n is a, c, g, or t
  misc_feature (3609)..(3609): n is a, c, g, or t
  misc_feature (3611)..(3612): n is a, c, g, or t
  misc_feature (3616)..(3616): n is a, c, g, or t
  misc_feature (3618)..(3620): n is a, c, g, or t
  misc_feature (3627)..(3628): n is a, c, g, or t
  misc_feature (3635)..(3635): n is a, c, g, or t
  misc_feature (3638)..(3638): n is a, c, g, or t
  misc_feature (3642)..(3642): n is a, c, g, or t
  misc_feature (3645)..(3645): n is a, c, g, or t
  misc_feature (3647)..(3647): n is a, c, g, or t
  misc_feature (3650)..(3650): n is a, c, g, or t
  misc_feature (3654)..(3655): n is a, c, g, or t
  misc_feature (3659)..(3659): n is a, c, g, or t
  misc_feature (3662)..(3663): n is a, c, g, or t
  misc_feature (3665)..(3665): n is a, c, g, or t
  misc_feature (3668)..(3669): n is a, c, g, or t
  misc_feature (3675)..(3675): n is a, c, g, or t
  misc_feature (3678)..(3678): n is a, c, g, or t
  misc_feature (3680)..(3680): n is a, c, g, or t
  misc_feature (3685)..(3685): n is a, c, g, or t
  misc_feature (3687)..(3688): n is a, c, g, or t
  misc_feature (3692)..(3693): n is a, c, g, or t
  misc_feature (3702)..(3702): n is a, c, g, or t
  misc_feature (3711)..(3711): n is a, c, g, or t
  misc_feature (3714)..(3714): n is a, c, g, or t
  misc_feature (3716)..(3716): n is a, c, g, or t
  misc_feature (3719)..(3722): n is a, c, g, or t
  misc_feature (3724)..(3727): n is a, c, g, or t
  misc_feature (3730)..(3731): n is a, c, g, or t
  misc_feature (3733)..(3733): n is a, c, g, or t
  misc_feature (3735)..(3735): n is a, c, g, or t
  misc_feature (3738)..(3739): n is a, c, g, or t
  misc_feature (3743)..(3755): n is a, c, g, or t
  misc_feature (3757)..(3761): n is a, c, g, or t
  misc_feature (3765)..(3769): n is a, c, g, or t
  misc_feature (3771)..(3774): n is a, c, g, or t
  misc_feature (3777)..(3778): n is a, c, g, or t
  misc_feature (3781)..(3781): n is a, c, g, or t
  misc_feature (3785)..(3786): n is a, c, g, or t
  misc_feature (3789)..(3792): n is a, c, g, or t
  misc_feature (3796)..(3799): n is a, c, g, or t
  misc_feature (3803)..(3807): n is a, c, g, or t
  misc_feature (3809)..(3809): n is a, c, g, or t
  misc_feature (3811)..(3813): n is a, c, g, or t
  misc_feature (3815)..(3817): n is a, c, g, or t
  misc_feature (3819)..(3820): n is a, c, g, or t
  misc_feature (3826)..(3826): n is a, c, g, or t
  misc_feature (3829)..(3831): n is a, c, g, or t
  misc_feature (3833)..(3836): n is a, c, g, or t
  misc_feature (3838)..(3841): n is a, c, g, or t
  misc_feature (3844)..(3844): n is a, c, g, or t
  misc_feature (3846)..(3846): n is a, c, g, or t
  misc_feature (3850)..(3850): n is a, c, g, or t
  misc_feature (3852)..(3852): n is a, c, g, or t
  misc_feature (3854)..(3865): n is a, c, g, or t
  misc_feature (3868)..(3870): n is a, c, g, or t
  misc_feature (3873)..(3879): n is a, c, g, or t
  misc_feature (3881)..(3885): n is a, c, g, or t
  misc_feature (3887)..(3891): n is a, c, g, or t
  misc_feature (3893)..(3897): n is a, c, g, or t
  misc_feature (3899)..(3902): n is a, c, g, or t
  misc_feature (3904)..(3905): n is a, c, g, or t
  misc_feature (3908)..(3915): n is a, c, g, or t
  misc_feature (3918)..(3920): n is a, c, g, or t
  misc_feature (3922)..(3925): n is a, c, g, or t
  misc_feature (3927)..(3931): n is a, c, g, or t
  misc_feature (3933)..(3936): n is a, c, g, or t
  misc_feature (3938)..(3946): n is a, c, g, or t
  misc_feature (3948)..(3948): n is a, c, g, or t
  misc_feature (3950)..(3953): n is a, c, g, or t
  misc_feature (3955)..(3960): n is a, c, g, or t
  misc_feature (3963)..(3968): n is a, c, g, or t
  misc_feature (3970)..(3975): n is a, c, g, or t
  misc_feature (3977)..(3978): n is a, c, g, or t
  misc_feature (3981)..(3994): n is a, c, g, or t
  misc_feature (3996)..(3998): n is a, c, g, or t
  misc_feature (4000)..(4000): n is a, c, g, or t
nnttnctnnnnncncnnnnntnnnnnnnnnnttntnnannnnnnnttnnnnnttnnnnnnnannnnnnnnnnnnnnnaannncnnnnnnnnnnntnnnnnnnnnnnnntnnntnnnnnnnnnnnntnnnnnnnnnnnnnnnnnnnnnncnnnanccngnnntnnnaaanncnnnnnnntnnnnnnnnnnnnnnnnnnnnnnttnggnnnnnnnnnnnnnnnnntntnnnnnnntnnnntnnannncnnnnnnntnntntncnnnnnaannnnnngnaaanncnnnnnnnnnttnnnnnncnnnnnnntnnnnaaannnnnnnntnttnnnnnnannnnnnntnnnnnnnttnannnnnnnnnnnntnnnnnnnnnaannnnccaanaaannttnnngggnnnntttttnttnnttnttnnnnnnttnnnnnnnnnnnngggnnnnnnncccaagggnnnnnaanaaccntctttgcaccaagcttgtaatagaattcgtgtttgtttgccgccgtaaacaccacatcgaagtattgcagtcttcctcttagtattgcgggaaacctgnnggtgtctgggtaaaccaacgctaagcgatggctctgggaaagcntttttaaaacggtatcagaaatcacttcgcccttaaacaccaagataaggtctggatcaattttccttaccgcactcggtaaactcttgttgattttctgtgaatccactaatatcctcattaccttggtgcgggtcacaagcagcctaaaaagaaattttctacttataccttcatactgatccaaaacaaacacttcatggccaagcctgcgcaggtatttcgtgtagaagtgctctgcgttaaacctattcacagaacccacaagaagaatcttcactttatcacgaatacaggataggaaacatattccttacgtttacttaccatatagcaatgtcccaacagctgaaaattttagaaagagcaaacgctttttagctacatgcgtgtttttgacttttagagagagtaggtttgacgtgagggtgctcattcttttaaggatnctttggacggcgggcgctcagcgaattgctgtgaacgaataccgctggcttaagaaacttgggtacgatgcacanatcgtttttctgagagcttcgaataccaagggttatgaggagattttgaaagatgtcgagtacaccgttattcgaaagacttcgggtccccttactcctgttttttcagcgattaccaaaaagtttgcgaaagacagaggtagcgaaagcacagtggatttggatcttattttaaagactcccgaaatcgcaaagaagaaaaaagcggattatttggtgtgccacgaccagtgggctgggctaggtggttacctcgcaaaaaagacactcggtttaccttatgtcgtntttatacacgaaaagttgtcggattattctgtccctctcctcggaaagcttgccacagatgtcgaaaaaaaggttttagaaaacgcagaaaaagttttggccgtgaccgacaaagtcgcaaagacggttgaggaaaaacacggtgtcagagcaacagtgaactttcctggtttagacgaactctcaagcacaccgctttcccaaaaggagaatttgctacttacagtggctttttgggacaaaggtagaaaaccagagatttacttggatatcgcagaaaaaattggcggtcacaaactgatctttgctggaaactggagaatcccagaattaaaaagggattttcttataaaggttggtaaaagaggtctagaggacaaagttttgttaaaagaaggcctgagcgaaaaagagcttactgggctttataagaaaagcaagtttttattaaggtttggtttcggagaatacggtcttggcacaccagtggtcgaagcactacaacacaccttgcctgttatcgtaaacgaggaacttggcacttcatccctcattaaggcgtataagtgtggctatgttttacctgatataaaccccaacgccgttgctgaaatagttagctcaatcgatgaagaacaatacacttctatgcagcttggcatttcgaaactcagaaatgtgtacacctgggaaagacacgcaaggcaactgatttcttaaagccaaaaaattaatgttggttggctttaatggtcaatatgtagcgctaagatcagcaattcgcaacgaagcttgcttggctgactccttctagaaaaaattctagtgagcgaataggatgtgacactgtcacatagaatcatttgctacccaagatgcggtgtcatagttctattgcacacgcttttcaaactaaaaattaagctccacaatcatatataattaagtctgaggtattaatctccagcctttcgggccaccacaaaaatgtgtgaagcgaaactactaaatctcgaaaatattttgtccaacgttctaaaaagaggattgtctactccnnntgnnntnannncnntanaancnnntatttnnaaannaaaatnnnnnatatannntnataangnnnntntannnnnnnnnnttntgnnncnntnncncnncnccntcaanatcnntngcnnnaagnnnnnantnannganncntnatnagannnnnnntnnnntnnnaatnnaagnncanntctgtnngncnatnannnannnnnngntgngnttnnanncantaannnnttnggtntnnncncnnttnnaattnnnnncatnntnnannntnnnttgnaaanntnctntntcnnntntnnnancannnnnangtnnannntnntntnntnnnnaggnaannantcgcnnnntacgtcnnnnnnnannnntttnatcnnnctntnntnaagtttntttnnnnncnnnnnnnnnannttnaanncnntnnnnantnnnanntnaannnnntnctnnannttnnntnanntntnnnnnnntnnnnnnncnannnncaannncntnnnnnntncnnnnntnantnnannnnnttntnnnntntttannnnnnnnnnnnnnnnnnngtttnnnnnnnnnngttnnannannttnnnnnnaannnntnnnnnnnntttnnnaannnnnnnnnnnnnnnnnnnatttnnnnnnnnnnnnnnnnnnnnnnnnnnnnaaannnnnnngnncnncncnnnnannnnntnnnnnnnnnnnannncnnnnnnnnnntncaananaannnnnnnnnnnnnnngnnnnnnaannnnnnnnncnnnnttntnnnnnnnnncnnnnnnnnnnnngnnntccnnnnnnnnngnnnncnnnnancncannnnannnnngttnnnnancnnnanttnnacacnntnantancnangaagantantnnngnnagnggtagnntcnnngnntttcnatcgagatcctttcnaatnnncttnactncaaangtngtngagantganantnanaaaagntcgnngnatnnanangttnttttnaaagnacnnnnncntnnactagnnatnancttgatctcncgnnannnnnttcctataccntatntgtttnaatntcttnnnantnnannnacanncnnggnngccacnagncttgncngnaananntaantnnntattgtnnactactntantctnatncnganatcnnaagnaanncngannaaaacntanangtcananngaannaagtaagtntctaaaaanatntnaannnnannnnagnntntntannatcnnnnnnnnnnnnngnnnnnttannnnnannnntannganaganntgnnnnaatnnnncttnnnnnantnnnannnanngcgttnaannntnnnncnnnngtngncttntntnnnnnnnnnnnnttnnnatnnnnnnntnnnnncnnnnngnnnnnannnnannttnnnnnnnnagnnngnnnnannnnngnnnnannnnnnnnntnannnnannnnnnaannnnnntnnnnnntnnaannnnnnnnnnnnnnannnan

SEQ ID NO: 1484 - DNA, 4000 bp, Escherichia coli
  misc_feature (2219)..(2219): n is a, c, g, or t
tcataaacggacattgtaacttcatttaatggaacatcagattcgctagagacgattccactcacgcgagctgtaataagtgtatcaccttgaaatggaatagaaaaatcgatattcgctgtttcttcattttctacaatggaaacgatgattgcattgtcgatatcttctgcgtcatcataatattccatatagaaaaaggatgaagaatcggaatggtcgttttgtccgtggtcgctatttctatctgttgcgatactagccacataataatttccttcgggcacggtgagttcataatgaccattatcatctgtccaaactcccaaattagatccacaaccccaaccttcttcgcgaatgagtcggataaaagcataacctggaccatcagcatcatcgtaacttacgtttccagagatagaaccaaacccagctaaaggagagagcccaatatcaaataaagtggaatctccaatatcgattgtctgattaaaaaattcaaatcctgcttcaaaaacacgaacatttccttcacctgttgcgagattatcaaatgcataattcccgttttcatcagtctctgttgtgaaaacatgatgtccccaactatcatgggaaccatcattattattagcagtaatcacacgaaccgttgttccaacaaaaccttctccagtttcgctattgcttacggtcccataaagcgaaccatcatatacgattgccgaaagagcgaaatcaaggctcatgtctgcatcaagggtaagactggtttcttcagaagtgtatccccatgccacggctttcaaattcatatcgccttcaagatggtcaacggaatagtatccattggaatccgcccaagccaatctaaaccaatgtccattttcattctcttttttgatggcagcataagggaggccctctccagtttcaacgtcagtaactaaaccagagagggtatggccataacttgtaagtgcaaaattgatggtggtatccgcatcaatatttaggctcatctcttcagagttatatccccatgccatggttttgatatttaaatcaccttcagcattaaaggaataatatcctacagaatcagcccacgcaagcggaaaccaatgtccaaaattgttttctcttttaatcacagcgtatggaacaccatcagcactttcagcatcattgatatatcctgaaacaacaaagccgcttcccgatgtattatgttcatttaatgccatatcaaatgtcatgtctccatcgagtgttagtgtagcaaaaaatccttcatacccttccgccgaagcaaaaaggttgtaattccccacagctaaactgtcaaaggtgtagtttccattttcgtcagtagatgcttcattccaatcccaatttgaatggcttgaatctgccagatgcaaagacacctgtgcattttcaataggaagaccagtctcagtgtctgtgatgatgccacttagacttgcgccaaagcttaatgcagtcatcaagataaatgatagggtcatttgtaatgtatttttcattttcttttccttttctttttttctgtcaatcatcctcttccagagaatggggttctgttttttagaccgatgattgaccattgtgtttactttttttagaaagacaaaatgtctttctaaaagcgttccttaatttattttagtaaaatgattttctgatgttctagtatttttccttgtgataattggacaaaatatataccgctcgcttgattttctgcatgccattgaatctcatgcgttccgggtgaaaatttcccattgaccaaagtcttcacaaggcgaccattaatatcgaatatttgtagagacacaatgcgttgcatctctaccctaaattggatgcttgttcttgggttaaatggatttggataggcagatagcagggaaaacgtatttggatttgtatcaaaaccatcgacacttacggtctcacctacaaccgtaaattgtcccatcatgcccgcttcttcatgggtaagaatatggcaatgatacatgtaaggcacgtctgaatctgcgaagtcttcaaattttgtgatgaatttcaccgtgccgttcataggcggaactaaaacgacatctttccaaccttgcatgtgagctggcggtgtttcaccatttatttctaaaatattgaattgaacatcgtgaatatgaaatggntgtgatatttgcgactgatttgtcaattcccaaatttcagtattatttagtggaatttcataattaataacattcatatcaaaggcttcaccattaaagacaaaaggaccatttaatgcgccattgggtcccatcacggctggagaaaattgaattattcttgtttcatcaatctcattttgatcccattcatcaacgctaacaagcgtagaaggaatcgagctaatagggtttgccgtttgcgtgccgacatgtaaagaaagtagaggaaaatctgctccatttaaatgattatccgtataataagggatagagcttccacccattccaccgatagttgctgtaccataaataccacttggaatggtagaaccaaagttcatcacatggaccatttcattttcatgatgagtcaaatcaacgagaatctcataacgttctcctggtgatatgagtagttcgtccaaagcaatgggcgcttctaataagccaccgtctgtcccgatgacataaaaagtctcgtgattatccagtcccacattaaaagatcgttcggatgcaccgttgagcaaccgaaatctcacgatttgtgcaggtgcatcaagataggcgtctcgtgttccgttggtaaataaggctgtatccaaaccacttgaatccatattggttacgatttgatagttttcattcaaggtttttgtttgaaaaactaagggaaagtcatccacgccatattcccgaggtaaatctaataaggcttcttcatcgtctttcacaatcacaaatcctgcgatgcccatttgaacatgctcatttgtcttatgcattagatgagggtgataccacatggttgaggcgtggtccatcactgtaaattgtgggttccaaatcgtatttggtgggataggcgtatgaggaccgccatcgacttcagcagggacatgcataccatgccagtgaatagtggtcgtatcagaaagttgattgtcgaaagttatattgaccgtttctcctttttgcatcaaaagtgtaggacctaaaataggtgaactaatacccatagtttgagtcataacgcctggaaaaaattccatttcaccttcttgaatggtcaggtcaaaattaggtccagtcaaaagggggggaatgatgattgggctttgtgaaaatcccaagcttatgagtaatagcaatttgaatagtagtttcatattttctcttctttgtgtcttatgcttattggataagtatttgaatggatatttttcttaattcgcttaactttatttgcagcaccggcataagaaatgttcaaagtttttgccaattgtttaatattttttgtattgtgtgcataagcacgttggataagttcatcttcgaataattgattcatctctttccaggataaggaaggatttttttgaataaatcgctggatagcttcgttcttagtgtttgaatcttttgctttgtgaagaatatcaaaaatagatctttcactcatttttaagtgatttgccgcgtctctttttgaatcacattgactgatggtgttttcaagaaatagatcttgaaatatttgttttgattttgcgagagattgagaaataagtttttcccaatcagagtcatgagaagcatccgaagcgaacgcttgtttatacttttcttgaaaggcgaaataaccattcatggcttttaatgtatctcctgcacaggggaaatgattctcaaccatattcatcccagcgcgaaatccttgcgaatgaaatgattga

SEQ ID NO: 1485 - DNA, 4000 bp, Escherichia coli
  misc_feature (2)..(5): n is a, c, g, or t
  misc_feature (8)..(18): n is a, c, g, or t
  misc_feature (20)..(23): n is a, c, g, or t
  misc_feature (25)..(26): n is a, c, g, or t
  misc_feature (28)..(28): n is a, c, g, or t
  misc_feature (30)..(36): n is a, c, g, or t
  misc_feature (40)..(42): n is a, c, g, or t
  misc_feature (44)..(44): n is a, c, g, or t
  misc_feature (47)..(49): n is a, c, g, or t
  misc_feature (51)..(53): n is a, c, g, or t
  misc_feature (55)..(60): n is a, c, g, or t
  misc_feature (62)..(62): n is a, c, g, or t
  misc_feature (65)..(66): n is a, c, g, or t
  misc_feature (68)..(71): n is a, c, g, or t
  misc_feature (73)..(74): n is a, c, g, or t
  misc_feature (80)..(80): n is a, c, g, or t
  misc_feature (82)..(82): n is a, c, g, or t
  misc_feature (87)..(87): n is a, c, g, or t
  misc_feature (90)..(90): n is a, c, g, or t
  misc_feature (92)..(92): n is a, c, g, or t
  misc_feature (97)..(99): n is a, c, g, or t
  misc_feature (102)..(104): n is a, c, g, or t
  misc_feature (108)..(115): n is a, c, g, or t
  misc_feature (117)..(117): n is a, c, g, or t
  misc_feature (119)..(120): n is a, c, g, or t
  misc_feature (122)..(123): n is a, c, g, or t
  misc_feature (125)..(127): n is a, c, g, or t
  misc_feature (129)..(132): n is a, c, g, or t
  misc_feature (134)..(135): n is a, c, g, or t
  misc_feature (137)..(140): n is a, c, g, or t
  misc_feature (144)..(146): n is a, c, g, or t
  misc_feature (149)..(151): n is a, c, g, or t
  misc_feature (153)..(153): n is a, c, g, or t
  misc_feature (155)..(155): n is a, c, g, or t
  misc_feature (157)..(158): n is a, c, g, or t
  misc_feature (160)..(160): n is a, c, g, or t
  misc_feature (163)..(163): n is a, c, g, or t
  misc_feature (165)..(169): n is a, c, g, or t
  misc_feature (174)..(176): n is a, c, g, or t
  misc_feature (178)..(179): n is a, c, g, or t
  misc_feature (182)..(182): n is a, c, g, or t
  misc_feature (184)..(184): n is a, c, g, or t
  misc_feature (187)..(188): n is a, c, g, or t
  misc_feature (190)..(190): n is a, c, g, or t
  misc_feature (193)..(194): n is a, c, g, or t
  misc_feature (196)..(196): n is a, c, g, or t
  misc_feature (199)..(199): n is a, c, g, or t
  misc_feature (201)..(201): n is a, c, g, or t
  misc_feature (203)..(203): n is a, c, g, or t
  misc_feature (205)..(205): n is a, c, g, or t
  misc_feature (207)..(212): n is a, c, g, or t
  misc_feature (215)..(218): n is a, c, g, or t
  misc_feature (220)..(223): n is a, c, g, or t
  misc_feature (225)..(228): n is a, c, g, or t
  misc_feature (232)..(232): n is a, c, g, or t
  misc_feature (234)..(237): n is a, c, g, or t
  misc_feature (239)..(240): n is a, c, g, or t
  misc_feature (242)..(244): n is a, c, g, or t
  misc_feature (246)..(247): n is a, c, g, or t
  misc_feature (253)..(258): n is a, c, g, or t
  misc_feature (262)..(262): n is a, c, g, or t
  misc_feature (265)..(265): n is a, c, g, or t
  misc_feature (271)..(271): n is a, c, g, or t
  misc_feature (273)..(273): n is a, c, g, or t
  misc_feature (277)..(278): n is a, c, g, or t
  misc_feature (281)..(284): n is a, c, g, or t
  misc_feature (290)..(292): n is a, c, g, or t
  misc_feature (294)..(294): n is a, c, g, or t
  misc_feature (296)..(305): n is a, c, g, or t
  misc_feature (307)..(310): n is a, c, g, or t
  misc_feature (312)..(312): n is a, c, g, or t
  misc_feature (316)..(316): n is a, c, g, or t
  misc_feature (318)..(319): n is a, c, g, or t
  misc_feature (322)..(322): n is a, c, g, or t
  misc_feature (324)..(327): n is a, c, g, or t
  misc_feature (330)..(330): n is a, c, g, or t
  misc_feature (332)..(332): n is a, c, g, or t
  misc_feature (334)..(335): n is a, c, g, or t
  misc_feature (338)..(338): n is a, c, g, or t
  misc_feature (342)..(343): n is a, c, g, or t
  misc_feature (350)..(350): n is a, c, g, or t
  misc_feature (352)..(352): n is a, c, g, or t
  misc_feature (354)..(354): n is a, c, g, or t
  misc_feature (356)..(357): n is a, c, g, or t
  misc_feature (359)..(363): n is a, c, g, or t
  misc_feature (367)..(367): n is a, c, g, or t
  misc_feature (370)..(370): n is a, c, g, or t
  misc_feature (372)..(372): n is a, c, g, or t
  misc_feature (374)..(374): n is a, c, g, or t
  misc_feature (397)..(397): n is a, c, g, or t
  misc_feature (399)..(401): n is a, c, g, or t
  misc_feature (403)..(403): n is a, c, g, or t
  misc_feature (406)..(408): n is a, c, g, or t
  misc_feature (410)..(410): n is a, c, g, or t
  misc_feature (412)..(412): n is a, c, g, or t
  misc_feature (414)..(414): n is a, c, g, or t
  misc_feature (416)..(417): n is a, c, g, or t
  misc_feature (419)..(419): n is a, c, g, or t
  misc_feature (422)..(422): n is a, c, g, or t
  misc_feature (426)..(427): n is a, c, g, or t
  misc_feature (429)..(431): n is a, c, g, or t
  misc_feature (435)..(435): n is a, c, g, or t
  misc_feature (438)..(438): n is a, c, g, or t
  misc_feature (440)..(440): n is a, c, g, or t
  misc_feature (444)..(444): n is a, c, g, or t
  misc_feature (457)..(457): n is a, c, g, or t
  misc_feature (459)..(460): n is a, c, g, or t
  misc_feature (473)..(473): n is a, c, g, or t
  misc_feature (476)..(477): n is a, c, g, or t
  misc_feature (479)..(479): n is a, c, g, or t
  misc_feature (484)..(484): n is a, c, g, or t
  misc_feature (1991)..(1991): n is a, c, g, or t
  misc_feature (3686)..(3686): n is a, c, g, or t
  misc_feature (3688)..(3688): n is a, c, g, or t
  misc_feature (3703)..(3704): n is a, c, g, or t
  misc_feature (3706)..(3706): n is a, c, g, or t
  misc_feature (3709)..(3709): n is a, c, g, or t
  misc_feature (3717)..(3717): n is a, c, g, or t
  misc_feature (3723)..(3723): n is a, c, g, or t
  misc_feature (3726)..(3726): n is a, c, g, or t
  misc_feature (3732)..(3732): n is a, c, g, or t
  misc_feature (3735)..(3735): n is a, c, g, or t
  misc_feature (3739)..(3746): n is a, c, g, or t
  misc_feature (3750)..(3750): n is a, c, g, or t
  misc_feature (3752)..(3754): n is a, c, g, or t
  misc_feature (3756)..(3762): n is a, c, g, or t
  misc_feature (3764)..(3764): n is a, c, g, or t
  misc_feature (3766)..(3778): n is a, c, g, or t
  misc_feature (3780)..(3782): n is a, c, g, or t
  misc_feature (3786)..(3786): n is a, c, g, or t
  misc_feature (3791)..(3793): n is a, c, g, or t
  misc_feature (3795)..(3795): n is a, c, g, or t
  misc_feature (3797)..(3797): n is a, c, g, or t
  misc_feature (3800)..(3801): n is a, c, g, or t
  misc_feature (3808)..(3808): n is a, c, g, or t
  misc_feature (3811)..(3811): n is a, c, g, or t
  misc_feature (3815)..(3815): n is a, c, g, or t
  misc_feature (3818)..(3818): n is a, c, g, or t
  misc_feature (3827)..(3827): n is a, c, g, or t
  misc_feature (3829)..(3830): n is a, c, g, or t
  misc_feature (3834)..(3834): n is a, c, g, or t
  misc_feature (3836)..(3836): n is a, c, g, or t
  misc_feature (3847)..(3847): n is a, c, g, or t
  misc_feature (3856)..(3856): n is a, c, g, or t
  misc_feature (3868)..(3868): n is a, c, g, or t
  misc_feature (3871)..(3871): n is a, c, g, or t
  misc_feature (3878)..(3880): n is a, c, g, or t
  misc_feature (3896)..(3896): n is a, c, g, or t
  misc_feature (3898)..(3898): n is a, c, g, or t
  misc_feature (3912)..(3912): n is a, c, g, or t
  misc_feature (3914)..(3914): n is a, c, g, or t
  misc_feature (3916)..(3916): n is a, c, g, or t
  misc_feature (3933)..(3933): n is a, c, g, or t
  misc_feature (3936)..(3936): n is a, c, g, or t
  misc_feature (3958)..(3959): n is a, c, g, or t
  misc_feature (3965)..(3965): n is a, c, g, or t
  misc_feature (3969)..(3969): n is a, c, g, or t
  misc_feature (3981)..(3981): n is a, c, g, or t
  misc_feature (3985)..(3985): n is a, c, g, or t
  misc_feature (3991)..(3992): n is a, c, g, or t
annnntannnnnnnnnnnannnntnntntnnnnnnntatnnntntannnannntnnnnnnanaanntnnnnanncattantnaaaanttnanatttnnnatnnnttannnnnnnntnannannannntnnnntnnannnntaannnaannnantntnntnatntnnnnnataannntnnaananagnnantcnntnttnanantntnnnnnntannnnannnnannnnatantnnnnannannntnnattaannnnnnaaanaanataatntntatnnttnnnnatatannntntnnnnnnnnnnannnnantttnanngtntnnnnaananannaanaaannaaataanananannannnnnaatnaanananaaaataaaaaaatatatattatnannnanatnnnananantnnanaanaaannannnttanaantnaaanaaaaaaataaaanannaaaataaaaaaanaannanaaaanaaaaaaaaaaaaaaaaaaaaaaaattaacacaaaaaagaaaaattaaagaaaaataataaatctatatttctatataaaaataaatataatattatatataatatattatatattataatattatattatattattatattgaagttattttataaaaaattattattattcaattatatttttataattaataataattaaagaatatacatttttatattaaaaaagaggaaaggatttgttttgtttataaaacttttttttttctttaataaaatttaaatttatataaattaaatataaatttaattttaaattattgtaaaaagtttttttttttttaatattaaaaagtaattatatattataaaggtaataaaaataacaataaattatattgaattatcgaagaataaataaattatcgttttactaataaaatattatatgaaaattttttatttttttataaataattatatttatatttcttcggacaataaaatattataattggcacatttatatcaaaattttacttggaaataattttggaaatatttttttttcaataataattgtaatcgtttcaatattatttaataaaatttgtatcaactccttcaattaattatattattaattcttgtaaaatagaaaatgatgatggataaaggtaaatcagaacatcgtattggtcaatacaaaagtcgtggtcttcttcaaactgatgaattaagacgtcgtcgtgaagatgctgctgtcgaaattagaaagcaaaaaagagaagaaaatttagcaaagagaagaaacttccttaatcaagatttctctgatgatagtgatgatgattatgaatttgaaaccccatatgctgaagaagtaaatatttattatttattataaatgttcgaggatttactattttataaatattaaaatcagaaattttttaataattaataacaatattttatatatatatattttaatataattataataattcattaaatatatttttataattatcaataattattatttaatcaatataacagcttcaacaattaccagaaatgatcaataaaatatattctaacgatattgaagatcaattagatgccactactaaattcagaaaattactttcaaaagaacgtaatccaccaattgaagaagtcattaaatgtggagtaattccaagatttgtcgaatttttaaaatctcaacattctcttttacaagtatatatcatatcattatatatataaaattaattcaggaagttaatttattaagtataaatttttattttattacatttatattataaatttaaatagtttgaagctgcctgggctttaacaaacattgcctccggtacttcagatcaaactaaagttattattgataacggagctgtaccaatctttatttctttattatattcaccagtctcagatgttaaagaacaagtaagttaaaaaaaaaaaaaaatttatntttttttttttttttttaattttgaatttttaattacacttttattaaatatttaatatatatttacattttaaataattattcatttattattcataataaaaaaggctgtttgggctcttggtaatattgctggtgataatccaacttgcagagattatgttttaagtcaaaatgctttaactccaatcttaaatattttaaacgaccataccaataaaatttcaatgttacgtaatgctacatgggctttatctaatctttgtagaggaaagaatccacaaccagattgggaaactgtaaatatcaaaataatatatattttttattataaattaaaaatagaaatataacatttaacttacattatattaataatataaaatatattaaacaaactttaaaagatatcacaatgtcttccagttttagctaaattaatttatgctcaagatccagaagttttaactgatgcttgctgggctctttcatacttatctgatggttccaacaaaaagattcaagctgttattgaatctggtgtttgccgtcgtttagttgaacttttaatgtatccacaatataatgttcaaactccagctcttcgtactattggtaacattgttactggtgatgatgttcaaactcaagtaaatatattataatataaatcataaaatcataatataagtgttttcaaaaattatataatattaatgaaatgcatatatatttttattttatcttttatattatttatttttaataggtcattattaattctaatgctttaccatctcttttatcattactcaacagtccaagagaaggtattaagaaggaagcttgttggacaatttctaatattactgccggtaatacttctcaaattcaagtaagtagataatattttataacaattaatatattgatatataaaaaattttattctaaaattttaattttaatttttttattaaataattaaggatgttattgatgccaatattattccagttttaattgatgttcttaagactggtgatttcaagactaagaaggaagcttgttgggctatttctaatgccacttctggtggtttacaaaacccagaacaaattaggtaattataaaataaatacatataagtttgatttttaatatcagagtattaatttaatattattattattatgcaattatagatatttagttcaacaaggttgtattactccactttgtgatcttcttacttgcaaggataatagaattattcaagttgctttagatggtttagaaaatatactaaaggttggtgaacaagatagaaaattaaatgaagataacttaaaccaaatggctttatatattgaagaatgtggtggtatggataagattcacaatttacaagctcacaaaaatgttgaaatttacaataaggcttacaatattattgataagtacttcaacgatgatgaagaagaaactggtttagaagctgaagtcgataatactggtgctttcaacttctcagctgataacagacaatttgttccaaatggtggtttccactttggtcattaaataatttaaacgaattcaatacattaaaaatttttttttaaacaatcctttatttcatattctttttcaataactaatcaaaaattaaaaaaaaaaaaaaaaaaaaaaaantnttaaaaaaaaatttnntnttntattttanaaatanaantttttnttnattnnnnnnnntatntnnnannnnnnnanannnnnnnnnnnnntnnnaatnaaaannntntntannataaatnatnaatnatnaatattaananntaananttttatctttntcaatttantattaaattttnaantataatnnntataattaatataaantntatataatattatnananaaaaataaataatcaanatnaaaaaattaataaattattatnnttaatnttanttttatgttttnatanattttnnatttataa

SEQ ID NO: 1486 - DNA, 4000 bp, Escherichia coli
  misc_feature (1)..(6): n is a, c, g, or t
  misc_feature (8)..(11): n is a, c, g, or t
  misc_feature (13)..(24): n is a, c, g, or t
  misc_feature (26)..(26): n is a, c, g, or t
  misc_feature (28)..(30): n is a, c, g, or t
  misc_feature (32)..(37): n is a, c, g, or t
  misc_feature (39)..(53): n is a, c, g, or t
  misc_feature (56)..(58): n is a, c, g, or t
  misc_feature (60)..(60): n is a, c, g, or t
  misc_feature (62)..(68): n is a, c, g, or t
  misc_feature (70)..(83): n is a, c, g, or t
  misc_feature (85)..(89): n is a, c, g, or t
  misc_feature (91)..(94): n is a, c, g, or t
  misc_feature (96)..(96): n is a, c, g, or t
  misc_feature (98)..(98): n is a, c, g, or t
  misc_feature (101)..(105): n is a, c, g, or t
  misc_feature (107)..(131): n is a, c, g, or t
  misc_feature (134)..(135): n is a, c, g, or t
  misc_feature (137)..(146): n is a, c, g, or t
  misc_feature (148)..(159): n is a, c, g, or t
  misc_feature (162)..(173): n is a, c, g, or t
  misc_feature (175)..(175): n is a, c, g, or t
  misc_feature (180)..(180): n is a, c, g, or t
  misc_feature (182)..(185): n is a, c, g, or t
  misc_feature (187)..(191): n is a, c, g, or t
  misc_feature (194)..(206): n is a, c, g, or t
  misc_feature (208)..(210): n is a, c, g, or t
  misc_feature (212)..(212): n is a, c, g, or t
  misc_feature (214)..(222): n is a, c, g, or t
  misc_feature (226)..(229): n is a, c, g, or t
  misc_feature (231)..(245): n is a, c, g, or t
  misc_feature (247)..(261): n is a, c, g, or t
  misc_feature (263)..(267): n is a, c, g, or t
  misc_feature (269)..(269): n is a, c, g, or t
  misc_feature (271)..(272): n is a, c, g, or t
  misc_feature (274)..(276): n is a, c, g, or t
  misc_feature (278)..(281): n is a, c, g, or t
  misc_feature (283)..(283): n is a, c, g, or t
  misc_feature (285)..(287): n is a, c, g, or t
  misc_feature (289)..(289): n is a, c, g, or t
  misc_feature (291)..(292): n is a, c, g, or t
  misc_feature (294)..(309): n is a, c, g, or t
  misc_feature (311)..(319): n is a, c, g, or t
  misc_feature (321)..(321): n is a, c, g, or t
  misc_feature (325)..(335): n is a, c, g, or t
  misc_feature (337)..(351): n is a, c, g, or t
  misc_feature (353)..(355): n is a, c, g, or t
  misc_feature (357)..(361): n is a, c, g, or t
  misc_feature (365)..(367): n is a, c, g, or t
  misc_feature (369)..(370): n is a, c, g, or t
  misc_feature (372)..(372): n is a, c, g, or t
  misc_feature (374)..(386): n is a, c, g, or t
  misc_feature (388)..(395): n is a, c, g, or t
  misc_feature (397)..(403): n is a, c, g, or t
  misc_feature (405)..(407): n is a, c, g, or t
  misc_feature (409)..(410): n is a, c, g, or t
  misc_feature (412)..(424): n is a, c, g, or t
  misc_feature (426)..(432): n is a, c, g, or t
  misc_feature (434)..(445): n is a, c, g, or t
  misc_feature (447)..(454): n is a, c, g, or t
  misc_feature (456)..(457): n is a, c, g, or t
  misc_feature (459)..(465): n is a, c, g, or t
  misc_feature (467)..(485): n is a, c, g, or t
  misc_feature (487)..(493): n is a, c, g, or t
  misc_feature (496)..(497): n is a, c, g, or t
  misc_feature (499)..(517): n is a, c, g, or t
  misc_feature (519)..(523): n is a, c, g, or t
  misc_feature (525)..(528): n is a, c, g, or t
  misc_feature (530)..(534): n is a, c, g, or t
  misc_feature (536)..(544): n is a, c, g, or t
  misc_feature (546)..(569): n is a, c, g, or t
  misc_feature (571)..(593): n is a, c, g, or t
  misc_feature (595)..(605): n is a, c, g, or t
  misc_feature (607)..(608): n is a, c, g, or t
  misc_feature (610)..(614): n is a, c, g, or t
  misc_feature (616)..(616): n is a, c, g, or t
  misc_feature (619)..(621): n is a, c, g, or t
  misc_feature (623)..(633): n is a, c, g, or t
  misc_feature (635)..(637): n is a, c, g, or t
  misc_feature (640)..(653): n is a, c, g, or t
  misc_feature (655)..(656): n is a, c, g, or t
  misc_feature (658)..(661): n is a, c, g, or t
  misc_feature (663)..(677): n is a, c, g, or t
  misc_feature (679)..(698): n is a, c, g, or t
  misc_feature (702)..(706): n is a, c, g, or t
  misc_feature (709)..(712): n is a, c, g, or t
  misc_feature (714)..(721): n is a, c, g, or t
  misc_feature (723)..(728): n is a, c, g, or t
  misc_feature (730)..(734): n is a, c, g, or t
  misc_feature (736)..(747): n is a, c, g, or t
  misc_feature (749)..(756): n is a, c, g, or t
  misc_feature (758)..(764): n is a, c, g, or t
  misc_feature (766)..(788): n is a, c, g, or t
  misc_feature (791)..(796): n is a, c, g, or t
  misc_feature (798)..(806): n is a, c, g, or t
  misc_feature (808)..(814): n is a, c, g, or t
  misc_feature (816)..(819): n is a, c, g, or t
  misc_feature (821)..(824): n is a, c, g, or t
  misc_feature (826)..(831): n is a, c, g, or t
  misc_feature (833)..(839): n is a, c, g, or t
  misc_feature (841)..(843): n is a, c, g, or t
  misc_feature (845)..(851): n is a, c, g, or t
  misc_feature (854)..(859): n is a, c, g, or t
  misc_feature (861)..(903): n is a, c, g, or t
  misc_feature (905)..(913): n is a, c, g, or t
  misc_feature (915)..(919): n is a, c, g, or t
  misc_feature (921)..(926): n is a, c, g, or t
  misc_feature (928)..(930): n is a, c, g, or t
  misc_feature (933)..(933): n is a, c, g, or t
  misc_feature (935)..(939): n is a, c, g, or t
  misc_feature (941)..(942): n is a, c, g, or t
  misc_feature (944)..(944): n is a, c, g, or t
  misc_feature (946)..(963): n is a, c, g, or t
  misc_feature (965)..(965): n is a, c, g, or t
  misc_feature (967)..(967): n is a, c, g, or t
  misc_feature (969)..(969): n is a, c, g, or t
  misc_feature (972)..(973): n is a, c, g, or t
  misc_feature (975)..(979): n is a, c, g, or t
  misc_feature (981)..(987): n is a, c, g, or t
  misc_feature (990)..(1001): n is a, c, g, or t
  misc_feature (1003)..(1004): n is a, c, g, or t
  misc_feature (1006)..(1012): n is a, c, g, or t
  misc_feature (1015)..(1016): n is a, c, g, or t
  misc_feature (1018)..(1020): n is a, c, g, or t
  misc_feature (1023)..(1027): n is a, c, g, or t
  misc_feature (1030)..(1030): n is a, c, g, or t
  misc_feature (1038)..(1043): n is a, c, g, or t
  misc_feature (1045)..(1049): n is a, c, g, or t
  misc_feature (1051)..(1052): n is a, c, g, or t
  misc_feature (1056)..(1060): n is a, c, g, or t
  misc_feature (1062)..(1062): n is a, c, g, or t
  misc_feature (1064)..(1064): n is a, c, g, or t
  misc_feature (1066)..(1073): n is a, c, g, or t
  misc_feature (1075)..(1078): n is a, c, g, or t
  misc_feature (1080)..(1080): n is a, c, g, or t
  misc_feature (1082)..(1084): n is a, c, g, or t
  misc_feature (1086)..(1091): n is a, c, g, or t
  misc_feature (1093)..(1094): n is a, c, g, or t
  misc_feature (1097)..(1098): n is a, c, g, or t
  misc_feature (1100)..(1102): n is a, c, g, or t
  misc_feature (1104)..(1104): n is a, c, g, or t
  misc_feature (1107)..(1108): n is a, c, g, or t
  misc_feature (1110)..(1112): n is a, c, g, or t
  misc_feature (1114)..(1115): n is a, c, g, or t
  misc_feature (1118)..(1119): n is a, c, g, or t
  misc_feature (1121)..(1123): n is a, c, g, or t
  misc_feature (1127)..(1134): n is a, c, g, or t
  misc_feature (1136)..(1136): n is a, c, g, or t
  misc_feature (1138)..(1139): n is a, c, g, or t
  misc_feature (1141)..(1144): n is a, c, g, or t
  misc_feature (1146)..(1150): n is a, c, g, or t
  misc_feature (1152)..(1155): n is a, c, g, or t
  misc_feature (1157)..(1164): n is a, c, g, or t
  misc_feature (1166)..(1168): n is a, c, g, or t
  misc_feature (1170)..(1173): n is a, c, g, or t
  misc_feature (1175)..(1177): n is a, c, g, or t
  misc_feature (1180)..(1180): n is a, c, g, or t
  misc_feature (1182)..(1183): n is a, c, g, or t
  misc_feature (1186)..(1188): n is a, c, g, or t
  misc_feature (1192)..(1193): n is a, c, g, or t
  misc_feature (1195)..(1197): n is a, c, g, or t
  misc_feature (1200)..(1200): n is a, c, g, or t
  misc_feature (1202)..(1207): n is a, c, g, or t
  misc_feature (1210)..(1210): n is a, c, g, or t
  misc_feature (1212)..(1214): n is a, c, g, or t
  misc_feature (1217)..(1220): n is a, c, g, or t
  misc_feature (1224)..(1225): n is a, c, g, or t
  misc_feature (1228)..(1228): n is a, c, g, or t
  misc_feature (1232)..(1235): n is a, c, g, or t
  misc_feature (1237)..(1238): n is a, c, g, or t
  misc_feature (1240)..(1241): n is a, c, g, or t
  misc_feature (1243)..(1247): n is a, c, g, or t
  misc_feature (1250)..(1255): n is a, c, g, or t
  misc_feature (1259)..(1260): n is a, c, g, or t
  misc_feature (1262)..(1266): n is a, c, g, or t
  misc_feature (1269)..(1269): n is a, c, g, or t
  misc_feature (1272)..(1272): n is a, c, g, or t
  misc_feature (1283)..(1285): n is a, c, g, or t
  misc_feature (1335)..(1335): n is a, c, g, or t
  misc_feature (1340)..(1340): n is a, c, g, or t
  misc_feature (1444)..(1444): n is a, c, g, or t
  misc_feature (1989)..(1991): n is a, c, g, or t
  misc_feature (2042)..(2042): n is a, c, g, or t
  misc_feature (2075)..(2076): n is a, c, g, or t
  misc_feature (2361)..(2361): n is a, c, g, or t
  misc_feature (2422)..(2422): n is a, c, g, or t
  misc_feature (2424)..(2426): n is a, c, g, or t
  misc_feature (2429)..(2429): n is a, c, g, or t
  misc_feature (2434)..(2434): n is a, c, g, or t
  misc_feature (2438)..(2450): n is a, c, g, or t
  misc_feature (2452)..(2454): n is a, c, g, or t
  misc_feature (2457)..(2458): n is a, c, g, or t
  misc_feature (2460)..(2461): n is a, c, g, or t
  misc_feature (2463)..(2471): n is a, c, g, or t
  misc_feature (2473)..(2473): n is a, c, g, or t
  misc_feature (2476)..(2477): n is a, c, g, or t
  misc_feature (2479)..(2482): n is a, c, g, or t
  misc_feature (2484)..(2484): n is a, c, g, or t
  misc_feature (2486)..(2486): n is a, c, g, or t
  misc_feature (2488)..(2494): n is a, c, g, or t
  misc_feature (2496)..(2496): n is a, c, g, or t
  misc_feature (2498)..(2503): n is a, c, g, or t
  misc_feature (2505)..(2508): n is a, c, g, or t
  misc_feature (2510)..(2510): n is a, c, g, or t
  misc_feature (2512)..(2512): n is a, c, g, or t
  misc_feature (2514)..(2523): n is a, c, g, or t
  misc_feature (2525)..(2528): n is a, c, g, or t
  misc_feature (2530)..(2531): n is a, c, g, or t
  misc_feature (2533)..(2539): n is a, c, g, or t
  misc_feature (2541)..(2541): n is a, c, g, or t
  misc_feature (2544)..(2545): n is a, c, g, or t
  misc_feature (2548)..(2551): n is a, c, g, or t
  misc_feature (2553)..(2559): n is a, c, g, or t
  misc_feature (2561)..(2561): n is a, c, g, or t
  misc_feature (2563)..(2565): n is a, c, g, or t
  misc_feature (2567)..(2568): n is a, c, g, or t
  misc_feature (2571)..(2571): n is a, c, g, or t
  misc_feature (2573)..(2574): n is a, c, g, or t
  misc_feature (2576)..(2576): n is a, c, g, or t
  misc_feature (2578)..(2578): n is a, c, g, or t
  misc_feature (2582)..(2582): n is a, c, g, or t
  misc_feature (2584)..(2589): n is a, c, g, or t
  misc_feature (2591)..(2592): n is a, c, g, or t
  misc_feature (2594)..(2597): n is a, c, g, or t
  misc_feature (2599)..(2600): n is a, c, g, or t
  misc_feature (2602)..(2602): n is a, c, g, or t
  misc_feature (2604)..(2605): n is a, c, g, or t
  misc_feature (2607)..(2608): n is a, c, g, or t
  misc_feature (2612)..(2615): n is a, c, g, or t
  misc_feature (2617)..(2617): n is a, c, g, or t
  misc_feature (2620)..(2622): n is a, c, g, or t
  misc_feature (2624)..(2626): n is a, c, g, or t
  misc_feature (2628)..(2634): n is a, c, g, or t
  misc_feature (2636)..(2636): n is a, c, g, or t
  misc_feature (2638)..(2638): n is a, c, g, or t
  misc_feature (2640)..(2642): n is a, c, g, or t
  misc_feature (2644)..(2644): n is a, c, g, or t
  misc_feature (2646)..(2648): n is a, c, g, or t
  misc_feature (2650)..(2650): n is a, c, g, or t
  misc_feature (2652)..(2654): n is a, c, g, or t
  misc_feature (2656)..(2658): n is a, c, g, or t
  misc_feature (2660)..(2661): n is a, c, g, or t
  misc_feature (2663)..(2663): n is a, c, g, or t
  misc_feature (2665)..(2665): n is a, c, g, or t
  misc_feature (2668)..(2678): n is a, c, g, or t
  misc_feature (2680)..(2680): n is a, c, g, or t
  misc_feature (2683)..(2684): n is a, c, g, or t
  misc_feature (2686)..(2686): n is a, c, g, or t
  misc_feature (2688)..(2691): n is a, c, g, or t
  misc_feature (2693)..(2693): n is a, c, g, or t
  misc_feature (2695)..(2696): n is a, c, g, or t
  misc_feature (2700)..(2700): n is a, c, g, or t
  misc_feature (2702)..(2702): n is a, c, g, or t
  misc_feature (2704)..(2706): n is a, c, g, or t
  misc_feature (2708)..(2708): n is a, c, g, or t
  misc_feature (2711)..(2719): n is a, c, g, or t
  misc_feature (2721)..(2724): n is a, c, g, or t
  misc_feature (2727)..(2732): n is a, c, g, or t
  misc_feature (2734)..(2734): n is a, c, g, or t
  misc_feature (2736)..(2736): n is a, c, g, or t
  misc_feature (2739)..(2739): n is a, c, g, or t
  misc_feature (2741)..(2741): n is a, c, g, or t
  misc_feature (2743)..(2745): n is a, c, g, or t
  misc_feature (2748)..(2749): n is a, c, g, or t
  misc_feature (2751)..(2771): n is a, c, g, or t
  misc_feature (2774)..(2793): n is a, c, g, or t
  misc_feature (2795)..(2800): n is a, c, g, or t
  misc_feature (2802)..(2802): n is a, c, g, or t
  misc_feature (2804)..(2808): n is a, c, g, or t
  misc_feature (2810)..(2811): n is a, c, g, or t
  misc_feature (2813)..(2815): n is a, c, g, or t
  misc_feature (2817)..(2819): n is a, c, g, or t
  misc_feature (2821)..(2831): n is a, c, g, or t
  misc_feature (2833)..(2833): n is a, c, g, or t
  misc_feature (2835)..(2839): n is a, c, g, or t
  misc_feature (2841)..(2842): n is a, c, g, or t
  misc_feature (2844)..(2846): n is a, c, g, or t
  misc_feature (2848)..(2848): n is a, c, g, or t
  misc_feature (2850)..(2854): n is a, c, g, or t
  misc_feature (2856)..(2860): n is a, c, g, or t
  misc_feature (2862)..(2868): n is a, c, g, or t
  misc_feature (2870)..(2877): n is a, c, g, or t
  misc_feature (2880)..(2883): n is a, c, g, or t
  misc_feature (2885)..(2885): n is a, c, g, or t
  misc_feature (2887)..(2888): n is a, c, g, or t
  misc_feature (2890)..(2892): n is a, c, g, or t
  misc_feature (2894)..(2895): n is a, c, g, or t
  misc_feature (2897)..(2898): n is a, c, g, or t
  misc_feature (2900)..(2903): n is a, c, g, or t
  misc_feature (2907)..(2908): n is a, c, g, or t
  misc_feature (2910)..(2913): n is a, c, g, or t
  misc_feature (2917)..(2917): n is a, c, g, or t
  misc_feature (2919)..(2924): n is a, c, g, or t
  misc_feature (2926)..(2931): n is a, c, g, or t
  misc_feature (2933)..(2935): n is a, c, g, or t
  misc_feature (2937)..(2946): n is a, c, g, or t
  misc_feature (2948)..(2952): n is a, c, g, or t
  misc_feature (2955)..(2956): n is a, c, g, or t
  misc_feature (2959)..(2959): n is a, c, g, or t
  misc_feature (2962)..(2966): n is a, c, g, or t
  misc_feature (2968)..(2972): n is a, c, g, or t
  misc_feature (2974)..(2976): n is a, c, g, or t
  misc_feature (2978)..(2979): n is a, c, g, or t
  misc_feature (2981)..(2981): n is a, c, g, or t
  misc_feature (2983)..(2986): n is a, c, g, or t
  misc_feature (2988)..(2989): n is a, c, g, or t
  misc_feature (2991)..(2991): n is a, c, g, or t
  misc_feature (2993)..(2996): n is a, c, g, or t
  misc_feature (2999)..(3001): n is a, c, g, or t
  misc_feature (3003)..(3004): n is a, c, g, or t
  misc_feature (3007)..(3013): n is a, c, g, or t
  misc_feature (3016)..(3016): n is a, c, g, or t
  misc_feature (3019)..(3021): n is a, c, g, or t
  misc_feature (3023)..(3025): n is a, c, g, or t
  misc_feature (3027)..(3028): n is a, c, g, or t
  misc_feature (3030)..(3032): n is a, c, g, or t
  misc_feature (3034)..(3034): n is a, c, g, or t
  misc_feature (3038)..(3039): n is a, c, g, or t
  misc_feature (3041)..(3041): n is a, c, g, or t
  misc_feature (3043)..(3050): n is a, c, g, or t
  misc_feature (3052)..(3052): n is a, c, g, or t
  misc_feature (3054)..(3055): n is a, c, g, or t
  misc_feature (3058)..(3058): n is a, c, g, or t
  misc_feature (3060)..(3061): n is a, c, g, or t
  misc_feature (3064)..(3064): n is a, c, g, or t
  misc_feature (3067)..(3067): n is a, c, g, or t
  misc_feature (3071)..(3077): n is a, c, g, or t
  misc_feature (3079)..(3082): n is a, c, g, or t
  misc_feature (3084)..(3088): n is a, c, g, or t
  misc_feature (3091)..(3092): n is a, c, g, or t
  misc_feature (3094)..(3103): n is a, c, g, or t
  misc_feature (3105)..(3105): n is a, c, g, or t
  misc_feature (3107)..(3111): n is a, c, g, or t
  misc_feature (3113)..(3116): n is a, c, g, or t
  misc_feature (3118)..(3118): n is a, c, g, or t
  misc_feature (3121)..(3123): n is a, c, g, or t
  misc_feature (3125)..(3126): n is a, c, g, or t
  misc_feature (3128)..(3130): n is a, c, g, or t
  misc_feature (3133)..(3133): n is a, c, g, or t
  misc_feature (3135)..(3135): n is a, c, g, or t
  misc_feature (3137)..(3139): n is a, c, g, or t
  misc_feature (3141)..(3141): n is a, c, g, or t
  misc_feature (3143)..(3143): n is a, c, g, or t
  misc_feature (3145)..(3148): n is a, c, g, or t
  misc_feature (3150)..(3157): n is a, c, g, or t
  misc_feature (3162)..(3166): n is a, c, g, or t
  misc_feature (3168)..(3170): n is a, c, g, or t
  misc_feature (3172)..(3181): n is a, c, g, or t
  misc_feature (3187)..(3187): n is a, c, g, or t
  misc_feature (3189)..(3189): n is a, c, g, or t
  misc_feature (3191)..(3191): n is a, c, g, or t
  misc_feature (3193)..(3193): n is a, c, g, or t
  misc_feature (3195)..(3200): n is a, c, g, or t
  misc_feature (3202)..(3209): n is a, c, g, or t
  misc_feature (3211)..(3212): n is a, c, g, or t
  misc_feature (3215)..(3218): n is a, c, g, or t
  misc_feature (3222)..(3225): n is a, c, g, or t
  misc_feature (3227)..(3229): n is a, c, g, or t
  misc_feature (3231)..(3231): n is a, c, g, or t
  misc_feature (3233)..(3241): n is a, c, g, or t
  misc_feature (3243)..(3244): n is a, c, g, or t
  misc_feature (3246)..(3246): n is a, c, g, or t
  misc_feature (3249)..(3251): n is a, c, g, or t
  misc_feature (3253)..(3253): n is a, c, g, or t
  misc_feature (3255)..(3255): n is a, c, g, or t
  misc_feature (3257)..(3257): n is a, c, g, or t
  misc_feature (3260)..(3262): n is a, c, g, or t
  misc_feature (3266)..(3269): n is a, c, g, or t
  misc_feature (3271)..(3273): n is a, c, g, or t
  misc_feature (3275)..(3280): n is a, c, g, or t
  misc_feature (3283)..(3285): n is a, c, g, or t
  misc_feature (3287)..(3287): n is a, c, g, or t
  misc_feature (3292)..(3293): n is a, c, g, or t
  misc_feature (3295)..(3297): n is a, c, g, or t
  misc_feature (3299)..(3302): n is a, c, g, or t
  misc_feature (3305)..(3305): n is a, c, g, or t
  misc_feature (3307)..(3308): n is a, c, g, or t
  misc_feature (3310)..(3311): n is a, c, g, or t
  misc_feature (3313)..(3314): n is a, c, g, or t
  misc_feature (3316)..(3318): n is a, c, g, or t
  misc_feature (3320)..(3324): n is a, c, g, or t
  misc_feature (3326)..(3327): n is a, c, g, or t
  misc_feature (3330)..(3332): n is a, c, g, or t
  misc_feature (3334)..(3334): n is a, c, g, or t
  misc_feature (3336)..(3337): n is a, c, g, or t
  misc_feature (3339)..(3339): n is a, c, g, or t
  misc_feature (3341)..(3348): n is a, c, g, or t
  misc_feature (3350)..(3358): n is a, c, g, or t
  misc_feature (3360)..(3361): n is a, c, g, or t
  misc_feature (3363)..(3363): n is a, c, g, or t
  misc_feature (3366)..(3367): n is a, c, g, or t
  misc_feature (3370)..(3386): n is a, c, g, or t
  misc_feature (3388)..(3389): n is a, c, g, or t
  misc_feature (3391)..(3393): n is a, c, g, or t
  misc_feature (3396)..(3398): n is a, c, g, or t
  misc_feature (3400)..(3409): n is a, c, g, or t
  misc_feature (3412)..(3419): n is a, c, g, or t
  misc_feature (3421)..(3425): n is a, c, g, or t
  misc_feature (3427)..(3428): n is a, c, g, or t
  misc_feature (3430)..(3431): n is a, c, g, or t
  misc_feature (3433)..(3434): n is a, c, g, or t
  misc_feature (3436)..(3436): n is a, c, g, or t
  misc_feature (3438)..(3440): n is a, c, g, or t
  misc_feature (3442)..(3446): n is a, c, g, or t
  misc_feature (3448)..(3454): n is a, c, g, or t
  misc_feature (3456)..(3464): n is a, c, g, or t
  misc_feature (3467)..(3468): n is a, c, g, or t
  misc_feature (3470)..(3474): n is a, c, g, or t
  misc_feature (3478)..(3478): n is a, c, g, or t
  misc_feature (3480)..(3484): n is a, c, g, or t
  misc_feature (3486)..(3490): n is a, c, g, or t
  misc_feature (3492)..(3498): n is a, c, g, or t
  misc_feature (3500)..(3501): n is a, c, g, or t
  misc_feature (3503)..(3505): n is a, c, g, or t
  misc_feature (3507)..(3513): n is a, c, g, or t
  misc_feature (3515)..(3518): n is a, c, g, or t
  misc_feature (3520)..(3521): n is a, c, g, or t
  misc_feature (3523)..(3523): n is a, c, g, or t
  misc_feature (3525)..(3527): n is a, c, g, or t
  misc_feature (3530)..(3532): n is a, c, g, or t
  misc_feature (3534)..(3534): n is a, c, g, or t
  misc_feature (3536)..(3539): n is a, c, g, or t
  misc_feature (3542)..(3546): n is a, c, g, or t
  misc_feature (3550)..(3555): n is a, c, g, or t
  misc_feature (3559)..(3562): n is a, c, g, or t
  misc_feature (3566)..(3568): n is a, c, g, or t
  misc_feature (3570)..(3570): n is a, c, g, or t
  misc_feature (3573)..(3573): n is a, c, g, or t
  misc_feature (3576)..(3580): n is a, c, g, or t
  misc_feature (3582)..(3585): n is a, c, g, or t
  misc_feature (3587)..(3588): n is a, c, g, or t
  misc_feature (3590)..(3597): n is a, c, g, or t
  misc_feature (3599)..(3602): n is a, c, g, or t
  misc_feature (3604)..(3606): n is a, c, g, or t
  misc_feature (3608)..(3613): n is a, c, g, or t
  misc_feature (3615)..(3616): n is a, c, g, or t
  misc_feature (3618)..(3619): n is a, c, g, or t
  misc_feature (3621)..(3621): n is a, c, g, or t
  misc_feature (3623)..(3624): n is a, c, g, or t
  misc_feature (3626)..(3628): n is a, c, g, or t
  misc_feature (3630)..(3631): n is a, c, g, or t
  misc_feature (3637)..(3640): n is a, c, g, or t
  misc_feature (3642)..(3648): n is a, c, g, or t
  misc_feature (3650)..(3651): n is a, c, g, or t
  misc_feature (3654)..(3661): n is a, c, g, or t
  misc_feature (3664)..(3665): n is a, c, g, or t
  misc_feature (3668)..(3685): n is a, c, g, or t
  misc_feature (3687)..(3687): n is a, c, g, or t
  misc_feature (3689)..(3693): n is a, c, g, or t
  misc_feature (3696)..(3698): n is a, c, g, or t
  misc_feature (3702)..(3708): n is a, c, g, or t
  misc_feature (3711)..(3716): n is a, c, g, or t
  misc_feature (3718)..(3718): n is a, c, g, or t
  misc_feature (3720)..(3722): n is a, c, g, or t
  misc_feature (3724)..(3724): n is a, c, g, or t
  misc_feature (3727)..(3727): n is a, c, g, or t
  misc_feature (3729)..(3729): n is a, c, g, or t
  misc_feature (3731)..(3735): n is a, c, g, or t
  misc_feature (3737)..(3741): n is a, c, g, or t
  misc_feature (3744)..(3760): n is a, c, g, or t
  misc_feature (3762)..(3762): n is a, c, g, or t
  misc_feature (3764)..(3765): n is a, c, g, or t
  misc_feature (3767)..(3768): n is a, c, g, or t
  misc_feature (3771)..(3771): n is a, c, g, or t
  misc_feature (3773)..(3773): n is a, c, g, or t
  misc_feature (3775)..(3781): n is a, c, g, or t
  misc_feature (3783)..(3791): n is a, c, g, or t
  misc_feature (3794)..(3800): n is a, c, g, or t
  misc_feature (3802)..(3802): n is a, c, g, or t
  misc_feature (3804)..(3809): n is a, c, g, or t
  misc_feature (3811)..(3811): n is a, c, g, or t
  misc_feature (3814)..(3814): n is a, c, g, or t
  misc_feature (3816)..(3817): n is a, c, g, or t
  misc_feature (3819)..(3819): n is a, c, g, or t
  misc_feature (3822)..(3832): n is a, c, g, or t
  misc_feature (3835)..(3838): n is a, c, g, or t
  misc_feature (3840)..(3840): n is a, c, g, or t
  misc_feature (3844)..(3844): n is a, c, g, or t
  misc_feature (3847)..(3847): n is a, c, g, or t
  misc_feature (3850)..(3852): n is a, c, g, or t
  misc_feature (3854)..(3854): n is a, c, g, or t
  misc_feature (3856)..(3858): n is a, c, g, or t
  misc_feature (3860)..(3860): n is a, c, g, or t
  misc_feature (3863)..(3865): n is a, c, g, or t
  misc_feature (3869)..(3870): n is a, c, g, or t
  misc_feature (3872)..(3874): n is a, c, g, or t
  misc_feature (3876)..(3879): n is a, c, g, or t
  misc_feature (3881)..(3884): n is a, c, g, or t
  misc_feature (3886)..(3886): n is a, c, g, or t
  misc_feature (3889)..(3890): n is a, c, g, or t
  misc_feature (3892)..(3893): n is a, c, g, or t
  misc_feature (3895)..(3895): n is a, c, g, or t
  misc_feature (3897)..(3901): n is a, c, g, or t
  misc_feature (3903)..(3903): n is a, c, g, or t
  misc_feature (3905)..(3905): n is a, c, g, or t
  misc_feature (3907)..(3908): n is a, c, g, or t
  misc_feature (3910)..(3915): n is a, c, g, or t
  misc_feature (3917)..(3918): n is a, c, g, or t
  misc_feature (3920)..(3921): n is a, c, g, or t
  misc_feature (3923)..(3923): n is a, c, g, or t
  misc_feature (3925)..(3930): n is a, c, g, or t
  misc_feature (3933)..(3933): n is a, c, g, or t
  misc_feature (3935)..(3939): n is a, c, g, or t
  misc_feature (3941)..(3941): n is a, c, g, or t
  misc_feature (3943)..(3945): n is a, c, g, or t
  misc_feature (3948)..(3948): n is a, c, g, or t
  misc_feature (3950)..(3951): n is a, c, g, or t
  misc_feature (3954)..(3954): n is a, c, g, or t
  misc_feature (3957)..(3957): n is a, c, g, or t
  misc_feature (3961)..(3962): n is a, c, g, or t
  misc_feature (3964)..(3967): n is a, c, g, or t
  misc_feature (3970)..(3970): n is a, c, g, or t
  misc_feature (3972)..(3972): n is a, c, g, or t
  misc_feature (3975)..(3975): n is a, c, g, or t
  misc_feature (3977)..(3981): n is a, c, g, or t
  misc_feature (3983)..(3983): n is a, c, g, or t
  misc_feature (3986)..(3991): n is a, c, g, or t
  misc_feature (3993)..(3994): n is a, c, g, or t
  misc_feature (3996)..(3997): n is a, c, g, or t
nnnnnngnnnngnnnnnnnnnnnncngnnngnnnnnncnnnnnnnnnnnnnnngannncngnnnnnnngnnnnnnnnnnnnnncnnnnncnnnncncncgnnnnngnnnnnnnnnnnnnnnnnnnnnnnnngcnngnnnnnnnnnngnnnnnnnnnnnngcnnnnnnnnnnnncnccgcncnnnntnnnnnccnnnnnnnnnnnnncnnncngnnnnnnnnncccnnnncnnnnnnnnnnnnnnnannnnnnnnnnnnnnnannnnntngnngnnnannnngncnnngncnncnnnnnnnnnnnnnnnngnnnnnnnnngncggnnnnnnnnnnncnnnnnnnnnnnnnnnannncnnnnnggcnnnanncncnnnnnnnnnnnnncnnnnnnnngnnnnnnncnnngnngnnnnnnnnnnnnngnnnnnnncnnnnnnnnnnnncnnnnnnnngnncnnnnnnngnnnnnnnnnnnnnnnnnnncnnnnnnncgnncnnnnnnnnnnnnnnnnnnncnnnnncnnnncnnnnngnnnnnnnnncnnnnnnnnnnnnnnnnnnnnnnnngnnnnnnnnnnnnnnnnnnnnnnngnnnnnnnnnnncnncnnnnncncgnnngnnnnnnnnnnngnnnccnnnnnnnnnnnnnngnngnnnngnnnnnnnnnnnnnnngnnnnnnnnnnnnnnnnnnnncccnnnnnggnnnncnnnnnnnncnnnnnncnnnnngnnnnnnnnnnnncnnnnnnnncnnnnnnncnnnnnnnnnnnnnnnnnnnnnnngcnnnnnngnnnnnnnnngnnnnnnncnnnncnnnngnnnnnncnnnnnnngnnngnnnnnnnggnnnnnncnnnnnnnnnnnnnnnnnnnnnnnnnnnnnnnnnnnnnnnnnnncnnnnnnnnncnnnnnannnnnnannnccncnnnnnanngngnnnnnnnnnnnnnnnnnngngngnggnnannnnntnnnnnnntgnnnnnnnnnnnntnngnnnnnnncgnncnnncgnnnnnccnccccccgnnnnnngnnnnngnnctgnnnnngngnannnnnnnntnnnngngnnnannnnnntnngtnngnnngnccnngnnncnnccnncnnncccnnnnnnnnanannannnncnnnnngnnnngnnnnnnnnannnannnngnnnggnannggnnngggnngnnnccncnnnnnnaancnnncannnnaacnnaanggannnngnnannannnnntcnnnnnnaagnncnnnnnagngcnctcatgagttnnnctaagaacgatcaagccgatcgagcgattagtaccagtaagctacatgcntcgcngcacttccacacctggcctatcaacgtggtggtctaccacggctctcggcgaagccttgttttgaggttagtttcccgcttagatgctttcagcggttatctantccacacttagctaccctgctgcgcggctggcgccacgacaggtccaccagaggtgtgtccatcccggtcctctcgtactagggacagatcctctcaagcttcgtacacccacggcagatagggaccaaactgtctcacgacgttctgaacccagctcacgtaccactttaatcggcgaacagccgaacccttgggacctgctccagccccaggatgtgatgagccgacatcgaggtgccaaactttgccgtcgctgtggacgcttgggcaaaatcagcctgttatccctagagtaccttttattcgttgagcgatggcccttccatacagaaccaccggatcactatggccgactttcgtctctgctcgacttgtcagtctcgcagtcaggcgggcttatgccattgcactcgacgagcgatttccgaccgctctgagcccaccatcgcgcgcctccgttacactttgggaggcgaccgccccagtcaaactacccgccacgccatgtcccgaacccggataacgggccgcggttagacgtcannnacaacaagggtggtatttcaaggttggctccaccgaagctggcgccccggnttcatagcctcccacctatcctacacatgttgnngctaacgccaaggcgaagctgtagtaaaggttcatagggtctttccgtctgaccgcgggaaccccgcatcttcacggggaattcaatttcgctgagcctatgctggagacagtggggaagtcgttacgccattcgtgcaggtcggaacttacccgacaaggaatttcgctaccttaggaccgttatagttacggccgccgtttaccggggcttcaattcggagcttgcacccctccttttaaccttccggcaccgggcaggcgtcagaccctatacgtcgccttncggcttcgcagagccctgtgtttttgataaacagtcgctaccccctggcctgtgccactcntnnntgnttgcncaannnnnnnnnnnnntnnnccnnanntnnnnnnnnnanttnncnnnntncntnnnnnnngntnnnnnnannnncntngnnnnnnnnnncnnnncnncnnnnnnngnttnnggnnnngnnnnnnntngnnntnnttncnngnancccntnnnnnncnngnnnnanncnannanncccnnnnanttnnngnnntnnnnnnntncnannngncnnngnannntnnncnngntnccnnnnnnnnnnncnttnngncnnnncntnngggncngnnnanccnnnnnnnnntnnnnttnnnnnngnanccntngnnnttnngnnnnnnnnnnnnnnnnnnnnnttnnnnnnnnnnnnnnnnnnnntnnnnnntncnnnnncnncnnncnnncnnnnnnnnnnncntnnnnngnntnnngnannnnncnnnnncnnnnnnntnnnnnnnnccnnnncntnngnnnanngnntnnnncccnntnnnntttncnnnnnngnnnnnntnnncnnnnnnnnnntnnnnnttnnttnaannnnngnnnnntnnnanncnannnncnngntnnnnaannnannccnnnnnnnttnccnnntnnncnntnnntngggnncntnnnnnnnngntnnggntnnttnccntttnnnnnnngnnnntnnnnnccnncnnnnnnnnnncngnnnnntnnnntnggnnntnngnnnttngntnnnantngnnnnannnnnnnnccccnnnnncnnncnnnnnnnnnncccccnangnantnnnnnnannnnnnnncnnaannnntttnnnngnnnancnnnnnnnnncnngnttnnntngncnttnnncccnnnncnnnannnnnnccnnnanttttnnannntnnnnggntnngnncnncnnntnnnnntnnccnnncntnnancnnnnnnnngnnnnnnnnncnngnttnnggnnnnnnnnnnnnnnnnntnntnnnccnnntnnnnnnnnnnttnnnnnnnncnnnnncnnanngnntnannntnnnnngnnnnnnnannnnnnnnnccnntnnnnnaaangnnnnncnnnnncnnnnnnngnngnnncnnnnnnntnnnngnntncnnnttnnngntnnnnttnnnnncccnnnnnngggnnnntttnnncnttnccnnnnngnnnntnntnnnnnnnngnnnntnnngnnnnnntnngnntngnngnnngnncccccnnnntnnnnnnngnnttnnnnnnnnccnnccnnnnnnnnnnnnnnnnnnantnnnnnctnnngggnnnnnnnccnnnnnngncnnncnttncnannnnntnnnnnttnnnnnnnnnnnnnnnnngncnngnnccngntnnnnnnncnnnnnnnnnggnnnnnnngntnnnnnncnttncnncnggnnnnnnnnnnnttnnnntncccnggnttnnntnannnanccnnntttnntnnngnnnntnnnncnttnnannancnnnnnancngnncnnnnnncnnanncngnnnnnnaantnnnnnantnnnaangnnggnttncccnntnnnnaantntcngnnnnnanggnnnnnngnncnnccc

SEQ ID NO: 1487 - DNA, 4000 bp, Escherichia coli
  misc_feature (1)..(1): n is a, c, g, or t
  misc_feature (3)..(3): n is a, c, g, or t
  misc_feature (6)..(7): n is a, c, g, or t
  misc_feature (9)..(9): n is a, c, g, or t
  misc_feature (11)..(16): n is a, c, g, or t
  misc_feature (18)..(18): n is a, c, g, or t
  misc_feature (21)..(23): n is a, c, g, or t
  misc_feature (25)..(28): n is a, c, g, or t
  misc_feature (32)..(33): n is a, c, g, or t
  misc_feature (36)..(40): n is a, c, g, or t
  misc_feature (44)..(45): n is a, c, g, or t
  misc_feature (48)..(49): n is a, c, g, or t
  misc_feature (52)..(52): n is a, c, g, or t
  misc_feature (55)..(55): n is a, c, g, or t
  misc_feature (57)..(58): n is a, c, g, or t
  misc_feature (60)..(61): n is a, c, g, or t
  misc_feature (65)..(69): n is a, c, g, or t
  misc_feature (71)..(73): n is a, c, g, or t
  misc_feature (76)..(78): n is a, c, g, or t
  misc_feature (80)..(81): n is a, c, g, or t
  misc_feature (83)..(83): n is a, c, g, or t
  misc_feature (86)..(88): n is a, c, g, or t
  misc_feature (91)..(94): n is a, c, g, or t
  misc_feature (96)..(97): n is a, c, g, or t
  misc_feature (99)..(102): n is a, c, g, or t
  misc_feature (105)..(108): n is a, c, g, or t
  misc_feature (110)..(114): n is a, c, g, or t
  misc_feature (117)..(118): n is a, c, g, or t
  misc_feature (121)..(121): n is a, c, g, or t
  misc_feature (123)..(124): n is a, c, g, or t
  misc_feature (127)..(127): n is a, c, g, or t
  misc_feature (129)..(129): n is a, c, g, or t
  misc_feature (131)..(132): n is a, c, g, or t
  misc_feature (134)..(135): n is a, c, g, or t
  misc_feature (138)..(138): n is a, c, g, or t
  misc_feature (142)..(144): n is a, c, g, or t
  misc_feature (146)..(146): n is a, c, g, or t
  misc_feature (148)..(148): n is a, c, g, or t
  misc_feature (150)..(154): n is a, c, g, or t
  misc_feature (157)..(162): n is a, c, g, or t
  misc_feature (164)..(166): n is a, c, g, or t
  misc_feature (170)..(171): n is a, c, g, or t
  misc_feature (174)..(179): n is a, c, g, or t
  misc_feature (184)..(184): n is a, c, g, or t
  misc_feature (187)..(187): n is a, c, g, or t
  misc_feature (189)..(189): n is a, c, g, or t
  misc_feature (191)..(193): n is a, c, g, or t
  misc_feature (195)..(196): n is a, c, g, or t
  misc_feature (199)..(200): n is a, c, g, or t
  misc_feature (202)..(203): n is a, c, g, or t
  misc_feature (205)..(206): n is a, c, g, or t
  misc_feature (208)..(208): n is a, c, g, or t
  misc_feature (210)..(211): n is a, c, g, or t
  misc_feature (213)..(215): n is a, c, g, or t
  misc_feature (219)..(221): n is a, c, g, or t
  misc_feature (223)..(225): n is a, c, g, or t
  misc_feature (227)..(228): n is a, c, g, or t
  misc_feature (232)..(233): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (245)..(253): n is a, c, g, or t
  misc_feature (255)..(256): n is a, c, g, or t
  misc_feature (259)..(259): n is a, c, g, or t
  misc_feature (262)..(262): n is a, c, g, or t
  misc_feature (266)..(268): n is a, c, g, or t
  misc_feature (271)..(271): n is a, c, g, or t
  misc_feature (273)..(274): n is a, c, g, or t
  misc_feature (276)..(276): n is a, c, g, or t
  misc_feature (278)..(281): n is a, c, g, or t
  misc_feature (283)..(284): n is a, c, g, or t
  misc_feature (286)..(288): n is a, c, g, or t
  misc_feature (290)..(292): n is a, c, g, or t
  misc_feature (296)..(296): n is a, c, g, or t
  misc_feature (298)..(298): n is a, c, g, or t
  misc_feature (301)..(301): n is a, c, g, or t
  misc_feature (303)..(305): n is a, c, g, or t
  misc_feature (307)..(309): n is a, c, g, or t
  misc_feature (312)..(312): n is a, c, g, or t
  misc_feature (315)..(316): n is a, c, g, or t
  misc_feature (321)..(322): n is a, c, g, or t
  misc_feature (325)..(325): n is a, c, g, or t
  misc_feature (328)..(329): n is a, c, g, or t
  misc_feature (331)..(333): n is a, c, g, or t
  misc_feature (335)..(336): n is a, c, g, or t
  misc_feature (342)..(343): n is a, c, g, or t
  misc_feature (346)..(347): n is a, c, g, or t
  misc_feature (350)..(351): n is a, c, g, or t
  misc_feature (353)..(354): n is a, c, g, or t
  misc_feature (363)..(365): n is a, c, g, or t
  misc_feature (367)..(367): n is a, c, g, or t
  misc_feature (371)..(372): n is a, c, g, or t
  misc_feature (376)..(381): n is a, c, g, or t
  misc_feature (386)..(387): n is a, c, g, or t
  misc_feature (390)..(392): n is a, c, g, or t
  misc_feature (398)..(398): n is a, c, g, or t
  misc_feature (402)..(403): n is a, c, g, or t
  misc_feature (408)..(408): n is a, c, g, or t
  misc_feature (410)..(414): n is a, c, g, or t
  misc_feature (417)..(417): n is a, c, g, or t
  misc_feature (419)..(421): n is a, c, g, or t
  misc_feature (423)..(423): n is a, c, g, or t
  misc_feature (427)..(429): n is a, c, g, or t
  misc_feature (432)..(432): n is a, c, g, or t
  misc_feature (436)..(437): n is a, c, g, or t
  misc_feature (439)..(440): n is a, c, g, or t
  misc_feature (443)..(443): n is a, c, g, or t
  misc_feature (445)..(446): n is a, c, g, or t
  misc_feature (449)..(450): n is a, c, g, or t
  misc_feature (453)..(454): n is a, c, g, or t
  misc_feature (456)..(457): n is a, c, g, or t
  misc_feature (459)..(459): n is a, c, g, or t
  misc_feature (462)..(464): n is a, c, g, or t
  misc_feature (468)..(469): n is a, c, g, or t
  misc_feature (473)..(473): n is a, c, g, or t
  misc_feature (475)..(475): n is a, c, g, or t
  misc_feature (477)..(478): n is a, c, g, or t
  misc_feature (480)..(480): n is a, c, g, or t
  misc_feature (482)..(482): n is a, c, g, or t
  misc_feature (484)..(484): n is a, c, g, or t
  misc_feature (486)..(486): n is a, c, g, or t
  misc_feature (488)..(488): n is a, c, g, or t
  misc_feature (490)..(493): n is a, c, g, or t
  misc_feature (495)..(498): n is a, c, g, or t
  misc_feature (501)..(503): n is a, c, g, or t
  misc_feature (505)..(505): n is a, c, g, or t
  misc_feature (507)..(508): n is a, c, g, or t
  misc_feature (511)..(511): n is a, c, g, or t
  misc_feature (514)..(515): n is a, c, g, or t
  misc_feature (517)..(519): n is a, c, g, or t
  misc_feature (524)..(527): n is a, c, g, or t
  misc_feature (531)..(531): n is a, c, g, or t
  misc_feature (533)..(533): n is a, c, g, or t
  misc_feature (540)..(540): n is a, c, g, or t
  misc_feature (543)..(543): n is a, c, g, or t
  misc_feature (546)..(554): n is a, c, g, or t
  misc_feature (557)..(561): n is a, c, g, or t
  misc_feature (563)..(564): n is a, c, g, or t
  misc_feature (567)..(568): n is a, c, g, or t
  misc_feature (571)..(572): n is a, c, g, or t
  misc_feature (574)..(574): n is a, c, g, or t
  misc_feature (576)..(577): n is a, c, g, or t
  misc_feature (580)..(580): n is a, c, g, or t
  misc_feature (583)..(587): n is a, c, g, or t
  misc_feature (589)..(589): n is a, c, g, or t
  misc_feature (594)..(594): n is a, c, g, or t
  misc_feature (596)..(597): n is a, c, g, or t
  misc_feature (599)..(599): n is a, c, g, or t
  misc_feature (603)..(605): n is a, c, g, or t
  misc_feature (607)..(609): n is a, c, g, or t
  misc_feature (614)..(618): n is a, c, g, or t
  misc_feature (621)..(622): n is a, c, g, or t
  misc_feature (624)..(626): n is a, c, g, or t
  misc_feature (629)..(629): n is a, c, g, or t
  misc_feature (633)..(634): n is a, c, g, or t
  misc_feature (636)..(637): n is a, c, g, or t
  misc_feature (640)..(641): n is a, c, g, or t
  misc_feature (643)..(643): n is a, c, g, or t
  misc_feature (645)..(646): n is a, c, g, or t
  misc_feature (649)..(652): n is a, c, g, or t
  misc_feature (660)..(660): n is a, c, g, or t
  misc_feature (662)..(665): n is a, c, g, or t
  misc_feature (668)..(668): n is a, c, g, or t
  misc_feature (670)..(675): n is a, c, g, or t
  misc_feature (678)..(680): n is a, c, g, or t
  misc_feature (683)..(683): n is a, c, g, or t
  misc_feature (686)..(687): n is a, c, g, or t
  misc_feature (693)..(694): n is a, c, g, or t
  misc_feature (696)..(696): n is a, c, g, or t
  misc_feature (698)..(702): n is a, c, g, or t
  misc_feature (705)..(706): n is a, c, g, or t
  misc_feature (709)..(714): n is a, c, g, or t
  misc_feature (717)..(718): n is a, c, g, or t
  misc_feature (723)..(726): n is a, c, g, or t
  misc_feature (730)..(730): n is a, c, g, or t
  misc_feature (732)..(733): n is a, c, g, or t
  misc_feature (738)..(739): n is a, c, g, or t
  misc_feature (743)..(744): n is a, c, g, or t
  misc_feature (747)..(747): n is a, c, g, or t
  misc_feature (752)..(753): n is a, c, g, or t
  misc_feature (755)..(757): n is a, c, g, or t
  misc_feature (760)..(763): n is a, c, g, or t
  misc_feature (766)..(766): n is a, c, g, or t
  misc_feature (768)..(774): n is a, c, g, or t
  misc_feature (777)..(778): n is a, c, g, or t
  misc_feature (780)..(780): n is a, c, g, or t
  misc_feature (782)..(782): n is a, c, g, or t
  misc_feature (784)..(784): n is a, c, g, or t
  misc_feature (787)..(787): n is a, c, g, or t
  misc_feature (791)..(792): n is a, c, g, or t
  misc_feature (794)..(794): n is a, c, g, or t
  misc_feature (797)..(798): n is a, c, g, or t
  misc_feature (801)..(803): n is a, c, g, or t
  misc_feature (807)..(808): n is a, c, g, or t
  misc_feature (811)..(812): n is a, c, g, or t
  misc_feature (816)..(819): n is a, c, g, or t
  misc_feature (824)..(825): n is a, c, g, or t
  misc_feature (828)..(833): n is a, c, g, or t
  misc_feature (835)..(835): n is a, c, g, or t
  misc_feature (838)..(845): n is a, c, g, or t
  misc_feature (847)..(847): n is a, c, g, or t
  misc_feature (849)..(850): n is a, c, g, or t
  misc_feature (852)..(852): n is a, c, g, or t
  misc_feature (856)..(858): n is a, c, g, or t
  misc_feature (862)..(863): n is a, c, g, or t
  misc_feature (865)..(867): n is a, c, g, or t
  misc_feature (870)..(876): n is a, c, g, or t
  misc_feature (880)..(880): n is a, c, g, or t
  misc_feature (883)..(886): n is a, c, g, or t
  misc_feature (888)..(890): n is a, c, g, or t
  misc_feature (893)..(893): n is a, c, g, or t
  misc_feature (895)..(900): n is a, c, g, or t
  misc_feature (903)..(904): n is a, c, g, or t
  misc_feature (906)..(906): n is a, c, g, or t
  misc_feature (909)..(909): n is a, c, g, or t
  misc_feature (912)..(913): n is a, c, g, or t
  misc_feature (915)..(915): n is a, c, g, or t
  misc_feature (918)..(919): n is a, c, g, or t
  misc_feature (921)..(921): n is a, c, g, or t
  misc_feature (923)..(929): n is a, c, g, or t
  misc_feature (931)..(931): n is a, c, g, or t
  misc_feature (933)..(933): n is a, c, g, or t
  misc_feature (935)..(944): n is a, c, g, or t
  misc_feature (946)..(946): n is a, c, g, or t
  misc_feature (951)..(954): n is a, c, g, or t
  misc_feature (957)..(964): n is a, c, g, or t
  misc_feature (966)..(968): n is a, c, g, or t
  misc_feature (972)..(976): n is a, c, g, or t
  misc_feature (978)..(983): n is a, c, g, or t
  misc_feature (985)..(985): n is a, c, g, or t
  misc_feature (987)..(988): n is a, c, g, or t
  misc_feature (990)..(991): n is a, c, g, or t
  misc_feature (993)..(993): n is a, c, g, or t
  misc_feature (995)..(998): n is a, c, g, or t
  misc_feature (1000)..(1002): n is a, c, g, or t
  misc_feature (1005)..(1007): n is a, c, g, or t
  misc_feature (1009)..(1009): n is a, c, g, or t
  misc_feature (1012)..(1012): n is a, c, g, or t
  misc_feature (1015)..(1015): n is a, c, g, or t
  misc_feature (1017)..(1019): n is a, c, g, or t
  misc_feature (1021)..(1021): n is a, c, g, or t
  misc_feature (1024)..(1024): n is a, c, g, or t
  misc_feature (1027)..(1028): n is a, c, g, or t
  misc_feature (1030)..(1030): n is a, c, g, or t
  misc_feature (1032)..(1032): n is a, c, g, or t
  misc_feature (1036)..(1037): n is a, c, g, or t
  misc_feature (1041)..(1041): n is a, c, g, or t
  misc_feature (1043)..(1043): n is a, c, g, or t
  misc_feature (1045)..(1045): n is a, c, g, or t
  misc_feature (1050)..(1050): n is a, c, g, or t
  misc_feature (1053)..(1057): n is a, c, g, or t
  misc_feature (1059)..(1065): n is a, c, g, or t
  misc_feature (1069)..(1072): n is a, c, g, or t
  misc_feature (1074)..(1075): n is a, c, g, or t
  misc_feature (1077)..(1081): n is a, c, g, or t
  misc_feature (1087)..(1093): n is a, c, g, or t
  misc_feature (1095)..(1100): n is a, c, g, or t
  misc_feature (1102)..(1112): n is a, c, g, or t
  misc_feature (1114)..(1115): n is a, c, g, or t
  misc_feature (1117)..(1125): n is a, c, g, or t
  misc_feature (1128)..(1132): n is a, c, g, or t
  misc_feature (1135)..(1138): n is a, c, g, or t
  misc_feature (1140)..(1157): n is a, c, g, or t
  misc_feature (1159)..(1160): n is a, c, g, or t
  misc_feature (1163)..(1164): n is a, c, g, or t
  misc_feature (1167)..(1170): n is a, c, g, or t
  misc_feature (1174)..(1175): n is a, c, g, or t
  misc_feature (1177)..(1189): n is a, c, g, or t
  misc_feature (1192)..(1192): n is a, c, g, or t
  misc_feature (1196)..(1211): n is a, c, g, or t
  misc_feature (1213)..(1217): n is a, c, g, or t
  misc_feature (1220)..(1221): n is a, c, g, or t
  misc_feature (1223)..(1228): n is a, c, g, or t
  misc_feature (1232)..(1232): n is a, c, g, or t
  misc_feature (1294)..(1294): n is a, c, g, or t
  misc_feature (1533)..(1533): n is a, c, g, or t
  misc_feature (1809)..(1809): n is a, c, g, or t
  misc_feature (2002)..(2002): n is a, c, g, or t
  misc_feature (2004)..(2004): n is a, c, g, or t
  misc_feature (2412)..(2412): n is a, c, g, or t
  misc_feature (2414)..(2414): n is a, c, g, or t
  misc_feature (2596)..(2596): n is a, c, g, or t
  misc_feature (2742)..(2742): n is a, c, g, or t
  misc_feature (2911)..(2911): n is a, c, g, or t
  misc_feature (3070)..(3070): n is a, c, g, or t
ngngannantnnnnnngnggnnnannnngggnngannnnnccgnnggnnggnggngnnanntttnnnnncnnngannngnnanacnnncgnnnntnncnnnngtnnnnannnnngcnnganannaanananngnnggnaggnnngngngnnnnnatnnnnnncnnngggnncannnnnngcgancgngngnnngnnttnntnncnnananngnnngggnnngnnntnngaannaaanganagngnnnnnnnnngnnagnggngggnnngananntntnnnnanncnnncnnngagngnggngnnntnnnganagnnaaaanntanttnntnnntnngagagnngcnnagnngnnagagaaagnnngngagnnagannnnnngagtnngtnnngcgcgngcgnncgcgngnnnnnaanannngngggnnngtntgtnngnnganannaanngtnnanngngcnnntttnngtgngngnngngngnangnannnnannnnagnnnanannaanaannannnttttnnnnagananaaaaaanagngannnnnnnnnacnnnnngnncgnnaannanannaanagnnnnnanaaaancnncncgcnnnannnaaaannnnnganntnnnctntgtnnanngtnngnanngannnncgctcgancnnnncgntnnnnnnggnnncanaanngcgctnncncnnnnnagnnggnnnnnncgnnaaaannnncgcnannaacanncgcnngangaaannannnaannnnttntnnnnnnncanncncncnctntctnncnccnncannnaaannaanngcgnnnnaaaannaannnnnnanaannnnnnnnananngnatgnnngatnnannnaannnnnnntttnttnnnngnnngcncnnnnnnaanncncgngannanagnncncnnnnnnngntngnnnnnnnnnnanaaaannnnccnnnnnnnnannnaaannnnntnnnnnncngnngnntntnnnnannnagnnngnaanaanannnanagnaannanangaannaaangnanaaaangannnnnannnnnnngaannnngnngnnnnnaaaaannnnnnncnnnnnnannnnnnnnnnnanngnnnnnnnnngannnnngannnncnnnnnnnnnnnnnnnnnnannaannaannnntctnncnnnnnnnnnnnnnganagannnnnnnnnnnnnnnncnnnnnttnnannnnnnatanatatatatagagagagagaaagagagagagttcgaaatgctctgctccggtagaagacaaangtaagaatacgagcgggcggcgaagcgaccggatgcggaaaatggcagacctttcaaaattcaaaattcaaccacaaactccacataaataagcgctcagtaaacacgaatcaacgcgaatcatcatgctcgaagaaaccaccaacaacgcgaacatcatcaccaccaccacaaccaccaccaccaacgagccaacactcacgcaatacgaagccgagcgcaacgcgcggatacaaaanaacatcgaacgcatgaaatcgttcggcatcgacgacgcgaggaaaaaagtgatgacgatggaatcgaagcacaaaaacaacgcgacgacgtccttgttatccaaaaagcgcgtcaaaaaacgctctgaaaacgcaacacagatggacagatcgaaacaaccgaggcggacgtcctcgcgcgtgcgcggagagaaagcgccggacgttttcgtgcccgatgaaagaaatctttgggaaccgacgtataacgaggaaatctacacgcaaaggcaagtntcgaacttgggcgatcgaaaatcggagtggcaactcttcgtctccgggtacgaccaacaaggtcgacggttgtacgacaacaacagaggcgtgtgttgtcaccagtgcaggcagaaaacgctgggaacgcacacgacgtgcaggaagtgcaacatgatgcgcgggaagttttgcggagactgtatttttatgngntacggtgaaaacgttctggaaatcaacgaaaatccggagtgggagtgcccggtgtgtcgtgacatctgcaattgttcgttctgtcgcacgaagaaagggtggatgccgactgggaacatgtaccgagccgcgatcgcgagcgggtacaaatccgtggcgcattatttagtcttgtcgagacaggacgacgaggaaaaggccaaactgtgcgaagaggaagccgaacgcgtcgccgagcgattgcagagagaagaaaagagacgaattcaagaaaacccagagttatacgcgaaagaacaagaggagaggaggaataggccgcactggttgaagaataaaaagtagtaaagcgggacggacagaagagcggaggatgtcccgcggccgctttgtaccatcactagaagntntaccaaattggagagagaaaaaaccacactttttatcatcatcatcatcatcatcatgtctcctcctcctcctctttcggagtctcacaccgccgagtccctccgaaaccttttcgcctctactttctcttggttcctccccgagaacgtcatcgacgaggacacgctcgagtatctgttcncgagtttatccgatggaagtttcgaggacaaggaggagtttctggatttcgtgacgccacttttgatggaattattcgaaggtgacgacgaagacgaggcgagagcgcagtgcacgaaagcgcacgatttgttatacggcaaatgngtagaagaagggagcgatactacgaaagaggaggagacgaccacgagagtgataaacgtgaaattaggtggcactccaggggaagaggaggaaagcgaattcgagaaagaggtttcgaggcggttgcgagagaaggaaagagaccgtttgccagattttagcacgaatncgaaccatcgaaatcaaaacgaagataaagcgcaggagaaagagcaacggaaaatgaggaaaaaactggaagagagcgaggaggaggtgcggaagttgttgagagaactggacgtcgccagggagacggcggcgaagaggcgcatcgaaggaagtagcngcggagggaacgggtcgattggaacgattgaagttgggccgttcaacgtgccgaatccaggtggagggcaggatctcatcaacgattgcgttttgacgttcgtacctgggagaaggtacgcgttgattggaagaaatggaacgggtaagtctactttgctgaagtatttggcgtccagacgggtgggcgacaaggttggtttctccgaggatgttttcgtgcattacgtgaatcaagaggtcacgttgaacgaggagcaagaagaatggttaccagtggacgttgtgttacacgcggacgtgcaaagacgacttttgttggaggagttgaaagagttggaatccaacgcgagcggagaaggtgacgtgcaaaggatttctgtcgttcacgaacatttagattctatagagtcctcgtccgcgcacgccagagcgtcgcaattgcttcgcagtctcggtttcagcgaggaattagccagtcgtaaaatgaaacagttatctggtgggtggagagttcggacgagtttagccgccgcgttgttcgcgactcccgatatattattcttggacgagccgacgaatcatttgtcgattcaagcggtaatgtttttagcaaaagagctggtggagaatccagtttggaaatctcgcattatcgtctgcgtttcgcacgacagacacttcttggacgaaaccacgacggattcgttgcatatttccggcgtcgccaaacgagtcacgtcgcatcgaatgaactattccagttgggccaaaaagaggagagaacagcaaatcgcgttgaaaaaacgcacggaattgagacagataaagattgacacgctgaaggaattcgctgggcacgggttccgctacggcggctcctcgtcgcaaatcaatatgatgcagaagaaagcctccgaggcgaagaaat

SEQ ID NO: 1488 - DNA, 4000 bp, Escherichia coli
  misc_feature (47)..(47): n is a, c, g, or t
  misc_feature (64)..(64): n is a, c, g, or t
  misc_feature (67)..(67): n is a, c, g, or t
  misc_feature (72)..(72): n is a, c, g, or t
  misc_feature (74)..(74): n is a, c, g, or t
ttaaaaaatcaaaatttaatttattaaaatagatttaattaaaaatnaaaaaaaaagttgaaanaanaaaananaaaaaaaaaaaaagattggaaagaggctagaaataaataattaaaagaaagtgtaacaactgaatgataatatcaaagtacaaataataatgtatttatagtaaataataatgttaatagtaaatagtaaataaataaacaagttaataaaatagtattaaataataaaataaagaaaaaatattaataataatacagataatgtggtcatgatactattaatacaatcaatacattgatgtatcaatatttatgtcaacatagtacattaattattgtatcgtcaaaatactgaatattaatattaataataatgtattataatagtattattaattaatatatactattaaaaaaatagaaaataattttttaatttacactaaataataaataaaaaaaattataaaatttcgaaattttaaatatatgtagatttttcatataaaagtgaaggaatttcctttccaacattttttttttcaataaaaaaaaattttttttatttgtgaatataattattataatatatttattataataattgacagataataattttcttgtataaataagaataataatttaacagtaattaaaatgaaatttttatttaagggattggttcttgtctcagttgctggtcttgtattggctgacaactattccggagactgtaaagaaatttatgattatttaaaacaaagtaattatgaattaaatctaaagaattgtacaactaatgaagaaggtttagttaaacaattgtatgtatatgaaacaattctattataatatatataatataaaaacaaaacaaaacaaaataaaaaaaaaaaaaggaaagaatttatatttatttatatacaaaattcatttataattaaatattaatgaataatacagagacctttacacttattgtttaactgaagaagatattaaccaattaattcactatgaatcaattagtagtctgtaagtttactattcatatcaaagaatatacattttgaattagaattacaacaatatataataattttttaattattaaaattttatataaaagtaaccttgataccgaaaccacttattattccaatgaatatgatactttaaagaattgtaatcaattattaaatttaccagatgttattacttctttatcaaatttggaatccttgtaaataaatatttttttattttattttgcatttttaaatattaaatttatattaaaaatattattcaaaaatatattgataaatattaatatatctttcatatattgatatattaaaatttttatttttataattatgacatatacagagaactccacagtttaataaaaataaaagaaaaagatttattaaaaattccaagttcagttcgtaaattgtatgtataatatatttaaatttgttaattttgtaacattattataatttaaaaatgtcctattgtgaaattagtttttattgatataattatatattatatatcaaatatttttttttttttattttatattaaaatataaataaaattaatatatattatagaacttttggtgatgttgctcttgaacaatttgttattgatgacatttctcaattatctaatatcgaagaattgtaattattattttattttattttattttaaatattatatatttatataaaatatataaatttgtcagttattaatattgtctggcgttaccataaatactatatatatacatttttaaaattaattttttttagatctttcgttcgtactacctctaataatgaattaaattttgaaccaatcaagaatctttccaacttatcttctttgtaattaaaaactgaaattgatatatatatttttaaaaaaaattaaaacaacctatttaactattaactttttttttcttttttttttttttaatagatacatttctaattctgaagacagaagaactgttaaaaagtatataaatccatcatatttaaaaagctttaccaatcttaagaaattgtaagataccattaattatacatatatatattatataatattttaaatgaataaacccatttacattaatatatattttttttatgttaatgaaaatatttagtgaagcttttgaatactcattcagtcaagaagctattgatgccatttccactttaactaatcttgaagaaatgtaattattatatataaccataatgaaaatttgtataaatttaaacatgagagtaataacattataaatattaataatgttaatatttaaaatagtacttttactgaatgtggttttgatgaagatttagatactgaatccataggaaatcttaccaaccttaaagcattgtaaatattaattaaatataaaatatatatttatttctctttactaaatcattatcataataatatatatttaatataatatatcagcaatatgctcggaactacacaacattgtttagaagaaattgatatttttggtggtaacaattgtccattagatgaaattccagaatctcttttcactattgaaggattaaagaaactgtaggtgtagatataataataatcataaattacaaaatgatatttattctaattaatcggaccttattatatataaattaattatagtgtttacaataaacaaaaggaacttgattacagtgctttagaagatattggtgaacttaagaaacttgaatacctgtaagcattaaaattcttgtttatatattaaaactacgtatgaaaatcctaaaaataataatgtaataataatttttaataaatattatgtaaatatagtgatttatccggtattcaattaaatgaagttccatcttctattaagcaacttaaaaagcttcaatacctgtaaatataaatttaaaatttaatattataattaaaattattatatataaatttcaatactattattataatatcattattctaaaaaaaataattgtaatatatatatatatgaattaataaattattattaattggtattattaaaatcataatctgatttaatttaatacagtaatttaagcaataactttatcgaaactgttccagatattttcagtaaaattaagaatattgaagaaatgtaagtagtattaatatttaaaaaataaataaaataaataaatttaatgtaaaatatattaaaatatataatatatattttaattgtcaaatagtgatttaagttcaaattcactcaaaacccttccagctagttttggaaaacttaagaacctcaagaaactgtaaggattataaatttcaaaatatatatatatatttatttaatattattaaataaaagttattaatatataattttaaattttgtatttttaatattaattattataaaaatattatctatatagtaatttgggtctcaatgaatttgaatccattccagaagttttaggaaatcttaaaaatgttgaatacctgtaattatctgatacattatatttttttttctttcatatttataataaattaacaaatataaaatatataaatgaaatatttttatattatatatgatattcagtaacatggaatttaataaacttaccaatttatctaaatctcttggaaacatgaaaaaccttaaggaactgtaagcgcaaaatatattattaaaaaatacaatattatagattttatgataatagaaataaaaatttatcataaaataaattatttatacttatttattttaaaaaacattatattaataaaaatttagtgatttaaataccaacggacttactattattccagatgattctagtattgttaatctttctaaccttgaagttctgtaaatatgcatttttgaataattattagttata

SEQ ID NO: 1489 - DNA, 4000 bp, Escherichia coli
  misc_feature (59)..(60): n is a, c, g, or t
  misc_feature (231)..(231): n is a, c, g, or t
  misc_feature (1980)..(1980): n is a, c, g, or t
  misc_feature (1986)..(1986): n is a, c, g, or t
acaacatcatcttcttcttcttctggtgtctgttccgacgcgcgcggtagtattgcgannagtgaatcatataccgacgacagagtggtgttgtcgtcgtcatcatcgaaaggatttttggttcgaacgaaagctacgtattcgaacaacgacgacgaggtgatgaagaaagatacgaaaaaattgattgattacggtcgagtcggtgtcgcgttcgcctttccggcgttngccgggttcctttttggtctcgatattggcctctcttcgggcgcgctggagagcataaaaacatcctcatcggatttcttcaatttgactgcgtcgcaatcgggtcaaattgtctccgcgtctctttttggcgcgttgacggcatccgcggtcgccgccgccggcgccggcgagaagttgggatcgaggaaagaaatcgccttggcgggagtgttgtatttaatcggcgggactatggaagcgaacgcgcagtcggttgattttttaatctttgcgaaagctatttatgggttagggattggatttgccatgcacggcgcgccggtgtacatcgcggagaccgcgccgagttctctgagaggaactttgatttctttgaaagaagcggcgattgtgtttgggattttgtgcgggtatttttgcgcgagtcagtacgtcggggaagatgggggatggagatccatgtttttaacctctgtgccattcgcagtgttgacgttagtcggtgctgggttcatcttaccggattctccgagatggttggcgtcgaaaaatatggactcgtttccggcgctgaaaaaattgcgagggccgaacgtgagcgagatggaattgatgaacgaattagacgagatcaacatgtttgcgaacgtgaggaggaaagaagagatgggaagaacgaaatcgccgtttgcgattttagataagaaatacgcgaaagctttgtacgtcggcttatcggtggttttgtttcagcaattaactgggcaaccgtcggtgttgtattacgcgacgcaaacgttcgaggcggccgggtggtcggcgcaaggcgcctcgaacattgccgtcgtggttggcgtgttcaaactattcatgaccggtatagccgtgtggaaagtagacagtttaggccggcgtccgttgttactcggcggggtgagcttgattacgttgtcgctgatggttctagcgttggcctcgccggattttgcgggatccggcgtcgaggcagcggcactttcagaaacgcaagcgcgcatttccgtggctgctattttcttatacgtaggcgcgtatcaagtgagttttggtccaattgcgtggttgttagtcggggaggtgttcccgacgaaagtccgttcgcaagcggttggcatcgcgacgcttttaaacttcgggtctaacttcatcgtcagtttaaacttgccgtacgcgattgaacaaattggcatcaagtctacgtatttcgggttcgcgtcgattggcgttttgagcgtcgcttcgatatatttcagtgtcgtggaaacgaaaggtaaaacgttggaggagattgaagacgcgtataccgtcaccgcgacgaaagtcgaagaagatcgatgattttcttttacgaaccaggcacttcttcgaagatgattaggaaaatattaatataacagctgtattgtacctcacgcgaaatcactcaaccctactattaacggatcgtcgaacgatattaatctatccgctttagaaatctcaaccaaatctcgatcggcttccgatactccgcacgtttcgccggcgaaaagttctgccgtttcaccctttgcagtcacgcctcccggtaataccgagtacgcgattgaaggcgagtcgcactcgactttccgcaaagcgctagtgatgtttttaacaacgcgacattcgccagctctgagcgtaattcctagttgcggcccgaaaattctcgcgctctttaccganttcggnctgtaccagccagggaaacacgacggatcagacgtcgaggaaaactcgtttctgctcgaagaattttcttcacttctgctcgcgatgcgaacttgagcggcgttgacatcattgggatcgatggaggataaaaaggtcgtaaacaagtcatccaaatcattctccagagattctaaaaacgtagagtttgccgtgccgttcgtttgccgtgccatcgtcgtcgtcgaagacgtcgtttcgccatctgtctgtttggtcaataagatctcagcaacgcgcggatcggattgcgcgaccattttcatgagataatcgctcccgtcttgaagcagacgaactaactcagcgacagttggatccgacgtagtagcggcgcctgcgttgaacgagaagaggaacgcaaagacggatgcgagaaggattaattttctggatggaaacataatttttgtatcgcaatcgaaaacgaagcgtttttaatttatttaccttttcatcgtttttgtcacttcaacaatttaaactacttttcaagtctaacttgaagacgcgctgtgtttgtttcctaccatctctctcgttgccgatgctgttgatgctgctgctgctgccgaattcctctcgcaggacagtctgcagatttgtggccgaaaccgttgcagttgtaacacttcattcctccgccgccgccgccgccggagcggttgtatttcatcgaagaaggacaatctctctggaagtgaccaactttcccgcattgtttacaagctttagcttggggattaaacgggtgcgacaaaatgctcgggccgaaaagaaacattgattttctcccgttcttgaatgaaaagttaggccagttcgcgtactccgctttgagttgattcatcgcctctcgcagtttttccgtggctggattcggcggtaagggaggcggcgccgtcgcggattgaaagctagaaacaactggtggcgtcggtgctaccgcattttgcttcggtattgaaaagcccgcacctcctccggccgaggaaggcattggtgttgatttttgtccaatgagaggtcgtttgtattgcggcgttttcgtctcggaagcaactactgaggcggcggatgcctccgcagcgagagcagacttttcatccttctctcgcttttgcttccgttgttcctcctcttcctcttgtttttctcgaactcttttctttgctgtctgttcttgcttcttcttctgctcttctgggacgatgaactcaatcacttctatgcctttctttttctccggcggcacgccgttggtggcggtggtaggagttataattcccacagccgacggcgacttttctgcactcttattcttattcttatcgacagcatctttctcatcttctctcggaggttccggcgtcgactgtttccgcgctacttttccttctactacttttttgacttctacttctttcttcttcgccgatgttgccgccggcttcttctgcttctccgccgacgcccccggtgttttcttcgtggcacctttcttcttcttcgcgctgctctcttcttcgactaacgctacgacgctatccatcactcgctttctttcgctcgcgagagttttctcgtcgctcgtaaatgtgctcaaacacgtcactttctttgtcctgaaaaccttcgcctccaactccgtctctctccttccactcgccccggtgttcgtaaacttcatcgtcgctactctggtttcaaacacgttgtcttccaacgatttctttttcggaggttgcaccaaatgatgtctcgcattcatcacttcgacgatgtcgccgatatcaatccacccggaatcgtcctcggtgacgaagatttcgtactcgttcgcctcttcgtccgacatacttttgatttcgttcggctttaacccttgctttggacaaacgtcgatgaatttcccgacccactcgtgtctacattcgtttcgagtaagaattctaactcctttaaacgttccttt

SEQ ID NO: 1490 - DNA, 4000 bp, Escherichia coli
  misc_feature (3)..(4): n is a, c, g, or t
  misc_feature (6)..(9): n is a, c, g, or t
  misc_feature (13)..(18): n is a, c, g, or t
  misc_feature (21)..(23): n is a, c, g, or t
  misc_feature (26)..(26): n is a, c, g, or t
  misc_feature (28)..(28): n is a, c, g, or t
  misc_feature (31)..(31): n is a, c, g, or t
  misc_feature (33)..(35): n is a, c, g, or t
  misc_feature (37)..(41): n is a, c, g, or t
  misc_feature (43)..(46): n is a, c, g, or t
  misc_feature (48)..(48): n is a, c, g, or t
  misc_feature (51)..(51): n is a, c, g, or t
  misc_feature (53)..(54): n is a, c, g, or t
  misc_feature (58)..(59): n is a, c, g, or t
  misc_feature (61)..(61): n is a, c, g, or t
  misc_feature (63)..(63): n is a, c, g, or t
  misc_feature (65)..(65): n is a, c, g, or t
  misc_feature (67)..(71): n is a, c, g, or t
  misc_feature (74)..(78): n is a, c, g, or t
  misc_feature (80)..(90): n is a, c, g, or t
  misc_feature (92)..(93): n is a, c, g, or t
  misc_feature (96)..(97): n is a, c, g, or t
  misc_feature (99)..(99): n is a, c, g, or t
  misc_feature (101)..(101): n is a, c, g, or t
  misc_feature (103)..(103): n is a, c, g, or t
  misc_feature (106)..(108): n is a, c, g, or t
  misc_feature (110)..(110): n is a, c, g, or t
  misc_feature (113)..(116): n is a, c, g, or t
  misc_feature (118)..(119): n is a, c, g, or t
  misc_feature (122)..(123): n is a, c, g, or t
  misc_feature (127)..(127): n is a, c, g, or t
  misc_feature (130)..(134): n is a, c, g, or t
  misc_feature (136)..(136): n is a, c, g, or t
  misc_feature (138)..(138): n is a, c, g, or t
  misc_feature (140)..(140): n is a, c, g, or t
  misc_feature (144)..(144): n is a, c, g, or t
  misc_feature (146)..(146): n is a, c, g, or t
  misc_feature (148)..(148): n is a, c, g, or t
  misc_feature (150)..(151): n is a, c, g, or t
  misc_feature (153)..(155): n is a, c, g, or t
  misc_feature (161)..(162): n is a, c, g, or t
  misc_feature (165)..(166): n is a, c, g, or t
  misc_feature (168)..(171): n is a, c, g, or t
  misc_feature (173)..(173): n is a, c, g, or t
  misc_feature (175)..(175): n is a, c, g, or t
  misc_feature (177)..(178): n is a, c, g, or t
  misc_feature (180)..(182): n is a, c, g, or t
  misc_feature (184)..(184): n is a, c, g, or t
  misc_feature (186)..(188): n is a, c, g, or t
  misc_feature (190)..(191): n is a, c, g, or t
  misc_feature (193)..(196): n is a, c, g, or t
  misc_feature (199)..(199): n is a, c, g, or t
  misc_feature (202)..(202): n is a, c, g, or t
  misc_feature (206)..(207): n is a, c, g, or t
  misc_feature (211)..(211): n is a, c, g, or t
  misc_feature (214)..(216): n is a, c, g, or t
  misc_feature (218)..(222): n is a, c, g, or t
  misc_feature (225)..(225): n is a, c, g, or t
  misc_feature (231)..(231): n is a, c, g, or t
  misc_feature (236)..(238): n is a, c, g, or t
  misc_feature (240)..(240): n is a, c, g, or t
  misc_feature (246)..(248): n is a, c, g, or t
  misc_feature (250)..(251): n is a, c, g, or t
  misc_feature (254)..(254): n is a, c, g, or t
  misc_feature (256)..(263): n is a, c, g, or t
  misc_feature (266)..(268): n is a, c, g, or t
  misc_feature (272)..(272): n is a, c, g, or t
  misc_feature (274)..(274): n is a, c, g, or t
  misc_feature (277)..(277): n is a, c, g, or t
  misc_feature (279)..(279): n is a, c, g, or t
  misc_feature (281)..(283): n is a, c, g, or t
  misc_feature (287)..(288): n is a, c, g, or t
  misc_feature (291)..(292): n is a, c, g, or t
  misc_feature (295)..(295): n is a, c, g, or t
  misc_feature (297)..(298): n is a, c, g, or t
  misc_feature (302)..(303): n is a, c, g, or t
  misc_feature (305)..(305): n is a, c, g, or t
  misc_feature (307)..(307): n is a, c, g, or t
  misc_feature (309)..(309): n is a, c, g, or t
  misc_feature (311)..(311): n is a, c, g, or t
  misc_feature (315)..(315): n is a, c, g, or t
  misc_feature (317)..(319): n is a, c, g, or t
  misc_feature (321)..(321): n is a, c, g, or t
  misc_feature (323)..(323): n is a, c, g, or t
  misc_feature (325)..(325): n is a, c, g, or t
  misc_feature (329)..(329): n is a, c, g, or t
  misc_feature (331)..(332): n is a, c, g, or t
  misc_feature (334)..(336): n is a, c, g, or t
  misc_feature (338)..(339): n is a, c, g, or t
  misc_feature (341)..(341): n is a, c, g, or t
  misc_feature (343)..(345): n is a, c, g, or t
  misc_feature (347)..(347): n is a, c, g, or t
  misc_feature (356)..(356): n is a, c, g, or t
  misc_feature (366)..(366): n is a, c, g, or t
  misc_feature (378)..(379): n is a, c, g, or t
  misc_feature (391)..(391): n is a, c, g, or t
  misc_feature (406)..(406): n is a, c, g, or t
  misc_feature (412)..(412): n is a, c, g, or t
  misc_feature (487)..(487): n is a, c, g, or t
  misc_feature (554)..(554): n is a, c, g, or t
  misc_feature (589)..(589): n is a, c, g, or t
  misc_feature (1108)..(1108): n is a, c, g, or t
  misc_feature (1963)..(1963): n is a, c, g, or t
  misc_feature (3386)..(3387): n is a, c, g, or t
  misc_feature (3391)..(3397): n is a, c, g, or t
  misc_feature (3400)..(3404): n is a, c, g, or t
  misc_feature (3406)..(3411): n is a, c, g, or t
  misc_feature (3413)..(3417): n is a, c, g, or t
  misc_feature (3419)..(3420): n is a, c, g, or t
  misc_feature (3423)..(3425): n is a, c, g, or t
  misc_feature (3428)..(3429): n is a, c, g, or t
  misc_feature (3431)..(3439): n is a, c, g, or t
  misc_feature (3442)..(3442): n is a, c, g, or t
  misc_feature (3444)..(3446): n is a, c, g, or t
  misc_feature (3449)..(3451): n is a, c, g, or t
  misc_feature (3454)..(3454): n is a, c, g, or t
  misc_feature (3458)..(3460): n is a, c, g, or t
  misc_feature (3462)..(3474): n is a, c, g, or t
  misc_feature (3476)..(3477): n is a, c, g, or t
  misc_feature (3479)..(3479): n is a, c, g, or t
  misc_feature (3481)..(3483): n is a, c, g, or t
  misc_feature (3485)..(3489): n is a, c, g, or t
  misc_feature (3491)..(3492): n is a, c, g, or t
  misc_feature (3494)..(3495): n is a, c, g, or t
  misc_feature (3497)..(3497): n is a, c, g, or t
  misc_feature (3499)..(3503): n is a, c, g, or t
  misc_feature (3505)..(3505): n is a, c, g, or t
  misc_feature (3507)..(3511): n is a, c, g, or t
  misc_feature (3513)..(3526): n is a, c, g, or t
  misc_feature (3528)..(3528): n is a, c, g, or t
  misc_feature (3531)..(3534): n is a, c, g, or t
  misc_feature (3536)..(3537): n is a, c, g, or t
  misc_feature (3539)..(3545): n is a, c, g, or t
  misc_feature (3548)..(3555): n is a, c, g, or t
  misc_feature (3557)..(3565): n is a, c, g, or t
  misc_feature (3567)..(3570): n is a, c, g, or t
  misc_feature (3572)..(3579): n is a, c, g, or t
  misc_feature (3581)..(3583): n is a, c, g, or t
  misc_feature (3585)..(3585): n is a, c, g, or t
  misc_feature (3587)..(3587): n is a, c, g, or t
  misc_feature (3589)..(3591): n is a, c, g, or t
  misc_feature (3593)..(3593): n is a, c, g, or t
  misc_feature (3596)..(3596): n is a, c, g, or t
  misc_feature (3599)..(3602): n is a, c, g, or t
  misc_feature (3604)..(3604): n is a, c, g, or t
  misc_feature (3608)..(3608): n is a, c, g, or t
  misc_feature (3610)..(3621): n is a, c, g, or t
  misc_feature (3626)..(3626): n is a, c, g, or t
  misc_feature (3628)..(3628): n is a, c, g, or t
  misc_feature (3630)..(3634): n is a, c, g, or t
  misc_feature (3636)..(3639): n is a, c, g, or t
  misc_feature (3641)..(3642): n is a, c, g, or t
  misc_feature (3644)..(3644): n is a, c, g, or t
  misc_feature (3647)..(3647): n is a, c, g, or t
  misc_feature (3655)..(3655): n is a, c, g, or t
  misc_feature (3657)..(3665): n is a, c, g, or t
  misc_feature (3669)..(3672): n is a, c, g, or t
  misc_feature (3674)..(3679): n is a, c, g, or t
  misc_feature (3681)..(3681): n is a, c, g, or t
  misc_feature (3683)..(3687): n is a, c, g, or t
  misc_feature (3689)..(3690): n is a, c, g, or t
  misc_feature (3692)..(3693): n is a, c, g, or t
  misc_feature (3698)..(3698): n is a, c, g, or t
  misc_feature (3700)..(3700): n is a, c, g, or t
  misc_feature (3702)..(3703): n is a, c, g, or t
  misc_feature (3706)..(3708): n is a, c, g, or t
  misc_feature (3710)..(3720): n is a, c, g, or t
  misc_feature (3722)..(3723): n is a, c, g, or t
  misc_feature (3726)..(3729): n is a, c, g, or t
  misc_feature (3732)..(3732): n is a, c, g, or t
  misc_feature (3734)..(3739): n is a, c, g, or t
  misc_feature (3741)..(3741): n is a, c, g, or t
  misc_feature (3743)..(3747): n is a, c, g, or t
  misc_feature (3749)..(3750): n is a, c, g, or t
  misc_feature (3753)..(3754): n is a, c, g, or t
  misc_feature (3757)..(3762): n is a, c, g, or t
  misc_feature (3765)..(3770): n is a, c, g, or t
  misc_feature (3772)..(3773): n is a, c, g, or t
  misc_feature (3782)..(3782): n is a, c, g, or t
  misc_feature (3800)..(3800): n is a, c, g, or t
  misc_feature (3839)..(3839): n is a, c, g, or t
  misc_feature (3875)..(3875): n is a, c, g, or t
  misc_feature (3911)..(3911): n is a, c, g, or t
  misc_feature (3920)..(3920): n is a, c, g, or t
  misc_feature (3941)..(3941): n is a, c, g, or t
tanntnnnntccnnnnnnttnnnttntnaantnnntnnnnnannnnanttnannaatnntntnantnnnnnttnnnnntnnnnnnnnnnntnntanngngntnaannnanggnnnnannttnntttnggnnnnnancntngaantngnanncnnnctcttnnttnnannnngnantnntnnntngnnnannannnnccnatnattnnaaanttnnntnnnnnaantttttntattnnnantttttnnncnnttntnnnnnnnnttnnncaantnttncnannntttnnttnnatngnnctanntncngngntttntnnncntncnttgnanntnnnanntncnnntntaggtattncattttcaantcagattcttgnntttacttctaancttgaactagagagnaatacnaatgatactaacagtgattcaaagtttttagaatcagatgatttttctatgcctactgtttctcttgcgaatgcnaagagacaagcacttaggatagcagaagtctctcaaaatatggttgtgtcatcacttgcagtaatgngagatgataacgaaatattaagaaatgaaattatnaaaaatgaggatattgttgataatctctttgactctataaagctttatattgctcgaatattacaagaagagctttcaccaaaagaaagccaacaagcactcaatattcttaactttacaacaaacatggagcatataggtgatattgtcaataatagtttaatggacatttctaaaaagaaaatttcaaaacatatacagttttctaaagaaggtttcagtgagattatttctattcatgaggtagtatgttctgattatgatcttgctattagtacatttatgtcgaatgattgtgagttagctaaagttctgtatggaaaaaaacaagagcttcataaactggaaactaaatcagtctcaaaacatcttcaacgaattggaaagggagttactgatagccttgagactagctcaatgcatattgatgtgataagagattataaaagaataaatagccttttatcatcgatagcctatccaattctatttgcatctggtgagatattagaaactagnttaaaggaaaacagctaattattaaggtgcaataaataagtactttaattttattaattcatcttgagagctctgcattatttctccttttgtagagttctcgaaatgtttaagactgttagatcaaggttttcataaatttaagagtgtttttaaatttatatttcttttattttgaatttaaaattggtggaatttttaataggtctttaaatttctcaatttgataatcagactctttgcagtcaggatctgggttgaagataattgtagtcaatcctattgctttagcaccatcaatttcaattttagcatgtccaacaaatgcagcattttctgggctttcattaagaggttcaagtgctgcaaggtatattctagggtctggcttggttatttgaagttcaaatgaatcagcataagaatcccaaatatcactaattccaacagatttaaaccaagtatttttttctgttctagagttgaatgtatttgttacaattccaagattaaatcctcttctttttaactcatgaagtgtttcgggaacgccttcaaaaaaatgtacatcactctgttggtttttcagtaacttaattccatcagcaaaatctgatgaatttgtgacgccataatgctccattagccattcaaaaaaagattctgtttcaattctccctgcatgtgcgtctcgtcgttttgccttttctactggatcattttcaagtggagcagaatagcctcgttcagtaagaaatttaatgactgatgatttacgattaggtttgttgtagagaatgtcaccagcatcaaagagtatggtttttaaaagcacattaattccttatttatttnagataaatttaatattaaacctaggtatgaaacgccttggctaaaatataaccaaggcgaaagttgtggtattttaaggcattaaagtaagataaagtgctaggaaaccaaactttgaataatagatttcctctggatctactggccataggccaagatctccaaatgccggtaaatcaaattttactaattgcttagcttcaaggtttgaacgcgcagcataatcacctggttcgttccaaggtttaaagccatcttcctccatcatatatcggattaaaagtttagctgcatttggatgtggtgccatatcagctatcactaacgcagttggataagttacaccaaaggctggatcaagatcgtaggctgggcctgaagaatatactccttccttgtttttacgaagttttgaaaatgtagtgattccaattggtggcttctcttgagtaacatctccaacatttttaaagatttttgttgtagatccttgaaatacgggttcattatttaagaatctatagagccattccattgaagcagttggggaatctaatgtagcgttttcttctacggcttcaataacatcctctgaaaaagttatctcttcaccaaattctcttttgtaagccgcagccatttcatctgagttatttaagactgtttgaataaaattagcagataagctatcttcaagagggctaggtaaaagaacgcgacccttccattcatcacgggtcatgtcccatagtgagtcaagtggcgctccatctggatgtacagctgtattgtaataaacgattcgactagagtgacgttgaatcaacaatggattcatttcgccagattccaaatctccggctacactttctggaatgaaattccaaaccaattgttttggtagggcttcattaagtagaatcgaagattctgaattaaacaaaacatctactgaatgaacacctgctcgatgctcacgcgatagtttttctagttgaaggtcagagggaatatcgtatcctataatatcgatatcatagcgctctttaaatccatcaactaattttgcaatgcgtgaggatactgaataaattactacctcaccttcttcacgtgcagcagcttcaattgcactccagttttgattgtcagacgcataacttccaacacctgcttttttttgccacgcttcatcagcttgaactgatccaatagaggaaaatgctaatcctaaggataaagcaaatacactaattgatgccattttttccatttttgttctcctttttaagtttgacttacaatttgatatttacaaattattaatattttttatacttacgattttcttataccatatagtttagatttatgcaataattattgcaataaatttaaatcgtgctataatttttgcaaaaannaaannnnnnnccnnnnnannnnnnannnnnannaannnttnnannnnnnnnnaantnnnttnnnggnaaannnannnnnnnnnnnnnannantnnntnnnnntnntnntngnnnnncntnnnnngnnnnnnnnnnnnnntncgnnnnanntnnnnnnnaannnnnnnntnnnnnnnnnannnntnnnnnnnntnnnangnannntnggnttnnnngntttncnnnnnnnnnnnnaaaantnannnnngnnnntnnanttnaaaaaaantnnnnnnnnnaaannnngnnnnnnantnnnnntnntnnaaaangntnnaannntnnnnnnnnnnntnnaannnnaantnnnnnnantnnnnncnnttnnaannnnnnttnnnnnnanncaaattgangaagtagtaaacaaaatntataaagcaaaaagtatttttatagttggacgaggaagngctgctccattaatgacacattttgaacgtcgtctnagaagatcaggtattcagtgccgtgttgcattaaanttgcaaagnagggatttagctgaacaactnattggaattcaaaaaggtgatgcaattgttgtttttggttttcagtcaattaactctct

SEQ ID NO: 1491 - DNA, 4000 bp, Escherichia coli
  misc_feature (294)..(294): n is a, c, g, or t
  misc_feature (443)..(443): n is a, c, g, or t
  misc_feature (1052)..(1052): n is a, c, g, or t
tcagccttatgttgttgatgagtaacctcgtgtccagacagagcagctaatgctagtacaagctcttcagtcgcatgaccatataagaacttcattaaggtagctggtgtcatagactcagctttatagttcctatgtctataccaaaggtatctatcttgcttaccgatactactcattcgtaaagcattactctcttcatgcttcgtaagtacttgattcttaaggatattcttcattgcctcaccaaagttatccacaatcttatccacatctacaccttcggctgcttcnttctttactaacacctcatagatgtcatctactaaatcttcaatcttcttcataactactcctagtgagtttcagcccacgtatctcctactttaaattcagcatcaaggggacagttcatctcatagtatgtacctgcctcaatcatnctccctactgccaagcttccgaatagaccagcttgttcttcttttacttctgtttgaatctcatcgtgaatattacccacgaacttataatcaatattgtaactcttagcatacccatccagtattactaaggctctcttcattactatcgcacctgctgattgtagtaatgtattcagagctgcatgtggacttctgatgtttaacttcctatcatctaatcctttaattgtgccttgttcagacaacttagtaactctgtctcgtaaatctttaagtgctggcgtattagcaaggaagtctttcttaagtcgtttaccatcgctacttgttcctccgacaatgtcaccgattttcccatccccagctccgtacaagaaagcatagatgaaagtctttgcctgatttcttgattcaagtcctgcagccatttgatttgctgtgtgtatatctccatctacaacctccttagtgtaatcttcattgttcatatagtgtgccagcatccttaactccagacctgacgcatccatccctactaacttataaccatctcttactttaaatagactcctacattgctcaccataagggctaccactagcaggnacttgagctagattaggattgctatgtgtcatcctattagtaacagcacctataggattaatataagcatgtatcctatctaatacacctgccgcttcaatccaagaagatactaaccctagtctcttttgtaacattaagtatctagctattaacttaccttcaggaaactctacattctctagtatagtctctgatacttgaggtatcccagtctcagttaactcagttggttcccatccataatgtattaggtgtctggctatctgcttcctactacctaagttaaactcagggtaggtaatcttaccccacccttgttcagggtctaggtaagctaatgaatctaattgtctttgtaaggaagctgcaacttcaccatcaatagtataaggcttgcttggaaagctcagtgatacaaaggtaggtagaggtacaaagacttctcttacttcatcttcagccttgaacatctcagacttaagttctgcttgtagagttatagcatccttagtattgaactcccaaccattaatcttctgttgatggattatcttagctaccttatactctagagttatggcatctttagataacttctgctgaagtagtaggttgtataaactatatgtaaccttgacatcttgaatacaatactcaagcatctcttggttatagttactccaagcatcttctttcttaccgaagtcacctttagcattacctagtctctcaccccaagcatctaagctatgaccacctttacgacttggactatctaacctagacagtaccaaggtgtcttcaatctcaccccaccaagtgaagtgtagtaatctttctataactggtatgtcaaagttgataatgttatgacctattagtacctctaccttgttatcttgtagccaaggtatgaagtctttaacatccttaggttcaaaggtagtaggctcatcccacctacctactatcttggcagcaatacaccagatgactgatggattaagaccattagtttctatatcgaatattgctttaaccattacatctcctcgggggctactgtttctctaagtctccctgtttctgcatcatattgtaagtaccctgtgactcctgtctcacctgtgtacctattctttagaatcctcagtgtagttgtgttcctaatgagagggtcatctgattgttgattacgttctaaggcaatgaccatattagataactgagctataccttgtgaacctctaaggtgtgacaatgagatagaacccccttcttcatgcggtgtaccttgttgtcttgatagatgggatacgaggaataagccaatgttagtctcaactactacctcacgtagcttagtcattaaagcatcgatgttcctacgttcatcacccttagcatcaccagacattacaaggttaagatggtctaatacaatccacttaatgttctgagccttagccatcaacttgatacgacttactatcttctcaatggatagttctttgccatcatataaagttaaagcttccccttcatctctttgaaagagttcatcgaaagcttcttcggctacttttcgtttagttaaagctctacattcatctaagtgataaggtctcttaaggtggatacctacaagaccatcaatagttctctcagttgtttcttctaagtgaatcactcctactctatcaggtgtctgagttaataagtggtactctagttctctaaccactgaagacttacccatacctgtgcccgatgtaagcgttaccagctcccctagtctaaaccctttagtcatctggttaagacatatccaagggtaagctactgaagctgtctcaggtctctctaaccaagtatcctttagttgtgtagcacctataatgtcttgaggcatccagctcttagcgttccagaaacactctgtaatttccttaacaagaccagcttgtagcatatcactgatgtctttgtaaccctcagggtaggacataatcttaatcttctctggtgagaacatctcgatagctttatcaatagccttcttacctgcctcatccttatcaaaggctagtacgatataggtaaacgaatcaaggaagtcatagctttgttgtattgatttctcaacactggagctaccattcttaagggaacacaccgcccacttgccattgaatacctcagctaaggatagagcatctatctcaccttcagttactgtgatgtacttaccacctttatcccatagacactcaccgaatagaccagtatctttgaagctaccttctgtatggaacttcttagtaggaacatctcttactttataagctgtaactctacaagcttggtcagtgaaagggtagtaatgtgtgttaccatcttcagatactctaacttgatactgcttacaaatagcttcagagattctacgcttagggatagcaccccaagtccctttaataggtaactctacgctgtttgttatcttccttgtataagaagtagatacttgtgctgtagctttaccatcccagaagttacatccttctgtaaagcaatgcttatggtcatcatagaccgctacgttgtcctcacttccacacttgggacacgcctcatgcttaataaacttactcattttgaatcctcattctattgttttataattaagtgactgcttgctcacacggctgcagtcatcaccgtcttaattactttagcatcatggagtacgctaaagaagtagtgagcttactaagagattagaaagttgattcatcctcaaagaacccagcctcagccccatggtctccaccctcccccatctctaagactagcactcgtttaacataaggcacttcacctgctgttggatgcttcttagtaatgtactcaagtctcactttagtaccactcggtaactcttt

SEQ ID NO: 1492 - DNA, 4000 bp, Escherichia coli
  misc_feature (5)..(5): n is a, c, g, or t
  misc_feature (8)..(8): n is a, c, g, or t
  misc_feature (10)..(10): n is a, c, g, or t
  misc_feature (13)..(13): n is a, c, g, or t
  misc_feature (17)..(17): n is a, c, g, or t
  misc_feature (21)..(21): n is a, c, g, or t
  misc_feature (23)..(23): n is a, c, g, or t
  misc_feature (32)..(33): n is a, c, g, or t
  misc_feature (35)..(35): n is a, c, g, or t
  misc_feature (41)..(42): n is a, c, g, or t
  misc_feature (45)..(45): n is a, c, g, or t
  misc_feature (62)..(62): n is a, c, g, or t
  misc_feature (78)..(78): n is a, c, g, or t
  misc_feature (116)..(119): n is a, c, g, or t
  misc_feature (161)..(161): n is a, c, g, or t
  misc_feature (215)..(215): n is a, c, g, or t
  misc_feature (262)..(262): n is a, c, g, or t
  misc_feature (269)..(269): n is a, c, g, or t
  misc_feature (411)..(411): n is a, c, g, or t
  misc_feature (458)..(458): n is a, c, g, or t
  misc_feature (1271)..(1271): n is a, c, g, or t
  misc_feature (1823)..(1823): n is a, c, g, or t
  misc_feature (1968)..(1969): n is a, c, g, or t
  misc_feature (1971)..(1972): n is a, c, g, or t
  misc_feature (1974)..(1975): n is a, c, g, or t
  misc_feature (1978)..(1979): n is a, c, g, or t
  misc_feature (1981)..(1982): n is a, c, g, or t
  misc_feature (1984)..(1984): n is a, c, g, or t
  misc_feature (1986)..(1987): n is a, c, g, or t
  misc_feature (1989)..(1992): n is a, c, g, or t
  misc_feature (1995)..(1998): n is a, c, g, or t
  misc_feature (2001)..(2008): n is a, c, g, or t
  misc_feature (2010)..(2011): n is a, c, g, or t
  misc_feature (2013)..(2014): n is a, c, g, or t
  misc_feature (2017)..(2018): n is a, c, g, or t
  misc_feature (2021)..(2021): n is a, c, g, or t
  misc_feature (2818)..(2818): n is a, c, g, or t
  misc_feature (2986)..(2986): n is a, c, g, or t
  misc_feature (3517)..(3517): n is a, c, g, or t
  misc_feature (3521)..(3521): n is a, c, g, or t
  misc_feature (3781)..(3781): n is a, c, g, or t
  misc_feature (3790)..(3790): n is a, c, g, or t
ttgcnttnanagnatancatncnctttatggnntngatatnnttnctcctgaaaaggagggngtggtaaagacttttncttggaaagatattgaaacaacttcttttccaatgcannnnttacccaagtttgatgctatcatccatttggcaggcaaagcncatgatacaaagaatcagtctgcttctcaggtatattttgatatcaatacaggnctgacacagaagatatttgatttctttttagaatcatctgcgaagangtttatntttttcagttctgtgaaagctgccgcagacagtgtagtgggggatatgttgacagaagatgtgatacctactccggttggtccttatggagaaagtaagattgcggctgaagaatatattcttagtaaattgagaagcgagnatggagaattgaaagttgctatgcagcgcgataagcgagtgtatatnttgcgtccttgtatgatccacggtcctggtaataagggtaatctgaacttgctttataatgtggtaaagaaaggtatcccctggcctttaggcgattttgagaacaagcgttcttttacttctatagataatctttgctatgttgtggaaggtttgttgacaaaagacgtagcgagcggtatttatcacatgggtgatgacgaagctttgtctacgaatgaactgattgctcttatgtgtgaagctatgggtaaggagcctcacatctggaaaatgaacagaaaaatgatggaaggttgcgcaggcttgggtacgctgcttcatttgcctttgaatacagaacggctgagaaaactgactgagaattacgtggtaagtaatgagaagataaaatcagctcttggcattgaccggatgcctgtccgtgcggcggatggaataatgaaaacaatacggagtttctaacctatttataaattgtaaatcgtgtattatatcattatattagttctgctctttgtagcagaacttttttattttagagtagctgataagtttaatatcattgataagcccaatgagcgtagttctcattcacggataactttgcgtggtggcggtataatcttctattttggagctttagcctatttcctgagtaatcattgggagtatccatggtttatgttggcattgactctgatcacttttatcagttttgtagatgatgtccgttctacttcccaaggtctgaggttggtgtttcactttactgctatggctctaatgttttaccaatggggcttgttttcnctttcctggtggtggatcattatagctttgattatttgtacgggtatcatcaatgcttataattttatggatggcatcaatggcatcacaggtggttattcattggttatccttggtgcattagcttatatcaattctgagatcactacgtttgttgaaccggctttgattaataccgttctttgcgcagtcctggtcttttgtttcttcaatttccgtaagaaggcgaagtgttttgcgggtgatgtcggttctgtgagtatcgcttttattcttctttttctgatagggaagctcatcattaaaacagaagatttcagttggataattctgttatccgtttatggtgtcgatagtgttctgactatcattcatcgcctgatgcttcatgagaacatcggtttgccccaccgaaaacacatgtatcaattgatggcaaacgagttgaaaatacctcatgttggggtatcattaatttatatgggggcacaggctttggtcatattaggttatttctgtttcgtgagatatggttattggtatttgttgggnataattgtattgttgagtggcatttatgtgttgtttatgagaaggtattttcatttgcatattcaaaagggaaaataaaaatgagtctccggctttaggaaacaatgcgatgaatatctaaataaaaatatcctgttttttttannannannggnngnnangnngnnnnttnnnnaannnnnnnntnncnnccnnttntttttttatagtttaaaattctacaactttttttctatccttataactttattgtatatttgccgaaacaattctatattcactgaatgggcttatttaggaaaataatatatagtttttttcttttcttactgatatccatttgggggctttcatcagcctttgcggtgactggagaacacccagtactgattatcagttcgtataatccggatgctcgtcagacttccggaaatatatacgatttcatggaagagtttgagcgtctgggtggaaaagctccgatagctttggaaaacatgaactgcaaaagcttctccgagtcgccacagtggaaatcgaaaatggcggagatactggataagtatgagggaaagcgcgcgcctgtattacttgttttaattggtcaggaggcatgggctgcctatctgtcgcaagcagattctatacgtggaaagttcccggtactgacttcgttggcaagccgcaatgccattattcttccggatgattctgtaaatctgaaaacatggatgcctggtgcagtggatttctttaatgactttactgattcttcagtcaaagccggttttgtttatgaatatgatgtggaagccaatatcaatctgataaaacacttatatccgaatactaagaatatagcttttgtttctgataacagttatgggggcgtttccttgcaagcccatgtagtagcggagatgaagaaacatccggagttaaatctgattctactggatggacgtaccaatacgatttataccatcagtgataancttcatgaattgcccccgaatacagctttgttgatgggtacctggcgtgtggatatgtacgacggatattttatgcgtaatgcaacttataccatgatggaagctgcgggtgatgtacctacattttccattagttctgtcggtatcggttattgggctataggtggngtgacaccctcttatcggccattgggcaaggatatggcgtatcaggcagtccgtctgctgcaaggagctgacagtgatcgtatagaagtagaagtcatccctaataaagtgatgatggatagtaagattgtgaaggaaaagcgtctggatctgtcttttattcatcagccgatagaaatggtgaatgaaaatccatcgttctacgaacaatataaatatcatatctggactgttgcaaccattttagtcgtgttatctgcggggttgtttgtttcattgtacttctattaccataccaaaaagctgaaagatgaactgcaagagtcggagagtgctttgagagatgcgaaagatcgtgcagaagagtccagccgtctgaagagtgccttcctcgcaaatatgagtcatgaaatccgtactccgctgaatgcaattgtgggattctcggatgtgttggcttccgggggaagttcggaagatgaacagcaggggtatgttgatatcatcaaaaccaattctgatttgctgctncgcntgataaatgatattctggatgtttcccgtctggaggcggaccgggttacgtttacatttgaggaatgtgatgtagtgccgttgtgccaacgcgttttggcttccgtcagtcaggctcgcaagtcagaaaatgaatttatctttgagtgtgaccgtgaaagcatggatatgcgcactgacactcagcgtctgcaacaggttatcataaatctgctttccaatgccgataagtttacccggaatggtaagattactttgggnctgaaagtngatgagaagcagagagaagtcctgttttctgtctcggataccggtacaggtattcctttggagaaacagaagcttgtatttgagcgatttgaaaaactgaacgagtacgtacagggcacaggattgggactttccatctgtaagttgaccgtagagaagtggggaggagagatctgggtggatccgggatatacggatggggcaagattt

SEQ ID NO: 1493 - DNA, 4000 bp, Escherichia coli
  misc_feature (1985)..(1985): n is a, c, g, or t
  misc_feature (2952)..(2952): n is a, c, g, or t
cggcccggagtcacgcagaagacctgcgcagcctgcttaagctcccgagccacagatgccgctcaggatcatttgcccatcactggaggcggaaccgctggcaaggtgaagcgaaatgcagcgcctttgcccggagccgtctcgagtcgcacctcaccgccgtgggcctggatgatgtgcttgacgatactcaagccaagacccgtgcctccctgctcccgcgaccgggctgtatccacgcgatagaaccgttcgaaaacccgctcagcagcctcggtcggaatacccggaccgtcatcggccacggccagctcgaccaagtctccgcccggaaggtcgcgcccctcgatgcgcaccctgccaccggggcgaccgtatttgatggcgttgtcgatgaggttcgacagcacctgatccaggcgatcggagtcggcacgcgcatgcaacccagcgggcacatcgttgatgagctggacgccgcggtcctccgccttgcggtggaaatcgtcgaacacctccgtcacatgtccgcgcaatggcaccgtgtcgtaattgatggccaactgaccggactccaatcgggacaaagtcaggagatcctcaatcaggtaggtcaaccggtcgcaatgacgatcgatgatgtcgaggaacttggaagcgatcgccggttgcgacgccgcaccatccaacaaggtctccaccgaacctttgatgagcgagagcggggtgcgcaactcatggctgacattggccacgaattcacgccgggttcgctccaactgacggaggcgcgtcgcatcgtgcaacaccatcagcacgccatcggtccgcccctcgggcccgatcaaagcgacggcattgacctgaagcaaccgggcttctgatccaccttccaactccaattccttgccgttgacccgccccgccttggccgcctcggcagccaccgccgaaagatcgttgcagcggaaggcctcgaggagcgtacgaccccgaacatcagcctcgagatcaaaaaatcgccggcacgcggtgttggtgaactgcacccttccggaagcgtccaacaacagcactccttcgagcatgttctcgaagagcgcctgttgccgggcgttctcggccgcctgggattcagcccggctggagcgctcgcgagcgagttgatcacgcagggctgttgcctctttggtcactcggaggcatcgcccccgcatgaacaaggtaacgaccaatccagagattccagcacccagaaccgccgccagtaatggagaaatcgacatgctcgggactcaggcctccatgaagcggtagccgactccgcgcacggtgtccaagtactgggccccggctcccaatttttcacgcaggcgccgcatgtgggtatcgacggtccgggtgtcgatgaggttgtcgtattcccagacatcgcgcagcaacgcctcccggctctgaacacggccacgtcgctgagccaacacgatcaagagcttgaactcggtggccgtcagatcgacccgttgacccgcaacactgaccaaatggcggggaatatcgatgaggagatcgccaaactgcatcgtctgcggcttttcctcctccgtctcgctgcgacgcttgagcaaattgcggatgcgcaagatcaattcgcgcgggctgaaaggcttggtgacgtagtcgtcggcgcccaactccaagcccaccacgcggtcgatctccgcggccttggcagtcaccatgatgatgggaatgccgctggtggccgggtctcgccgcaacagcttgcacacttccaagccatccacctcgggcagcatgaggtccaggaggatcaggtcgggcaactgttgacgcgcctttttcagcgcagcgtcgccgtcatccgccgtcgtcacctcgtatccggcgttcttcaaattgaagcccagaacctccagcgcatcgggttcgtcgtcgacgacgagtatctttgccataactcncactggttctagcatcaatgccatggtcgctccgtgtcggtcaggttacaagtccgtgacttgacccgatttcagcgacgtctgtgatcccattcaacactgagatatttgtacgggtgaacccctgcaaacccactggctaggggaggtgcttgacctacacagggtgtcgaccaaggtgcaacccatgtgtggccggtacagtttgacgcgggaatccatggaggtggaagtcgggacccaacgcgtctcacgccgtggaaaaccccgttacaatatcgcgcccacccagcgcgccccggtgatccgccggaaggccgctggtttggcggtggacgacttgcgctggggactcgttcccgagtggtcccgcgatgaggccatcggtttttcactcatcaacgcccgttccgaaaccttggccgacaaacccgccttccggaccgccttccgaagtcggcggtgtctcattgtggccgatgggttttacgaatggcaggtcctcggccggtccaagcaaccctggagattcagacgaaccgaccccgacttcctgctgttcgccgggctgtgggaatcctggtcatcgcccactgaagctgccccactcgaatccttcaccgtcatcaccacggtcccgaactccgtggttgcacccatccacgaccggatgccggcatgcctcgaccgggaagccgcggcgctctggctggaaccgtcgtccccagtggaactcctgcaaaccctcctcaggccgagcccggaggctgactggtcggcctaccgggtgaaccccatcgtgggccaggcccgcatcgacgacccacgatgcatcgaagcgttcgctgaacaaccgagcctgttctgattctggccccaggcgaagagaggcgcaggccgggttccagctcagtcgaaaatcgggaagaaggtgttgaaggccttctcgcagaaataccccgggtcnttgaagcggcgatggcggtcgagtgcatcgatggcctgcatttgcccatcgctcagcgaaaagtcgaagacctgggcattatcgcgcaaatgattgaaatcctgcgccttcggaatgacggcgcatccgcgctggactccccatcgcagcaccacttgggccggagtgcgccccagagccgcggcgatgccggccaccacgggatccaccagcaccgactcctccggtcgggccatccccaagggcagataagacggcgcgcccagcggcgagaacgccgtcacggcgattccctccgactggcagaagcgcacctgacgttcctggatcaggtacggatgcgcttcgaactgatgcaccgccggccggatggaggccgtgttcagcacttcccgcagcatcgagacgttcaggttgcacacgccgatccgcttcaccaggccggcccgctgcaattcttccatcgcaccccaggtgtcggcatagggcacggcgatggggttcatggccggcttttcggccgccggatcgaagaaccactctggcggatagcgcacgtcgaagggcacgtaagccagagcgatggggaaatgcaccaggtacaaatccagaacatccaagcgcaggtcccgcagcgaccgctcgcaggcggcacgaacgtgcttcggttcgtggtaggtgttccacagtttggaggtgacccagaggtcgtcccggcggcaaaggccttgctggacaaccgaagccaaccccgcgcccacctcggcctcattgccatagtcgcaggcgcaatcaaaatgccggtacccgagccggaccgcctcgcggatcaccgccggtgcctgcggcttgggcagtttccaagtacccaggccgagcgtcggaaaacccaggtcggtgaaggagcgaaggtccggactgagtcgcgattggggcaagcgctgcgtcatcttgggaaccatttgggttcacccgacggaaatccagcccctgctcacgatccttcggacgccgatgccgatcgtcagaactccgcccacgttcgaag

SEQ ID NO: 1494 - DNA, 4000 bp, Escherichia coli
agggttagaaccgagactgtggtgtcgatcttggatagctgaaaatcgtcccaatcctgagtgtaataagcagcgtttagacgtaaccgaccgtctacgaagttacccttcatacccagttcgtagctggtcaggatgtctgcctggtaggcacctgctacggccgtaacgctgagacgattcaacccgccaggtcggtagccttccgagaaggtaccgtagaccaagaggtcgttgttgacggcataggagacgttaaacttgtggacgtctttagattcgtcaatggttaaatcattgttgaattcggaatctcccctcggtccgtaacggctgggccaccagatagtgcccgagaagccaaccaaagaggactcatagttaaaatagcgagtgctataggagaccgataaatcttccgtaaggtcataagcgatctcgccaaagtaagcagtctctttgttgccacggatctggttcgtcgtccaatagatatcgggtggctcaacatacccaggggtgaatgccccggtagtctccggcgtgatcgttgcaagacctagcacgtgccaatctaggtcgaaatcgtgtgtagcttcctcataaaatgcgccaacgatccaacgaaaacgttgatcttgagctgagaccaatcgaacttcatgattttcccgcgcccactcttgatcacctgtgtaaagcaaggttgggtcagcgcagatgccgaagtacgagacataacaagcgtagtagccaacgacgtagcctggtgaaccgttgctgggatcagaatacaaggagtagtctgcgttttgatatgactcacgatcgaggtccgagtaggcataggtcaacgacatatcattgattttgccctctaccaccagggcgctttgggtccattcatcatcattggtgtcaggttgaaatcgcacaaccgataaatcgccaacgtctgtcgggtcatggtcccaaacgcctttcgcttcaagctcttggcgcatgacgctcgcggtaaccgtccagttttcatttaaatcgactcgaagcgcgacgcgcccaccggtcgtttcggcggtattaaagtcttcttgaacatagtctgcattgtcgatggtttgatcggcggccatctcaacaagcgctgggtcgtcagcaacgcttgctcgaatgccggataagtcaaaagtatgggtccccggcacgttatcgatgtaacccgcttcgtctttgcgatagccgacaattcgaatagcggccttgtcgcccagaggaatattcacaaagccctcgatgagattaccggtatcgccctcattgaccgaattaaattcaacatcgtagccagctgaaaatgcgccaggtgtcggtttgttggtgataaatcggatgctgcccgcctgtgaattggccccatataacgtgccttgaggtccagcgagagtctcaattctggcgacatcgtaaatgtgggggttcagaaaagagcctacggccgtcaccggttgctcgtccatatagaccgcaacgttaggggttgcaccaagaaggctttcgccaccgcttgagatgccgcgcatgtagacgttgccagtgcccgggcctagcgtgacgtagttcagtgaggcgatcaaatgagcaaagtcctcgaggtcaccaacaccgttattctcgagttcgccctcactaagtacatcgatactaatgggaatatcttggacgctttcgttgcgccgggtggctgaaacaatgatctcctcgagctcatactgctcttcggcgagcgcaatgtggcctgcacctgaggacagcgccacggctagtgccagaggctttatcataaaatttggtttattggttgcctgtttggtcatcaaaatccccttagatttagccattattgggcggtttttgggaagtaattcccactcatgaagaccatgacggcaagtcattaacttgtgtcagatcttaaaatagagcgaattgatttttacacgcttctccgagacatacaaatcgggtggttaacggcctgattagctgcctacaggcttgactcatgcaaagtgatccagggcgctagaatttctctcattggttcgaggtgggattcatagttgcgccattgctctagcgcgccactatagagcggttgtctgacttgctcagagctggcagtacgaatcgcgcgatcagtctgatgaaattcaaggcaagcggcttcaaagggaagtccgcaataatccaaaatgcctctgacctcctgttctaggttttcgatcactgactcatagttaaccctcagcaccttaccgggaagcacattgtcccagtgcaacattaggcgggcgtagtccgcgtaatatcgagcgatatcagtttgactgtaggtaaaagtttggccagcggcaaacagttgcttgtatccactaaagcaggtcgccattgggtgtcttcgggcatcgataatttttgcattggggaggatcttgctaataagcgcaacatgttggaaattgttgggcattttatcgatgaaatacggcgcctcctgacgttggattcgggtgcgttccaaatattcagcccctaacgatcgacacgtctcggcggacaaatcaaacaaaatttcagggtacagcgacgcgtcatcgcgattgcgcttgccgcctaatctacgcgcgatcgcaatcatttcccgcagttcagaggtgccatcgacgagcgagtgactggctagaatttgttcaagtaaggttgagccggcgcgaggaagcccaacgataaaaatgggatctggcgcgggatcgcctgattctggctggcgcgctagacgcgcttttgagcaatgtgtaattagggcagtcgtttcggcctcggtgtcatcggcctgatagccctctagcggctgtttgcggttattaccaagctcatagtagcgaaaggattcgtcaaattgtttgtcgtcctcaagggccttccccaacgcaaagcacaagtgatagtaatccctgggtgcactctggtcagtatcgataagctgacgcatggcactgacatctgctgtctcaaaacggaacgtcttaagatttgccaagttccaataggtttcgcccaggctgggtttgacggtcatagcctgacggtaagcagcgatggcgtcttgttgtttacctagggtcttgagggcatgaccgtgactattgtgtagctgtgcatataacggaaagcgattggtaagatcggtatatcgagcaacagctgcctcgtaatttccgaccatgacctcgatggatgctgccaaaatactatgggaaaaattctgcgggtcaacacgctctaaataactgatttgttgcagggcttgttcatatttatgagcttgaccaagggcattggcataagtgtttcgggcgagatgaaaatcgggcgcgatctttaggcagtcttcaaggagcaactccgggtcctccttgatgccgagcttgatgccaatctcagcgagtagcctgattaccgtgacatcctcaggatgacgctttagatagtccctgcaaataccttcggccatgccaagtctttcctgctgcactaggtcgatggcctttacgatcgctgggtgagtgtggctgtgcgcgagcgcctgtcgaatggcatgctctgcctcctgagcctcgccctcgctatgaagcgattcaccgagtaatcgccaactgaccgcaagcgtggggtctatggataacgcgtctctgagtgccgtaatagcatcgtcgatctgaccaaggccgtgaagcgcctggcctaattcttggtggataatcgcaaccccttgagtgccagcggcaagccttcgtaacgctaatacagcttcctcgagtcggcctaagcggcgcagtgctgctgctcgtaaatagtgagttttagcgtcttttggatgaacgtccaaaatcgcttccgcttgcgcatgggcgagctcaaactggccggtctgcagcag

SEQ ID NO: 1495 - DNA, 4000 bp, Escherichia coli
  misc_feature (2)..(2): n is a, c, g, or t
  misc_feature (4)..(4): n is a, c, g, or t
  misc_feature (8)..(8): n is a, c, g, or t
  misc_feature (10)..(10): n is a, c, g, or t
  misc_feature (13)..(14): n is a, c, g, or t
  misc_feature (17)..(21): n is a, c, g, or t
  misc_feature (23)..(27): n is a, c, g, or t
  misc_feature (29)..(29): n is a, c, g, or t
  misc_feature (31)..(32): n is a, c, g, or t
  misc_feature (34)..(36): n is a, c, g, or t
  misc_feature (38)..(40): n is a, c, g, or t
  misc_feature (42)..(44): n is a, c, g, or t
  misc_feature (46)..(49): n is a, c, g, or t
  misc_feature (52)..(53): n is a, c, g, or t
  misc_feature (55)..(58): n is a, c, g, or t
  misc_feature (61)..(61): n is a, c, g, or t
  misc_feature (64)..(72): n is a, c, g, or t
  misc_feature (74)..(77): n is a, c, g, or t
  misc_feature (84)..(87): n is a, c, g, or t
  misc_feature (89)..(89): n is a, c, g, or t
  misc_feature (91)..(91): n is a, c, g, or t
  misc_feature (93)..(93): n is a, c, g, or t
  misc_feature (96)..(98): n is a, c, g, or t
  misc_feature (100)..(101): n is a, c, g, or t
  misc_feature (103)..(103): n is a, c, g, or t
  misc_feature (105)..(110): n is a, c, g, or t
  misc_feature (112)..(113): n is a, c, g, or t
  misc_feature (115)..(117): n is a, c, g, or t
  misc_feature (119)..(119): n is a, c, g, or t
  misc_feature (121)..(121): n is a, c, g, or t
  misc_feature (124)..(128): n is a, c, g, or t
  misc_feature (130)..(133): n is a, c, g, or t
  misc_feature (142)..(142): n is a, c, g, or t
  misc_feature (144)..(144): n is a, c, g, or t
  misc_feature (146)..(146): n is a, c, g, or t
  misc_feature (148)..(151): n is a, c, g, or t
  misc_feature (153)..(158): n is a, c, g, or t
  misc_feature (160)..(161): n is a, c, g, or t
  misc_feature (167)..(168): n is a, c, g, or t
  misc_feature (170)..(170): n is a, c, g, or t
  misc_feature (172)..(172): n is a, c, g, or t
  misc_feature (175)..(175): n is a, c, g, or t
  misc_feature (178)..(180): n is a, c, g, or t
  misc_feature (182)..(183): n is a, c, g, or t
  misc_feature (186)..(186): n is a, c, g, or t
  misc_feature (188)..(195): n is a, c, g, or t
  misc_feature (197)..(197): n is a, c, g, or t
  misc_feature (202)..(204): n is a, c, g, or t
  misc_feature (206)..(207): n is a, c, g, or t
  misc_feature (209)..(209): n is a, c, g, or t
  misc_feature (212)..(212): n is a, c, g, or t
  misc_feature (219)..(219): n is a, c, g, or t
  misc_feature (222)..(223): n is a, c, g, or t
  misc_feature (225)..(225): n is a, c, g, or t
  misc_feature (227)..(227): n is a, c, g, or t
  misc_feature (231)..(232): n is a, c, g, or t
  misc_feature (235)..(235): n is a, c, g, or t
  misc_feature (239)..(241): n is a, c, g, or t
  misc_feature (243)..(253): n is a, c, g, or t
  misc_feature (255)..(258): n is a, c, g, or t
  misc_feature (260)..(264): n is a, c, g, or t
  misc_feature (267)..(269): n is a, c, g, or t
  misc_feature (271)..(272): n is a, c, g, or t
  misc_feature (274)..(275): n is a, c, g, or t
  misc_feature (279)..(280): n is a, c, g, or t
  misc_feature (282)..(282): n is a, c, g, or t
  misc_feature (284)..(284): n is a, c, g, or t
  misc_feature (286)..(286): n is a, c, g, or t
  misc_feature (288)..(288): n is a, c, g, or t
  misc_feature (291)..(294): n is a, c, g, or t
  misc_feature (297)..(297): n is a, c, g, or t
  misc_feature (302)..(306): n is a, c, g, or t
  misc_feature (308)..(310): n is a, c, g, or t
  misc_feature (312)..(315): n is a, c, g, or t
  misc_feature (317)..(317): n is a, c, g, or t
  misc_feature (320)..(323): n is a, c, g, or t
  misc_feature (325)..(325): n is a, c, g, or t
  misc_feature (333)..(333): n is a, c, g, or t
  misc_feature (336)..(338): n is a, c, g, or t
  misc_feature (340)..(340): n is a, c, g, or t
  misc_feature (342)..(345): n is a, c, g, or t
  misc_feature (347)..(347): n is a, c, g, or t
  misc_feature (349)..(350): n is a, c, g, or t
  misc_feature (352)..(353): n is a, c, g, or t
  misc_feature (355)..(355): n is a, c, g, or t
  misc_feature (357)..(357): n is a, c, g, or t
  misc_feature (359)..(362): n is a, c, g, or t
  misc_feature (364)..(366): n is a, c, g, or t
  misc_feature (370)..(375): n is a, c, g, or t
  misc_feature (377)..(377): n is a, c, g, or t
  misc_feature (380)..(381): n is a, c, g, or t
  misc_feature (383)..(383): n is a, c, g, or t
  misc_feature (385)..(386): n is a, c, g, or t
  misc_feature (1991)..(1991): n is a, c, g, or t
  misc_feature (2392)..(2395): n is a, c, g, or t
  misc_feature (2397)..(2399): n is a, c, g, or t
  misc_feature (2401)..(2401): n is a, c, g, or t
  misc_feature (2404)..(2404): n is a, c, g, or t
  misc_feature (2406)..(2408): n is a, c, g, or t
  misc_feature (2412)..(2413): n is a, c, g, or t
  misc_feature (2415)..(2415): n is a, c, g, or t
  misc_feature (2417)..(2418): n is a, c, g, or t
  misc_feature (2422)..(2423): n is a, c, g, or t
  misc_feature (2430)..(2432): n is a, c, g, or t
  misc_feature (2434)..(2435): n is a, c, g, or t
  misc_feature (2439)..(2440): n is a, c, g, or t
  misc_feature (2443)..(2443): n is a, c, g, or t
  misc_feature (2446)..(2446): n is a, c, g, or t
  misc_feature (2448)..(2448): n is a, c, g, or t
  misc_feature (2450)..(2450): n is a, c, g, or t
  misc_feature (2452)..(2452): n is a, c, g, or t
  misc_feature (2454)..(2454): n is a, c, g, or t
  misc_feature (2457)..(2466): n is a, c, g, or t
  misc_feature (2469)..(2472): n is a, c, g, or t
  misc_feature (2474)..(2474): n is a, c, g, or t
  misc_feature (2476)..(2478): n is a, c, g, or t
  misc_feature (2483)..(2483): n is a, c, g, or t
  misc_feature (2486)..(2489): n is a, c, g, or t
  misc_feature (2491)..(2494): n is a, c, g, or t
  misc_feature (2498)..(2498): n is a, c, g, or t
  misc_feature (2501)..(2502): n is a, c, g, or t
  misc_feature (2504)..(2513): n is a, c, g, or t
  misc_feature (2515)..(2527): n is a, c, g, or t
  misc_feature (2530)..(2538): n is a, c, g, or t
  misc_feature (2541)..(2543): n is a, c, g, or t
  misc_feature (2545)..(2555): n is a, c, g, or t
  misc_feature (2557)..(2562): n is a, c, g, or t
  misc_feature (2564)..(2570): n is a, c, g, or t
  misc_feature (2572)..(2575): n is a, c, g, or t
  misc_feature (2577)..(2579): n is a, c, g, or t
  misc_feature (2581)..(2581): n is a, c, g, or t
  misc_feature (2583)..(2593): n is a, c, g, or t
  misc_feature (2595)..(2595): n is a, c, g, or t
  misc_feature (2598)..(2608): n is a, c, g, or t
  misc_feature (2610)..(2613): n is a, c, g, or t
  misc_feature (2615)..(2617): n is a, c, g, or t
  misc_feature (2619)..(2620): n is a, c, g, or t
  misc_feature (2624)..(2624): n is a, c, g, or t
  misc_feature (2627)..(2630): n is a, c, g, or t
  misc_feature (2632)..(2637): n is a, c, g, or t
  misc_feature (2639)..(2639): n is a, c, g, or t
  misc_feature (2642)..(2642): n is a, c, g, or t
  misc_feature (2645)..(2645): n is a, c, g, or t
  misc_feature (2647)..(2647): n is a, c, g, or t
  misc_feature (2650)..(2652): n is a, c, g, or t
  misc_feature (2654)..(2658): n is a, c, g, or t
  misc_feature (2660)..(2663): n is a, c, g, or t
  misc_feature (2665)..(2665): n is a, c, g, or t
  misc_feature (2667)..(2667): n is a, c, g, or t
  misc_feature (2670)..(2670): n is a, c, g, or t
  misc_feature (2675)..(2699): n is a, c, g, or t
  misc_feature (2701)..(2701): n is a, c, g, or t
  misc_feature (2703)..(2706): n is a, c, g, or t
  misc_feature (2708)..(2708): n is a, c, g, or t
  misc_feature (2710)..(2711): n is a, c, g, or t
  misc_feature (2713)..(2714): n is a, c, g, or t
  misc_feature (2716)..(2724): n is a, c, g, or t
  misc_feature (2726)..(2731): n is a, c, g, or t
  misc_feature (2733)..(2734): n is a, c, g, or t
  misc_feature (2736)..(2737): n is a, c, g, or t
  misc_feature (2740)..(2743): n is a, c, g, or t
  misc_feature (2745)..(2747): n is a, c, g, or t
  misc_feature (2749)..(2752): n is a, c, g, or t
  misc_feature (2755)..(2755): n is a, c, g, or t
  misc_feature (2758)..(2758): n is a, c, g, or t
  misc_feature (2760)..(2763): n is a, c, g, or t
  misc_feature (2765)..(2765): n is a, c, g, or t
  misc_feature (2767)..(2773): n is a, c, g, or t
  misc_feature (2776)..(2776): n is a, c, g, or t
  misc_feature (2779)..(2783): n is a, c, g, or t
  misc_feature (2785)..(2785): n is a, c, g, or t
  misc_feature (2787)..(2789): n is a, c, g, or t
  misc_feature (2791)..(2804): n is a, c, g, or t
  misc_feature (2806)..(2806): n is a, c, g, or t
  misc_feature (2808)..(2808): n is a, c, g, or t
  misc_feature (2810)..(2812): n is a, c, g, or t
  misc_feature (2814)..(2816): n is a, c, g, or t
  misc_feature (2819)..(2819): n is a, c, g, or t
  misc_feature (2822)..(2826): n is a, c, g, or t
  misc_feature (2828)..(2834): n is a, c, g, or t
  misc_feature (2836)..(2837): n is a, c, g, or t
  misc_feature (2839)..(2839): n is a, c, g, or t
  misc_feature (2841)..(2844): n is a, c, g, or t
  misc_feature (2847)..(2851): n is a, c, g, or t
  misc_feature (2855)..(2858): n is a, c, g, or t
  misc_feature (2860)..(2860): n is a, c, g, or t
  misc_feature (2862)..(2867): n is a, c, g, or t
  misc_feature (2869)..(2869): n is a, c, g, or t
  misc_feature (2872)..(2875): n is a, c, g, or t
  misc_feature (2877)..(2891): n is a, c, g, or t
  misc_feature (2894)..(2894): n is a, c, g, or t
  misc_feature (2898)..(2898): n is a, c, g, or t
  misc_feature (2901)..(2901): n is a, c, g, or t
  misc_feature (2903)..(2905): n is a, c, g, or t
  misc_feature (2907)..(2917): n is a, c, g, or t
  misc_feature (2919)..(2920): n is a, c, g, or t
  misc_feature (2922)..(2927): n is a, c, g, or t
  misc_feature (2929)..(2932): n is a, c, g, or t
  misc_feature (2934)..(2934): n is a, c, g, or t
  misc_feature (2936)..(2936): n is a, c, g, or t
  misc_feature (2938)..(2940): n is a, c, g, or t
  misc_feature (2944)..(2952): n is a, c, g, or t
  misc_feature (2955)..(2955): n is a, c, g, or t
  misc_feature (2957)..(2959): n is a, c, g, or t
  misc_feature (2961)..(2972): n is a, c, g, or t
  misc_feature (2976)..(2977): n is a, c, g, or t
  misc_feature (2980)..(2983): n is a, c, g, or t
  misc_feature (2985)..(2987): n is a, c, g, or t
  misc_feature (2989)..(2991): n is a, c, g, or t
  misc_feature (2993)..(2996): n is a, c, g, or t
  misc_feature (2998)..(3004): n is a, c, g, or t
  misc_feature (3007)..(3007): n is a, c, g, or t
  misc_feature (3009)..(3010): n is a, c, g, or t
  misc_feature (3013)..(3020): n is a, c, g, or t
  misc_feature (3022)..(3028): n is a, c, g, or t
  misc_feature (3030)..(3033): n is a, c, g, or t
  misc_feature (3035)..(3036): n is a, c, g, or t
  misc_feature (3038)..(3043): n is a, c, g, or t
  misc_feature (3045)..(3045): n is a, c, g, or t
  misc_feature (3047)..(3047): n is a, c, g, or t
  misc_feature (3049)..(3056): n is a, c, g, or t
  misc_feature (3058)..(3063): n is a, c, g, or t
  misc_feature (3067)..(3069): n is a, c, g, or t
  misc_feature (3071)..(3072): n is a, c, g, or t
  misc_feature (3074)..(3074): n is a, c, g, or t
  misc_feature (3076)..(3079): n is a, c, g, or t
  misc_feature (3082)..(3103): n is a, c, g, or t
  misc_feature (3105)..(3107): n is a, c, g, or t
  misc_feature (3109)..(3111): n is a, c, g, or t
  misc_feature (3113)..(3114): n is a, c, g, or t
  misc_feature (3116)..(3123): n is a, c, g, or t
  misc_feature (3125)..(3134): n is a, c, g, or t
  misc_feature (3136)..(3142): n is a, c, g, or t
  misc_feature (3144)..(3145): n is a, c, g, or t
  misc_feature (3147)..(3148): n is a, c, g, or t
  misc_feature (3151)..(3154): n is a, c, g, or t
  misc_feature (3157)..(3158): n is a, c, g, or t
  misc_feature (3160)..(3160): n is a, c, g, or t
  misc_feature (3162)..(3162): n is a, c, g, or t
  misc_feature (3166)..(3168): n is a, c, g, or t
  misc_feature (3170)..(3172): n is a, c, g, or t
  misc_feature (3174)..(3176): n is a, c, g, or t
  misc_feature (3178)..(3178): n is a, c, g, or t
  misc_feature (3180)..(3195): n is a, c, g, or t
  misc_feature (3197)..(3200): n is a, c, g, or t
  misc_feature (3202)..(3209): n is a, c, g, or t
  misc_feature (3212)..(3215): n is a, c, g, or t
  misc_feature (3217)..(3222): n is a, c, g, or t
  misc_feature (3224)..(3229): n is a, c, g, or t
  misc_feature (3231)..(3235): n is a, c, g, or t
  misc_feature (3237)..(3237): n is a, c, g, or t
  misc_feature (3239)..(3243): n is a, c, g, or t
  misc_feature (3245)..(3247): n is a, c, g, or t
  misc_feature (3249)..(3251): n is a, c, g, or t
  misc_feature (3253)..(3259): n is a, c, g, or t
  misc_feature (3262)..(3262): n is a, c, g, or t
  misc_feature (3264)..(3266): n is a, c, g, or t
  misc_feature (3268)..(3273): n is a, c, g, or t
  misc_feature (3276)..(3287): n is a, c, g, or t
  misc_feature (3289)..(3289): n is a, c, g, or t
  misc_feature (3291)..(3291): n is a, c, g, or t
  misc_feature (3293)..(3299): n is a, c, g, or t
  misc_feature (3301)..(3301): n is a, c, g, or t
  misc_feature (3303)..(3304): n is a, c, g, or t
  misc_feature (3306)..(3306): n is a, c, g, or t
  misc_feature (3308)..(3311): n is a, c, g, or t
  misc_feature (3313)..(3313): n is a, c, g, or t
  misc_feature (3318)..(3321): n is a, c, g, or t
  misc_feature (3323)..(3327): n is a, c, g, or t
  misc_feature (3330)..(3330): n is a, c, g, or t
  misc_feature (3333)..(3334): n is a, c, g, or t
  misc_feature (3336)..(3339): n is a, c, g, or t
  misc_feature (3341)..(3341): n is a, c, g, or t
  misc_feature (3343)..(3347): n is a, c, g, or t
  misc_feature (3349)..(3359): n is a, c, g, or t
  misc_feature (3361)..(3362): n is a, c, g, or t
  misc_feature (3364)..(3366): n is a, c, g, or t
  misc_feature (3370)..(3370): n is a, c, g, or t
  misc_feature (3372)..(3373): n is a, c, g, or t
  misc_feature (3375)..(3377): n is a, c, g, or t
  misc_feature (3379)..(3391): n is a, c, g, or t
  misc_feature (3393)..(3395): n is a, c, g, or t
  misc_feature (3398)..(3399): n is a, c, g, or t
  misc_feature (3401)..(3402): n is a, c, g, or t
  misc_feature (3404)..(3405): n is a, c, g, or t
  misc_feature (3408)..(3415): n is a, c, g, or t
  misc_feature (3417)..(3426): n is a, c, g, or t
  misc_feature (3428)..(3429): n is a, c, g, or t
  misc_feature (3432)..(3438): n is a, c, g, or t
  misc_feature (3440)..(3441): n is a, c, g, or t
  misc_feature (3443)..(3443): n is a, c, g, or t
  misc_feature (3445)..(3457): n is a, c, g, or t
  misc_feature (3459)..(3461): n is a, c, g, or t
  misc_feature (3463)..(3463): n is a, c, g, or t
  misc_feature (3465)..(3470): n is a, c, g, or t
  misc_feature (3473)..(3474): n is a, c, g, or t
  misc_feature (3477)..(3480): n is a, c, g, or t
  misc_feature (3482)..(3485): n is a, c, g, or t
  misc_feature (3487)..(3489): n is a, c, g, or t
  misc_feature (3492)..(3495): n is a, c, g, or t
  misc_feature (3497)..(3499): n is a, c, g, or t
  misc_feature (3501)..(3504): n is a, c, g, or t
  misc_feature (3506)..(3507): n is a, c, g, or t
  misc_feature (3510)..(3512): n is a, c, g, or t
  misc_feature (3514)..(3517): n is a, c, g, or t
  misc_feature (3519)..(3526): n is a, c, g, or t
  misc_feature (3528)..(3547): n is a, c, g, or t
  misc_feature (3551)..(3553): n is a, c, g, or t
  misc_feature (3556)..(3556): n is a, c, g, or t
  misc_feature (3558)..(3558): n is a, c, g, or t
  misc_feature (3560)..(3561): n is a, c, g, or t
  misc_feature (3564)..(3568): n is a, c, g, or t
  misc_feature (3571)..(3577): n is a, c, g, or t
  misc_feature (3579)..(3583): n is a, c, g, or t
  misc_feature (3585)..(3585): n is a, c, g, or t
  misc_feature (3587)..(3587): n is a, c, g, or t
  misc_feature (3589)..(3589): n is a, c, g, or t
  misc_feature (3591)..(3595): n is a, c, g, or t
  misc_feature (3597)..(3605): n is a, c, g, or t
  misc_feature (3607)..(3616): n is a, c, g, or t
  misc_feature (3618)..(3626): n is a, c, g, or t
  misc_feature (3628)..(3630): n is a, c, g, or t
  misc_feature (3633)..(3635): n is a, c, g, or t
  misc_feature (3638)..(3641): n is a, c, g, or t
  misc_feature (3643)..(3643): n is a, c, g, or t
  misc_feature (3645)..(3645): n is a, c, g, or t
  misc_feature (3648)..(3648): n is a, c, g, or t
  misc_feature (3651)..(3651): n is a, c, g, or t
  misc_feature (3656)..(3657): n is a, c, g, or t
  misc_feature (3660)..(3660): n is a, c, g, or t
  misc_feature (3662)..(3663): n is a, c, g, or t
  misc_feature (3672)..(3672): n is a, c, g, or t
  misc_feature (3675)..(3675): n is a, c, g, or t
  misc_feature (3678)..(3678): n is a, c, g, or t
  misc_feature (3681)..(3681): n is a, c, g, or t
  misc_feature (3684)..(3684): n is a, c, g, or t
  misc_feature (3699)..(3699): n is a, c, g, or t
  misc_feature (3713)..(3713): n is a, c, g, or t
  misc_feature (3715)..(3715): n is a, c, g, or t
  misc_feature (3717)..(3717): n is a, c, g, or t
  misc_feature (3720)..(3720): n is a, c, g, or t
  misc_feature (3722)..(3722): n is a, c, g, or t
  misc_feature (3726)..(3726): n is a, c, g, or t
  misc_feature (3729)..(3730): n is a, c, g, or t
  misc_feature (3734)..(3734): n is a, c, g, or t
  misc_feature (3744)..(3745): n is a, c, g, or t
  misc_feature (3753)..(3753): n is a, c, g, or t
  misc_feature (3755)..(3764): n is a, c, g, or t
  misc_feature (3767)..(3767): n is a, c, g, or t
  misc_feature (3769)..(3770): n is a, c, g, or t
  misc_feature (3772)..(3772): n is a, c, g, or t
  misc_feature (3776)..(3776): n is a, c, g, or t
  misc_feature (3778)..(3778): n is a, c, g, or t
  misc_feature (3781)..(3781): n is a, c, g, or t
  misc_feature (3783)..(3783): n is a, c, g, or t
  misc_feature (3785)..(3785): n is a, c, g, or t
  misc_feature (3787)..(3788): n is a, c, g, or t
  misc_feature (3795)..(3795): n is a, c, g, or t
  misc_feature (3797)..(3798): n is a, c, g, or t
  misc_feature (3802)..(3802): n is a, c, g, or t
  misc_feature (3809)..(3812): n is a, c, g, or t
  misc_feature (3815)..(3816): n is a, c, g, or t
  misc_feature (3819)..(3819): n is a, c, g, or t
  misc_feature (3821)..(3829): n is a, c, g, or t
  misc_feature (3831)..(3831): n is a, c, g, or t
  misc_feature (3836)..(3837): n is a, c, g, or t
  misc_feature (3839)..(3839): n is a, c, g, or t
  misc_feature (3842)..(3843): n is a, c, g, or t
  misc_feature (3845)..(3850): n is a, c, g, or t
  misc_feature (3852)..(3860): n is a, c, g, or t
  misc_feature (3863)..(3865): n is a, c, g, or t
  misc_feature (3868)..(3881): n is a, c, g, or t
  misc_feature (3887)..(3887): n is a, c, g, or t
  misc_feature (3892)..(3892): n is a, c, g, or t
  misc_feature (3894)..(3895): n is a, c, g, or t
  misc_feature (3904)..(3904): n is a, c, g, or t
  misc_feature (3916)..(3916): n is a, c, g, or t
  misc_feature (3921)..(3921): n is a, c, g, or t
  misc_feature (3924)..(3924): n is a, c, g, or t
  misc_feature (3927)..(3927): n is a, c, g, or t
  misc_feature (3929)..(3929): n is a, c, g, or t
  misc_feature (3934)..(3934): n is a, c, g, or t
  misc_feature (3943)..(3943): n is a, c, g, or t
  misc_feature (3957)..(3957): n is a, c, g, or t
  misc_feature (3968)..(3968): n is a, c, g, or t
  misc_feature (3970)..(3970): n is a, c, g, or t
  misc_feature (3978)..(3978): n is a, c, g, or t
  misc_feature (3985)..(3985): n is a, c, g, or t
tntntttntntannatnnnnnannnnnanannannntnnnannntnnnncannannnntanaannnnnnnnntnnnnttttttnnnnanananaannntnntntnnnnnntnntnnnananatnnnnntnnnnatatatatntntntnnnnannnnnnannatatannananatnttnnnannatntnnnnnnnntntatannntnnanaanatatatnttnnananaaanngtntttnnncnnnnnnnnnnntnnnnannnnnatnnnannannacanntntntntntcnnnntanaaaannnnnannntnnnnanatnnnnanaaaaaaanatnnnanannnntntnntnntntntnnnntnnnatannnnnnanaanntntnntatatatatatatatatatatatatttttatttatttattttttatctatattaatattaaatatgttgcttcattgcacgtgtacgccattttaacatgactaatgtatcatattgaaaacctaacaataaaatagaattttattataatataattgacattgttactatttaacctaatttctttgtctaataacgtatataaaagtaattatttatttgcttatttatttatataattttaatcattttaattatttaaaataaataaatatatataatatatatattatattttcttctacattgtaaaaatggaaatattataaaagtttagtaaaaataaataataattagattatagatgaataaatattcttttcatatctcaattatgttaaataataatagcacaaacattatgttataatgtttgtgctattattattacttgttttactttaacatcgaaattaaaaattattttaattttttgtgaaaaaaaaaaaattaaatttacattaaaaatgtttgataaagtttttttaagcaacttggatttactttatcgttaatggcaatattaaaataaacttaatcatattgttagcttcatatttgttttatcattaaataaaattgtaatctcaatataataatttctatataatataaataaaccagtatataccctatcaatttttttaatataaatattgttaatattcctaccacagttaatgtatttaaaattatgttttcttttgaataataatatttcaattcattgcataaatctcgtttttatttgaagattaaaatcgttatataatatatttatattttattaattaatatttaatattactatttcaatttattttcatatattttaattatttgttatattttccaagataaagataaaagtatattttccatgataaaaataaaaagttttatgtagctatttattgttttaaagttaacaaatacaataaaaaactttcaattaccattatttattatttagctttctcatggataaacctattttaatattaaatatcattataccgatatataatattcaatattaatgataataatattaataaagagtaatattattacttcatataatacgatacaatataattattacaaaacgatatattaaactattaaagtctaataataccattttataaattaatttataatatttttatattttataatttattaataaacctaaccttttattaatttaatgaaatataaaatatccccaattgactaagtaatttattactaaatatatttatttttcctatttattatataaatatgatttatttatgtaaatataaaaattctccaattgattataggtattatttatttattattatatagttattgaataggaatataaagagatattgatataaaagtatatacatatactatttttattttaagagaagaatgaaaatttacaacatttgtttatgtaattcataattattcatgtatgtacattattttatattttttaattattactatttaatttttttttaaaaaaaaaaaaaaataaanaaataaacctgactttatttttatatattataatgtttttacacaaatttttagtaataaaatatttgatagagttttggcgtttttggcagtacattatacattttttattagttatatacaaattacaaaaaatattatcaacataaatacaaagtaagtctgaaaataatttatcagatgataatgtctaatctttatacattattttaacaaataaattttagacaaaaaaaatattcttttcaatatggttcatgcgcatatacgttcaattaataatatcaatgaaaaggatgtaaaaataattaacataacaattaataaaaatctaatagttgaattttattgaagatttattataataaaaaaaaaaaaaaaaaaaaaaaaaaaaaaaaaannnntnnntnaantnnntttnnanannaaannaaaaatnnntnntttnnttnaantntntntnttnnnnnnnnnnatnnnnantnnnaattnaannnntnnnntttnaannannnnnnnnnntnnnnnnnnnnnnnaannnnnnnnnaannnannnnnnnnnnntnnnnnntnnnnnnntnnnnannnantnnnnnnnnnnntnttnnnnnnnnnnntnnnnannnannttanttnnnntnnnnnntnttnttntnttnnntnnnnntnnnntntnaantaaannnnnnnnnnnnnnnnnnnnnnnnnanannnnananntnnannnnnnnnntnnnnnnannannaannnnannnannnntanatnannnntntnnnnnnnaanatnnnnntntnnntnnnnnnnnnnnnnntntntnnntnnnttnttnnnnntnnnnnnnanntntnnnnttnnnnntttnnnntntnnnnnntnatnnnnannnnnnnnnnnnnnnttntttnttntnnnannnnnnnnnnnannannnnnntnnnntntntnnntttnnnnnnnnntantnnntnnnnnnnnnnnnatanntannnntnnntnnntnnnntnnnnnnntanannaannnnnnnnannnnnnnannnnanntnnnnnntntntnnnnnnnnannnnnnatannnannanannnntannnnnnnnnnnnnnnnnnnnnntnnnannnannannnnnnnnannnnnnnnnntnnnnnnntnntnnttnnnntannantnattnnnannnannntnannnnnnnnnnnnnnnntnnnnannnnnnnnttnnnntnnnnnnannnnnnannnnnantnnnnntnnnannntnnnnnnnttntnnntnnnnnnatnnnnnnnnnnnnantntnnnnnnntnanntntnnnntnttttnnnntnnnnnttnttnntnnnntnannnnnannnnnnnnnnntnntnnntttntnntnnnannnnnnnnnnnnntnnnttnntnnannatnnnnnnnntnnnnnnnnnntnnttnnnnnnntnnanannnnnnnnnnnnnannnanannnnnnatnntannnntnnnntnnnttnnnnannnannnnanntannntnnnntnnnnnnnnannnnnnnnnnnnnnnnnnnnaaannnaantntnnttnnnnnttnnnnnnntnnnnntntnanannnnnannnnnnnnntnnnnnnnnnntnnnnnnnnnannnaannnaannnnananaanaanaaaannaanannaaaaaaaanaanaanaanaanaaaaaaaaaaaaaanaaaaaaaaaaaaanananaananaaanatnnaaanaaatatatanntttttatntnnnnnnnnnnatnannanatantntantnananntttattntnntatnttttttnnnnatnnatntnnnnnnnnntnttttnntnatnntnnnnnntnnnnnnnnnttnnnaannnnnnnnnnnnnnatatanatttnannatatatatntttctttttctnttaanaanatntnaaaantatattctnaaaataaatattcncaatattattntntttttttntattttntttattttttttttt

SEQ ID NO: 1496 - DNA, 4000 bp, Escherichia coli
  misc_feature (460)..(460): n is a, c, g, or t
  misc_feature (535)..(535): n is a, c, g, or t
  misc_feature (901)..(901): n is a, c, g, or t
  misc_feature (910)..(910): n is a, c, g, or t
  misc_feature (1593)..(1593): n is a, c, g, or t
  misc_feature (1663)..(1663): n is a, c, g, or t
  misc_feature (1711)..(1711): n is a, c, g, or t
  misc_feature (1871)..(1871): n is a, c, g, or t
  misc_feature (1937)..(1937): n is a, c, g, or t
  misc_feature (1956)..(1956): n is a, c, g, or t
  misc_feature (1987)..(1989): n is a, c, g, or t
  misc_feature (2035)..(2035): n is a, c, g, or t
  misc_feature (2075)..(2075): n is a, c, g, or t
  misc_feature (2217)..(2217): n is a, c, g, or t
  misc_feature (2222)..(2222): n is a, c, g, or t
  misc_feature (2332)..(2332): n is a, c, g, or t
  misc_feature (2777)..(2777): n is a, c, g, or t
agtgtgactgagatttttagtaaacatatcagcagggttgttgttaccttcagtgaagaagacttcaaccttgcctttgtcaatacaatctctaatatgatgataacgaatatctatatgttttgagcagatttcttgtaccagattacaagacataaaaattgatccctggttatctccagcaagtaggattggcccaaggttatatcctagctctttaagcacattctgaagccaagcagcttgttggcttccatcagacagagccatatactctgtctctgtagaggataatacaacagtcttctgtgctctagatctccaactgataatgccctttgctaaaaggaagaagaatccagtagtagggcgtcttgttgttggatttgagccccagtcagcatctgtatatccctccaatccctgatcactagtaccatcatatattagagcatagtcncttgtttctgcaagatagcagcatatatacaatgccttatctaaatgttcttttgagggatttgctgagaactgngataagcaagttacagcatatgctatatcaggatgtgttcctaacataatatataataatgagccaattacagattggaatctggaatcgctgctcttggtcaatggttccttcataaggtattggctgataaccttctagtagtggagttgaagcaactcatacattgaacatgttaaattttttgagtactttgttaaggtaggctgtttgagtgatgaaaatcttatgctgttctcgatgtatattcatatgcaaaaattctttaacatctccaagatctctacactaccagtgcttcatgaagtcaccctttagtttattgactagtaatttattcttgccaataaagagagcatcgtcaanatatatganaacaatgactgtttcattatcctttagataaatgaatacacctgcatctgcagtgagtcacttaaaacccaatattttcatggatttagtaagttgtttccaccaggctaaagcagcttgcttcagcccatatattgcttgatgcaagcagagcactttgtactctaggccttttatcttaaagccttcaggttgctccatataaatctcctcatctagtttcctatataggaaagtgctcttgacatctaagcctgttatgtaccaatccttaagagcacttagtgcaagaatgagttacacagtctcaaaccttacaacaggtgagaagatttcattaaaatctatgtcttcaatttgtgagaaccctttggccacaagttgtgccttcttttgaccatttgccttctggtcaaaaacccaacaacatttgattattttctgcccttgaggcagatctacaacatcacagactttgtggtctttaagagcatcaagctcttcatagcaggcctttttctattcctcctggttttgcttaggcaagtgtgcaatgtcttgaaatgttcattctcggacattacctggaagattaatttcatctattattgcctttgagagcaggtatgaaattaatagtactctccctttacaggccaatttcattattgttgattcttccnggttagaatcgtcattaggaacctcagaacttggtctgggaatagacctttttgattctgagattgcacntgaagtatccctgattatatgtttccatcctttgatctgatgaatttntttttcaatgtcaatagggctttgagttttcccatagacattgccagggtgtgttacatggctccttactctatgagggcgttccctgtagatggtggcacattttggtgctcttgcccttcatctggatttggagtaggttgacaaggggcaggaggtntaagggcaaccagagcagtacactccaggagattccttgtaaggggacccctaatccgcgactccngagcccgttctagagctcnggagcgaccctgtagctgatccaatattacnnngtaatattgggtctcactcccatcattctgagagcactccattgcnacccaacacactttccttgttcagaccctggttactgatncagggacacgaagacactgtagtatataatgtagattattccctccaggaacctcatctaattctctgaggaatctcctggaggtaggttgtaatcatatttcataaattataattaactaaggaatctcctggagtcttcnactcnggtcacccttacagtagaattagatcctattatcagagccccagaatttctcagtggacagccgccctccagtcgccctctgctaacaaactctggccccttgatcactncactccaaagagatgtcactctctgcggacacccccccagccttcgctgatgtcttaggctacctgcagcaccatctccaggagttaaccgagcatcagaacacttcggaacatgttattaacaataccctcgcgagcctaacagcccaaatacaacagctcactcaactgatgaccagccctgcccccgctccaacagtcgctccgcctccgataacaacgtctccccctcttgtcaaccctccttccctagtcccgtccgccccgaccaaacagcggacgaggccaaaactcccttctccacccaacttctccagtgaacaaacttctggccgagccttcttaaactcctgtatgttatacctatgcctggctccggagcagttcagctgcaatgaggagaaaatctttgggacactcacctttttcaaagacggacgtgccntgaggtggtccgagaacctctttcgccaggaggcgaacaccggcgtttttcctatccagtcttgggctgactttgaacaacagttccagagtcaattcttcccggtcaatgcagaagcggatgccgttaacgctctggaaggctcctcatactaccaagaaaaccagacggtggacgattacctggactgtttcctaaccttggtctccgacactggatacactgacccccagactcttgtggtgaagttccgccgaggcctcaagacgaacattcagggccaaatcgccaccatgcccttcggacgacccgctgacactgatccggaggcttggtacgcagctgcccagaggattgaccaagtacgattgaccaatgaggcttttcaattcacgctctggtcaacaactatggcacctatgcgctctgcccttccctggcctgtccctctcttgatgttctgcctgcctcagtccgctctgctccccgttctcccaagacccgctccacctgtaccatctggagggatacctatggacgtggacaccatccagaagacgtgccctacacctccgcagggatgttatcgatgcggagagcccaactatctcataaaggactgtccctactgtctagacgtccagaggttaaccgcggagcaacaggaagaattgattgaagatttgatggccttgaaagatgcagtagcagaagaggaagttggctcctccccggaggaggattttgtttagcgtggccagcgaaaagtgcgccccggtcgctgctagttaataggttcactgtattagacgtagaagaagtcaatacagaaattcgtgaacctatagacgcactccctctctctcctccactccagtcaggacagccctgcctcggaggtccaaatgggaaaaaaaactccccagacgactctccgccaacaccctcgacgcctgtgaaatgtctatcatcctgcctatagagatcggtaccaccgacaccagcgaggtgcattccatcaaagcgcttttggactccggagccaccggcaacttcatagacaaggattttgtccgtacaaaaggtattagtacccggagcatctctcgtcccataccggtgttcaatgtggatggctctcctaacgaagcaggacaaatctccaaagtagtggatgtagtcctccgttataagacccactctgaaagaacgctccttgccat

SEQ ID NO: 1497 - DNA, 4000 bp, Escherichia coli
  misc_feature (1492)..(1492): n is a, c, g, or t
  misc_feature (1778)..(1778): n is a, c, g, or t
  misc_feature (1859)..(1859): n is a, c, g, or t
  misc_feature (1991)..(1991): n is a, c, g, or t
  misc_feature (3218)..(3218): n is a, c, g, or t
  misc_feature (3220)..(3220): n is a, c, g, or t
  misc_feature (3225)..(3226): n is a, c, g, or t
  misc_feature (3228)..(3231): n is a, c, g, or t
  misc_feature (3234)..(3236): n is a, c, g, or t
  misc_feature (3238)..(3238): n is a, c, g, or t
  misc_feature (3240)..(3240): n is a, c, g, or t
  misc_feature (3242)..(3246): n is a, c, g, or t
  misc_feature (3248)..(3250): n is a, c, g, or t
  misc_feature (3252)..(3252): n is a, c, g, or t
  misc_feature (3254)..(3257): n is a, c, g, or t
  misc_feature (3260)..(3267): n is a, c, g, or t
  misc_feature (3270)..(3271): n is a, c, g, or t
  misc_feature (3273)..(3275): n is a, c, g, or t
  misc_feature (3279)..(3279): n is a, c, g, or t
  misc_feature (3281)..(3281): n is a, c, g, or t
  misc_feature (3283)..(3285): n is a, c, g, or t
  misc_feature (3288)..(3288): n is a, c, g, or t
  misc_feature (3291)..(3301): n is a, c, g, or t
  misc_feature (3303)..(3304): n is a, c, g, or t
  misc_feature (3306)..(3307): n is a, c, g, or t
  misc_feature (3309)..(3313): n is a, c, g, or t
  misc_feature (3316)..(3320): n is a, c, g, or t
  misc_feature (3324)..(3324): n is a, c, g, or t
  misc_feature (3327)..(3327): n is a, c, g, or t
  misc_feature (3329)..(3329): n is a, c, g, or t
  misc_feature (3332)..(3337): n is a, c, g, or t
  misc_feature (3339)..(3352): n is a, c, g, or t
  misc_feature (3354)..(3363): n is a, c, g, or t
  misc_feature (3365)..(3389): n is a, c, g, or t
  misc_feature (3392)..(3393): n is a, c, g, or t
  misc_feature (3395)..(3400): n is a, c, g, or t
  misc_feature (3402)..(3415): n is a, c, g, or t
  misc_feature (3418)..(3454): n is a, c, g, or t
  misc_feature (3456)..(3462): n is a, c, g, or t
  misc_feature (3464)..(3464): n is a, c, g, or t
  misc_feature (3466)..(3474): n is a, c, g, or t
  misc_feature (3477)..(3478): n is a, c, g, or t
  misc_feature (3480)..(3486): n is a, c, g, or t
  misc_feature (3488)..(3498): n is a, c, g, or t
  misc_feature (3500)..(3504): n is a, c, g, or t
  misc_feature (3507)..(3507): n is a, c, g, or t
  misc_feature (3509)..(3530): n is a, c, g, or t
  misc_feature (3532)..(3541): n is a, c, g, or t
  misc_feature (3543)..(3549): n is a, c, g, or t
  misc_feature (3551)..(3568): n is a, c, g, or t
  misc_feature (3570)..(3572): n is a, c, g, or t
  misc_feature (3574)..(3575): n is a, c, g, or t
  misc_feature (3577)..(3581): n is a, c, g, or t
  misc_feature (3583)..(3585): n is a, c, g, or t
  misc_feature (3587)..(3593): n is a, c, g, or t
  misc_feature (3595)..(3597): n is a, c, g, or t
  misc_feature (3599)..(3610): n is a, c, g, or t
  misc_feature (3612)..(3623): n is a, c, g, or t
  misc_feature (3625)..(3627): n is a, c, g, or t
  misc_feature (3629)..(3638): n is a, c, g, or t
  misc_feature (3640)..(3643): n is a, c, g, or t
  misc_feature (3645)..(3645): n is a, c, g, or t
  misc_feature (3647)..(3653): n is a, c, g, or t
  misc_feature (3655)..(3662): n is a, c, g, or t
  misc_feature (3664)..(3671): n is a, c, g, or t
  misc_feature (3673)..(3701): n is a, c, g, or t
  misc_feature (3704)..(3721): n is a, c, g, or t
  misc_feature (3723)..(3723): n is a, c, g, or t
  misc_feature (3725)..(3725): n is a, c, g, or t
  misc_feature (3727)..(3732): n is a, c, g, or t
  misc_feature (3734)..(3742): n is a, c, g, or t
  misc_feature (3744)..(3747): n is a, c, g, or t
  misc_feature (3749)..(3753): n is a, c, g, or t
  misc_feature (3755)..(3760): n is a, c, g, or t
  misc_feature (3762)..(3765): n is a, c, g, or t
  misc_feature (3767)..(3772): n is a, c, g, or t
  misc_feature (3774)..(3780): n is a, c, g, or t
  misc_feature (3782)..(3788): n is a, c, g, or t
  misc_feature (3791)..(3800): n is a, c, g, or t
  misc_feature (3802)..(3802): n is a, c, g, or t
  misc_feature (3804)..(3805): n is a, c, g, or t
  misc_feature (3807)..(3817): n is a, c, g, or t
  misc_feature (3819)..(3832): n is a, c, g, or t
  misc_feature (3835)..(3835): n is a, c, g, or t
  misc_feature (3837)..(3838): n is a, c, g, or t
  misc_feature (3840)..(3841): n is a, c, g, or t
  misc_feature (3843)..(3854): n is a, c, g, or t
  misc_feature (3856)..(3860): n is a, c, g, or t
  misc_feature (3862)..(3884): n is a, c, g, or t
  misc_feature (3886)..(3897): n is a, c, g, or t
  misc_feature (3899)..(3935): n is a, c, g, or t
  misc_feature (3937)..(3947): n is a, c, g, or t
  misc_feature (3949)..(3966): n is a, c, g, or t
  misc_feature (3968)..(4000): n is a, c, g, or t
tccccgccgtcaatgtaaccggcgggcatagagaagttctgcgcggcgatcagctgctttaaggtgttcatgttcagcagctggtccagattggcgcttttcagcgcttcctcgcgggccgattcatactcttcgcgggcggagtccaactgggtctggcccgcttccagctgggtgcggccgctgctgatctggaactcgcccaaactgagctgggcttcggtgccgctgagcagcagctgcacggccatatcggccagttgggggtctgtcgggttggcagaaaggctttccagcatcgattgcagcttgccgcgctgatcgttcaaattggccagcatggcttcggctttgtcgatctgggtgttcagggtggtaatcgtctgctgtagggtttggcgcagttcctcggtgctctcgttcaggctggcttcggcttcctgccgggctttcagcagcaccgttgcgttccgcaaggccgtctgggtggtggaaagggtgctttcatcactcttgtaaccatccagggctgcgcgctggctggtggcagtgtccagctgggtctgtaaagccgcctgttcagcttttttgctttcgatttccgcgcggatggcatcctgctcttccggggcggcggtatccagctgctgttccagctgaacgatctcgttatccttctgctgcacctgcacggtcagcgtcaggatctgggcgtccagcgcggcgcaggcatcgctgacgctctgcccgccggtcagggcggcagcttcggtctcaatggcctgctgggcgcgctcgatggaagccagcatcgcggccatcttggtcaggtcgctcttggcttcctccaaattagcgggcatggcatttgcatcgtactgggggtcatattttgccagaatctctttgcaggaagcaaacagtgcatcatcgatcggcagcgtcacttccggcaggctgctggggtccactttcagctggttcagcttgctctgggcggtgtccagctgggttttcagccccgcaatctgctcttccagcttggggatctcctcgttcagctggtcgatggcatcccgcagctgctgggtcaggctctgcttttgggtattcagctgggctttgccggaatccagctggctctgggcactgtccagctccgccaggccgtccttgattttggcctcgttttcgtccagctgctttttggcttcggccaggcggtcgctcaccttgaccagcagtttgtcattcacctcgtcaattttgtcctggtccagcgtgatctgcactgattttttgacaaggccggtggtggaaacgctggccacgccgtccacgcgctccagctggggtacgatcgtatcctccacatagtcggaaagctcgtagatgtccatcccctcatagtccaccgcaacatactgggtggccatcatatcggggctcatctccatcagcgtgggggtgctggccatatcgggcagactgnccgaaagctggttcacggcggtgctggccttgaccatggcgctgtccatgtcggtgtcgtcctggtattccagaatgacaaggctgtagttttcgttgctctggctggtcacgttctttacaccattcagggtggaaaggctgttttccagcggctgggtcacatcgctttccacctgttccgggctggcgccggggtaggtggtaatgaccagcaggtagggcaggttcatattgggcagcaggtctgtctgcatgccggtcaggcttacaaagcccagcaccancaccaatatgaccgccacaagtacggtaaatggctttttaacactgtattttggcatttgtttgttccctttgcccgcacnttgggcgggcctatgttggcggatgtgaccgaccggccgggttcaggctgccccaaaaggaaggagcgccgaagcgcagcgcagccgccgtgtggcgcccctttttagggggaaacggagcttttttagcgngcttgaccgaccggtcggtcggtttttcgctgttattatagcaccgcggaaaatcattgtaaagaggagataaagattccgtccgtgcggtacagtttgccgcaaaagcggcaaaaatcgccgccagccttgctttttcggccccaatcatgtaaactgttcatcataagtttacagttatacggtgcagctgaaaaaacgaacattcagtcggtttccttgttttccgctgcaccctgggtaaggaagggcgttttgcatggggatcgttgtcatcggcgcagtttttgttgatatcaaggggtacccccttgccacctatattccgggcgggcgcaacgccgggcgggtagaacaggtacacggcggtgtgtgccgcaatgtggcggaggatatcgccaacgtggagctgcgccccacctttgtaagcctggtggatgacactggcacagggcaggatgttattgataaactggcgcgccacaaggtgaacacccgctatatccagcgcgtgccggacggcatgggcacctggctggctgtgttcaataatgagggcgatgtggtggccgccatctccaagcggccggacaccaatcccctgaccgacctgctggccgaaaaaggcgatgaaatttttaaggactgcgatggcattgccattgaacttgatctggaaaaagacactgtaaagcaggtcttgtattttgcacagaaataccacaaaaaggtatatgccgcggtttccaacatgagcattgccatggagcggcgtgactttttgcagcaaatcgactgttttgtctgcaaccagcaggaagcggggatcctcttttctgacgaatacgaccatatggggccggaggaaatgtgccgcacgctggccgctaatgtaggcagcgcccgcatcccctgcatggttgttaccatgggggacaaaggcgcggtgtacgcctgcgcggatggcgaaagtggcattgtacccgccaaaaaggtaaacgtgatcgataccaccggcgcaggcgatgcgttctttgccggtacggtcattggccgcgcttatggcaaaacgatggcggaagcctgcggcattggcagccggctggcggcttcggtcatctgcaccgccgaaaatgtctgcccgcggttccgcccgcaggagttcgggctggatgttccggttgtggattgagcgccgtttcagcaggccggtcacagccgccggancngtgcnnannnngcnnngngngnnnnntnnngngnnnnccnnnnnnnnaannannncccngnannnttncannnnnnnnnnngnncnncnnnnnctnnnnngggnttncntcnnnnnntnnnnnnnnnnnnnngnnnnnnnnnncnnnnnnnnnnnnnnnnnnnnnnnnntgnntnnnnnnannnnnnnnnnnnnnaannnnnnnnnnnnnnnnnnnnnnnnnnnnnnnnnnnnncnnnnnnntncnnnnnnnnngcnncnnnnnnngnnnnnnnnnnnannnnngcngnnnnnnnnnnnnnnnnnnnnnncnnnnnnnnnntnnnnnnncnnnnnnnnnnnnnnnnnnannntnngnnnnncnnngnnnnnnntnnncnnnnnnnnnnnntnnnnnnnnnnnncnnncnnnnnnnnnngnnnngncnnnnnnncnnnnnnnnannnnnnnngnnnnnnnnnnnnnnnnnnnnnnnnnnnnngtnnnnnnnnnnnnnnnnnncngncnnnnnncnnnnnnnnngnnnngnnnnncnnnnnngnnnngnnnnnngnnnnnnncnnnnnnngcnnnnnnnnnncngnngnnnnnnnnnnncnnnnnnnnnnnnnnaananncnncnnnnnnnnnnnnannnnngnnnnnnnnnnnnnnnnnnnnnnncnnnnnnnnnnnncnnnnnnnnnnnnnnnnnnnnnnnnnnnnnnnnnnnnnannnnnnnnnnncnnnnnnnnnnnnnnnnnngnnnnnnnnnnnnnnnnnnnnnnnnnnnnnnnnn

SEQ ID NO: 1498 - DNA, 4000 bp, Escherichia coli
  misc_feature (1986)..(1986): n is a, c, g, or t
  misc_feature (1988)..(1988): n is a, c, g, or t
  misc_feature (1992)..(1992): n is a, c, g, or t
agtcaaaatcaaaccaaatatcaccttctgttaatagatccgctgttataggattacttgttagagttgaggaataatcattctccaataatggatcccaattaaactgtgcacttggctcagggtctccaacatttggattaatcatccagttatcagaattgtcattgaatctccattgttggaaggtaaaggttccttgatcccatccttcgaagaatggtaaatcatatccccatacaacctctacagtatctgttccttcccacgctgactcaccaaaatctcctgggaagccaaaaatagttaggtcatataccgcacttacatcaaataagtaagttgctggatccaaattattaacaacatgatatacatgctcatctactgcctgtccttcgtatggtacgttggcaatatttactccgtcctggtatacgttaaatgataccaatccatctggtatcattccgccgccaccgccgccgccactgtagtcagctagctcgatgccccataacgtctcattttgtgcattaccaccaatggttaccttatcaggtgaccatagagctggtgttgtatatgctccaccggccagtgcagttgcaccagtaatagatccaacatctaaggttaaacctgttgctgtaccatctggtagagtatattgtactaagttattagcaccttgatcatatgcccacaagtactcattacttggatctgaatagtcatcatatgccaatccataaatacttgttacacttggtgtaaatgatccaaggttagctccactagcatcaaaggtaacaatgtctgttccccagttgttgccatagaatgtcatatcattatgattgtatgctatagctctaactgctgttggtgctgtaaatgaagtaactagtgtctgtgttgcaaagtccattacatatactgttgtagatgcagcagctccatacataaactcaccatcatatgctaaatcacgtacgccacttgttccagcaatactaaatgattctatcatatttcctgctaaatcatacttgaaatatgttgatccattccatagagatgtataaacaaattctccatcagactcacaacctgcttcaccagagttatcaactgttgggaatgcgaactgaaagtcaccaaagtcacgtgtactttgtggattatcaaattcaatgatagtaacctctgaagctgcctctacgtttggtcctactgcactaagctgtggtcctacataaacaactttaaaagctgatgtcattggaattgttcctgtcattggtggtaaccacatcaatggcacctcattggttccataaacatactcatcatccaattctcttggtgggtgtaggtaagttgatgtccatgtataacatacttcatcacttaatccacatgcgtacaatgcacgtacacatccctcataagtttcaccatatgctaaatccatatatgtccactcacgtgtggtagcatctgttgatccaacaaacgcatcattaaggtatacatagtatcccaatactggtgatggtccgtttttaacagctacattatcaactgcccaaccagaaccccagttgccgttgtcgtcagaatggaatgctaaccatacatttgatgatgttaaacctgatagagcagctaagctaacctctacatctgtccaagcaccaggagttggtgacattgcctccaatacttcccatgtagctccaccatcataactatattcaacatatgcactttgaccataagctgcatcaaagaaactactgaaatataatgtgaagtcatcactttctctaagatccaactctggagtgattagataatcatcttctccatcatttgtactacccgctgcatcatcatttgcaactgcgtagaatccgtcaccttctggaatagcccaagcaccagttccggcatcatcactgcgataccatccttgtcctnangtanttgattgccatcccgctggtgggaatgcagcatcttcgaaagtctctgtaaatagtgctgtaattaatggctcatcccatgtagcatgtgatgttaactcatcaaccataaagttacgcggtgcgtaagccttctcggttaataccaagctataagtctgatcatcaaaaattgcaagattgtagtgctcatactgtgtatagcctaccttatttacaaacatatcataataaccatctataacgctatcaaatacaacaataccagcagcatctgttgatcctacatgaaaatcataaggataatcctgtccaactagtaatacttctgcatcacttggctcattaccatcacataaactaacctctacggtaaattcattggcaagtaaatgtccaactatattggaataaacccatatggattcattggattcataaacagctttaactgcatatgcgtaaaaacctgctggctgtccgccaaaggctgcatcattatacatctcagttgttgggttggcaataggtgttaatgtacctgtctctggtcctaaatcaggatcaaaattgctaactcttgcaactgtataatttgtaaagtcacgtgtggcattggttacttcaattggaaggaattctccatcctttagagttccactaacacctgttggcatacttgttgccaagaatggaccttgtgttacttttggtaaacgaaccatagatccaacagcactgctaacaacaccagcatttggcccgtcaacaatcgcgcgaatcataaagtcttggtatggggatgttgaccatccactaccaccaggtaattgaaccacagaacgatatacagttggtagatcagtatccactcctactggagctgagttactagccaaacctaactgccacattactatgtagaaatctccatcactaatagtagcaccaaatactccactaaagtcaacccagccaaaattagctacatcaacaactgctgaatcaagaactgttccaggcataccgtttgtaccatcatcatcaagtactccaactgccatctgcgtgcctaaaaagtttgttcctcctgggaagctaccatcaccaacataaaggctaccgcctgttattgtggctgggtatccagctggtgtaaagtctacacctactgctcctcctggagtgttccagataacgtagtcattagcctgaccatcatcataaacaataacatatgggcccattggtaatgtccatgttacctcacattgtgtatcatcctgatttggatcagcaaatacccattgtacaggatatggtgtttcacacatggatgcatttaattcagtcgcattaccagatgtaacaatagcaacaccaaattcattttcaaaacctaatttttcaaaggaaacgccatactcatctgcatcagcatacatcatgtactgaccactaccatctgtagttgcataataaataggaccgaaaacaccttctgcagttacgcttactcctcccatgccaagaccagtgttacaatctgtaacctgtccaaaaattgaacctggtacataaacatgcattgtgttaaatacactatcagataatctagctgggtcattggtctcaatgttaagccactcatcatatgatcctgctgggaatccagctgaactataagtaaccattacatccaatgtacctcctgctgggatttgtccagctgctggttctacatctactatgtaacttggctgtggacatgttccataaacaactccaactggtaaacttacgttacccgctgaatagattacgttaccatctccatctaaaaagtcataagaacactcatatgaccaaccacctggtgtaaaaacagtactaatatcatcaccagtctctgcagggaatccaaaacattcaggaccactaccacttgccaatgtaatgttatctaatacaatgttgccatttacaaatacactaagggtaccgccatt

SEQ ID NO: 1499 - DNA, 4000 bp, Escherichia coli
  misc_feature (360)..(360): n is a, c, g, or t
  misc_feature (798)..(798): n is a, c, g, or t
  misc_feature (952)..(952): n is a, c, g, or t
  misc_feature (1011)..(1011): n is a, c, g, or t
  misc_feature (1398)..(1399): n is a, c, g, or t
  misc_feature (1987)..(1987): n is a, c, g, or t
  misc_feature (2049)..(2049): n is a, c, g, or t
  misc_feature (2591)..(2591): n is a, c, g, or t
  misc_feature (2753)..(2753): n is a, c, g, or t
  misc_feature (2813)..(2813): n is a, c, g, or t
  misc_feature (2870)..(2870): n is a, c, g, or t
  misc_feature (2900)..(2900): n is a, c, g, or t
  misc_feature (2933)..(2933): n is a, c, g, or t
  misc_feature (3047)..(3047): n is a, c, g, or t
  misc_feature (3083)..(3083): n is a, c, g, or t
  misc_feature (3095)..(3095): n is a, c, g, or t
  misc_feature (3128)..(3128): n is a, c, g, or t
  misc_feature (3164)..(3164): n is a, c, g, or t
  misc_feature (3207)..(3207): n is a, c, g, or t
  misc_feature (3325)..(3325): n is a, c, g, or t
  misc_feature (3713)..(3713): n is a, c, g, or t
  misc_feature (3823)..(3823): n is a, c, g, or t
cggcgatcctgaaaacgtccagattcgggtacgacggcaagggccaggtgcgtgtcgatgaggtcggcgatcttgccgccgcgtgggacagcatcggcaacgcgccggcggtgctcgaaggcttcgtcgatttcgagcgggaaatttccgtcatcgtcgcccgcgggatcgacggcgcgacccagagctacgtgccggtcgacaacgtgcaccgcaaccacatcctgtacaccaccacggcaccgtcgacggtgacagaaaatatcgcgaatgaagcccggcgcatcgcggcggaggtggtcaacgcgctcgatctgatcggccttctggcggtggaaatgtttgtgttgcgcggcggcnaagtgctggtcaacgagatcgctccccgtccccacaattccggacactggacgctggacgcatgcgccgtcagtcagttcgaacagtttatccgcgccgtggcgggcctgccgctgggcgacccgtcccggcactcggatgcggtaatgaccaatctgatcggcgacgaggcagattcatgggcggaactggccgccgaaccgggcgcctgtctgcatctctacggcaaggctgaaagccgccccggccgcaagatgggtcacgtcacccggctgtcgcctgtatcgggccgcccgtagcgcttttcgacaacatctttcaggatgcccagcgggccgagcacccggtcgcgggacccctcgatgcgtttgcgggcgccgtgaattttcatgacatcggcgaggcggcgatggaggaaggccgtcgtctccgccccgncctcgctgcgatcgtccagccagaacagcgtagtcgacccgaccacaccggccagcaggccgcgcttggtatagaacgagaaatcggccgaccggtcgccgacggcgtaccagatatcgtcgacggtgcgatacagcagccgcgcccccagcancgcgttttgcggcagggccagccaggtcagtccgcgatgcaccgcttcccgatggggcncgaggaacgccagccgggtttccacggccagggcgacgcgctcatgaatgcgcaaatctccaaggtccgcctgttccatcccggcgagcatatgccggtcggccatgcgtgaaaaatgccggatcgcatccgcgacgccacggggaaattcctgtgtgacgatttcgggaccgaaacccgaatcccgggcgccgtcccgcaaggcctgcatcgaccagccgtcgaacggcacatgggcgagtgtcgcctcgatcagcctgtctcgaaggagggggtgccggtcagtcacgcgccggcgtcttccccgttcgaattggccgccgcctgcgccgaggcatgctccatgaaagctttcagttcctcgttgaaactgagcagggacagatnngtcatgcgcatgggaaacagaaccccgtcgagatgatctatttcatgctggacgacgcgggcatggaaattggtggcctcgcgttcgaccggctgaccgttgggcagatagccgcgataaacgatacgggaataacggggcaccgcacccgtcaggccgggaatcgacaggcagccttcccagccaagcgccagttcgtcctctaccggctcgaattccgggttgatcagcgccgtcaggggcgaaaaatcggtttccgcgccgtcttcctcgccgcgctcgcggggcgatttgaagatgatcacgcgcttgccctcatacacctgcggcgcggccaggccgacgccggacgcatcttccatggtctcgaccatgtcttccagcagacgccctacatcgcgcgacgtcggatcggcgatcgcctcggctgcctgtaaaagaacgggatggcccatgcgggcgattttgagcagtgtcatgtcgaaacgcagtcctgacgcgggttacggttgattttgcgggtatagcaccataattgagacaatggcgttaaggactttaaaatcaagtcctgtttatgctataagncgccatcaaaccggtggaaacgccggttttcgctgtttttgacaattcgtttttcgcttcancgagcgatcatacgtacccgactggagatggtttaaccgtggaagtatccgtaagagacaacgacgtcgatcaggcactgcgcgcgctgaaaaagaaaatgcagcgcgagggcattttccgggaaatgaaaatgcgccggtcctatgaaaagccgtccgagcgccgcgcccgcgaaaaggcggaagcgatccgccgcgcccgcaagctggaacgcaagcgtctggaacgcgaaggcttctgagcccgcgtcacaatacgatctgaaaggccgcttttcgcggccttttttgatgcgtagattcagggacgatttttttcgcgcacttcacttttggcgggctgcccgatgaccaatgacaacaccggccagatcgaattctggaacagcgatcacggcctcgcctgggcacgttatgccgatgcggtggatacgatgttttccgacatcaccgacgccgtgctggatgcggcggaggttggcgttggagaccgggttctcgatctgggctgcggcaatgggggcaccacgctggcggcggcngcgcgcgtcacggcgatcggcacagtcacggcgatcgacgtttccggcccgatgatcgaccgcgcccgtgaacgcgccgatgccgccgatctggtcaacgtcaccttcatactgggcgacgcggcggattatcccttcgcaggcggatccttcgacaaactnatttcccgcctcggcgtcatgtttttcgacgacccggcggacgccttcgcccggctcggnccggcgctggacaccggcgggcgtgtcgcgctgggggtgtggcgcgggccgcgcganaatccgtgggcaatggaaccggtggccgcngccaggccgttcctggacatgccgccgcggccnggaccggaagacccgggacctttttccttcgccgatccggaccgcgtacgccgcgtgctggccgactccggctggcggaatatcgatctggcgccgctggatttccatatcccnctgggacacacaatggaagacgcgctggccttcgtnatggaaatgggncccctgtcggcgccgctgggcaaagtgacgggngggaaccgcaccagggcgatagacgcgatcaccaangtgctggaagaaaacaccggcgacgacggcatcgtccgccttnccggcgcctgctggatcgttacggcgcgggcgggctgaagcccaccgttttcagcggcacgtcgcccacgaacctctccagggcatcccgcgtttcggtaagcgggatattgctgtcntcggtctcgttcacgacgatcttttcaaccggaatatcccggacgcggagcgcctccagcgccgtcagggcgtggctcaggctgccgagatagctgccgaccaccaggacgacggggatgcccagcgcccctatcagatcgcgcatggtgcgggtcgcgtcgagcggcaccatgacgccccccgccccttcgatcagcagatgcgcgcccgacgcatccgccttttcgatggcggcccggcagtagtcggcgatttcgtcgaccggaacgccccgcccctccagcgcggctgccatatccggcgacagcggcgcggcatagcgccagggcgaaacgcggtcgatggcatcgggcgatatcgtttctccgagtgcacgcagcagttttncggtatcggacccgcaggcctccgacgggtcgaacccgctgatcaccggtttcagcgcccgcaccgcctcgccgttcgcccgccagtcgcggatcatcttttcggagacntaggtcttgccgcggccggtgccgcaggaggtcacgaagatggcggccatgtcagccgtccgcggcccgcagcgctgtcccgtgatcgaccgacagcgcattgacggcgtcggccagcgccgcgacctgtgcgtcggtatgttcggcggtaaacgtaaaccgcaggcgcgacgtccc

SEQ ID NO: 1500 - DNA, 4000 bp, Escherichia coli
  misc_feature (519)..(519): n is a, c, g, or t
  misc_feature (552)..(552): n is a, c, g, or t
  misc_feature (1190)..(1190): n is a, c, g, or t
  misc_feature (2269)..(2269): n is a, c, g, or t
  misc_feature (2658)..(2658): n is a, c, g, or t
  misc_feature (3214)..(3214): n is a, c, g, or t
  misc_feature (3245)..(3245): n is a, c, g, or t
  misc_feature (3298)..(3298): n is a, c, g, or t
  misc_feature (3349)..(3349): n is a, c, g, or t
aatatgaccacatctcatggttacgctcatcccaatagagttcattgctatagaaattaagcccttgcgctgtaaggattcttacacgccctcttagttcccaacgacggtccttatcaaagtaaacagcagagtcacattgaatataacccactacatgtttcttcaaatcaaactgagtaagtaggattcctttattgaaagtccagcgcgaaggtcttctattctcattaatttcccaacgctcagtaacaatacgatatttgataacgcctgaatctgagataagtgtattgacaccatatgtagtcataaccggcacagagtcacggtcatgaatagcaggagcggtatgctcacgttcctccgaacaggaaaccatagcatagctcgctgtaaataatactaatccaataaaaaatgaataaaggcttgaacgcatattattcaaccttgaacttagcaaaccagcgctcattaaatgtgaaaccaacgttgatacggaacatattttccttnatcattcccgtaacactctggttcacccactcngcactgatattcaacatactgcgattattgtaagcattgaggattggaataccaactccaaggcttgcagaaagctcgcgtggaccgtctacaccattaatctttagataaggactggcatagctaaaacctgctcgatagtgcatacgactaaagaaaccacgatagcgttcgcccttgcagtagtcaccacctaatgtgaacttatgacgatcattgaattgtccatcaacgagattatagcttgttgtaccattgactgtggttaattgtgggtactttagcttagcccacttctgcaactgatagtcaacaccgaacttcagacggttattatgattccacatcaaaccaactccgaaagtatgaggcagttcaagagagtttgatacaacataacgagttgtatcagaaacgcttgtttgtgaatttgttgaaatcaaattacactcagcctctgtccctaaattatgtccaagagagtaagtaagacccaaggtcagctcattcttcttatctacagcataagtatattgtgcaccgaagtcaaccttgtagctttttacctgtgcagagtaattctttgacaatgtattaacataactgtcactataggtatttgtcgaattacgattcantgttccccacaagtaaccaatattcgcaccaaatgagaaacccttaaaaggctcccaaccagcacctaaataaacaagatgtaaaccaccactaccattataagcattggaatacgtagcatttacagaagatgtacttgggaaagcattgacattttgagtgttactaaagttgtaacctacatttgtataaggtaaaagaccaaagctaacacccacatgcttaaaagctctgaatgacgcaacaacgtattcaatatcagcattcttagcatttaccttgttaccattttcctcaaaattagtcaactgaaggctaacacctgcatcaaatatgaatgaaagagagtcaacagaagcgtatgaagcagggttcgcatagttcacctgattacgctcatgaaatccgtatgccaatccgttcataccacgattaaaacttgttgcctgagatgccaaagcacctaatccatactgactatatggagagttagttccgctttgagctgacacctgtactgcaagacctgcaaggaacgctgctgcaattatctttttcattcgctttctttttcttattctgacgatatgtctaaacaatatattggcgcaaagttattaaaaaaaatctatattgcagaaaaacaataaaggattttgatttttaataagctttctttgtgctctcatgcttttttactacctttgcggagaaaatgaaaaagggattattatatattgtactgactttcatcctgtctgttgttaacgctacagcgggggctcagtctatgactaatcctgatcgtattcagatatcccttttgacttgttcacctggtaaagaagtttgggcacaatatggtcataccgctattcgatattacgacaaagaaagcggagaagaccttgccatcaactatggtattttctccctcgaccaaacctactttatccctcgttttgttcttggtatgacagactatcgcatgggagttcaacctatggatatgttccttgctcaatatagttatgaagggcgaggagttgtcgaacaggttcttaatttatcagctgangataaagaggttatctataaagctttgcaggagaacatgaagcctgaaaatgtagtttatcgctacaactacttctttgacaactgtaccacaagggcacgtgatatgctcgtcaatcacctccatggaaaggttgtttatccaccagcagaagaagatgcaacgttccgttctatgatacataaatggaacaataaatatgaatggtcacaattcggagaagacctcctactcggtgtgaatgctgatcgtaagacaacaaagtctgaacagcagtttcttccagagaacttaaggagtgactttgacaaagcaagatacaacggaaagcctttagtaaaggaaactaacgtactattggatgctgaaacagaagtggcagaaccagnttttccactttctccgctatctatagcactcatatttgcagttatcagtcttgtaatgatgctctttagctatcgtagacagcaggtttattgggcgtgggacttagctttaatgcttacatcggggctcatgggaattatcttcttcgttatgattttctcacaacatccatgtgttagcttgaatttcatcctattattctttaatcctttaccattgttcttcctttatagtacaattaaaaagaagaaggtaatatggtggaaaatatggggagtccttatcattttaggacttttcggaagtttattccaagaaataccactgccaatattaattgtggcatcattcttgctattacattgtatagtacatttgcggattaataaagcggttgcaccaaccgtgagtagttcaaagaaataaaagataatgaataaatacatcaccgctttacttgtcgtacttgcggcaacaggagtcgaggcgcagagctatcagtctgcgctaaagattgcgttgggtgatgtcaacatcgaagatctttgccataancaagcgtttaagggcgttgaacaggagattntgtcagttcttgaagcctttaagcagattaaagaagacgaagaaacagagccngcacaaagcaaagcagtctttgtgacagacttatacgacaattattccatngctttaacatctcaatcaaataataatcaggaatcacaactattccttcctaatccttccttaaggactggaatcaagattcgtgcccccagtttacttcctttagcgtaataaacaatattacaaaacatagatatatagaagtaaacaaagagggagaacctctaatataaataacaaactcaattagaataaatgaatttcaataagatattaaaggcacttttcggagataagtcaacacgtgatatgaagcttatacagccatacgtagataaggtaaaggctacatatccagagattaaagcactcagcaatgacgaattgcgtgcaaagacaaaggaaatccagaagtatgtccaggatgcaggtaaggaacaacgtgagaagataaccgaacttcgtacaacaattgaagctacaccgattgaagatcgtgaagctattttcaatcaaatagataaacttgagaaagaagctcttgacaactatgagaaggctctcgatgaggttatgccagtagcattctctattgtcaaagatacagcacgtcgtttctctgagaatgaggaaacaatcgtaacagcaaccgacttcgatcgtgagttggctgcagacccttcaaaggactttatcactattgatggcgac

SEQ ID NO: 1501 - DNA, 4000 bp, Escherichia coli
  misc_feature (404)..(404): n is a, c, g, or t
  misc_feature (904)..(904): n is a, c, g, or t
  misc_feature (996)..(996): n is a, c, g, or t
  misc_feature (1179)..(1179): n is a, c, g, or t
  misc_feature (1383)..(1383): n is a, c, g, or t
  misc_feature (1386)..(1386): n is a, c, g, or t
  misc_feature (1434)..(1434): n is a, c, g, or t
  misc_feature (1485)..(1485): n is a, c, g, or t
  misc_feature (1487)..(1487): n is a, c, g, or t
  misc_feature (1617)..(1617): n is a, c, g, or t
  misc_feature (1938)..(1938): n is a, c, g, or t
  misc_feature (1943)..(1943): n is a, c, g, or t
  misc_feature (2486)..(2486): n is a, c, g, or t
  misc_feature (2552)..(2552): n is a, c, g, or t
  misc_feature (2857)..(2857): n is a, c, g, or t
  misc_feature (3076)..(3076): n is a, c, g, or t
  misc_feature (3668)..(3668): n is a, c, g, or t
  misc_feature (3775)..(3779): n is a, c, g, or t
  misc_feature (3782)..(3782): n is a, c, g, or t
  misc_feature (3785)..(3790): n is a, c, g, or t
  misc_feature (3793)..(3793): n is a, c, g, or t
  misc_feature (3795)..(3796): n is a, c, g, or t
  misc_feature (3798)..(3798): n is a, c, g, or t
  misc_feature (3803)..(3803): n is a, c, g, or t
  misc_feature (3805)..(3805): n is a, c, g, or t
  misc_feature (3863)..(3869): n is a, c, g, or t
  misc_feature (3875)..(3877): n is a, c, g, or t
  misc_feature (3880)..(3881): n is a, c, g, or t
  misc_feature (3884)..(3888): n is a, c, g, or t
  misc_feature (3892)..(3892): n is a, c, g, or t
  misc_feature (3894)..(3900): n is a, c, g, or t
  misc_feature (3903)..(3904): n is a, c, g, or t
  misc_feature (3907)..(3907): n is a, c, g, or t
  misc_feature (3909)..(3915): n is a, c, g, or t
  misc_feature (3918)..(3920): n is a, c, g, or t
  misc_feature (3924)..(3928): n is a, c, g, or t
  misc_feature (3931)..(3931): n is a, c, g, or t
  misc_feature (3934)..(3951): n is a, c, g, or t
  misc_feature (3954)..(3957): n is a, c, g, or t
  misc_feature (3960)..(3964): n is a, c, g, or t
  misc_feature (3967)..(3968): n is a, c, g, or t
  misc_feature (3971)..(3981): n is a, c, g, or t
  misc_feature (3986)..(3988): n is a, c, g, or t
  misc_feature (3991)..(4000): n is a, c, g, or t
ttacggatgccgccggagagttgaagtctccgctgattctgcaggtctccgcaggtgcacgcaagtacgcccgtcatgagtaccttgtccatctcgtcaaggcagcacttgaaatcaatgatattcccatcgcacttcacctcgaccacggcgcagattttgacatctgcaaggcgtgcatcgatggcggtttcacctccgtcatgatcgacggctcgcatctcccctacacagaaaacgtggcacttgctaagcgcgttgccgagtatgcacatgcacacggcgttgttgtcgaggcagaacttggtcagctggcaggtatcgaagacgatgtcaatgtctcggcagaagatgcttcctacacgaagccggaggaagtacaggactttgtcgagaagacgggngttgactccctcgctatcgcgatcggcacgtcgcacggcgcatttaagtttacgccggagcagtgcacgcgcaatgcggacggcgttcttgtaccgcccccgctccgctttgatattcttgaggagatcgagaagcgtatcccgggattccccatcgtgctccatggtgcgtcctctgttattccgaagtacgtcaagatcatcaacgagaacggcggtcacatgccggatgcggtcggcattcccgaggatcagctccgccgtgctgcaaagtcggccgtctgcaagatcaacatcgattccgatctgcgtcttgcgatgacggcaggcatccgcgagcacttccataaggagccgtcgcactttgacccgcgtcagtacctgtccgatggtcgtaactacatcaaggagctcgttgctcacaagatcaaggaagtcctcggctcggatggaaaggcacccgaagttcaggctctcatcgaccagaacaagtaattctncgacttaagcagtacaaaatagctcatccgtatggatgagctatttttatattgtttcatcaggaatcacagatgaattacgttcaaatcanccgcgcacggctttgacaacaacggaaagcaatttatcctcggatgaaacttcagtaaatgacagacccgcagcatcctttggcacggctcgatcacgacgattgtaccaaacagcactccagcctgcctctatcgcacctttcacatccatctcaaacgcatcaccgacatagagaagcccngccttgtccagatccatacgttcctccatcagttggaaaatacgagggtctggtttacgaaacttgtagtcacctgatacgatcgttgtctcttccggcatccattttgacagaccaagagaagctatcttttttctctgatgtgcagattcgccgttggtaatcacaccgagtttggcgcgcgaacggagctcgttgaacatncgnatcatcattggcgagagccgaatctgatactggagccccatatagacncgctgaaacgccaacgcctgcgcatccgtcgtctgaacgtcagcttcttcnancgttttttggatgcgataaatatagaattgctccatactgattttccctgtttgcgactcctcaaaccgctcatcgctgtggcgacgaaaggacagaaagagagatggcaagtcgaactcactgcgctcnccatagagtcttcgtaatgcagcatagaatggctgagccatatcatacagcgtgtcatcaacatcaaacactacgccctgtattctcataacatcctcatttcatataactcttatgactcttattcctattataagggaaaaaggaatatcgtgcaatctaggaaagcacggataaaacaaaagatgttctccaatgaaagagaacatcttctgcattgatattattttcccgccagcgtgcgtgccgcctcggcaatgtggtcagcagtcagaccgaactccttcaggagctctgccgcagggccagagtgtccgaacncatcnttgacaccgacacggcggacaggaacgggacatccttccgcaagcgcagcgcagaccgcttcgccaagtccgccgatgatgttatgctcctctaccgtgacaatcttcccgcattcacgcgctgcacgaagaacgatctctgtatcgagcggcttgatcgtcgccatattgatcacacgtgtgctgatgccctcggccgcaagacgttttcctgcctcgatcgcctccggcacgagaatccctgtggcaatgaccgcgacatccgtgccatcctgcagcacctctcctttgccaacgacaaaaggaaaatcctccgcatggtagaccggcgttgctgcacgtccgaagcggatgtagacaggaccatccatctcgtaggcagcatgcagcattttgcgcgcctccacatcatccgaagggcacatgaccgtcatgccgggaatcgtacgcatgagagcaaaatcctcacagcactgatgcgatgcaccatcttcgccgacggagatgccgccgtgcgtggcacagatcttgacgttcagatgngggtatccgatcgtattgcgcacctgctcataggcacgccccgccgcaaacatggcaaacgtcganacaaacggcacgagtcccatggtcgacagacctgcgccgacatccaccagattgcactctgcaataccgcagttgaagtgacggtcagggaacgccttcttaaagattgccgtcttggttgcaccggcaagatccgcatccagcacgacgacgttatcgtgttcttttcctaattccaccaatccgttgccgtagctctcacgggttgcaattttctttacctctgccatgctcatgcctcctcgatgctcttccgaaccgcagccaagtcctccagtccctgggcaagctcggcatcgttgggngctttgccatgccagcccgcctgattctccataaaggagacatccttgcccttgaccgtcttcatcagaatcaccgtcggtttcttgctgccctgattcgcatggaaggtgtggaatgccgacgcaagagcagtgaaatcatgtccgtcaatccactgaacggcacagccgaacgcctcgaatttcttgtccacgggggcgctattcatgacatctgcngtttttccgtcgatctgaagcccattgacatccacggcgatgcagagattgtccagtccatagtgcgcggcgaacatcgtcgcctcccagatctgtccttcggcaagctcaccgtcgccgagcagtgtgtagacgttgatgtccttgccaagatacttcgcgccctttgccatgcccgcagccgtcgaaagcccctgaccaagcgagcctgtagacatgtcgatgccgggcgtgaggttcatattcggatgcccctgcaggcgcgagccgatatgacggagggtcagcagttcctccacggggaaaaatccgcagttcgccagtgtcgcatagagccccggtgcaacgtgccccttggaaagaacaaagcggtcgcggttcggatcatgcgggtttttcggatcgacacgaatttccttcttgtagagataggtgaaatagtccgctgacgaaagtgatccacctggatgcccgcttttcgccgcatgcgtgccgcgcagaattccctcgcgcaccttcactgcaaagagccgcagctctttctgttcagccgccgtcataaaactcctcctcatccacatcaaaaaagacnataaaccatgattattctatctcattttgtgaacaactgcaagccgccaatacagcaatatcatcaaaatattactattgctttgcctttgtggtacgatactcgcnnnnnccnaannnnnnggntnngnggaangnaatacacaaatggggccattatacgaagttcgcttcttcgcataacaaccccatatannnnnnnttaaannnccnnaannnnngggngnnnnnnnggnnggngnnnnnnnttnnnaaannnnnaanggnnnnnnnnnnnnnnnnnnttnnnnttnnnnnccnnccnnnnnnnnnnnttttnnnccnnnnnnnnnn

SEQ ID NO: 1502 - DNA, 4000 bp, Escherichia coli
  misc_feature (24)..(24): n is a, c, g, or t
  misc_feature (1278)..(1278): n is a, c, g, or t
ttagagcgcattgaggtagccttngggccaacctccaatgcgtacggtagcgatgctatgggtggggtgattcatttcatgacgaagacccccatgttctcgcaaaaaaggcagttgcatggccaggcctatgccaaatacagcaccgcacttcagagttgggtgaagcatgcggagcttacaggtacatctttgcactggggatttttcacttcgttaacggaatccaattttggggaacttcgtggcggacgacgcatcaacccattttacggtgaattgtatggcatgcgcgaggtgtatgccgtccgaactttatcgggggattccctggtggcaaacccagagccgtggattcaaaaggggagtgggtacacccaatacgactttgttcagaaagtgctgtatcgtgcgcgttccgaccgccgaaacaccctaaatattcagggctctacctccagcaatattccccgctacgatcgaatgaccgatcccagttccaccacagggcttaaatatggagattggtactatggaccccaaaagcgcttgatggcgagcttcaaacatgaggcattggacgtcttaggttttgatggcgtaagtgtgacggtgtaccaccagaatgtagaggaaagccgcatgactcgaaaattcaatcgctccagtcttcagcaacgcgtggagaatgtcatggtaaacggttttaactcagacgcaatgaagcgctggggtaacaataccttgcgtgcgggcgtcgatggatggtatcaaaccgttcagtcgagaggtatggagtccgatgtatttaacggtggaccagaaacccctattgattcgcgctatcccggtggacggaatgaaatgtattcacttgcggcatttgccacccacattaaccgtgtgacggatgaagtgaccatcacagagggttttcgcgtaggcaattcggtgttgtttagcgagttcacggataaaacatatttcccctttccttttgaatacatctaccagcggatgccggtcgcttcagggagcatagggttgatctacaacccaaatgagggcaacaaatattctttcaccgtttcaacggcctaccgtgtacccaacattgatgacctttccaaggtttttgaaatggctccaggcatgctgatagtgcccaacccgcacttgcgtcccgaacaggctttcactgcggaacttgggaacatccgaattttcaaagccggccacagcctggaatggaacctgtatacgacctcgttgaccgangccctaatggtacagcccttccgtgtagatggttcggattctgtcttctatgacggcgccatggtaggcgtttatgcccagcaaaacgtgcagagggcggtcattatggggtactccattcgtggtaacgtggttctgagcggtccttggacgatgaatggcgtgctgcaggggacacaggggatgttgggatatccgatcatggggaacctggaccacattcctccagtttcaggcaggcttgccctgaactggcagcacaaagcctggtcttgggaattctttggtttaggcaatggatggaagcacatcaaagcatatcaactaaacggtgaggacaatgagcaatatgccacacctgagggaatgcctgcttgggtgacctggaatagctccttgacctttgccagtaaacagggcttgtccatgcaattaggggtctacaaccttttggatacgcagtaccgaacctttgcctctgggatcaacgctcctggtcgaaacattcaaacggccctgcgctacaccttctaggccttctcctgtgtacctttaggggaaacccaaggtatccatgaagaaattcttgcctcttttcgccttttggctgctgttggcctgcgaatcgcccgagctcacggaagccgtttcattggattcgctggtgcctcttccctcaaggatggatgttcccgacgatagaggctttaccgcggttcaaggctccgtccggtttgttggaattccagaagatgactttgccgaaatggaggaatggccgcagtcagcggatggcttacctatcatttggaggaaagaggaaggcgatgccctgagtcttcaagggtattggctcgatatttctgccgattctgtggtcattctcgcagctggagatgcaggggtgcatgcggccttatccaccttaaagcaattagtgcccacctcccattggcctgaaaaaaagggggatccaattcggcttggatttgcatggccccaagtgcatatagaggatgaacctgcctttgaataccgaggtatgcacttggatgtgtgccgccactttatgcccattgaatttatcgagaagtacctagataaccttgcattgcacaagttcaaccggtttcactggcaccttacagaggaccaaggctggcgtattgaaatcaagaaatacccaaagttgacggaggtaggagcttggcgttcagcgtcgcaaaccggtgcctacagcgagcagcgtttcgacagcacgcgttatggtgggttttacacccaagaagaagcgcgtcacatagtggactatgcccgccgacgcggaattacggtgattccagaaatcgaaatgccgggtcactctttagctgcattggcggcttaccctgagctatcctgtaccggaggtcccattgaagtggctcatggatggggagtctttgacgatgtgtattgcgcagggaacccagaggtgtacacttttttagaaggcgttttggacgaagtcatggatatcttcccgtcgcctttgattcatatcggtggcgatgagtgcccaaaaacccgatgggagtcctgttccaagtgccagctggagatggagcgaaacaaactcaaggacgaacacgcgcttcaatctcatttcatcacccgaatggaacgctatctcaatgcccatggtcgaaacatcattggctgggacgaaatcctagaaggcgggttggccccaaatgccgcggtgatgtcttggcgtggcacggcaggaggcatacaagctgcctccatggagcacgaggtggtcatgacccctggcaagccgctctattttgaccattaccagtttaacccaggcgaagagccggtagccattggggggttcaattccttgatggatgtctatgcattcaatccagttgccggcgtgccggccgaataccaccggtacatcttaggcgctcaagccaatgtgtggaccgaatacatggaaacctcggaccatgtcgagcacatggttcagccacgcgcttcggctttgtcggaagttttgtggcttgggggaaagcgccccggtgaagatgcggccttccgacaagcgatggactaccacatccaacgcctccaggccatgggctggaagtacgcaccctatgaattcaaaaaaatagccaccgatgaagcgcagtgattttcttaagattgtaggaggtggggcggccatgacggccatactgccctcaaccctacgcgcgaaggatgccgcacgctctaacgagtatatagaacccgtttccatcgctacctggcgctttggcttggagaccacggccgaggccatgaaggtcttacgtgctggcggatctgccctggatgccacggaagccggggtgaagctttgtgaggcggaccccaaggagcgttccgtgggattgggtgggcgtccagaccgcgatggatttgttaccctggattcatgctgtatggaccacttgggcaacatcggatcggtggccgcagtcgagaacgtggtgcacgtgagctcgttggctcgggccgtgatggaaaagaccccacacgtgatgcttgtgggggagggcgcacgccagtttgcccaagaaatgggctttccactccaagatctaatggtaccggattccaaacgcgaatgggagaaatggcgggagaaatcggactaccagcccatcgtaaacattgaaaacca

SEQ ID NO: 1503 - DNA, 4000 bp, Escherichia coli
  misc_feature (2)..(2): n is a, c, g, or t
  misc_feature (28)..(29): n is a, c, g, or t
  misc_feature (115)..(115): n is a, c, g, or t
  misc_feature (214)..(214): n is a, c, g, or t
  misc_feature (316)..(316): n is a, c, g, or t
  misc_feature (778)..(778): n is a, c, g, or t
  misc_feature (964)..(964): n is a, c, g, or t
  misc_feature (3011)..(3011): n is a, c, g, or t
  misc_feature (3028)..(3028): n is a, c, g, or t
  misc_feature (3176)..(3176): n is a, c, g, or t
cntgagaatctgctcttttatttcttcnntccaaggtgaaattatttagaaagcattgtgcgaatatacataataaagttcgctcaattcatccatttttttactcatcaagacntgcaaatccgaagccgtgtcatagtcttcttccgacaaggcccgtttgatttgcgtaaagagagacaaattcttatccgtatctctccccagttcagtncgcaaagcattaatttgctgccaccgttcttcttccaaaggattcgcatcgctatctaaatgcaatgccttagcattaattaccctttccagattatcaggnacaatacggtactgaagttcaagagcccaccgtttcaaagctccttctcggaaggaatccataacacgtcttgcaaagttatcgcaagccagggtttccagtttatggggatatacttcccatgacttgaaattttcccaaaccgtcgccggagccttgccgaacatagtattgcgttcttcttccgtgaaggcttcaaacacatccacttccgaacgataagcacgatccgcagccaggtagtctgccttatctcccaccttcttggaaatttcagccaataattcagccggtgcttttttattcttcaaagcataacgaatgccgtccaaggctgccaagtagaagagagcaatagcgatataagtattggtaaacggattgggagcccgcatttccacacgcgtcgcattagggcttgctacgttacgaatcaagccggccaaaacggaacgatttcgngtcggcacgtcggggctttcaccgcccaaagaggttacaatgcagaccggtgcttcaaatcccggtttcaaacgattcaacgaatccgtcgtagacgatacaaaaggattaatgacttcataatgtttaagaatacccattaaggccccataccctacagatgaaaggaactctttcatcatgtcntccggattgaacaggttaacgtacttaccgtttttcataatggcgcctataccgatatgggtatgttcaccgctaccggcaacccccgatatcggtttggccttaaaggtgacttccaagccgttttcacgaaaggcttcgcgaataataatacgggcctgaatttcgttatctgctgtctgaacaggatcggacgagaacttccagtctacttccagctgttcaagaacgaagataagtttacccgaatcatcaatatgagccttaataccgcctacttccttgtgccccatttccggctcaaggccgtatttttcaaggcgttcaactgcctgttccaaggccgtgcgtacaacaccgtgtgtccgttgccaatattgttcctgcaatttttgcgatgtggacaaaaggcgagaagccacgtcctgactgggcgacttaacccaaaactccaattccgtagctgtcgtaagtaccagtttctctatatcatttacattgatattcaacccgggaacaccgtattccttaaccagcttgagaacttcatcgcctacatagtcggtcgtattgcgcaaaatagatcgggaatctataaagcccgtagcatgttcaaggaaactcggtatacgcaaagtccctacaggctttccagtagcttcatctatatttccgtcgttatagtcaacaaaccagttaacgcccggatccgccttaatatctacacgagcattgtctaaggtggcaatccccggcaggactacggaagaaccgtccgtctggaaggccgagccgtcaaagaaactttcatagtcgtcaaagaagacggagatagggatcttttcatccgtatcattgcccgccaaatcgacacctaccaaagatacgaatttaatttccggatgttgttccaaaagtgccagaatgccttcttttccgtactgcccggcagggattacataaagcaagttttccgtattcatactgttcctccttagaactaaaaaactccgcacctctaccggtgcggagtcccctttgactcggtcatattcttttgtccgaattacagttacattatatgagtaaccgactcgtctgtcaactcgacgatataaaatctatctgctttgcagagttttctttaccgcatcggaaatgacctttccgtcagccttgccttgaagctgcggcataaccgccttcatgacatcacccatttttaaagcaccttcgcccataccggccactatgtcggaaacaattttaaacacttcttccgacgacagctgagcaggcatgtatttttcgagaactgcaatttccgcacgaacttgtgcagctaaatcttcccgaccgcctttgacaaagtcttccagcgattctttgcgttgcttcatttctttggcgatgaccttgcttacaccggcgtcatcgagctcgcactttccgtcgatttccacgttcttgatggaagaacgtactgagcgaataacggcaagttcaatcttgcccgcttcttttttcttcatcgccgacttcatgtcctgcgataattcttcctttaaagacactgtatcaaccttctcggattatgctttaaatttacgtttacgtgccgcttcggactttttctttctccgtacgctgggtttttcataatgttcgcgtttacggacttcggaaagaacacctgccttttggcaagagcgcttgaaacgacgcaatgcgctgtccaaagtttcatttttaccaactctgatttctgccattctgtatccctccctccaaaattatcgttagggagtgctgttttgcacacatgaaaattatacttaaaaagcgtcgttttgtcaattacatgcccttttatcctatgcaaaaacattctctcgtgttttatctcaaaaagcggctgaacacatagtttccataaagaagcccctggcttgtaaggcaatatccccactcggtcttttccaggaaacctcgcagtaccaaatcctctattaccgtgccgaaagcatctgtcaccgttctcttaaancactgctcaaaccgttnattatcaattcctttcatggttctcagccctaaaaaacaaaagtcttcttctcctctttccttgccgattagttcatgttctgccaggaccgatgtttttcctgcattttttatatattccggcaaagaacgtatatttgaaaaacgntaggtgccgtcaaaggagtggctcgaagcgccgaacccgatatacggctcatactgccaatacttaagattatgctttgattgaaaaccctccgccgcataggctgaaatttcataacgcttcaagccgcccttctccagagtatgacataccctttctccggcttcttccgtaacacgatcttccggaaggaggatttcccctttccggacaagacgcttcagcatcgtaccttcttcaacaataagactgtatgccgaagcgtgtgtaacacccagttcgattaagatacgggcatcggtctcggcgtcctcgggtgattgtcccggcaggccgtaaatgaggtctgccgatacattcgtcacaccgcctgtacgtacggcttccaaggccgcaaaggcttccgccgacgtatgaaccctccttaacaattgcaacaatcgatcgtcaaaggactggattcccatgctgattctattaacgccaatttttacaagatcgcatatataatcggacttaattccgtccggatttacttcaaacgtaatttcgctatctgcgtctatccgaaaggtatctgtcagtgccgacattattttttcgccttgccgtgccgtcaaaagcgagggagtaccgccgccgaaatagacggtatccgccgcctccccaatgtatgaagttgcgcgtatttctcgacacagggcctctacatagtcatctaaatacgacgaaatgcctccgtacgacggaaagtcgcagtagaggcacttacgtacgcaaaaaggaatatgaacatacaggcccgtcatcagttatcatccacc

SEQ ID NO: 1504 - DNA, 4000 bp, Escherichia coli
  misc_feature (144)..(144): n is a, c, g, or t
  misc_feature (193)..(193): n is a, c, g, or t
  misc_feature (208)..(208): n is a, c, g, or t
  misc_feature (259)..(259): n is a, c, g, or t
  misc_feature (262)..(262): n is a, c, g, or t
  misc_feature (366)..(366): n is a, c, g, or t
  misc_feature (385)..(385): n is a, c, g, or t
  misc_feature (1171)..(1171): n is a, c, g, or t
  misc_feature (1725)..(1725): n is a, c, g, or t
  misc_feature (1785)..(1785): n is a, c, g, or t
  misc_feature (1987)..(1987): n is a, c, g, or t
taaccataaaaacaattaaaaaaaaacttaattttttcatgaattttcaattgttggtattcttatattctcaactaaatcttgaacctcttttgaaggttctttagttaaatggcaaacagttaatgaaactacaaaattaantaacattgcaaatgttccgaagccttcaggcgatattccaaaccaccantctgcttcagttccnccaccaaaccatccaaatttaaattttgtcatataaaaaagcattaaaagnagnccagtaatcattccagaaatcgctccttctttgttcattcttttgtaaaaaatacccatgactatagcaggaaaaaatgaagctgcagccagaccaaaagctanagccacaactgctgctacnaatcctggtggatttattccgaaatatccagctaataaaactgcaaaaaatgcagaaactctagctgcaatcaattctcctttttcactaacatcgggttttataatttttttaataagatcatgagatacagatgaagaaataactagcagtaatccagcagctgtagaaagtgctgctgctagagcaccagctgcaagtaatgctatcacccagtttggaagttcagcaatttctggatttgccataaccattatgtctctgtcaattgttaactcatttaattgtgggtctgcaacatattgaataaggccatcgtcatttttatctgtaaaagttaaaagcccagttttttcccaattttcaaaccacactggcatttcatcatattttttttcactaaccgtttcaattaaattagttctagcaaaaactgcaattgcaggtgcagtagtgtataaaatcgctataaataaaagagcccaacctgcagattttcttgcatcgctaactttttttactgtaaaaaacctaacaataacatgaggaagaccagctgttccaatcattagagctgctgtgatgaaaaacacatcaagtttagattttgatccagttgtatattcgtgaaaccctaagtccctacttaatccgtctaatttttctaaaagataaactccatctgtccctatagatccaaaacctaattgaggaattggatttccggtcatttgcatcgaaataaaaatagcaggcaccataaaggcaaatattagaacacaatantgagctacttgtgtgtatgtaattcctttcatccctcctaaaacagcataaaataaaacaattgccattccaatgacaacaccagtatttatatcaacttctaaatatctcgaaaagacaagtccaacacctctcatttgacctgcaacatatgtgaaagaaattataagcgcacaaaagaccgcaacaagtcttgctgtatcagagtaatatctatctccaataaaatcaggaacagtaaattttccaaattttcttaaatacggagccaacaataaagctaataaaacatatcccccagtccatcccataagatatactgaaccgtcataacccataaaagatatcaaccctgccattgaaataaatgatgctgctgacatccagtctgcagcagttgccattccatttgctattggagatacaccagagcctgctacataaaattcttttgttgatccagcctttgaccaaatggcaatgcctatatataacgaaaaagttataccaatcattaaccatatccatagttgtaaatccataattattttttngaatgatatttcttatctagtctgttcataagaccaatataaataaatattaacgttacnaaaacgtaaatagaaccttgttgagcaaaccagaatccaagtttaaatccaccaatttttatttgatttaattcatcaattaatattataccaaatccaaaggaaacggtaaaccaaattgataaaagaattaatagatatttaagattttttttccagtactcttctgctaaatttttactcataataatagttgttgttnactctaatttaaaaaaattaatctctaagtttgtcttaaaaaggattaaagccttaatttatattattaatcatttaatttaatggattaaataattcttgttattaaatattgaccctatctaatgaaaaaaatagtcttctttttaattttatgtttaaatttttcttgtaataatttagaaaaaaaacaaagtaaagttgaaattccaactggaatgattttcatacagggaggtgaatttttgatgggagctgataataaacaagcgatgagagatgaatatcctcaacataaagttttgatcaattcttttttaatggacgaaaccgaagttactaatgctgactttaaaaaattcatagaatctactggctatttgactactgctgaaagaaaaatagattgggatgacttaaaaaaatatttaccgcctaatactccaaaacctcacgacagtttgttagcaccttcctctcttgttttttttgagtcacaaacgaaaaatttaaatgatttttctcaatggtggaaacttcaaaaagaagttaactggaagcatccttatggcaaagaaagtactattgatacaattttagatcatcctgttattcatgttagctgggacgacgctgtagcttattgtaattggaaaggaagaagattgccaactgaagctgaatatgaatatgcaatgagatcaggtaattcaaatactatttatacctggggaaatgagccagtcggaactggtacacaaaaagctaatatttggcaaggaaattttccttcaaataatatttcatccgatgaattttattatacttcacctgtaaaatcatttgaaaaaaatgattttggtttatatgatatttctggaaatgtttgggaatggtgttctgatttatatcacagcgattattattcaactatttcaaatgggttggcaaacaatcctaaaggaccaataaaaagctatgatcctaatgatccatttagttctaaaagagtgatgagaggaggaagttttctttgtaacgactcttattgtagtggctttagaaattcaatgagaatgaaaagcacacctgatagtagttcgcaacacgttgggtttagaacagtcttagatatataataaaacaaaaatgctcagctttaggaaactgagcattttaacaacaactaaccaaaaatattatgtgttaattattttacattaatcgtgccaaactttttaatcattaaaatatttcattataattaaaaactgttttatagccttttttgttaaaataatttttagaattaattggtccagcagctaaaacaaaatcccctccccatgctcctaagctttttatttcgccattataatctttaaaatatttattttttactgtttcggtttttaaagtttttgaaattatagtttcatgctctattatacaattttgaaaatttaatagtgtttgtgaatttacaaactccattgtaagattagacaatatgttaatagttgaattagtgatttttcttttagaaaacttatctatttctgtattactatcctgttttttatttaggtaaataaaaaatagattattaatatatttaggattgaatttaactggattaactattgggatattattttttagctgatataaaactggtccttttgccaatgcgcatgctatgtcgtaaccacttcctttataattggtccacaataattcaaatggatcaatattagcccattttgaaatattattaattaaagttgatgaagttccaagcccccattttctagaaaaattaagatgagttgataccaaacctccagtgtttttctttaaaaattctgaatttattttgttagcagaaattaataaagactgtagtgttttgctaaatttatttatgttttttgtaatccttaagtcagaaagatcaaattcgcaactcagccaaacttcattttttctatcataacttttccattctagttta

SEQ ID NO: 1505 - DNA, 4000 bp, Escherichia coli
  misc_feature (369)..(369): n is a, c, g, or t
  misc_feature (869)..(869): n is a, c, g, or t
  misc_feature (1202)..(1202): n is a, c, g, or t
  misc_feature (1284)..(1284): n is a, c, g, or t
  misc_feature (1451)..(1451): n is a, c, g, or t
  misc_feature (1475)..(1475): n is a, c, g, or t
  misc_feature (2409)..(2409): n is a, c, g, or t
  misc_feature (2698)..(2698): n is a, c, g, or t
  misc_feature (3081)..(3081): n is a, c, g, or t
  misc_feature (3601)..(3601): n is a, c, g, or t
  misc_feature (3999)..(3999): n is a, c, g, or t
gcttcgatcaggctaaggcgtgaaccggcggcgctggtcaatccggcaagaacatcggcggcgcggcgatctttttcaatggcgatcacatgatcggcaccttcaagaagcagggcgcgggttaatccgcccggacccgggccaatctcgatcgttgttcccgataaagtgccagccgaacgcgcaatcctgcgagtcagattcaggtcaaacaggaaattctgcccaagcgatttccgcgcgcgcatatccattgaatcaacaagctggcgcaagggctgtaaagcctcgatccgctcgaccatctgttgcttatcagtcatctattccaatcattgatccatttatccggatcatcttgtgctgggngtaatcgggcattaacccgccttctggttctggcggttatccgcgaaattgcgcgccattttgattgccgcgatcaggctgtcagcacgggcaatgccgcggccggcaatatcaagtccagtgccgtgatctggcgatgttcggatgaaatcaaggccaagtgtcacattaactccaccaaaaaaatcaattgttttcagtggaataagaacttgatcatgatacatgcccaaaaccgcatcataggttttgcgcgcttcgctgtgaaataaagtatcggctggatgcggtcctgtcgcattgattcccgcggcctgaagcttggtaatcgcaggtaggataatttgggtgtcttcattccccatattgccgttttcaccagcatgcgggttgaggccacaaaccgcaatatgcggattagcaatgccgaaattggcctttagacaggcatgaagcagctggcatttttcgatgatcagcgctgttgaaatggcggcggnaactttgtttagcgcgatatggatggtcgcaggcacaacccgcaattcatcacaagcaagcatcataagcggcgcaccagcaacaggttttgataggctggcgagaaattcagtatggccaggataggcaaagccagcatcataaaggcttgatttctgtatggggttggtcacgatcccggcggcggttcctgattggctccaaaacgcggcttgccgtatggcgtcgatgacctgcggcgcgttagccggatcaggggtgccagcaacgggcgttgttttccatgaaacggggatgacatgcagatcttggctggtgctgtcaaaagacgncggatcgttaatttcccgaatcttggcggtgatgccaagtgacgctgccatttgcgcgatttgcgctggctgttcaatcagncaaatatcgctgatcccaccttgccatgcttttagcgcaatttcagacccaatacctgcaggttcgccgggggtgataagcaaagggcggtttgtcatcggattatgaattggtttcgataattgctgaacgacgcagccgcagcagatagcgttcggcaagcgatncgaaaatcttgtcaaattcaaccngcaatacctcgtcacgtggcggcagggtgatttttggcgatatgcgatcgcacagcatgaaaacactgatgccttcagtgaatgacaggggcttgcttggaacgccggctttcaggtcattgaccaaagcctgcaaggggcggttgaaagagccaaggttgatattcttgattaacccttgaatgcctgaaccatagctttggttcagcgctacaagaccgtcacagctattaatcgatgcggtgtctcgctcaagctttgctgcagcttccagcttgtcagcattgctggcatccttagcaagcggataaaccgcccgtgcaagggtgatcatatcctgacttggatcggcaacgccatcctgacgacggccttcattgcgaatcaaaataaccagcccatcacgttgaattggtgcgctgaccgcgccaatcttggtcattttcacctgatcttgaatatcatcaggcaattgatcaagcataacccagccaagctggccgccatttgtggtggctcctgatgcggaatattgtttggcaatggcgttgaagttagcgccgttattcactgccttgataatttcattggccagaacaagggtgcggtcaagcgggcgatttggttcgggaagaagaatgatttcgcttagcttgacttgtggctgtcttgcgttggcttcgatgcggctaagcgccttgtcgacaatcgtgtctaattcagcaaatttggtttgaaatttgaaccggatgacctcgccccatacgatatcggtgatgaatttttgttggatattgctgctatcaataccttgttcgcgcagactttgcgaaccggtcttgccatttgccgcaaaattctcgtcaaccagcttgcgggcggtttcacggcttctttgggcaagggtcgggtcaagcgcagcggcggcatccantttcaagatttcgtcaatcagcatctgggttgcatcttgtttgatctgggcgcgattttccacggtatcttccagattcgttaccatgcgtaaaaaggcggcgcgctggtcaacctgataattagtaatggccttgccatttaccttggcaacaatttccagcgcagcattggcttgcgacatgccggtgcccagcataaatagcacgcaaaaggcagacatcaggtttgtttttttcagcatcgcaatcatggtttctaatttgtccaagacgttacagattgagggnggcaaagcccgccggatcgcatcaatttttaccactataaatcagctttcatcggttcgggcaaggataatggcaccaatcaaagagatggcaattgccggtgtccaggccgcaaccgacattggcacttgcaaggatgatcccaaaatttgcatgaaatagctgaagatgaaaatcacaattgccagaaacgcgccgcgcagaaacaaccggcttcgccgaccgcgcgaaacattggtcaaggtcacgcgcgctgcaagcatggcaatgccaatcatcaataatggcactgatagggtcttataaaggtgaaaccgatattcgcttgccggaattcctgcccgttcaagcgcgtcgataaagcccggtaacagatagaccgnaattgattgggggcgaaggccggattgtcgcagatcaagtgcatcaagtccggttggtaaaagcaaattgccaagatcggtcttttgcccatcggtctgccatcgtgacgcccgatccagcatccagcccttatcggtcaattgcatgctgctggctttatacagcgctttcatgtggatattgtcatggtagagataaatgaccggattaataatgcttgccgtttcggcatttaaggcgtcaccgcgaataatcaattttccgctttccagcttatcgcgaagccatatcccactggttgagaccgaaaaattactgtctgattcaccaaaaactttggccatttgcgcctcatggcgtttcgatgtaacggctccgatggggttgattacggtgacaagaagcatgccgatgataaaggctgaaaacagcgctggccctaaagcggcccagaccgattgaccgaaaccacgaaccgcaacaaattcattactgcggttccatgatgaaaaacacagnatcgcccctgccaacatggcaaagggcaggatcatttcaatgaccgctggcaagtttaacagcgccattttgaggaaattaatatcgggcgggggagatgttaaaacacttacgcggcggacaagttcgaccgtttgaattaggctgatgatcgaggcgaggccgagaaggcaaagcgtgatccagccgacaaaacgcaaggcgaaatagcgaaacagggttccaaatggcgcaaattggctcatgtcagcgcctcattttgccctgttgcatcgatcgtttcacgcggttggcgaagcagccaaaatgcgatgatgattggcgctaaaacgcttagatggataaagggccaaagattggcattattggttacccagccgcgcgatatcaccacggcna

SEQ ID NO: 1506 - DNA, 4000 bp, Escherichia coli
  misc_feature (1)..(2): n is a, c, g, or t
  misc_feature (6)..(6): n is a, c, g, or t
  misc_feature (10)..(15): n is a, c, g, or t
  misc_feature (19)..(20): n is a, c, g, or t
  misc_feature (22)..(27): n is a, c, g, or t
  misc_feature (29)..(30): n is a, c, g, or t
  misc_feature (34)..(35): n is a, c, g, or t
  misc_feature (37)..(37): n is a, c, g, or t
  misc_feature (40)..(40): n is a, c, g, or t
  misc_feature (42)..(43): n is a, c, g, or t
  misc_feature (46)..(48): n is a, c, g, or t
  misc_feature (51)..(51): n is a, c, g, or t
  misc_feature (54)..(59): n is a, c, g, or t
  misc_feature (61)..(64): n is a, c, g, or t
  misc_feature (68)..(68): n is a, c, g, or t
  misc_feature (70)..(70): n is a, c, g, or t
  misc_feature (72)..(76): n is a, c, g, or t
  misc_feature (78)..(78): n is a, c, g, or t
  misc_feature (80)..(83): n is a, c, g, or t
  misc_feature (85)..(87): n is a, c, g, or t
  misc_feature (89)..(91): n is a, c, g, or t
  misc_feature (94)..(94): n is a, c, g, or t
  misc_feature (96)..(98): n is a, c, g, or t
  misc_feature (100)..(101): n is a, c, g, or t
  misc_feature (105)..(105): n is a, c, g, or t
  misc_feature (109)..(109): n is a, c, g, or t
  misc_feature (111)..(112): n is a, c, g, or t
  misc_feature (114)..(115): n is a, c, g, or t
  misc_feature (120)..(121): n is a, c, g, or t
  misc_feature (123)..(123): n is a, c, g, or t
  misc_feature (127)..(127): n is a, c, g, or t
  misc_feature (130)..(133): n is a, c, g, or t
  misc_feature (136)..(137): n is a, c, g, or t
  misc_feature (140)..(140): n is a, c, g, or t
  misc_feature (142)..(142): n is a, c, g, or t
  misc_feature (144)..(147): n is a, c, g, or t
  misc_feature (154)..(155): n is a, c, g, or t
  misc_feature (157)..(157): n is a, c, g, or t
  misc_feature (159)..(159): n is a, c, g, or t
  misc_feature (161)..(161): n is a, c, g, or t
  misc_feature (163)..(163): n is a, c, g, or t
  misc_feature (166)..(170): n is a, c, g, or t
  misc_feature (172)..(172): n is a, c, g, or t
  misc_feature (174)..(176): n is a, c, g, or t
  misc_feature (181)..(183): n is a, c, g, or t
  misc_feature (186)..(189): n is a, c, g, or t
  misc_feature (191)..(195): n is a, c, g, or t
  misc_feature (197)..(198): n is a, c, g, or t
  misc_feature (200)..(200): n is a, c, g, or t
  misc_feature (202)..(203): n is a, c, g, or t
  misc_feature (205)..(205): n is a, c, g, or t
  misc_feature (213)..(213): n is a, c, g, or t
  misc_feature (217)..(217): n is a, c, g, or t
  misc_feature (451)..(451): n is a, c, g, or t
  misc_feature (530)..(530): n is a, c, g, or t
  misc_feature (971)..(971): n is a, c, g, or t
  misc_feature (1083)..(1083): n is a, c, g, or t
  misc_feature (1115)..(1115): n is a, c, g, or t
  misc_feature (1163)..(1163): n is a, c, g, or t
  misc_feature (1655)..(1655): n is a, c, g, or t
  misc_feature (1667)..(1667): n is a, c, g, or t
  misc_feature (1784)..(1784): n is a, c, g, or t
  misc_feature (1991)..(1991): n is a, c, g, or t
  misc_feature (2350)..(2350): n is a, c, g, or t
  misc_feature (2502)..(2502): n is a, c, g, or t
  misc_feature (2743)..(2743): n is a, c, g, or t
  misc_feature (2955)..(2955): n is a, c, g, or t
  misc_feature (3027)..(3027): n is a, c, g, or t
  misc_feature (3078)..(3078): n is a, c, g, or t
  misc_feature (3093)..(3093): n is a, c, g, or t
  misc_feature (3126)..(3127): n is a, c, g, or t
  misc_feature (3130)..(3130): n is a, c, g, or t
  misc_feature (3134)..(3134): n is a, c, g, or t
  misc_feature (3138)..(3138): n is a, c, g, or t
  misc_feature (3140)..(3140): n is a, c, g, or t
  misc_feature (3155)..(3155): n is a, c, g, or t
  misc_feature (3202)..(3206): n is a, c, g, or t
  misc_feature (3208)..(3208): n is a, c, g, or t
  misc_feature (3211)..(3211): n is a, c, g, or t
  misc_feature (3213)..(3215): n is a, c, g, or t
  misc_feature (3217)..(3219): n is a, c, g, or t
  misc_feature (3221)..(3224): n is a, c, g, or t
  misc_feature (3226)..(3226): n is a, c, g, or t
  misc_feature (3229)..(3234): n is a, c, g, or t
  misc_feature (3236)..(3237): n is a, c, g, or t
  misc_feature (3241)..(3241): n is a, c, g, or t
  misc_feature (3243)..(3247): n is a, c, g, or t
  misc_feature (3249)..(3253): n is a, c, g, or t
  misc_feature (3255)..(3260): n is a, c, g, or t
  misc_feature (3262)..(3262): n is a, c, g, or t
  misc_feature (3264)..(3264): n is a, c, g, or t
  misc_feature (3266)..(3268): n is a, c, g, or t
  misc_feature (3270)..(3274): n is a, c, g, or t
  misc_feature (3276)..(3279): n is a, c, g, or t
  misc_feature (3284)..(3284): n is a, c, g, or t
  misc_feature (3286)..(3288): n is a, c, g, or t
  misc_feature (3290)..(3290): n is a, c, g, or t
  misc_feature (3292)..(3301): n is a, c, g, or t
  misc_feature (3303)..(3304): n is a, c, g, or t
  misc_feature (3306)..(3307): n is a, c, g, or t
  misc_feature (3309)..(3330): n is a, c, g, or t
  misc_feature (3332)..(3333): n is a, c, g, or t
  misc_feature (3335)..(3339): n is a, c, g, or t
  misc_feature (3341)..(3341): n is a, c, g, or t
  misc_feature (3344)..(3352): n is a, c, g, or t
  misc_feature (3354)..(3355): n is a, c, g, or t
  misc_feature (3357)..(3357): n is a, c, g, or t
  misc_feature (3359)..(3364): n is a, c, g, or t
  misc_feature (3368)..(3375): n is a, c, g, or t
  misc_feature (3377)..(3377): n is a, c, g, or t
  misc_feature (3381)..(3382): n is a, c, g, or t
  misc_feature (3384)..(3384): n is a, c, g, or t
  misc_feature (3387)..(3389): n is a, c, g, or t
  misc_feature (3392)..(3396): n is a, c, g, or t
  misc_feature (3398)..(3401): n is a, c, g, or t
  misc_feature (3403)..(3406): n is a, c, g, or t
  misc_feature (3409)..(3410): n is a, c, g, or t
  misc_feature (3412)..(3413): n is a, c, g, or t
  misc_feature (3415)..(3418): n is a, c, g, or t
  misc_feature (3421)..(3421): n is a, c, g, or t
  misc_feature (3423)..(3429): n is a, c, g, or t
  misc_feature (3432)..(3437): n is a, c, g, or t
  misc_feature (3442)..(3448): n is a, c, g, or t
  misc_feature (3450)..(3450): n is a, c, g, or t
  misc_feature (3453)..(3459): n is a, c, g, or t
  misc_feature (3461)..(3462): n is a, c, g, or t
  misc_feature (3465)..(3467): n is a, c, g, or t
  misc_feature (3469)..(3470): n is a, c, g, or t
  misc_feature (3472)..(3473): n is a, c, g, or t
  misc_feature (3476)..(3476): n is a, c, g, or t
  misc_feature (3478)..(3478): n is a, c, g, or t
  misc_feature (3482)..(3482): n is a, c, g, or t
  misc_feature (3484)..(3488): n is a, c, g, or t
  misc_feature (3490)..(3496): n is a, c, g, or t
  misc_feature (3498)..(3499): n is a, c, g, or t
  misc_feature (3501)..(3504): n is a, c, g, or t
  misc_feature (3507)..(3507): n is a, c, g, or t
  misc_feature (3510)..(3513): n is a, c, g, or t
  misc_feature (3515)..(3517): n is a, c, g, or t
  misc_feature (3519)..(3519): n is a, c, g, or t
  misc_feature (3521)..(3525): n is a, c, g, or t
  misc_feature (3528)..(3528): n is a, c, g, or t
  misc_feature (3530)..(3538): n is a, c, g, or t
  misc_feature (3540)..(3549): n is a, c, g, or t
  misc_feature (3551)..(3552): n is a, c, g, or t
  misc_feature (3554)..(3559): n is a, c, g, or t
  misc_feature (3561)..(3562): n is a, c, g, or t
  misc_feature (3566)..(3570): n is a, c, g, or t
  misc_feature (3572)..(3577): n is a, c, g, or t
  misc_feature (3580)..(3582): n is a, c, g, or t
  misc_feature (3585)..(3585): n is a, c, g, or t
  misc_feature (3587)..(3591): n is a, c, g, or t
  misc_feature (3593)..(3601): n is a, c, g, or t
  misc_feature (3603)..(3605): n is a, c, g, or t
  misc_feature (3607)..(3612): n is a, c, g, or t
  misc_feature (3615)..(3616): n is a, c, g, or t
  misc_feature (3618)..(3623): n is a, c, g, or t
  misc_feature (3625)..(3625): n is a, c, g, or t
  misc_feature (3627)..(3628): n is a, c, g, or t
  misc_feature (3630)..(3630): n is a, c, g, or t
  misc_feature (3633)..(3637): n is a, c, g, or t
nnggcnagcnnnnnnccgnngnnnnnngnngggnncngcncnncgnnnccnggnnnnnngnnnncccncngnnnnngncnnnncnnnannncgncnnngnncgcntccncnncnngcccnntncgcngcnnnncgnnctncncnnnncgccccnncngntncnggnnnnncngnnncggcnnnccnnnncnnnnncnncngnngnctgagcanccgngtggcctgcccgtgcgggaaatgcctttgccgtggggcggagggtctcgggtaggctggaaccatgcaaccgctcctggtgtgacgggccgccatgggtcctgtgtggacgtgtggtctctggtgtccgttctatactgttatggagcatttctccgatgatccgggttgatgatgttgagctgcgcgccggtgcgcagctgctgctggccggcgcgacgtttcaggtggcgcncggcgacaagataggcctggtcggccgcaacggcgcgggcaaaaccacgctggcgcgggtgctcgccggcgagtcggcnccggccgcgggatcggtccgcagcagcgggtccgttgggtacctgccccaggacacgatggtcggcgacctggcaggcctggccgtcgaccgggtgctgtcggcccgtggcctggatacgctgctggcgggcctgcgcgaggccgaggtcgccatggccgactccgatccggccaggcgcgacgccgcggtgcgcaggtacggccagctcgaggagcggctcacggtgctgggcgggtacgcggccgaggccgaggcggcgtcgctggcatcgagcctggggctgccgccgcaggtgctcaggcagcagctgcggaccctgtccggcgggcagcgccgccgcatcgagctggcccggatcctgttcggcgggtcggacaccatgctgctcgacgagcccaccaaccacctcgacgcggattcggtgtcctggctgcgcgancacctgcgggccttccgcggcgggctggtggtgatcagccacgacaccgcgctgctcgaggccgtcgtcaacaaggtgttctatctcgacgccgaccgctgcgaactcgacntctacaacctcggctggaagaactacctggancagcgggacaccgacgcacggcgccgcaggcgtgagcgcgtgaacgcncagcgccaggcgaccgcgctgcagtcgcaggccgacaagatgcgggccaaggcgaccaaggcgagggcggcgcacaacatggagcgccgggcggaacggctgctcgccagcgtcagcgcggaccgtgcgccggaccgggtggcccggatcaggttcccggttcccgcgcactgcgggcgcaccccgctcgccgctcagggcctgaccaagtcgtacggctcaaacgaggtgttcaccggcgtggacgtggcggtcgaccgcggcgcgcgggtggtcgtcctcggcctgaacggcgcgggcaagaccacgctgctccggctgctgtccgggctcgaggagccggacgctggcgaggtcaaacccggccacggcctgcggctcgggtattacgcgcaggagcacgagaccctggacaccgggcggaccgtgctcgagaacatgcggtcggcagccccggacctcaccgaggccgagcagcgccgggtcctcggntcgttcctgttntccggcgacgaggtggccaagccgaccagcgtgctgtccggcggcgagaagaccaggctcgcgctcgcgctgctggtcgtgtcgggcgcgaacgtactgctgctcgacgagccgacnaacaacctggatccggggagccgggcggagatcctgtccgcgctgcgccggttccagggagcgatcgttctggtcacgcacgacgagggtgccgtcgaggcgctcgcgcccgaacgggtcgtgctgctccccgacggggtcgaggatgcgtggagcgaggagtttaccgaccttgtggcgctggcctgaaacagcgccggcaagccnccgggaacggtcttcagcggcgctgaaaaagaggagatcttttgatggcgtgtgggtagccgatcacgagttcttgcgtgatcatggcgagagacggtaacgcaccggtcacttaagttcaccgggaggtacccgtgaccgaaaccctcaagaaaggcacccgggtgaccggtgccgatcgcaccaagctggcggctgatctgaagaagagatacaacgccggcgagagcatccgctcactggccggctcgaccggcaggtcctacggcttcgtgcaccggatcctgaccgagaccggggtgtcgctgcgcggccgcggcggcgccaccaggggtaaggccaagcgctgaacaacggcnccgctctttcctctgccgagcttgccgcgagcgggctgcgccttgacatcgacgacgcggtcgccacggtcacgctgagcaggcccgagcgccggaacgcgatgaccccgcaggtctggcgcggccttgcggcgatcggggccgacctggantcccgggtccgcgtggtggttgtgcgcggcgccgggccatccttctgctccgggatcgacctgcgcatgttctcggctgagggggttccgggcgaggacccgccgccaagcgccgccgaccccgggttcgagtcgtggatcgccagctgccaagagggctacctgtggctgcgcgatcccggcatcgtgtcgatcgccgcggtgcagggacacgccatcggcgcaggattccagctcgccntggcgtgtgatctgcgcattctggccgacgacgcgaagctgtgcatgaaggagcccgccctggggctggttcccgacctcaccgggaccaagccactcgtcgacatcgtggggctgccgcgggcaatcgagctgtgcctcaccgcgcgcacgctgtcggcggccgaagccgggtctctgggcctggccgagctgctggttccggtggccganctggacgccgcggtggcggatctgaccgcggcactgctggagatcgacaccgagaccgcgcgggccaccaancggctgctgctccaggccggcgcgaatacgctggagcagcaggcagccgcngagcgcgcggcgcangccgcgctgctgcgagcgcgccttgcgcgctcnnagncttnggtntnaccccaacgggcggntggttttgactttggggggttcgcggggggtgtccccccgcgggggnnnnnanttngnnngnnncnnnngnggnnnnnncnngcgngnnnnngnnnnncnnnnnntnangnnngnnnnncnnnngcaancnnngngnnnnnnnnnncnngnncnnnnnnnnnnnnnnnnnnnnnngnngnnnnncncgnnnnnnnnnanngncnnnnnngcgnnnnnnnncnggcnngntcnnncgnnnnncnnnntnnnngcnncnntnnnngcngnnnnnnncgnnnnnnatccnnnnnnncncgnnnnnnncnntgnnnanngnntcntncccnannnnncnnnnnnngnncnnnnacnagnnnntnnngncnnnnngcncnnnnnnnnngnnnnnnnnnncnngnnnnnncnncggnnnnncnnnnnncgnnncgntnnnnncnnnnnnnnngnnntnnnnnnccnngnnnnnngncnngngcnnnnnctacgatctgcgcactcaggtattcagccacgtgcagcggcagccgatcgcgtttttcaccagggcgcagaccggctcgctggtcagccggctgaacagtgacgtgatcggcgcccagcaggcgctcacctccacgctgtcgtcggtggtgtccagcgcgctgcagctggtcctggtgctgatcgcgctgttctactactcatggctggtcacggtcatcgcactggtgctgctcccggtgttcctggtccccgcgcgcttggtcgggcgcaggctgcagcggctgaccagggagggaatgcagctcgacgccgcgatggggacgacgatgaccgagcgcttcaacgtcgccggggcgatgct

SEQ ID NO: 1507 - DNA, 4000 bp, Escherichia coli
  misc_feature (1987)..(1987): n is a, c, g, or t
tgggatgtttggttacgacttgaataaaaaggggacggagcgcgagagggatcagattccggaggggtgtgggttggccgcggggtgcgcatacgcgacggcgttaacgatgacgcagttggcgcagcgcgttgttcgatggtattttagtcagagctatggcgtcacgtcggattcgtgggccttagagcaaaatagcgcgctcgcatgcgtcggatttatgatttttctcggtttcgtcgacgacgtgctcgatttgccgtggcgggtgaagattatcatgcccggatttgcggcgcttccgttgctgttgtcttatagcggcggcacgactgttttggtaccgtcaccgctgagaaagcttttacacttgtcagaagtagtgcgttcgatcgacgtgggaccgctttatcactgctacatgtggttactcgtggtattttgctcgaattcaatcaacattcacgccggattgaatgggctcgaggcggggcagtcgctcgtcattgccggcgcgatattgctgttgaacgtcatgtcgctcgcgaatgatccgtccgtcgatcccatgacttctggttcgcacttgtttagcttgtttctcacgatgccgttcttcgcaacgacgttgggtttgctcgagcacaactggtatcccgcgagcgtctttgtcggcgatacgtacacgtactttgctggaatgacgctcggcgtcgtgggcacgctaggacactttagcgagactttattgctctttttccttccgcaaatgctcaactttctgtacagcacgccgcagctcttcaaaattgtccactgtccgaagcaccgcttgccgattcgcgatgcgagcaccggcttgctccatccttccaaggcgacagagacgagatacaacatgaatctagtcaatctcttcttgaggctttttggcccatgcacggaaaagcaactctgtcgacgactgatggcgtttcagtttgcatcgtgtgcattcgcattcggcgctcgctacgtgttgacagggatttggaagtgagagtgtctttggtttcttcgaggcgacggatggcgtcggcggcgtcttcttcccagcgaagtagtctatagtctgcgctacttacaacatattttaaacactagtcatctcacgatattcgatcgtcatcgattcccgggtaattttttgtgtcgaatgtcatgtagctcagtcgcaagcgaatccgcgcgcgcccgacattccttcaaatcctcttcacactcccctcccgctccgtcttcgcaatccctactctcgcctccgacaacgtacgtcgcctcaatctccaccctactgacgggcatgacaaagatgccgttctttgtcgtctccacttgttcaattttacgcatcgttgtctccatcccgtcgacgacttcaccaaaaatcgcatactttccatccaagtgcggcgcctttccaagcatgacgctaaagctactcgtcccactgtttggatcgtcgtacctcgccatcgataaccgccctcgctcgtgtttcaacgattcactgaactcccctggcaccgtccgctcggccaactgtcgttgcgcttcgttcaacgcgactctccgtccactcttcacatccgcaatctgcgccacgaacccggcatcgacgcggaaaaagtgattcgtcgcgtacattccactcgtcagcatctccttgacgtgcgccgtcgtcgccgacgcgacgccgtcgtacaacgccagagtgatgtcaccaaagctcgtttgtaaaacgaaccgctcgtcgccgagtttcggtgtcatcgggtccgcgcgcgcgacattgaacagcgtcgacggcatacatagcaccgcgacgaccacgaggagaacgcgtctcggcgacgacgccatcgcgcgcgcgtcggtgtgtccggactcgtcggtacagcgggtccgaaatctcaatagaaatcaacattgtatgtgtaagtagtgngcagggtttagaaatacgtaggcacccagttgatgcgtgcgtgtcgtcattaaacacctcgaggtcgtttccagtcacgccgacgacgggcgtcgacgacgtcgcgtttgagaccaggggctgcgcgcttcgcgatccaccgcatctcactgaatagggctggataaacccacgggtgaagagcgagcgagcgtaggatacgatacgaagggaacaaagccctcgaaaattcagtgaatttttcgatccaaccatgtcttcttccgtcgatatccacggcgcgttcaagggcgaaggcgaagatatgattgcggcgttgatcgcggcgagtgcggcgcgaccgggggataaagcaccggcgcgcgcgacgacgggaaacggcgcgggaacgttcgacgtggacgcggaggtgatcaaggagaaaaagtctttcgagcgtgaactcgtaccttttgatttcggggataacgacgcgtcggtggtcaccgcgccggtggttcccgtggcggtaacgccgtcgtcgttgatgcggattccgactccgaaattggtcggagaggcaaagccggagaacgcgaacggggaggccgcggcgacgtcgtcgtcgaggcgtcagagaggaaagaaaaagtccaagggtacggtgaagacgttgccgacgccgaaaactgggggtcaatccaaggatccggcagttcgggcgaacgaggtgtgcgcgccgcaaaaaccagcgctaacggcggagcaacaatcggcggttttgaaccaagtggagacgacgggaaggaagcaacgaggggcgggtaaaggtatcatcgctacaaatgatgaacgatgggcaaactcgagctttcaaaacgcgccggctccggatcaattgccgatgccgtcgtttttgaaggacatgccgccggtgcccgttgagccgaagaaaaatccggcacctttgagcggcggcgcttcggcgaacgccgccgggttgaaaaacttgcttggcatgtcggctccggttccggttcgaccagttccagacgcgcctcaacaaaacaagggccagcagctcttcaaaagcattctttcaagcgcacaggcaccggcgccgccggcgccgcaacaacaacacccgatgcccccgccgggaatgatcccgccaccgggaatgatcccgcaatacccaccgcataaccacccaccaccggtgcaacaaaagctgaacgccatctttggtgtcacaccgcaaccaccgcaaccgttcccaccggcgcaaccgtatccgacggcgccagaaacgagtggtggtaacttccaaatgctcatgtccaagctttcgcatcgagcgtaagcgcgactcgagagcgtcttgtaccaatagcaccgtgtataccaactagtttgatgagtctccgctctgtgaaacgttccagagcgcgtttgacgcacccaactcgcgaacataaccgttcgcaaaacggccgaagagtgccggagcgcgttttaaaagctctcaatctcacaacaaaattcgagccaacagacgagtttcgcagaggaaatttttcctactttgtggaaccctttagcgcggtcattcgaccgcgcgcttctcaagacttcaagatccatgcgccgataaagggcggcgccaaccatacgaaccgttcattagtgttgtttgtgattctacttacaatgtttgctaactatcgcctactttttttggcgacgggctcttcttcggcaacgcgtccaaacgcgtccccctcgaccccatcttcaaaatcgtcaaaatcgtcttcgaagtcatccacttggtcgagcatggcgtcgagcgcctcttcgacggcgtcttcgtcgtcgtcgccgccgttatcgtcatcatcgctgtcggcggcttcttggttggcggccgccaacgcggcgttggcgaactcaaaattcacctttttcacgtagctcgggtgaaacttgtgcttgacgttgccaaagagcttcttcatcaccgccaactggcgc

SEQ ID NO: 1508 - DNA, 4000 bp, Escherichia coli
  misc_feature (342)..(342): n is a, c, g, or t
  misc_feature (452)..(452): n is a, c, g, or t
  misc_feature (462)..(462): n is a, c, g, or t
  misc_feature (547)..(547): n is a, c, g, or t
  misc_feature (549)..(549): n is a, c, g, or t
  misc_feature (627)..(627): n is a, c, g, or t
  misc_feature (660)..(660): n is a, c, g, or t
  misc_feature (825)..(825): n is a, c, g, or t
  misc_feature (888)..(888): n is a, c, g, or t
  misc_feature (993)..(993): n is a, c, g, or t
  misc_feature (1017)..(1017): n is a, c, g, or t
  misc_feature (1020)..(1020): n is a, c, g, or t
  misc_feature (1101)..(1101): n is a, c, g, or t
  misc_feature (1176)..(1176): n is a, c, g, or t
  misc_feature (1462)..(1463): n is a, c, g, or t
  misc_feature (1875)..(1875): n is a, c, g, or t
  misc_feature (2026)..(2026): n is a, c, g, or t
  misc_feature (3398)..(3398): n is a, c, g, or t
  misc_feature (3410)..(3410): n is a, c, g, or t
  misc_feature (3412)..(3412): n is a, c, g, or t
  misc_feature (3414)..(3414): n is a, c, g, or t
  misc_feature (3451)..(3454): n is a, c, g, or t
  misc_feature (3462)..(3463): n is a, c, g, or t
  misc_feature (3465)..(3465): n is a, c, g, or t
  misc_feature (3469)..(3469): n is a, c, g, or t
  misc_feature (3472)..(3472): n is a, c, g, or t
  misc_feature (3474)..(3474): n is a, c, g, or t
  misc_feature (3476)..(3476): n is a, c, g, or t
  misc_feature (3478)..(3478): n is a, c, g, or t
  misc_feature (3481)..(3487): n is a, c, g, or t
  misc_feature (3489)..(3501): n is a, c, g, or t
  misc_feature (3503)..(3512): n is a, c, g, or t
  misc_feature (3514)..(3517): n is a, c, g, or t
  misc_feature (3519)..(3536): n is a, c, g, or t
  misc_feature (3538)..(3538): n is a, c, g, or t
  misc_feature (3540)..(3541): n is a, c, g, or t
  misc_feature (3543)..(3548): n is a, c, g, or t
  misc_feature (3550)..(3550): n is a, c, g, or t
  misc_feature (3553)..(3555): n is a, c, g, or t
  misc_feature (3558)..(3562): n is a, c, g, or t
  misc_feature (3564)..(3564): n is a, c, g, or t
  misc_feature (3567)..(3569): n is a, c, g, or t
  misc_feature (3571)..(3572): n is a, c, g, or t
  misc_feature (3575)..(3587): n is a, c, g, or t
  misc_feature (3589)..(3589): n is a, c, g, or t
  misc_feature (3591)..(3598): n is a, c, g, or t
  misc_feature (3601)..(3610): n is a, c, g, or t
  misc_feature (3612)..(3613): n is a, c, g, or t
  misc_feature (3615)..(3625): n is a, c, g, or t
  misc_feature (3627)..(3633): n is a, c, g, or t
  misc_feature (3635)..(3641): n is a, c, g, or t
  misc_feature (3643)..(3651): n is a, c, g, or t
  misc_feature (3654)..(3659): n is a, c, g, or t
  misc_feature (3661)..(3661): n is a, c, g, or t
  misc_feature (3663)..(3678): n is a, c, g, or t
  misc_feature (3680)..(3680): n is a, c, g, or t
  misc_feature (3682)..(3697): n is a, c, g, or t
  misc_feature (3699)..(3701): n is a, c, g, or t
  misc_feature (3704)..(3709): n is a, c, g, or t
  misc_feature (3711)..(3711): n is a, c, g, or t
  misc_feature (3713)..(3721): n is a, c, g, or t
  misc_feature (3723)..(3727): n is a, c, g, or t
  misc_feature (3730)..(3740): n is a, c, g, or t
  misc_feature (3742)..(3748): n is a, c, g, or t
  misc_feature (3750)..(3750): n is a, c, g, or t
  misc_feature (3753)..(3753): n is a, c, g, or t
  misc_feature (3755)..(3757): n is a, c, g, or t
  misc_feature (3760)..(3763): n is a, c, g, or t
  misc_feature (3765)..(3765): n is a, c, g, or t
  misc_feature (3767)..(3773): n is a, c, g, or t
  misc_feature (3775)..(3775): n is a, c, g, or t
  misc_feature (3778)..(3791): n is a, c, g, or t
  misc_feature (3793)..(3801): n is a, c, g, or t
  misc_feature (3803)..(3811): n is a, c, g, or t
  misc_feature (3813)..(3815): n is a, c, g, or t
  misc_feature (3817)..(3817): n is a, c, g, or t
  misc_feature (3820)..(3829): n is a, c, g, or t
  misc_feature (3831)..(3831): n is a, c, g, or t
  misc_feature (3833)..(3840): n is a, c, g, or t
  misc_feature (3842)..(3846): n is a, c, g, or t
  misc_feature (3848)..(3855): n is a, c, g, or t
  misc_feature (3857)..(3859): n is a, c, g, or t
  misc_feature (3861)..(3883): n is a, c, g, or t
  misc_feature (3885)..(3887): n is a, c, g, or t
  misc_feature (3889)..(3893): n is a, c, g, or t
  misc_feature (3895)..(3898): n is a, c, g, or t
  misc_feature (3901)..(3901): n is a, c, g, or t
  misc_feature (3903)..(3905): n is a, c, g, or t
  misc_feature (3907)..(3911): n is a, c, g, or t
  misc_feature (3913)..(3919): n is a, c, g, or t
  misc_feature (3922)..(3922): n is a, c, g, or t
  misc_feature (3924)..(3936): n is a, c, g, or t
  misc_feature (3938)..(3940): n is a, c, g, or t
  misc_feature (3942)..(3946): n is a, c, g, or t
  misc_feature (3948)..(3961): n is a, c, g, or t
  misc_feature (3963)..(3974): n is a, c, g, or t
  misc_feature (3977)..(3986): n is a, c, g, or t
  misc_feature (3988)..(3989): n is a, c, g, or t
  misc_feature (3991)..(3994): n is a, c, g, or t
  misc_feature (3997)..(3997): n is a, c, g, or t
  misc_feature (3999)..(3999): n is a, c, g, or t
gacggcgcttccaccatggactggatggctcaggagcaggagcgaggtattaccattacctccgcagcaaccacctgcttctggaaggacaaccagatcaacattatcgacacccccggtcacgtcgacttcaccgttgaggttgagcgctccctgcgcgtcctcgacggcgcagttgctgtgttcgacggcaaggaaggtgttgagccccagtctgagaccgtttggcgccaggctgacaagtacgatgtcccccgtatctgcttcgtcaacaagatggacaagatgggtgctgacttctacttcaccgttcagaccatcatcgaccgcctgggcgcacgnccgctggttgttcagctccccatcggcgctgagagcgacttcctcggtgttgttgacctgctcgaaatgaaggcatacgtctggcccggcgacgccaagggtgacgtgancatgggtgcntcttacgaggttcaggacattcctgctgacctggttgagaaggctgagcagtaccgcgctgagctggttgaggctgttgctgagncnagcgaagagctcatggagaagtacctcgaagagggcgagctgaccatccccgagattaaggctggtatccgtcagctngttatctccggcgaggcattccccgttctctgnggttctgcattcaagaaccgcggtgttcagcccatgctggacgctgtgattgagtacctgccctccccgctggacgttccggacgttgtcggctccaacccctccaacgaggaagagaagctgacccgtaaggcatccgctgacgagcccttcgcagcactggcnttcaaggttgcagctcacccgttctacggtcagctgacctacacccgtgtgtactccggtgtngcagctcagggccagcaggttctgaactccaccaagggtaagaaggagcgcatcggtaagctcttccagatgcactccaacaaggagaaccctgttgaggagatnaccgcaggtcacatttacgctgcnatnggtctgaaggacaccaccaccggtgacaccctgtgcgaccccgcacacccgattgttctcgagtcgatgaccttccccgancccgtgatcttcgtggctatcgagcccaagaccaagggtgaccaggagaagatgtccaccgctatccagaagctntccgctgaggaccccaccttcaccgtttcgctgaacgaagaaaccggtcagaccgaaattggtggtatgggtgagctgcacctggacatcatcgttgaccgtatgaagcgtgagttcaaggttgaggctaacgttggtaagcctcaggttgcttaccgcgagaccatcaagaaggcagtcgagaaggtcgactacacccacaagaagcagaccggtggttccggtcagttcgcaaaggtgcaggtctccttcgagcccctgcccctggatggcgaagagctgtacnngttcgaggacaaggtcaccggtggccgcgttcctcgcgagtacatcccctcggtcgacgctggtatccaggacgctatgaagttcggtgtcctcgctggctacccgatggtgggcgtgaaggcaaccctgatcgacggtgcttaccacgacgtcgactcctccgaaatggcgttcaagatcgctggttcgatggtcttcaaggaaggcgctaagcgcgctaacccggtcctgctcgagccgctgatggacgttgaggttcgtacccccgaggagtacatgggcgacgttatcggcgacctgaactcccgccgtggccaggttcgttccatggaggacgcatccggcgttaagatcatcaaggctatcgtgcccctgaccgaaatgttcggttacattggcgacctgcgtggnaagacccagggtcgtgcagtgttctcgatggcattcgatagctacggcgaggttcccaagaacgtcgctgacgagatcatccagaagagccgcggcgagtaattttcgcgtctcacccgtgggccacgggctaaaaacctgtggcccacgncaaaattttcaattaaatccattattgagagcatgaacagtttcatctctgcggcgtaatccgctattgtagacgctagaccgttttataacgggatgcgccggagcgaagatccgcgtgcatgttttcaatcgttctaggaggaacactcttggctaaggctaagttcgagcgctccaagcctcacgttaacgtcggtaccattggtcacgttgaccacggtaagaccaccctgaccgcagcaatctccaaggttctggctgacaagtacccggacctgaacgagaagcgcgacttcggtatgatcgactccgctcccgaggagcgccagcgcggtattaccattaacattgctcacatcgagtaccagaccgagaagcgccactacgcacacgttgacgctcccggccacgctgactacgtcaagaacatgattaccggtgcggctcagatggacggcgcaatcctcgtggttgcagctaccgacggccccatggcacagacccgcgagcacgttctgctcgctcgccaggttggcgtccccaccctgctggttgcactgaacaaggcagacatggttgacgacgaagagctcctcgacctcgtcgagatggaggtccgtgacctcctctcctcgcaggagttcgacggcgacaacgctcccgttgttcgcgtttccgcactgaaggctctcgaaggcgaccccgagtgggttgctaaggtcgaggagctcatggacgcagtcgacacctacattccggaccccgtgcgtgagaaggacaagcccttcctcatgcccatcgaggacgtcttcaccatcaccggtcgtggcaccgttgttaccggtcgtgcagagcgcggtaccctgaagatcaactccgaggtcgagatcgtcggtatccgcccgatccagaagaccaccgttaccggtatcgagatgttccacaagcagctcgacgaagcatgggcaggcgagaactgtggtctgctgctgcgtggtctgaagcgtgacgatgttgagcgtggtcaggttgtcgtggagccgggctccatcaccccccacaccgagttcgaggcaaacgtctacatcctctccaaggatgagggtggccgtcacaaccccttctactccaactaccgtcctcagttctacttccgtaccactgacgtgaccggcgttatcaccctccccgagggcaccgagatggttatgcccggtgacaacaccgagatgaccgttaccctgatccagcccatcgcaatggaagagggcctcggcttcgctatccgtgagggtggccgcaccgttggttcgggtcgcgttaccaagatcatcaagtaattgccgtaaatttacgacaattcgctaaanatctgccggagngnanactctccatcaggtagcgatactcaaggacccccgcnnnngcgggggnncntttnttntncncnttnnnnnnngnnnnnnnnnnnnncnnnnnnnnnnannnngnnnnnnnnnnnnnnnnnncnanncnnnnnngngcnnnatnnnnncntcnnngnnccnnnnnnnnnnnnngngnnnnnnnngannnnnnnnnngnnannnnnnnnnnnannnnnnnannnnnnngnnnnnnnnnccnnnnnngngnnnnnnnnnnnnnnnncntnnnnnnnnnnnnnnnnannnctnnnnnntngnnnnnnnnngnnnnnggnnnnnnnnnnngnnnnnnngnagngnnnctnnnncntnnnnnnntnagnnnnnnnnnnnnnngnnnnnnnnngnnnnnnnnngnnnancgnnnnnnnnnngngnnnnnnnnannnnncnnnnnnnngnnnannnnnnnnnnnnnnnnnnnnnnnannngnnnnnannnngangnnngnnnnncnnnnnnngantnnnnnnnnnnnnnannnannnnngnnnnnnnnnnnnnngnnnnnnnnnnnnatnnnnnnnnnncnngnnnngancng

SEQ ID NO: 1509 - DNA, 4000 bp, Escherichia coli
  misc_feature (224)..(224): n is a, c, g, or t
  misc_feature (1980)..(1980): n is a, c, g, or t
  misc_feature (1985)..(1985): n is a, c, g, or t
  misc_feature (1992)..(1992): n is a, c, g, or t
  misc_feature (2038)..(2039): n is a, c, g, or t
  misc_feature (2310)..(2310): n is a, c, g, or t
  misc_feature (2582)..(2582): n is a, c, g, or t
  misc_feature (2670)..(2670): n is a, c, g, or t
  misc_feature (2911)..(2916): n is a, c, g, or t
  misc_feature (2919)..(2920): n is a, c, g, or t
  misc_feature (2923)..(2923): n is a, c, g, or t
  misc_feature (2930)..(2930): n is a, c, g, or t
  misc_feature (2932)..(2932): n is a, c, g, or t
  misc_feature (2934)..(2935): n is a, c, g, or t
  misc_feature (2938)..(2940): n is a, c, g, or t
  misc_feature (2942)..(2943): n is a, c, g, or t
  misc_feature (2945)..(2947): n is a, c, g, or t
  misc_feature (2951)..(2955): n is a, c, g, or t
  misc_feature (2957)..(2957): n is a, c, g, or t
  misc_feature (2960)..(2960): n is a, c, g, or t
  misc_feature (2964)..(2966): n is a, c, g, or t
  misc_feature (2971)..(2971): n is a, c, g, or t
  misc_feature (2974)..(2975): n is a, c, g, or t
  misc_feature (2979)..(2979): n is a, c, g, or t
  misc_feature (2983)..(2986): n is a, c, g, or t
  misc_feature (2988)..(2988): n is a, c, g, or t
  misc_feature (2990)..(2990): n is a, c, g, or t
  misc_feature (2992)..(2994): n is a, c, g, or t
  misc_feature (2997)..(2997): n is a, c, g, or t
  misc_feature (3000)..(3000): n is a, c, g, or t
  misc_feature (3003)..(3003): n is a, c, g, or t
  misc_feature (3006)..(3012): n is a, c, g, or t
  misc_feature (3014)..(3014): n is a, c, g, or t
  misc_feature (3017)..(3017): n is a, c, g, or t
  misc_feature (3019)..(3019): n is a, c, g, or t
  misc_feature (3022)..(3022): n is a, c, g, or t
  misc_feature (3024)..(3026): n is a, c, g, or t
  misc_feature (3029)..(3029): n is a, c, g, or t
  misc_feature (3031)..(3032): n is a, c, g, or t
  misc_feature (3035)..(3035): n is a, c, g, or t
  misc_feature (3038)..(3041): n is a, c, g, or t
  misc_feature (3045)..(3046): n is a, c, g, or t
  misc_feature (3049)..(3054): n is a, c, g, or t
  misc_feature (3056)..(3057): n is a, c, g, or t
  misc_feature (3059)..(3059): n is a, c, g, or t
  misc_feature (3061)..(3061): n is a, c, g, or t
  misc_feature (3065)..(3065): n is a, c, g, or t
  misc_feature (3069)..(3071): n is a, c, g, or t
  misc_feature (3073)..(3074): n is a, c, g, or t
  misc_feature (3079)..(3079): n is a, c, g, or t
  misc_feature (3084)..(3084): n is a, c, g, or t
  misc_feature (3087)..(3088): n is a, c, g, or t
  misc_feature (3090)..(3090): n is a, c, g, or t
  misc_feature (3092)..(3093): n is a, c, g, or t
  misc_feature (3096)..(3102): n is a, c, g, or t
  misc_feature (3104)..(3105): n is a, c, g, or t
  misc_feature (3107)..(3108): n is a, c, g, or t
  misc_feature (3110)..(3115): n is a, c, g, or t
  misc_feature (3120)..(3120): n is a, c, g, or t
  misc_feature (3122)..(3123): n is a, c, g, or t
  misc_feature (3127)..(3127): n is a, c, g, or t
  misc_feature (3131)..(3131): n is a, c, g, or t
  misc_feature (3133)..(3136): n is a, c, g, or t
  misc_feature (3138)..(3138): n is a, c, g, or t
  misc_feature (3141)..(3141): n is a, c, g, or t
  misc_feature (3145)..(3145): n is a, c, g, or t
  misc_feature (3147)..(3148): n is a, c, g, or t
  misc_feature (3153)..(3155): n is a, c, g, or t
  misc_feature (3157)..(3160): n is a, c, g, or t
  misc_feature (3163)..(3163): n is a, c, g, or t
  misc_feature (3165)..(3166): n is a, c, g, or t
  misc_feature (3168)..(3168): n is a, c, g, or t
  misc_feature (3170)..(3170): n is a, c, g, or t
  misc_feature (3172)..(3172): n is a, c, g, or t
  misc_feature (3174)..(3177): n is a, c, g, or t
  misc_feature (3179)..(3181): n is a, c, g, or t
  misc_feature (3199)..(3201): n is a, c, g, or t
  misc_feature (3203)..(3203): n is a, c, g, or t
  misc_feature (3206)..(3206): n is a, c, g, or t
  misc_feature (3208)..(3209): n is a, c, g, or t
  misc_feature (3211)..(3211): n is a, c, g, or t
  misc_feature (3215)..(3216): n is a, c, g, or t
  misc_feature (3218)..(3218): n is a, c, g, or t
  misc_feature (3220)..(3220): n is a, c, g, or t
  misc_feature (3222)..(3223): n is a, c, g, or t
  misc_feature (3230)..(3232): n is a, c, g, or t
  misc_feature (3234)..(3239): n is a, c, g, or t
  misc_feature (3241)..(3241): n is a, c, g, or t
  misc_feature (3243)..(3244): n is a, c, g, or t
  misc_feature (3246)..(3246): n is a, c, g, or t
  misc_feature (3252)..(3252): n is a, c, g, or t
  misc_feature (3255)..(3256): n is a, c, g, or t
  misc_feature (3259)..(3259): n is a, c, g, or t
  misc_feature (3261)..(3262): n is a, c, g, or t
  misc_feature (3264)..(3265): n is a, c, g, or t
  misc_feature (3267)..(3269): n is a, c, g, or t
  misc_feature (3271)..(3271): n is a, c, g, or t
  misc_feature (3278)..(3278): n is a, c, g, or t
  misc_feature (3280)..(3280): n is a, c, g, or t
  misc_feature (3282)..(3282): n is a, c, g, or t
  misc_feature (3284)..(3284): n is a, c, g, or t
  misc_feature (3288)..(3288): n is a, c, g, or t
  misc_feature (3290)..(3291): n is a, c, g, or t
  misc_feature (3293)..(3296): n is a, c, g, or t
  misc_feature (3299)..(3301): n is a, c, g, or t
  misc_feature (3303)..(3303): n is a, c, g, or t
  misc_feature (3307)..(3307): n is a, c, g, or t
  misc_feature (3310)..(3310): n is a, c, g, or t
  misc_feature (3312)..(3315): n is a, c, g, or t
  misc_feature (3317)..(3322): n is a, c, g, or t
  misc_feature (3325)..(3325): n is a, c, g, or t
  misc_feature (3328)..(3328): n is a, c, g, or t
  misc_feature (3330)..(3333): n is a, c, g, or t
  misc_feature (3336)..(3339): n is a, c, g, or t
  misc_feature (3342)..(3342): n is a, c, g, or t
  misc_feature (3344)..(3344): n is a, c, g, or t
  misc_feature (3346)..(3346): n is a, c, g, or t
  misc_feature (3351)..(3352): n is a, c, g, or t
  misc_feature (3354)..(3354): n is a, c, g, or t
  misc_feature (3358)..(3358): n is a, c, g, or t
  misc_feature (3361)..(3362): n is a, c, g, or t
  misc_feature (3368)..(3370): n is a, c, g, or t
  misc_feature (3376)..(3379): n is a, c, g, or t
  misc_feature (3381)..(3381): n is a, c, g, or t
  misc_feature (3384)..(3384): n is a, c, g, or t
  misc_feature (3387)..(3387): n is a, c, g, or t
  misc_feature (3393)..(3393): n is a, c, g, or t
  misc_feature (3395)..(3398): n is a, c, g, or t
  misc_feature (3401)..(3401): n is a, c, g, or t
  misc_feature (3404)..(3404): n is a, c, g, or t
  misc_feature (3406)..(3407): n is a, c, g, or t
  misc_feature (3410)..(3410): n is a, c, g, or t
  misc_feature (3412)..(3413): n is a, c, g, or t
  misc_feature (3416)..(3416): n is a, c, g, or t
  misc_feature (3421)..(3427): n is a, c, g, or t
  misc_feature (3432)..(3434): n is a, c, g, or t
  misc_feature (3437)..(3437): n is a, c, g, or t
  misc_feature (3439)..(3439): n is a, c, g, or t
  misc_feature (3444)..(3448): n is a, c, g, or t
  misc_feature (3453)..(3453): n is a, c, g, or t
  misc_feature (3457)..(3457): n is a, c, g, or t
  misc_feature (3459)..(3461): n is a, c, g, or t
  misc_feature (3463)..(3463): n is a, c, g, or t
  misc_feature (3469)..(3472): n is a, c, g, or t
  misc_feature (3474)..(3475): n is a, c, g, or t
  misc_feature (3482)..(3487): n is a, c, g, or t
  misc_feature (3491)..(3491): n is a, c, g, or t
  misc_feature (3494)..(3495): n is a, c, g, or t
  misc_feature (3497)..(3501): n is a, c, g, or t
  misc_feature (3503)..(3503): n is a, c, g, or t
  misc_feature (3508)..(3509): n is a, c, g, or t
  misc_feature (3511)..(3511): n is a, c, g, or t
  misc_feature (3514)..(3515): n is a, c, g, or t
  misc_feature (3517)..(3519): n is a, c, g, or t
  misc_feature (3522)..(3524): n is a, c, g, or t
  misc_feature (3526)..(3527): n is a, c, g, or t
  misc_feature (3535)..(3537): n is a, c, g, or t
  misc_feature (3539)..(3539): n is a, c, g, or t
  misc_feature (3541)..(3541): n is a, c, g, or t
  misc_feature (3544)..(3544): n is a, c, g, or t
  misc_feature (3547)..(3547): n is a, c, g, or t
  misc_feature (3554)..(3555): n is a, c, g, or t
  misc_feature (3557)..(3558): n is a, c, g, or t
  misc_feature (3565)..(3565): n is a, c, g, or t
  misc_feature (3572)..(3574): n is a, c, g, or t
  misc_feature (3578)..(3578): n is a, c, g, or t
  misc_feature (3580)..(3581): n is a, c, g, or t
  misc_feature (3584)..(3584): n is a, c, g, or t
  misc_feature (3590)..(3590): n is a, c, g, or t
  misc_feature (3594)..(3594): n is a, c, g, or t
  misc_feature (3597)..(3600): n is a, c, g, or t
  misc_feature (3602)..(3603): n is a, c, g, or t
  misc_feature (3606)..(3611): n is a, c, g, or t
  misc_feature (3613)..(3613): n is a, c, g, or t
  misc_feature (3615)..(3616): n is a, c, g, or t
  misc_feature (3618)..(3618): n is a, c, g, or t
  misc_feature (3620)..(3620): n is a, c, g, or t
  misc_feature (3624)..(3625): n is a, c, g, or t
  misc_feature (3629)..(3629): n is a, c, g, or t
  misc_feature (3637)..(3640): n is a, c, g, or t
  misc_feature (3642)..(3642): n is a, c, g, or t
  misc_feature (3649)..(3649): n is a, c, g, or t
  misc_feature (3654)..(3654): n is a, c, g, or t
  misc_feature (3657)..(3657): n is a, c, g, or t
  misc_feature (3661)..(3662): n is a, c, g, or t
  misc_feature (3664)..(3665): n is a, c, g, or t
  misc_feature (3667)..(3667): n is a, c, g, or t
  misc_feature (3669)..(3669): n is a, c, g, or t
  misc_feature (3671)..(3671): n is a, c, g, or t
  misc_feature (3677)..(3677): n is a, c, g, or t
  misc_feature (3680)..(3685): n is a, c, g, or t
  misc_feature (3687)..(3691): n is a, c, g, or t
  misc_feature (3694)..(3694): n is a, c, g, or t
  misc_feature (3696)..(3698): n is a, c, g, or t
  misc_feature (3700)..(3700): n is a, c, g, or t
  misc_feature (3705)..(3706): n is a, c, g, or t
  misc_feature (3709)..(3709): n is a, c, g, or t
  misc_feature (3713)..(3713): n is a, c, g, or t
  misc_feature (3715)..(3719): n is a, c, g, or t
  misc_feature (3721)..(3721): n is a, c, g, or t
  misc_feature (3724)..(3729): n is a, c, g, or t
  misc_feature (3731)..(3731): n is a, c, g, or t
  misc_feature (3734)..(3737): n is a, c, g, or t
  misc_feature (3739)..(3740): n is a, c, g, or t
  misc_feature (3742)..(3742): n is a, c, g, or t
  misc_feature (3744)..(3744): n is a, c, g, or t
  misc_feature (3746)..(3748): n is a, c, g, or t
  misc_feature (3750)..(3750): n is a, c, g, or t
  misc_feature (3753)..(3754): n is a, c, g, or t
  misc_feature (3757)..(3758): n is a, c, g, or t
  misc_feature (3761)..(3762): n is a, c, g, or t
  misc_feature (3765)..(3765): n is a, c, g, or t
  misc_feature (3770)..(3772): n is a, c, g, or t
  misc_feature (3774)..(3777): n is a, c, g, or t
  misc_feature (3779)..(3785): n is a, c, g, or t
  misc_feature (3788)..(3789): n is a, c, g, or t
  misc_feature (3791)..(3792): n is a, c, g, or t
  misc_feature (3797)..(3797): n is a, c, g, or t
  misc_feature (3800)..(3801): n is a, c, g, or t
  misc_feature (3803)..(3804): n is a, c, g, or t
  misc_feature (3810)..(3810): n is a, c, g, or t
  misc_feature (3812)..(3813): n is a, c, g, or t
  misc_feature (3821)..(3821): n is a, c, g, or t
  misc_feature (3825)..(3825): n is a, c, g, or t
  misc_feature (3827)..(3829): n is a, c, g, or t
  misc_feature (3831)..(3832): n is a, c, g, or t
  misc_feature (3836)..(3836): n is a, c, g, or t
  misc_feature (3839)..(3839): n is a, c, g, or t
  misc_feature (3842)..(3842): n is a, c, g, or t
  misc_feature (3844)..(3845): n is a, c, g, or t
  misc_feature (3847)..(3853): n is a, c, g, or t
  misc_feature (3855)..(3855): n is a, c, g, or t
  misc_feature (3858)..(3858): n is a, c, g, or t
  misc_feature (3861)..(3861): n is a, c, g, or t
  misc_feature (3864)..(3864): n is a, c, g, or t
  misc_feature (3869)..(3870): n is a, c, g, or t
  misc_feature (3873)..(3873): n is a, c, g, or t
  misc_feature (3877)..(3877): n is a, c, g, or t
  misc_feature (3880)..(3883): n is a, c, g, or t
  misc_feature (3886)..(3887): n is a, c, g, or t
  misc_feature (3894)..(3894): n is a, c, g, or t
  misc_feature (3896)..(3898): n is a, c, g, or t
  misc_feature (3900)..(3900): n is a, c, g, or t
  misc_feature (3903)..(3904): n is a, c, g, or t
  misc_feature (3907)..(3910): n is a, c, g, or t
  misc_feature (3912)..(3912): n is a, c, g, or t
  misc_feature (3915)..(3920): n is a, c, g, or t
  misc_feature (3923)..(3923): n is a, c, g, or t
  misc_feature (3926)..(3926): n is a, c, g, or t
  misc_feature (3928)..(3931): n is a, c, g, or t
  misc_feature (3936)..(3936): n is a, c, g, or t
  misc_feature (3938)..(3939): n is a, c, g, or t
  misc_feature (3941)..(3955): n is a, c, g, or t
  misc_feature (3958)..(3959): n is a, c, g, or t
  misc_feature (3962)..(3962): n is a, c, g, or t
  misc_feature (3964)..(3964): n is a, c, g, or t
  misc_feature (3966)..(3966): n is a, c, g, or t
  misc_feature (3968)..(3970): n is a, c, g, or t
  misc_feature (3972)..(3972): n is a, c, g, or t
  misc_feature (3974)..(3977): n is a, c, g, or t
  misc_feature (3979)..(3980): n is a, c, g, or t
  misc_feature (3982)..(3984): n is a, c, g, or t
  misc_feature (3986)..(3987): n is a, c, g, or t
  misc_feature (3989)..(3989): n is a, c, g, or t
  misc_feature (3991)..(3992): n is a, c, g, or t
  misc_feature (3994)..(3994): n is a, c, g, or t
  misc_feature (3998)..(4000): n is a, c, g, or t
agtccacatcattggaagttgctttataataaggtgacttctgtaccagcgcatctacctcgtcctgggtgtagtgcttggcaggatcgtatccttgcgcctgcatccaggtgacgaacttgggatggaatacgatgtattcctcgaatgcgtctccggtttcatccacgaaatccacatgtacgttggcgtcattcggattgactttgcgacgtcgcttgtanaccggcaggaatacgggttcgatgccggaagtggtttgcgtcatcaggcttgtcgtgcctgtcggtgcgatggtgagacaggcaatgttgcggcggccgtatttcttcatttcctcgtacagttccgggtctgcttcgcgcaggcggttgatgaacgggttgttcttttcgcgttcgctgtcgtatacttcgaaagcgccgcgttctttagccatttccacagaagagcggtatgcactcagtgctacggtctggtgtactttctctgcaaattcggtagcctcttcagtgccgtaacgcagtcccaatgctgcaagcatgtcgccttcggcggtgatgcctacgccggtgcggcggccttgtccgctctttttgtagattttctgccacaaaacgctttcggtatgctttacatcttcgttttccggatcggagtcaattttggccatgatacgttctatcttctcaagttccaggtcgatgatgtcgtccatgatgcgctgggcgagtgctacgtgcttcttgaacaaatcgaaatcgaagtaggcatccggtttgaacggattgactacatatgaatataggttaatggccagcaaacggcaggagtcgtaggggcacaagggaatttcaccgcaagggttggtcgacacggtacggtaacccaggtctgcgtagcaatcgggtacggactctcttaatatggtgtcccagaagagtacgccgggctcggcggacttccatgcgttgtgcacgatttttttccacaaatcggtggcgctgatttctttcttgaacagaggttcgtccgcgtcaatgggatattgctgtacgaatggcttgccgtcgatggctgcctgcataaatgcgtcggtcagcttgacggatacattggcccccgtaactttaccttctgtcatttttgcatctataaaggcttccgaatccggatgcttgatggatacgcttaacatcagcgcaccccggcggccgtcttgggctacttcacgggtggagttggagtagcgttccatgaagggaaccagtccggttgatgtcagggcggaattttttaccggagaacctttcgggcggatgtgtgacaagtcgtgtcctacaccgccgcggcgtttcatcagttgtacctgctcttcatcaatcttgaagattgcaccgtatgagtcggcctcgccatccacacctatcacaaaacagttggaaagggaagctacctggtagttgtttccgattccggtcatcgggctgccttgcggaacgatgtatttgaagtggtccaacaagccgaagagttcttcggaagtcagtgcgttggggtacttggcttcgatgcgggctacttcattggctattctccaatgcatgtcttccggagatttttcgtaaatatttccgaaagaatctttgactgcgtatttgttcacccaaacccttgcagccagttcgtcgccttggaagtatcgtaaagattcttcgtaggcttcgtcataagaataaactttcttttccacgatgcgataactcttagatttaattatgaataagtaaaagtgtagaagttgtacttattgctaacaaatgtggctgcaaatctatgaatgttttttgttatggcaaaataaaaattgatgtttttattaaccggttgttagttttcagttttaatcggttaatttgttggtttataataaaatggctttttgtaaattaacaaaaagttttctaaaaagaaaattcnataangaatacngttcgggtagtttgtcctttttagaaaacatgcctgcacatattcnnaactattggatgatattctgtgtttcttttcatatatttgcagaaaaaagaaagaatggaaagtctaaaacaaaggagaacaatccgtaagtatcagcagaaagatatttcttctgatttgttaaatgatttgcttgaaacctctttccgtgcttctacggttggaaacatgcaggtgtatagcgtaattgtaacccgtgacgctgaccggaaagccaggttggcaccggcgcatttcaatcagcctatggtgaagacggcgccggcagtncttactttttgcatcgacttgcgccgttttagcaaatggtgcgagcagcggaaggcagaaccgggatataacaattttgaatggtttgttaccggagctgtggatgctttgttggttgcgcaaacattctgtgtggcagccgaagaaaaaggtttgggcatctgctatctgggtactaccacctacaacccccaaatgattattgaggcattggagttgcccgaattggtcttccctatcactaccgttaccgtaggctggccggcagagantcctgcacaggtagaccgcctgcctttggaagccattgtccatgaagaaacttatcatgattatactcctgaggatatcgaccgtctntatgcctataaggagtctttgcctgagaataaacagtttatcgcagaaaataataaagaaacattggctcaggtctttacggatgtacgctatacaaagaaagacagcgaggctatgtccgagaacctttggaaagtaatgaaacaacagggattttaatttgagtataacgtatgaggtataaagcgtatccatgcagttttttgcatgatgactttatacctcataccttatacttttnnnnnntannttntactttntncnnggnnntnngnnnttcnnnnntntcngcgnnnaatgnttnntccncctnnnncngntnnntgnttnttntgnnnnnnngnagnanggngnnntgntnnttnttnnnnattnncgnnnnnntnntngntgtngagnnntnngtatnttttntgnntnannacnnnnnnntnngnngnnnnnncaccncnncgcntttncnnnntnttntatntnnggcgnnntnnnncanannanantntnnnnannnggtggtgatgatgtcgtnnntngtnanngntttnntntngnngttcacnnntnnnnnnangnngngttgtnccnnctncnngnngnnntncttgttntntntngtananngnnnnatnnngnaganganannnncnnnnnngtngcncnnnntgnnnnctncntnctctnntntatnatnnattacnnncggcgnnnntngtnaancgtcangnnnnatnttntnncgnannatnttttnnnnnnnttctnnngtngnctttnnnnnttccnccancnnncnccattnnnnanntgtaatnnnnnnttcntcnntnnnnngnagcannanggnngnnnggnnngnngtgagaannngntnttngcngttttgnngnnggtggtngaagatnnngaananngtnttctgngttntgnnnncnnctnnnnnntncnnantntcgnnaatnatcaatannnnantagtctngtagnagntgannanntngntngtcgtnttnnnnnntnnnnngtngnnntnttgtnnttngaanannnnngnagnnnnnnanaannnncnntncncnnnanatnnttnnttnnttnttgtnnngnnnncnnnnnnnagnngnnttttnccnncnnctgatncnncatacaanaacngnnnanngaanatngtntnngnnnnnnngngcnccnctncttcnncancacnacnnnngannttattgntnnntnctnnaannnncntgnnnnnnttntantnnnnattcngnngnnnnnnnnnnnnnnnaannggnancngnnnantnnnntnntnnntnntntnntnttgnnn

SEQ ID NO: 1510 - DNA, 4000 bp, Escherichia coli
  misc_feature (585)..(585): n is a, c, g, or t
  misc_feature (588)..(588): n is a, c, g, or t
  misc_feature (590)..(590): n is a, c, g, or t
  misc_feature (592)..(594): n is a, c, g, or t
  misc_feature (597)..(597): n is a, c, g, or t
  misc_feature (600)..(600): n is a, c, g, or t
  misc_feature (603)..(604): n is a, c, g, or t
  misc_feature (607)..(608): n is a, c, g, or t
  misc_feature (610)..(610): n is a, c, g, or t
  misc_feature (612)..(612): n is a, c, g, or t
  misc_feature (616)..(617): n is a, c, g, or t
  misc_feature (620)..(623): n is a, c, g, or t
  misc_feature (625)..(625): n is a, c, g, or t
  misc_feature (628)..(630): n is a, c, g, or t
  misc_feature (633)..(633): n is a, c, g, or t
  misc_feature (638)..(638): n is a, c, g, or t
  misc_feature (640)..(645): n is a, c, g, or t
  misc_feature (647)..(648): n is a, c, g, or t
  misc_feature (654)..(654): n is a, c, g, or t
  misc_feature (657)..(660): n is a, c, g, or t
  misc_feature (665)..(666): n is a, c, g, or t
  misc_feature (669)..(669): n is a, c, g, or t
  misc_feature (672)..(672): n is a, c, g, or t
  misc_feature (674)..(676): n is a, c, g, or t
  misc_feature (682)..(684): n is a, c, g, or t
  misc_feature (687)..(687): n is a, c, g, or t
  misc_feature (689)..(689): n is a, c, g, or t
  misc_feature (693)..(693): n is a, c, g, or t
  misc_feature (696)..(696): n is a, c, g, or t
  misc_feature (698)..(700): n is a, c, g, or t
  misc_feature (703)..(703): n is a, c, g, or t
  misc_feature (705)..(705): n is a, c, g, or t
  misc_feature (710)..(712): n is a, c, g, or t
  misc_feature (715)..(718): n is a, c, g, or t
  misc_feature (720)..(721): n is a, c, g, or t
  misc_feature (724)..(724): n is a, c, g, or t
  misc_feature (726)..(728): n is a, c, g, or t
  misc_feature (731)..(732): n is a, c, g, or t
  misc_feature (736)..(744): n is a, c, g, or t
  misc_feature (746)..(749): n is a, c, g, or t
  misc_feature (752)..(752): n is a, c, g, or t
  misc_feature (754)..(756): n is a, c, g, or t
  misc_feature (758)..(758): n is a, c, g, or t
  misc_feature (760)..(763): n is a, c, g, or t
  misc_feature (766)..(766): n is a, c, g, or t
  misc_feature (769)..(772): n is a, c, g, or t
  misc_feature (775)..(775): n is a, c, g, or t
  misc_feature (777)..(778): n is a, c, g, or t
  misc_feature (780)..(781): n is a, c, g, or t
  misc_feature (785)..(785): n is a, c, g, or t
  misc_feature (788)..(789): n is a, c, g, or t
  misc_feature (791)..(792): n is a, c, g, or t
  misc_feature (794)..(795): n is a, c, g, or t
  misc_feature (797)..(801): n is a, c, g, or t
  misc_feature (806)..(808): n is a, c, g, or t
  misc_feature (810)..(810): n is a, c, g, or t
  misc_feature (812)..(813): n is a, c, g, or t
  misc_feature (815)..(816): n is a, c, g, or t
  misc_feature (818)..(818): n is a, c, g, or t
  misc_feature (820)..(821): n is a, c, g, or t
  misc_feature (823)..(823): n is a, c, g, or t
  misc_feature (825)..(827): n is a, c, g, or t
  misc_feature (831)..(832): n is a, c, g, or t
  misc_feature (834)..(834): n is a, c, g, or t
  misc_feature (836)..(838): n is a, c, g, or t
  misc_feature (840)..(846): n is a, c, g, or t
  misc_feature (848)..(853): n is a, c, g, or t
  misc_feature (855)..(857): n is a, c, g, or t
  misc_feature (859)..(859): n is a, c, g, or t
  misc_feature (862)..(863): n is a, c, g, or t
  misc_feature (866)..(870): n is a, c, g, or t
  misc_feature (872)..(872): n is a, c, g, or t
  misc_feature (874)..(876): n is a, c, g, or t
  misc_feature (878)..(878): n is a, c, g, or t
  misc_feature (881)..(884): n is a, c, g, or t
  misc_feature (889)..(895): n is a, c, g, or t
  misc_feature (897)..(913): n is a, c, g, or t
  misc_feature (916)..(917): n is a, c, g, or t
  misc_feature (920)..(926): n is a, c, g, or t
  misc_feature (928)..(930): n is a, c, g, or t
  misc_feature (932)..(934): n is a, c, g, or t
  misc_feature (936)..(936): n is a, c, g, or t
  misc_feature (938)..(948): n is a, c, g, or t
  misc_feature (950)..(956): n is a, c, g, or t
  misc_feature (958)..(962): n is a, c, g, or t
  misc_feature (965)..(965): n is a, c, g, or t
  misc_feature (970)..(972): n is a, c, g, or t
  misc_feature (976)..(978): n is a, c, g, or t
  misc_feature (981)..(981): n is a, c, g, or t
  misc_feature (983)..(984): n is a, c, g, or t
  misc_feature (987)..(993): n is a, c, g, or t
  misc_feature (995)..(995): n is a, c, g, or t
  misc_feature (998)..(999): n is a, c, g, or t
  misc_feature (1002)..(1008): n is a, c, g, or t
  misc_feature (1010)..(1010): n is a, c, g, or t
  misc_feature (1012)..(1012): n is a, c, g, or t
  misc_feature (1015)..(1019): n is a, c, g, or t
  misc_feature (1021)..(1024): n is a, c, g, or t
  misc_feature (1026)..(1027): n is a, c, g, or t
  misc_feature (1031)..(1033): n is a, c, g, or t
  misc_feature (1036)..(1039): n is a, c, g, or t
  misc_feature (1042)..(1045): n is a, c, g, or t
  misc_feature (1047)..(1047): n is a, c, g, or t
  misc_feature (1050)..(1051): n is a, c, g, or t
  misc_feature (1055)..(1056): n is a, c, g, or t
  misc_feature (1059)..(1064): n is a, c, g, or t
  misc_feature (1066)..(1068): n is a, c, g, or t
  misc_feature (1070)..(1072): n is a, c, g, or t
  misc_feature (1074)..(1078): n is a, c, g, or t
  misc_feature (1082)..(1082): n is a, c, g, or t
  misc_feature (1084)..(1085): n is a, c, g, or t
  misc_feature (1087)..(1087): n is a, c, g, or t
  misc_feature (1089)..(1090): n is a, c, g, or t
  misc_feature (1092)..(1092): n is a, c, g, or t
  misc_feature (1097)..(1101): n is a, c, g, or t
  misc_feature (1104)..(1107): n is a, c, g, or t
  misc_feature (1114)..(1116): n is a, c, g, or t
  misc_feature (1118)..(1121): n is a, c, g, or t
  misc_feature (1128)..(1133): n is a, c, g, or t
  misc_feature (1135)..(1136): n is a, c, g, or t
  misc_feature (1139)..(1139): n is a, c, g, or t
  misc_feature (1142)..(1143): n is a, c, g, or t
  misc_feature (1145)..(1145): n is a, c, g, or t
  misc_feature (1147)..(1149): n is a, c, g, or t
  misc_feature (1155)..(1156): n is a, c, g, or t
  misc_feature (1158)..(1159): n is a, c, g, or t
  misc_feature (1161)..(1162): n is a, c, g, or t
  misc_feature (1164)..(1165): n is a, c, g, or t
  misc_feature (1168)..(1168): n is a, c, g, or t
  misc_feature (1171)..(1174): n is a, c, g, or t
  misc_feature (1176)..(1176): n is a, c, g, or t
  misc_feature (1178)..(1178): n is a, c, g, or t
  misc_feature (1181)..(1181): n is a, c, g, or t
  misc_feature (1184)..(1186): n is a, c, g, or t
  misc_feature (1188)..(1191): n is a, c, g, or t
  misc_feature (1193)..(1194): n is a, c, g, or t
  misc_feature (1197)..(1198): n is a, c, g, or t
  misc_feature (1200)..(1200): n is a, c, g, or t
  misc_feature (1202)..(1202): n is a, c, g, or t
  misc_feature (1204)..(1204): n is a, c, g, or t
  misc_feature (1206)..(1207): n is a, c, g, or t
  misc_feature (1209)..(1209): n is a, c, g, or t
  misc_feature (1213)..(1213): n is a, c, g, or t
  misc_feature (1215)..(1216): n is a, c, g, or t
  misc_feature (1220)..(1220): n is a, c, g, or t
  misc_feature (1222)..(1223): n is a, c, g, or t
  misc_feature (1240)..(1240): n is a, c, g, or t
  misc_feature (1242)..(1242): n is a, c, g, or t
  misc_feature (1246)..(1247): n is a, c, g, or t
  misc_feature (1251)..(1251): n is a, c, g, or t
  misc_feature (1254)..(1257): n is a, c, g, or t
  misc_feature (1259)..(1259): n is a, c, g, or t
  misc_feature (1261)..(1261): n is a, c, g, or t
  misc_feature (1263)..(1264): n is a, c, g, or t
  misc_feature (1267)..(1270): n is a, c, g, or t
  misc_feature (1274)..(1274): n is a, c, g, or t
  misc_feature (1279)..(1280): n is a, c, g, or t
  misc_feature (1284)..(1284): n is a, c, g, or t
  misc_feature (1287)..(1287): n is a, c, g, or t
  misc_feature (1294)..(1296): n is a, c, g, or t
  misc_feature (1298)..(1298): n is a, c, g, or t
  misc_feature (1301)..(1304): n is a, c, g, or t
  misc_feature (1315)..(1315): n is a, c, g, or t
  misc_feature (1317)..(1317): n is a, c, g, or t
  misc_feature (1320)..(1321): n is a, c, g, or t
  misc_feature (1323)..(1325): n is a, c, g, or t
  misc_feature (1328)..(1328): n is a, c, g, or t
  misc_feature (1331)..(1337): n is a, c, g, or t
  misc_feature (1340)..(1341): n is a, c, g, or t
  misc_feature (1345)..(1345): n is a, c, g, or t
  misc_feature (1348)..(1350): n is a, c, g, or t
  misc_feature (1352)..(1352): n is a, c, g, or t
  misc_feature (1357)..(1359): n is a, c, g, or t
  misc_feature (1364)..(1364): n is a, c, g, or t
  misc_feature (1368)..(1369): n is a, c, g, or t
  misc_feature (1371)..(1373): n is a, c, g, or t
  misc_feature (1379)..(1380): n is a, c, g, or t
  misc_feature (1382)..(1386): n is a, c, g, or t
  misc_feature (1390)..(1391): n is a, c, g, or t
  misc_feature (1393)..(1395): n is a, c, g, or t
  misc_feature (1397)..(1399): n is a, c, g, or t
  misc_feature (1402)..(1405): n is a, c, g, or t
  misc_feature (1407)..(1409): n is a, c, g, or t
  misc_feature (1412)..(1413): n is a, c, g, or t
  misc_feature (1415)..(1420): n is a, c, g, or t
  misc_feature (1422)..(1422): n is a, c, g, or t
  misc_feature (1424)..(1426): n is a, c, g, or t
  misc_feature (1430)..(1435): n is a, c, g, or t
  misc_feature (1442)..(1442): n is a, c, g, or t
  misc_feature (1444)..(1445): n is a, c, g, or t
  misc_feature (1449)..(1453): n is a, c, g, or t
  misc_feature (1461)..(1461): n is a, c, g, or t
  misc_feature (1463)..(1463): n is a, c, g, or t
  misc_feature (1468)..(1468): n is a, c, g, or t
  misc_feature (1470)..(1471): n is a, c, g, or t
  misc_feature (1477)..(1477): n is a, c, g, or t
  misc_feature (1480)..(1481): n is a, c, g, or t
  misc_feature (1483)..(1485): n is a, c, g, or t
  misc_feature (1489)..(1493): n is a, c, g, or t
  misc_feature (1495)..(1496): n is a, c, g, or t
  misc_feature (1498)..(1500): n is a, c, g, or t
  misc_feature (1503)..(1503): n is a, c, g, or t
  misc_feature (1505)..(1507): n is a, c, g, or t
  misc_feature (1509)..(1509): n is a, c, g, or t
  misc_feature (1511)..(1511): n is a, c, g, or t
  misc_feature (1514)..(1515): n is a, c, g, or t
  misc_feature (1517)..(1517): n is a, c, g, or t
  misc_feature (1519)..(1520): n is a, c, g, or t
  misc_feature (1523)..(1524): n is a, c, g, or t
  misc_feature (1526)..(1527): n is a, c, g, or t
  misc_feature (1531)..(1533): n is a, c, g, or t
  misc_feature (1535)..(1536): n is a, c, g, or t
  misc_feature (1539)..(1541): n is a, c, g, or t
  misc_feature (1543)..(1548): n is a, c, g, or t
  misc_feature (1550)..(1550): n is a, c, g, or t
  misc_feature (1552)..(1552): n is a, c, g, or t
  misc_feature (1555)..(1555): n is a, c, g, or t
  misc_feature (1558)..(1560): n is a, c, g, or t
  misc_feature (1563)..(1563): n is a, c, g, or t
  misc_feature (1565)..(1565): n is a, c, g, or t
  misc_feature (1568)..(1570): n is a, c, g, or t
  misc_feature (1572)..(1573): n is a, c, g, or t
  misc_feature (1575)..(1575): n is a, c, g, or t
  misc_feature (1577)..(1578): n is a, c, g, or t
  misc_feature (1580)..(1581): n is a, c, g, or t
  misc_feature (1584)..(1588): n is a, c, g, or t
  misc_feature (1592)..(1592): n is a, c, g, or t
  misc_feature (1594)..(1595): n is a, c, g, or t
  misc_feature (1598)..(1598): n is a, c, g, or t
  misc_feature (1601)..(1601): n is a, c, g, or t
  misc_feature (1603)..(1604): n is a, c, g, or t
  misc_feature (1606)..(1606): n is a, c, g, or t
  misc_feature (1613)..(1613): n is a, c, g, or t
  misc_feature (1615)..(1615): n is a, c, g, or t
  misc_feature (1621)..(1621): n is a, c, g, or t
  misc_feature (1623)..(1625): n is a, c, g, or t
  misc_feature (1627)..(1629): n is a, c, g, or t
  misc_feature (1633)..(1633): n is a, c, g, or t
  misc_feature (1636)..(1636): n is a, c, g, or t
  misc_feature (1638)..(1638): n is a, c, g, or t
  misc_feature (1640)..(1641): n is a, c, g, or t
  misc_feature (1652)..(1652): n is a, c, g, or t
  misc_feature (1658)..(1658): n is a, c, g, or t
  misc_feature (1662)..(1662): n is a, c, g, or t
  misc_feature (1664)..(1664): n is a, c, g, or t
  misc_feature (1667)..(1667): n is a, c, g, or t
  misc_feature (1669)..(1669): n is a, c, g, or t
  misc_feature (1674)..(1674): n is a, c, g, or t
  misc_feature (1681)..(1681): n is a, c, g, or t
  misc_feature (3019)..(3019): n is a, c, g, or t
ttgttggaatgggcattcagtcggagattctaattggaaaggctggtcaaacaggattaaaacagcaagagcaagttgaagtagtacaaagatttcgagatgggataacaagggttcttgttgcaaccagagttggtgaagagggtttagatatttcagaggttaatttagtagttttttatgataatgtaccgagctcaattagatttgtgcaaagaaaaggtaggactggcagaaaaaacactggtcgattaatagtgttaattgcaaaagatactattgatgaggcgtattactggattggtaagcgaaaaatcaaattagcggataacatggctgataagctcactaagcatcttgaaaagactgagcaggtaatggatgactttttttagttacgaaagtcttttgattatgtggtaaccatactgggtttttactggctctgaaatttgacccgcttgtagattaaatgcagtagtttcaaactctttcaccatttttccccttccaaaatagcccaagttgccatccctttttgcacttcccgaatcaatagagagttcttttgccagttttccaaanttntnannnttnttnatnntcnntnanacgnntannnncncannntgnttctncnnnnnnanntgagancannnnatctnnttnganannnccatcnnnccnancaanaanannnatnantagtnnnatnnnnannganannnctnngtannnnnnnnntnnnnaancnnntnannnnttnttnnnnagntnntnntttnatnnanntnntnnnnnttttnnntnannannangnntnannnttcnnanannntnnnnnnnannnnnnannnanttnntgnnnnngntnnntntgnnnnttttnnnnnnnannnnnnnnnnnnnnnnntgnntannnnnnntnnnannntntnnnnnnnnnnntnnnnnnntnnnnnaanaactnnnatannntcncnnaannnnnnnanatnncannnnnnntnanatnnnnntnnnnannattnnntannnntannnntnatnnaatnngtnnnnnnannntnnnannnnntaananngnanntnttttnnnnnagnnnnaaagatnnntnnnnatagatnnnnnngnnttnaanntnannngtcttnnanntnntnnagnttnnnnancntanaannnannnntnnagnncnantncnntnattntnnggangnnatttgtctttctgtttntnattnnattnacnnnnantntnngtnnnnagangaatnntttngtnaataagnnntntannnnttttaattttnanatnncnnngtnttnnnnnnntcnnatantcnnnanaaaannnaaatntcannannntaaaanntnnnnnaaanncnnnannnatnnnnannnttnntnnnnnngngnnnaaannnnnnaaaaatnanntttnnnnntacggtgntnattanannttttanganntnnngtannnnntnnannnttnannntncntgnnangnnaanntnntcannntnnacnnntnnnnnntngnacnttnnnttncnaannnanngnanntnngtnnnnnctcngnnaanaantnncnaggcttngngagaantnnnannnttanttnanannaattcgtcaanttgtgncgtntntcntnaaaanactcgantaatcatgcaaaaaactatttgatcatgtgaataattcatgccaaaatcatcacatcaagttctttcataaagaagaaataggtagtataattatcgtaattcaatatggaaggtgatccgacaggaggcatgtggatatatcttatctttttcgcgattccactagtaagaataattccgcgtattttaagaaagtatagacgcaaaaatgccggattggaaccggaaccagctgaaaaagatcatgcaggacagtttttcactagtgaacgaatgccagaaccaccaaaatacagggaaccacctccatcggaaccacagtcaaaacctgacagtaaagatggttgggtcggcaaagacgattttaaacgataagattgttcatgctttaaattattcatgttttaatcctgtttattgacatcatacttcactgttaacgaagcaaacaaaattcttcctacagttattgagaaatttaactatgcaaaaaagctaaaggatgagattgttaagacggagcaagaattagccacaaacgtatcagcaaccagctctttagcagaatacgccactttgaagcaaaaattaaactctatagtttccaaattttatcaatcaatagaggatcttgaaagtacgggcgttatactaaaaggacttgatgagggtttacttgattttcctgcaagacgctttaacgaggaaatttggctttgttggaaagaaggggaaactgagattaaattttggcatgaaaaggatgttggatttatgggaagaaaaccaattagtgtaagtactgaatctttagtgtaatgatttctgtctggttacgtgtgattcgcatccgttttttattagcatcagtgatagcagtatccgtaggtttagcaattacttggtggcatactggaagcataacagtatttgatgcagcattaacaatgggtggcgtgcttgcccttcatgcaagtgttgatttgcttaacgattattgggattttaagcgtaaaatagacacagtaactcaaaggacaaaaatgagtggtggttctggtgttctacctgagggtttgttaaaacctggacaagtttatgcagcaggcattgcttttttggtacttggcactgtaattggaatatattttgttattacatatggcataattattggggcaatacttggttttgcagtagtgtcgatttatttttactcaactaaaattgttgattggggcctggcggaagtttttgttgccataaagggaactatgattgttataggaacttactttgttcaaacatctcagatttcagaatccgtcatattgggnggaattgttgtaggagcattatcatcacttgtgttatttattacctcatttccagatcatgatgcggataaatcaaaaggaagaaaaacacttgtcataaatctgggaaaacaaaaagcatgcacatttttttggatatttccaataattatttacagtgtaactatagtcgccgtcataatcagtgtttttcctattttctgtctaatcatccttggaactattcccatggtgataaaatcaggcaaaaaactaaaacatgggtataatgaattgaataaaattattccagtcatgagttctactctagtttttagtagacttactggtgtattgcttgtttttggtttcattataaatataggctaacaaaaattttatttttactaatgacacaaaatatgattaataagaaaatatacttatagattacatgaaggtgattacttgtgccagttgatcctgtttgtggaatagaaatggatgaagatattgcagtagttcatgaattagatgggaaaaaatactttttttgttgtgatggttgcagaaaaatttttgtgaaaaagccaaaaaaatacaaaaaaaatgtttagataggaaatgaaccgcacatacgacaaaattttgaatctggttttatcttatacctgcaattaggacacttgaatttagaagaatgaagatttattggagcatcaaaatattttctgtatctcatgtaataatacaaagattcttttgatttgatcaaaactttatcagcagcagcgattttttttgtttcttccttaaaaaatttatcagatattgtattattaaacatgctaattagtccagatgtacctgccccatcttgcatggctgctttttttctccaaacaactgattttggaatcttgttttcaaataatttacgcagtatccattttccatatttttgaccattttcaactttaactttataatttacaggtaaag

SEQ ID NO: 1511 - DNA, 4000 bp, Escherichia coli
  misc_feature (1989)..(1989): n is a, c, g, or t
aacttattgccctctttgatcagacccatcgcaatacctgccacatgggccttcatcggcacacctgcatccatcagcgcgaggctgccgccgcagaccgacgccatcgatgacgaaccattcgactcggtgatctcggacaccaaacgcacggagtagctgaactcgtcggagccaggcaatgcggcgatcagcgcacgcttggccagacgaccgtgaccaatttcgcgacgctttggcgagccgacgcgacctgtctcaccagtagcaaacggcggcatgttgtagtgaagcatgaagcgatcactgtactcaccggtcagcgcatcaattttctgctcgtcgcgtgccgtgcccagtgtggccaccaccagcgcctgcgtctcaccgcgggtaaacaaggcagaaccatgagtgcgcggcagcacgctgctacgaatcgaaatcgggcgaacagtgcgcgtatcgcggccatcaatccgtggctcaccgtcaagaatctgcgagcgaacaatcttcgactcaagaccaaacatgatgtcgccgacttccgcagaatctggtgtcgatgtgccggaagcagcagcttcctcagccagcttggctgaaacttcggcgtgaatcgagcgcagcttgtcggaacgcgcttgtttttctttggtgcggaatgcatcgcgcagtttttcttctgccagcgcagtgacacgcgcaatcagcgcctcgttctgcgagggcgctatccatggcacctctggcttaccgccatcgcgtaccagatcatgaatggcgtcgatcactgccttcatctgctcatggccgtaaacaacggcacccagcatgacttcttcggacagttcttgcgcttcggactccaccatcagtaccgcagcctcggtacccgcaaccacgagatccattttcgagtgaggcatctgcgaaacagtcgggttcaacacgtactggccatcgatataaccaacgcgcgctgcaccgatcgggccgttaaaaggaatgccagcaacgcacagcgccgctgatgcgccgatcatcgaagggatatcggggtcgatttccgggttgactgacaacacatgaatgatgacctgcacttcattcaggtaaccctcagggaatagcgggcgaatcgggcgatcaatcaggcgcgacgtcagcgtctctttttcggacgggcgtccttcgcgcttgaagaaaccaccgggaatacgtccggcagcataagttttttcgacgtagtcgacggtcagcgggaaaaaatcttgaccgggcttggcttctttacgagcaaccacggtcgcgagtacgacagtatcttcaaccgttaccatcacggcacctgacgcttggcgagcaatctcgccagtttccagcgttactgtgtgttggccatattggaagctctttgtgactttgttaaacattgggtccatcctttcattttttgccgacagagtttcaggcgctgtcgttcacctcaccaccggcgggcattgccagcccaccgcacgactttagggttaccgctacctgcgagtttatgcaggcttcaaaaacgcgaaatgcccgcatcagttggctgatacaggcatttgcagatagatcgtttgggcaaaggcttacttgcgcagacccagtttttcgatcagagcacggtaacggtccgtgtccttgcgcttcaggtaggccagcaggctcttacgacggttgaccatcatgatcagaccacgacgcgaatgatgatctttggcgtgggccttgaaatggccattcaactcattgatgcgtgcagtcagcaacgccacctgcacttcgggggacccggtgtcgttttgaccccgagcatttgcagcgatgaccgctgccttgccttctttggacactgccatgataaaaaccctttcacatgcggcattcggagtcgcaaccccagaaaccgtgacaacattgataacttcgcctttcgaggccaangcaagattatagcctaaaccgactccccgacggctaagccatttggcaaagcctcacagctgcggattcagcttctcattctttgattgcaatttatttaacgctgacaagtaagccttggccgaggccaccacgatatccagatcagcgccgacgccgttcacgatgcggccattcttcgataaacgcatggtcacctccccctgcgactgcgtgcctgtggtgatggcattcaccgagaacagcagcagctcggcgccgctggccgtgtgcgactcgatcgcattcacgatggcgtcgaccgggccgttgccctcgccctcgcatttgatctccttgccctccgccgcgaacactaccttggccgtgggcttttcaccggtctctgagtgctgcgacaaggacacgaacttgtagaactctttctcatgcgcgctctgctcgtccgacaccagtgccatgatgtcctcatcaaagatatccgacttgcgatccgccagttctttgaaccgagcaaacgcagcattcacctcagactcggaatccaaggcgatacctaattcatccaggcgctgcttgaacgcattgcgacccgagagcttgccgagcacaatcttgttcgcgctccaacctacatcttcggcgcgcatgatctcgtaggtatcccgcgccttgaggatgccgtcttggtgaatgcccgaggcatgcgcaaatgcattagcacccaccaccgccttgttgggctgtactgcgaaaccggtgatctgagacaccagcttggaggtcggcacgatctgagacgtatcaatacccacgtccagcttgaaatgatccctacgggtttttactgccatcacgatttcttccagcgcggtgttgcccgcacgctcgcccaagccgttgatggtgcactcgatctggcgagcgccaccgatcatcactgcggccaaggagttggccacggccatgccaaggtcgttatggcaatgtacggaccataccgccttatcggaattagggatgcgttcacgcagggttttgagcgtatgcccgatcatctccggcacgccgtaaccgacagtgtcagcaaagttaatcgtagtcgcaccctcatcaatcacaccctcgagcacacgacacagaaagtcgagatccgagcggcttccatcttccgggctgaactcgacatcatccgtgaactgacgcgcaaaccggaccgccagacgggcttgctcgaccacctggtccggcgacatccgcagctttttttccatgtgcagcggcgatgttgcgatgaaggtgtgaatgcgctttctggctgctggctcaagtgcctccgctgcgcgcgcgatgtctcgatcattggcacgtgacagcgagcaaacaatcgactccttgactgtgcccgcaatagcacgaatagcatcaaaatcgccgggcgaagaggccgcgaaacccgcctcaatcacatccaccttcaggcgctctagctgacgagcgatgcgaattttctcttcgcgcgtcatggacgcgccgggcgactgctcgccatcgcgaagggtggtatcaaaaataatcagcttgttcgaatcgggcattttgtgctcccgggatattgaatcagtgggttgggcatattttcgcctaccctcgcatttattgcgcgggttgggcaaagctcaggttggggggaaaagagtgtctgcgccttagcgcagtaggtatagcagcagcaggccgaacgggctgccgagggaaagaaactgaggctggtggctgttgatcaacatgcaggtaagaatacgggggaatgccgcaaagtgcaaccgagagatttctattgccccgatagccggcgttactacttatcgtcgccgggctcggagcttgtctgcaccagactgaccgggttgcccttggcccagaaccagagcgctacaccgtaacccgacaagccatacacgacaaacagaccgaacagcaccttcggcgggtcgctcgacaccgccac

SEQ ID NO: 1512 - DNA, 4000 bp, Escherichia coli
  misc_feature (232)..(232): n is a, c, g, or t
  misc_feature (234)..(235): n is a, c, g, or t
  misc_feature (238)..(238): n is a, c, g, or t
  misc_feature (244)..(244): n is a, c, g, or t
  misc_feature (262)..(262): n is a, c, g, or t
  misc_feature (265)..(265): n is a, c, g, or t
  misc_feature (270)..(270): n is a, c, g, or t
  misc_feature (273)..(274): n is a, c, g, or t
  misc_feature (276)..(276): n is a, c, g, or t
  misc_feature (283)..(283): n is a, c, g, or t
  misc_feature (287)..(287): n is a, c, g, or t
  misc_feature (298)..(298): n is a, c, g, or t
  misc_feature (306)..(307): n is a, c, g, or t
  misc_feature (309)..(310): n is a, c, g, or t
  misc_feature (313)..(314): n is a, c, g, or t
  misc_feature (322)..(322): n is a, c, g, or t
  misc_feature (324)..(324): n is a, c, g, or t
  misc_feature (331)..(331): n is a, c, g, or t
  misc_feature (333)..(336): n is a, c, g, or t
  misc_feature (340)..(340): n is a, c, g, or t
  misc_feature (351)..(352): n is a, c, g, or t
  misc_feature (354)..(356): n is a, c, g, or t
  misc_feature (360)..(360): n is a, c, g, or t
  misc_feature (367)..(367): n is a, c, g, or t
  misc_feature (370)..(371): n is a, c, g, or t
  misc_feature (1986)..(1986): n is a, c, g, or t
  misc_feature (1989)..(1989): n is a, c, g, or t
  misc_feature (2331)..(2331): n is a, c, g, or t
  misc_feature (2338)..(2338): n is a, c, g, or t
  misc_feature (2923)..(2923): n is a, c, g, or t
  misc_feature (2938)..(2938): n is a, c, g, or t
  misc_feature (2944)..(2945): n is a, c, g, or t
  misc_feature (3584)..(3584): n is a, c, g, or t
  misc_feature (3593)..(3593): n is a, c, g, or t
  misc_feature (3595)..(3595): n is a, c, g, or t
  misc_feature (3605)..(3605): n is a, c, g, or t
  misc_feature (3608)..(3608): n is a, c, g, or t
  misc_feature (3638)..(3638): n is a, c, g, or t
  misc_feature (3704)..(3704): n is a, c, g, or t
  misc_feature (3729)..(3729): n is a, c, g, or t
  misc_feature (3832)..(3832): n is a, c, g, or t
  misc_feature (3891)..(3892): n is a, c, g, or t
  misc_feature (3918)..(3918): n is a, c, g, or t
  misc_feature (3925)..(3925): n is a, c, g, or t
  misc_feature (3931)..(3931): n is a, c, g, or t
  misc_feature (3942)..(3942): n is a, c, g, or t
  misc_feature (3949)..(3949): n is a, c, g, or t
  misc_feature (3952)..(3952): n is a, c, g, or t
tacacctgcaacttttgcagttgttacactcataactgcagaagcaatatgagcatatcttccagcagggacataacatccagctgtgttaacaggaattaatctttgacctgcaaataatccttcagaaagctcaacttcaaaatcttgtccatagttttttaattgtgcttcagcaaatttttttactctctcatgagcaaattgaacatcatctttagttttttgatcnanngtntttttnatttcttcaattctttcnttngaaanaannanatcaccntcanatttatcaaanttttttgnnanntcnntacaaccntnttctttngnnnnttcnatatcttttannannncttnaactatnccnnttgtttttgtgtcgtctgttgatgatgtttttggtgatttttttaaatattgtattgccattgattatttcctttgttttaagagcatcttaataaagtaaaaatgaattttattcaatgatttaaaagtaaaatctataggccatatttacactagctacacaaagaatgattactaaaagatacaaacttatataatcgaatggtttcataaattttgtttagaattaatctaaggcaactacagctgctgcaatagacgctagtcttgcttgagcttcatcagatctgcttgtaattacaactggaactttgccaccaactacaactccagcagcacaagctcccataaaataaatcatcattttaactaaaccatttccagtctcaacacttggaactaacaaaacatcagcttctccagctactacatttttaattccttttatagcagctgatttttttgaaatactattatcaaacgctagtggcccaaaaacatcggcctctaaattttcttcttttgcaagttttgttaattcagcagcatctaaagaacttggaacactatctaagacttcttctgtagccgataaaactgcaatttttggtctagatattcctattctattcgaaaaattaattacgtttttaagaatatgcatctttgttttaacatttggcaaaacatttaaagcaccgtctgtaatgattaatggtttactatctttttcagtagtcatatgccaaatatgacttaatcgagttttacctaacaaattatattcacgttttaaaacttctttcattaggacatctgtatgaatatgacctttaacaattatttttattttatcttcactagcaagtttagctgcaatttttgcagtagcattctcaataggctcatttattatttcatattttgaaatatcccattttaaatcctcagcacattttagaatttctttttcatcaccgataaaaataggttcaattaaattttcattaactgcatcttgaacagaaagcattggtaaaggtttgcctgcatttacaactgcaacttttacacctttttttttatgtgctacatctagcaagttgtttggacaaataatttctttattcgaaagcataaacaatgattataattaaattttaaaatgtatatagtagattttattattttagatattaaatttattaaatgattaaagaattcaacattaattttactaaagaagaaatatctttgatttatcaaaaagtaaaagactatccttgggattccatagctaatttggaaaattgggatcatggaaccaataaagagtatttaaaagaattgtgcaattattgggttaaagattttgattggggtaaacacgaattagaacttaataaattttctaactttactacaaatgtagatggagaagaaattcattttattaaagaaaaaggaagtagtccaaattctgttccattacttttaatgcatgggtggccaggatctgttattgaatttttagacatcattgaaaaacttgctcatcctgaaaaatttggaggaaataaaaaagactcttttgatgtaatagttccttcattnccnggatttggtttttctagcaaaccatcgaaacctcttggcccaagaaaaatggctaaaatatttaacaaactcatgacagacaatcttgaatataaaaattacattgttcaaggaggtgattggggtgcaactattgcaaactggattggctatgattattctaatttttgtaaagcaattcatataaattgtcttaccatgcgtcacccagatggccctcaatctactgaagaaaaagattggcaagtaagatttgataaagatcaaattatacaagatggatatagaacacagcaagcaactaaacctcaaactttaagttatggaatgatggatagcccngttggtntagctgcatggataattgaaaaaatgcatgcttggtctgacttaaaaaataataaaattgaaagcgtttattcaaaagataaattgctggcaaacattatggtttatattttgactaaaacctttgatacagcaacctggatatattatggaagaagagaagagggtggaaggttttttccaaaaaattttaaaaagatagaaattccaacagctatagcaatatttcctgctgaaatgtctgaatggccaccaagatcttatgttgagagaatatttaatgttcaacaatggactgaaatgtcagcaggtggtcactttgcagctttagaacagccagatctacttgttaacgatataagaaaatttttaagaagtttaagatatgatccttatgatgaaaggggtggtcaatttaatctttaagaactctaatatctttttcattaagacttaaaaataccttttcaccaacttcaaacacatcatttgtatcattagaaataacgtataatttacctatctcagagtttaaaatatattggtaactactaccaacaaaagaagcattatttactgttgcgtnaatacaattcttgtnatcaannctttcaattttaattttttcaggtcttaaggctactgaaactgttttagtaaaatcattatcactttcaattttcacttttatctctgctaattttaattcataaatatttgattgtttatttattatttctgctttaaccacatttgcatcaccaataaaattagctacaaatttattttttggaaaattataaagatctttaggacttccttgttgagcaattacagctttattcataacgatcactttatcagatattgctagtgcttcttcttgatcatgtgttacataaattgcggttactccaagtttttgttgaatttctcttatatcttcacgaacttgtcttctaagttttgcatccaaatttgaaagaggttcgtcaaataataacactttaggttttagtacaattgctcttgccacagctactctttgttgttgtcctccagataattctgatggcattctgttttcatatccatctaagtttactaattttaaagtttctaatgctttttctgtatattcttctttatttacgttgatcatttttaatccataagaaacattttcaataacactcatatgtggaaataaagcataagactggaataccatcgaaacatccctgtcngttgctggnantatagtaacntcntcattatcaactaaaatttttccttcggtngctctttcaagtcctgcaattattcttaatgatgtagtttttccacacccagatggaccaagtaangtagttaaagttccagcttcaaaantacaactgacattatcaacagctacagtttcattaaatttttttgtaatattttcaaattttacttcagcttttttcattatcctaagtttccttgtaatatncctgcagattgatctcttcttcctaatttacgtttgcctattattaattgcataagtannattgtaaacaacataacaactattantgcagangaatanactattgctanaccaaantcnttattttctaatcttcctaaaatgtatgaaacagctaagtcataattt

SEQ ID NO: 1513 - DNA, 4000 bp, Escherichia coli
  misc_feature (1191)..(1191): n is a, c, g, or t
  misc_feature (1985)..(1985): n is a, c, g, or t
acctttgatcaagcgcgcaatttctctcgcaaagtaggtcagcacgccatctgcgccggcacgtttgaagcacagcattgcctccatcatggttttgtcatggtcgagccagccgttttgtgctgccgccttgatcatggcgtactcgccactcacctgatacgcaaatgtcggtactttgaattcctgttttacgaggcgcacaatgtcgagatacggcataccgggcttaaccatcaccatatccgcaccctcagcaaggtcgagtgcaacttcacgcaaggcttcatttgaattgcctgggtccatttggtaagtggccttattgcctttccccagattggccgccgagcccaccgcgtcgcggaaaggtccgtaaaacgccgaggcgtattttgccgagtaggccatgatgcgcgtgtagatccggccgcgttcctcaagcgcgctgcggatcgcgccgatacggccatccatcatgtcggacggcgcgacgatatcaacccccgctgctgcttgggttagcgcctgctgtaaaagaattttggtggtttcgtcattcagtacatagccgtctgcattcagcacaccatcctgaccatggctggtgtacgggtctagcgcgacatcggttagtacgcccaactccggaaagcgtcgcttcagttcatgcactgcgcgcggtaccaaaccattcgggttggtagcctctataccgtcgggggttttcagctgcggatcgatcaccgggaacagagccagcacgggtataccaagcgacatacattcttcggcaactggcatcaacaggtcgacggataaacgctcgacaccgggcatggatggcacggcttcgcgctttttttcaccgtcgagaataaagacgggataaatcaaatcagccggtgtaacaacatgctcgcgcatcatcgcgcgcgagaatgcatctttgcgcatgcggcgcatacgcgtggcaggaaagcgggcaagtggatcgtggctcatgatgaatctcatgcaagtgttgttgtcaatatttttagcagcgagacgctttttgtatcgatgaacttcctgataaagcggtgctcctagccataggtgttgatcacctcccgcttatcctccctgagcgggactggctcaaacgagtcagtgtttggaccctggaggcatctcccgcgctccagnggttttttccgtggatacggtttgttcttcttcatgatcgacgctcgtctcgagctgcaacaggctacagatggtgcgatctgcctcatccagaccgatccgcttgagcgccgagaatagctgaacggagaatggcagaggctggccttgctcgtcaacatagctggccagaacggtcttggcgagccggatcgcacccgattgctcttgtcggttgagcttgtctgctttgctcaagaggcagtggataggcttgccggtcggcgcgaaccactccagcatctcaatgtccagctcggtaaatgggcggcgcgcatccatgatcagcaccaagcccaccagcggctgcctgacctgaacatagcggccgagcagctgctgccagtggtgcttggccgtcccagccacttcggcatagccgtagccgggtaaatccaccaaaaacgcccgaatctcttcgctgcgggcgatgtcgcggcggtgctggccaacatgagcgccgccgatcgagaaatagttgatgtgctgggtccgaccgggcgtcttggaggcaaatgccagttttttctggttgcagagcaggttgattgcggtcgatttgcccgcattcgagcgtccggcgaaggccaattcagggacttggtattttggcaaatcctgtagtcgattcacggtcgtgaagaagcgggcttgccaaagaatggacatcgggaatgggtgcaggtggggccggcaaacgcggcggctgtcagcaggatagcgaaaaatcgctgatgggcattgtagtacaatgncaggctgtatttcgcgaccaactcaatcaattattgcccgggtgtttgaatgaatcgagtgctctcgttgtgtttaaaagtgtccgctgttgcgttgttctccacgcttcttactgcaggggcgacagaacaaaagtcagcagcagctgatcccgccaaaggcgccacgctgtactccggtggtgacccagcgcgcggcattaccgcttgtattgcttgccatggcgcagagggtaactcgggcattccgcaaaaccccaaactcggcggtcaacatgctgcctatatcaagaaacagttgcatgattttcaggggccggatcgcaataacgcgatcatgaccacgatcgccaaagcgatgacacctgaagatatcgacaacgtagcagcctatttggccacgcaaaaagcgacggccaatgtcgccaaggtcaaagaaaccgctgatctgggccgcaagatttaccgcgccggcatcgctgaaaaaaatgtaccggcttgcgcaggctgccacagccccaatggcgctggcattccggcacagtacccgcgtatcgctggtcagcaccaggattatgcggtgacgcagctaaccaacttccgtggcggcgtgcgtggtaattcggctcagatggtcgcaattagtaagcgcctaaccgacgatgaaatgaaggcggtatccgattacatcgccgggttgcggtgaatctcaatctcccggaacaagcgccaagaacctatctcaaacgtcaattacaaggcggttgcaccgtagacggtacaagacgtacataaggcgaaatgcgaccaaggtagtaagacgccgaatgagatggttggttatcgggtgaagtgaaccaataccggggggtggcggtgagccgcccctttttgttgatacaggcagatatggacgctctcgatacaagccaacaatcctcgcctagtacgcacggcatgctgctaacgaaccgtggacgctttgtcaccgagatggttgagctggtgtcttcgatgcgttttgcgatcagtttgttgaccgtaatctcgattgcctcggtcgtgggcacggtggtgttgcaaggcgagccgatgccaaactacgtcaaccagtttggcccgttctggtttgaagtattcgctcggttctctgtctactcggtgtattcagcctggtggttcttgttgatcatggcgtttctggtcacctcgacctcgctctgcatcattcgcaatgcgccgaaaatgatcgctgacatgaagagctggcgggcgaatgtccgtgagcagtcgcttcgaaattttcatcatcacgccgaatggactgctgatcgcgatatgacgcagctcgcgcgagcgtatgcgcagcagatcgcggcagccgggtatcaggtaaagcagataagtaaagatgacgcaattttgctgagtgcaaagcagggtggcgccaacaagctcggttatatcttcgcgcactcagcgattgtgattatctgcgtcggcggcttgcttgactccaatctggccattcgcgcgcagcaatggttacttggtaaagagacctttaaaggcagtggtgtaattgccgaaatcccggagaaacacagactcggaaccggaaacattaccttccgcggtaataccttggtgcccgagggtcagagcagtgacaccacgattctgcagatgggcgatggtgtgctgatccaggacttgccgttcacgctgcagttagaaaaatttatcgttgatttttattcaacgggtatgccgaagctatttgccagcaatgtcatcgttactgacaaagaaacgggtaacagtttcagggccacgatcaaggtgaatgagccgttgatttacaaaggtctggcggtttaccagtcgagctttgaagatggtggcagtcgtttgaagctgaccggctacccaatggcaggcgctggccatgcgcagtttgcgttggatgggcaagtggggaaagcctcacgcttggcgggtaatgcgggtgacta

SEQ ID NO: 1514 - DNA, 4000 bp, Escherichia coli
  misc_feature (167)..(167): n is a, c, g, or t
  misc_feature (1038)..(1038): n is a, c, g, or t
  misc_feature (1677)..(1677): n is a, c, g, or t
  misc_feature (1680)..(1680): n is a, c, g, or t
  misc_feature (1786)..(1786): n is a, c, g, or t
  misc_feature (1968)..(1968): n is a, c, g, or t
  misc_feature (1985)..(1985): n is a, c, g, or t
  misc_feature (2245)..(2245): n is a, c, g, or t
  misc_feature (2272)..(2272): n is a, c, g, or t
  misc_feature (2292)..(2292): n is a, c, g, or t
  misc_feature (2451)..(2451): n is a, c, g, or t
  misc_feature (2482)..(2482): n is a, c, g, or t
  misc_feature (2602)..(2602): n is a, c, g, or t
  misc_feature (2706)..(2706): n is a, c, g, or t
  misc_feature (2737)..(2737): n is a, c, g, or t
  misc_feature (2753)..(2753): n is a, c, g, or t
  misc_feature (2778)..(2778): n is a, c, g, or t
  misc_feature (2826)..(2826): n is a, c, g, or t
  misc_feature (2838)..(2838): n is a, c, g, or t
  misc_feature (2857)..(2857): n is a, c, g, or t
  misc_feature (2869)..(2869): n is a, c, g, or t
  misc_feature (2872)..(2872): n is a, c, g, or t
  misc_feature (2947)..(2947): n is a, c, g, or t
  misc_feature (2988)..(2988): n is a, c, g, or t
  misc_feature (3007)..(3007): n is a, c, g, or t
  misc_feature (3009)..(3009): n is a, c, g, or t
  misc_feature (3015)..(3015): n is a, c, g, or t
  misc_feature (3069)..(3070): n is a, c, g, or t
  misc_feature (3099)..(3099): n is a, c, g, or t
  misc_feature (3102)..(3102): n is a, c, g, or t
  misc_feature (3104)..(3105): n is a, c, g, or t
  misc_feature (3247)..(3247): n is a, c, g, or t
  misc_feature (3250)..(3250): n is a, c, g, or t
  misc_feature (3257)..(3257): n is a, c, g, or t
  misc_feature (3345)..(3345): n is a, c, g, or t
  misc_feature (3544)..(3544): n is a, c, g, or t
  misc_feature (3632)..(3632): n is a, c, g, or t
  misc_feature (3769)..(3769): n is a, c, g, or t
  misc_feature (3805)..(3805): n is a, c, g, or t
  misc_feature (3957)..(3957): n is a, c, g, or t
gaacatcggtgcgaatggtagccaagaacttcgacattttaatatcgtctacggcagcttccactttctctcttagctttccttttatctggttggtatgttcgagcatattatctatagacccaaactggttgataagctttgctgcagttttttctcctacgccnggacagccaggaaaattgtcggctgtatcgcccataagtgccaataggtctattacttgagctggggtgggaatgccatatttggcttccacctcttgcgtacctataatatcgtatcctccaccgtgtcgtgggcgatacatatatacattttcttgaatgagctgaccataatccttgtcgggtgtaagcatatatgtgctgataccctttttgccagcttgagttgcaatagtgcctataatatcatcggcttcgaagccatctacctgtaagataggtatatgcatagctccaagaatttgttttatgtagggaacagacagctttatgtcttctggtgtttcctctctttgcgccttgtattcgggatatgcctcgtggcgaaaagtgagtccgtggtcgaaagccactgcaatgtgtgttggattttcttttgttaaaacttcgtttagtgtattgcaaaaacccataattgccgatgtattcaatccttttgatgtgatacgagggttacgaataagggcatagtacgaccgaaagatgagtgcgtacgcatcgatgagaaacaatttgtccattgtataaatcttatttatgggtaaaattactaaaaaaataccataattaccgatataattcattatttttgtatcaaaatagttttccaatggattatctgtcgattataaaaaaaccaattagtcaggaattaaacgaatttatctcactgtttaacaagtcgttaacgcacagcgatggcttacttgcacgtgtgttagaacatattcgtaacaggggagggaagcgtatgcgacctatattaacactactaatagcgaagaattttggtgcagtaacgtttgttgcncaacatgctgcagtagggttagaacttcttcatacagccagtttagtacacgatgacgttgtggacgagagtggagaacgcagaggacaggcatctgtgaatgccatatataacaataaggtgtcggtattggtaggcgattatattctttcgacggcactattgaatgtggcttatacaaaatctgatgaaattgtaggcgaccttgcagaattgggacgtacactttcgaatggagaaatattgcagttgactaatatttcgaaccaaaagatatcggaagaggtgtattacgaggtgataaaacagaagactgctgccttgtttgaaacctgtgcagagattggagcaaaggctggaggagcatcaaatgaggctattaaggctgcaaaacagttcggtcagcatatcggaataatattccaaatacgcgatgatatattcgattattacgattcaaccgagataggaaaacccacaggcaacgatatgttggaaggaaaactgactctacccattatttatgcattgaaatctactggtaataaagatatgcttaacttggctatgaaggtgaaagaaggaacagtaagtgccgatgaaatagcccagttggtagcttttgcaaaagaaagtggnggnatagaatatgcagaaaagaagatgttggaattgcacaacgaggctttacaatttatttctgactatgtctgcaacgaagaaatatcagatgcgttgaaagcttacntggattttgtgattcaacgcaagagttaagtatgtgccatagctgcttactattttgtgagaaatatgctttaattttgtaaatattatttatacagaaacggtagataccatttggcgttgcaaaagtgggtgttttggagcacaaaacacccacttttgctgtgtaaaaaccatactttnggaatgcaaaatagtgnttttcacaatgcgttgatagtcaaaccgttatacgaatattatatttgtgaaagatttttacaacatttatgatgttttctataagtaatcctcttacagcaatcgtagcaagatactatacagatgaacttattatgtattgcaataacaccaaaagatagccttcaaagaataagagaaagatacgcaaaaacggtgttaggactatgaaaatatttagattctattcttcaaatcgtaatattctacttatctttgnccttaagattttaatataatactaatnagttataattaaaaaaaacnaaaatgaaattagcaaaactcttatttggcagtatgtttatgctttctactttattctttgcttcatgtaataagaaaggagaatttgatagccaccctccagcagtaaataaagaggattttaaattatctacttcacagtcgggcaaagatactctntatgttacgaataaagaagattttaagttgnatgctgtagaattgctaaataaggcagacaggaaactgctttgcagagtaaatcttaatgacgtaaaaaacactaagttagaggctgaaggtgtaacttatggtgaagtaaaatatacangaggtgaagcttctataataaagattaataattggggaaccatcgaaaaaactactattgcacgccacaaaaaagcttatgctatggcttatattggcaaaagnccctcggatatagaattaactctctttgttntaggagtgaatggtgncacagttgtaacggtaaaataaccntttatggtatataccagcaattgtagaaagatgtaaatcgtacatttngcaagtgaaaanaatattggtaggaggtagncgtctatgatanatntttacttcctatctttttaaatatttaatagtgttcagttgattgtattgaaactattatggtaagagagattgntgtatttttggttttatgaaattccaataaaatcaattgcnatgttatggtttcttctgntnaatgtntatataaagcaatgctgttctattgaatttaagaaataaaaaatcctgatttcnncgttgaaatcaggattttcgtattgtttnaangnnggtttagaagaacttaacctctttgccttcaatgtcgctgagcagcaaattggtgagacgactggtaccaagacggaaccaatagttggtgagccacttctcgccgagaacttctttgtagatggtatagaagataacggcntcnataacgntgtttatgcctcctgcaggctttagtcctacctgtacgccagttctgtcgtagaactccttaatagccgtacacataatgtaaacagnctctggggttgcgctaattttctctttacccgtgcttgttttaatatagttagcacctgcaaacatagagagtagggcagctgcctttatgttgcgagcattttttaagtcgccagtttcgagtataaccttcattgggacatcgccacaagtctgcttcaattcactaatttggtcgtaaacatcttcataatcgccngaaaggaatttgccaacgggtaatacaatatcaatctgtgtggcaccgtccttgatggcaagtgccgtttcgatggtcttaacttcgnggaatgtttgagaagatgggaagtttcctgttacgtttgttatgtctacaccatctatttctaagctatcggcaatcagttttgtgaagcacggataagcacaaacagctccaacgtgtggaagagtagggtattcntgtgcaaatttgttcactttctcgaccattgcgagnacttcttcttctgtgtctgtggtcttgagagtagttaattctacacttccgaggaggaatttcttgacctctacgttattgttttctgcaactttctcttcaataatcttctttactgctgcttttacttcctcgtctgttatgtcgaggtngtattgtttcagcatctcatcgtacttacttgtgtatccaata

SEQ ID NO: 1515 - DNA, 4000 bp, Escherichia coli
  misc_feature (473)..(473): n is a, c, g, or t
  misc_feature (514)..(514): n is a, c, g, or t
  misc_feature (548)..(548): n is a, c, g, or t
  misc_feature (589)..(589): n is a, c, g, or t
  misc_feature (594)..(594): n is a, c, g, or t
  misc_feature (611)..(611): n is a, c, g, or t
  misc_feature (618)..(618): n is a, c, g, or t
  misc_feature (780)..(780): n is a, c, g, or t
  misc_feature (821)..(821): n is a, c, g, or t
  misc_feature (824)..(824): n is a, c, g, or t
  misc_feature (842)..(842): n is a, c, g, or t
  misc_feature (875)..(875): n is a, c, g, or t
  misc_feature (886)..(886): n is a, c, g, or t
  misc_feature (889)..(889): n is a, c, g, or t
  misc_feature (896)..(896): n is a, c, g, or t
  misc_feature (901)..(901): n is a, c, g, or t
  misc_feature (906)..(906): n is a, c, g, or t
  misc_feature (946)..(946): n is a, c, g, or t
  misc_feature (959)..(959): n is a, c, g, or t
  misc_feature (989)..(989): n is a, c, g, or t
  misc_feature (994)..(994): n is a, c, g, or t
  misc_feature (1012)..(1012): n is a, c, g, or t
  misc_feature (1025)..(1025): n is a, c, g, or t
  misc_feature (1141)..(1141): n is a, c, g, or t
  misc_feature (1448)..(1448): n is a, c, g, or t
  misc_feature (1475)..(1475): n is a, c, g, or t
  misc_feature (1478)..(1478): n is a, c, g, or t
  misc_feature (1480)..(1481): n is a, c, g, or t
  misc_feature (1517)..(1517): n is a, c, g, or t
  misc_feature (1592)..(1592): n is a, c, g, or t
  misc_feature (1695)..(1695): n is a, c, g, or t
  misc_feature (1716)..(1716): n is a, c, g, or t
  misc_feature (1721)..(1721): n is a, c, g, or t
  misc_feature (1727)..(1727): n is a, c, g, or t
  misc_feature (1730)..(1730): n is a, c, g, or t
  misc_feature (1779)..(1779): n is a, c, g, or t
  misc_feature (1842)..(1842): n is a, c, g, or t
  misc_feature (1985)..(1985): n is a, c, g, or t
  misc_feature (2160)..(2160): n is a, c, g, or t
  misc_feature (2165)..(2165): n is a, c, g, or t
  misc_feature (2863)..(2863): n is a, c, g, or t
  misc_feature (3566)..(3566): n is a, c, g, or t
  misc_feature (3928)..(3928): n is a, c, g, or t
gcagtccatggaggttgccgaagtcgaagaacatgagtttgccgatggaggcaaatgctagaacaagcccaacaatgagggatgcctgcctgctgaggaaccgtgcgcgaagcaagacgtagcaagccaagagcatccataagacggacaccgtggcgtggccgataaggtaaccacccttcacgttgcctgatagtccacccaggtaggtggctatggacacgatggccagcatggaaagatgaaggctgaccagcgcaagcccagattgagcggtgccggaaagatgcgttaggccggagcggcgtcgtaaagcaaccagcagcaggatgatgatggcgacggcttgggcagtagcccaggaagtgccaagccacagaaaggtaccgctaagtacgccgtctgtgaccatataggtgaggataagtgctgttgctgcccagcagaaccaaacaccgccgcggaactttatnccggaggtcatccaccaggtgacacctacggctgtgaggangaaaatgcacaccaccattggtttattcagcagnacatcagcgccgagtggcgcggccataacatacacaggcangaagntgagggccaggaagacngaaccgnattggatcagtgctttattgtgattgactatcgcgatggcgatgtagcagattgatcccgcaatgagaacccagctcagggggcgtgtggagacgtgggtagacaacgatggcatggtttcgagtccaagggcaccgaggccaaacagcacggcaggtgcgncgatggtcagtaggggattccacggcatacgctcggtgttngcncccattgcgacaaatatnacggcggtgataaccacaacgggggttgtgggnaggatcatggnagntgaatcnctgancaatncgtagaagaaggccgtaatcagcgtaaagatgacagcaanatcaatacccttngaccacttccgaatgtaggcagcgatggcnagggntgtgggtgcgagtgtgcnaggaagagtcganaattcggcgtagttaacgcatgaggcaaagtagatgctacctactatcgacgccccgatacccaaagcaattgccacaccttcctcgttccacacggtggctagtgctatgaaacngatggtaagcgcgatgattgttgctgttccagcaggttctggccaccattcgagtatgaccacaaggctaaataccgtggccatcgcgctgaggagagatgtggtgcaaaaggcgccgaccgctgctttatgcgcgtgacgcttatgggctacgacaccaattccacccatcacggcggagaaaacgctggccaggatgactcggccgagggggccgagcaggccattttgaatggcaaggaccaccaggaagaacacaccggcaatggtgatcagcgtgcctagcgtggcaatgaccctcacaacnatctgttccgatgtccaccatctggancgngnnggaagaacctggtccgcttgcgaacctggttgcccnggtggctgaatatttgcttgtgcactgtacacaggcgttggttgaattgggggtctcgtgagcggcgcgggttgnacaggtggattcgcagccccaggattgatatgaggtacgccaggattgatgcgtggcccggctggattgacgatgccggacggctgtggggctggcgcagagngtgcagaaggcatggcagccngttgntctgcngcntgttgttctgtggtggactgaccgacagattcccccgactgttctggtnctgagagctgttgccgctggaggagcagcatgtgcatgtccatgcgggcttcgcccagtgccntttcggcctgactcagcttttccagtgtcctttcgaagagaagtttttctgtatgcgaaatctccatggttttgatcctaaggaacccacagcgtacgcagctaaaaagttatcaacttgcaacgttatggggttagtgatanattgatgtgcgctaccgcctagaaactgtgctgtgcatggattttaggccgcaagtggagatccctcccaccagaagccgccacattgtggcaggataatggttattgtgaagttcacctcactgctacgcgcagtgtagatgcttcttggcacgatggatctcccgctttcacngaatnatggaagcgggtttttgtgtgtcatgtagggaaaactagttgcggtacggtgcgtacattatctctatcactgcaacttaggagtacacatcagcgctgaagctcgcattaatgagcgtattcgagttcccgaggtccgtcttgtgggccccagtggcgaacaggtgggcatcgtccgcattgaggatgctcgcaagttagcgtatgaggctgatcttgatttggttgaggttgccccgaacgctaaacctccggtctgcaaaatcatggactacggcaagttcaagtatgaagctgcacagaaggcacgcgaggctcgtaagaaccagcagcagactgttgtcaaggagcagaagcttcgtcccaagattgatgatcacgattatgagacgaagaaaggtaatgtgatccggttcttggagaagggttccaaggtgaaggtgacaatcatgttccgtggtcgtgagcaatcacgtcccgagcttggttaccgtctcttggaccgtttggcagccgacgtcgccgattacggcgttgttgaaaccaaggcaaagcaggatggccgcaatatgaccatggtcatcggcccggtgcgcaagggcaagaagtaaagacacattctagggttttaaggactaaatctcatgaagcaaaagacccacaagggcaccgcaaagcgtgtaaaggtaaccggttcnggcaagctccgtcgcgagcaggcgaaccgccgccacctcctcgaaggcaagccgtccacccgtactcgtcgcctgaagggcacgacggaagtggctaaagctgacaccaagcgtgttaagcggctgctcggccaggcttaatcgccgcctgttcacccctccaccaactctcaaagatttaaggaagtattactgtggcacgtgtcaagcggtcagtaaacgccaagaagaagcgtcgtacaattctgaagtccgcgaagggctaccgcggccagcgttctcgcctgtaccgcaaggctaaggaacagtggttgcactccatgacttacgcctaccgcgaccgccgtgcgcgtaagcgtgagttccgtcgtctgtggatccagcgcatcaatgctgccgcccgcatgaacggcatcacctacaaccgtctcatccagggcctgcgccttgccgagattgaggtggaccgtaagattcttgcggagctggctgtcaacgatttcgctgcgttctccgcaatttgcgaggccgccaaggctgccctgccggaggacgttaacgcccctaaggctgcgtaagtaatattgtgccttttatggcaagaaggtcctggtgtcatatcattgccaccagggccttccgcttgtattgaggattttcggtagcatgggtatgtttacagaattcttagtgttctacaagngtctaggcgggagataaggcatgacttttgatttcggtggtcggcagtacgataaagacgggctgcctattgaaaagacaccgccaccagcagcaacgccccaggtcaatccatcaccgtcctaccagcatccgcagcagcaggcaccgttcgcacaaccccagcagcagacgcctgggtttgctacgccaacgcctcagtctcagccagctccttttgcacaaccgctgatgcaacaacctgggtatggtgtggcggccccagttcctgtgggctaccagcagaagtcgtgggttgcatccttcctgcttgcctttttccttgggtcttttggggtccacaacttttacctcggttactcnagccgtgcgaaggttcaactgctactgggggtcggtggtatcgtgacctcacctttcatcattgggtttctt

SEQ ID NO: 1516 - DNA, 4000 bp, Escherichia coli
  misc_feature (1985)..(1996): n is a, c, g, or t
  misc_feature (1998)..(2004): n is a, c, g, or t
  misc_feature (2006)..(2007): n is a, c, g, or t
  misc_feature (2009)..(2014): n is a, c, g, or t
  misc_feature (2051)..(2054): n is a, c, g, or t
  misc_feature (2057)..(2060): n is a, c, g, or t
  misc_feature (2062)..(2070): n is a, c, g, or t
  misc_feature (2073)..(2075): n is a, c, g, or t
  misc_feature (2077)..(2079): n is a, c, g, or t
  misc_feature (2118)..(2121): n is a, c, g, or t
  misc_feature (2123)..(2123): n is a, c, g, or t
  misc_feature (2125)..(2132): n is a, c, g, or t
  misc_feature (2134)..(2135): n is a, c, g, or t
  misc_feature (2137)..(2139): n is a, c, g, or t
  misc_feature (2141)..(2144): n is a, c, g, or t
  misc_feature (2146)..(2146): n is a, c, g, or t
  misc_feature (2183)..(2190): n is a, c, g, or t
  misc_feature (2192)..(2192): n is a, c, g, or t
  misc_feature (2194)..(2196): n is a, c, g, or t
  misc_feature (2198)..(2199): n is a, c, g, or t
  misc_feature (2201)..(2201): n is a, c, g, or t
  misc_feature (2203)..(2205): n is a, c, g, or t
  misc_feature (2207)..(2208): n is a, c, g, or t
  misc_feature (2210)..(2210): n is a, c, g, or t
  misc_feature (2212)..(2212): n is a, c, g, or t
  misc_feature (2249)..(2249): n is a, c, g, or t
  misc_feature (2251)..(2251): n is a, c, g, or t
  misc_feature (2253)..(2253): n is a, c, g, or t
  misc_feature (2256)..(2256): n is a, c, g, or t
  misc_feature (2258)..(2262): n is a, c, g, or t
  misc_feature (2264)..(2266): n is a, c, g, or t
  misc_feature (2271)..(2271): n is a, c, g, or t
  misc_feature (2275)..(2275): n is a, c, g, or t
  misc_feature (2277)..(2277): n is a, c, g, or t
  misc_feature (2316)..(2317): n is a, c, g, or t
  misc_feature (2319)..(2324): n is a, c, g, or t
  misc_feature (2326)..(2326): n is a, c, g, or t
  misc_feature (2328)..(2332): n is a, c, g, or t
  misc_feature (2334)..(2334): n is a, c, g, or t
  misc_feature (2336)..(2336): n is a, c, g, or t
  misc_feature (2341)..(2342): n is a, c, g, or t
  misc_feature (2344)..(2344): n is a, c, g, or t
  misc_feature (2382)..(2383): n is a, c, g, or t
  misc_feature (2385)..(2393): n is a, c, g, or t
  misc_feature (2398)..(2402): n is a, c, g, or t
  misc_feature (2404)..(2410): n is a, c, g, or t
  misc_feature (2447)..(2447): n is a, c, g, or t
  misc_feature (2450)..(2451): n is a, c, g, or t
  misc_feature (2453)..(2459): n is a, c, g, or t
  misc_feature (2461)..(2462): n is a, c, g, or t
  misc_feature (2465)..(2465): n is a, c, g, or t
  misc_feature (2467)..(2471): n is a, c, g, or t
  misc_feature (2473)..(2473): n is a, c, g, or t
  misc_feature (2475)..(2475): n is a, c, g, or t
  misc_feature (2514)..(2514): n is a, c, g, or t
  misc_feature (2516)..(2517): n is a, c, g, or t
  misc_feature (2519)..(2521): n is a, c, g, or t
  misc_feature (2523)..(2523): n is a, c, g, or t
  misc_feature (2525)..(2525): n is a, c, g, or t
  misc_feature (2528)..(2535): n is a, c, g, or t
  misc_feature (2538)..(2540): n is a, c, g, or t
  misc_feature (2579)..(2584): n is a, c, g, or t
  misc_feature (2588)..(2591): n is a, c, g, or t
  misc_feature (2594)..(2599): n is a, c, g, or t
  misc_feature (2602)..(2603): n is a, c, g, or t
  misc_feature (2606)..(2606): n is a, c, g, or t
  misc_feature (2608)..(2608): n is a, c, g, or t
  misc_feature (2641)..(2641): n is a, c, g, or t
  misc_feature (2645)..(2648): n is a, c, g, or t
  misc_feature (2651)..(2651): n is a, c, g, or t
  misc_feature (2653)..(2653): n is a, c, g, or t
  misc_feature (2655)..(2657): n is a, c, g, or t
  misc_feature (2660)..(2662): n is a, c, g, or t
  misc_feature (2666)..(2666): n is a, c, g, or t
  misc_feature (2668)..(2668): n is a, c, g, or t
  misc_feature (2670)..(2673): n is a, c, g, or t
  misc_feature (2711)..(2711): n is a, c, g, or t
  misc_feature (2714)..(2716): n is a, c, g, or t
  misc_feature (2718)..(2727): n is a, c, g, or t
  misc_feature (2729)..(2729): n is a, c, g, or t
  misc_feature (2731)..(2731): n is a, c, g, or t
  misc_feature (2734)..(2735): n is a, c, g, or t
  misc_feature (2737)..(2737): n is a, c, g, or t
  misc_feature (2740)..(2740): n is a, c, g, or t
  misc_feature (2777)..(2778): n is a, c, g, or t
  misc_feature (2782)..(2784): n is a, c, g, or t
  misc_feature (2786)..(2788): n is a, c, g, or t
  misc_feature (2791)..(2794): n is a, c, g, or t
  misc_feature (2799)..(2799): n is a, c, g, or t
  misc_feature (2801)..(2801): n is a, c, g, or t
  misc_feature (2803)..(2804): n is a, c, g, or t
  misc_feature (2806)..(2806): n is a, c, g, or t
  misc_feature (2843)..(2843): n is a, c, g, or t
  misc_feature (2845)..(2848): n is a, c, g, or t
  misc_feature (2850)..(2850): n is a, c, g, or t
  misc_feature (2852)..(2854): n is a, c, g, or t
  misc_feature (2857)..(2859): n is a, c, g, or t
  misc_feature (2866)..(2867): n is a, c, g, or t
  misc_feature (2869)..(2869): n is a, c, g, or t
  misc_feature (2871)..(2872): n is a, c, g, or t
  misc_feature (2909)..(2909): n is a, c, g, or t
  misc_feature (2911)..(2911): n is a, c, g, or t
  misc_feature (2914)..(2914): n is a, c, g, or t
  misc_feature (2916)..(2919): n is a, c, g, or t
  misc_feature (2921)..(2921): n is a, c, g, or t
  misc_feature (2923)..(2925): n is a, c, g, or t
  misc_feature (2930)..(2930): n is a, c, g, or t
  misc_feature (2932)..(2933): n is a, c, g, or t
  misc_feature (2936)..(2938): n is a, c, g, or t
  misc_feature (2975)..(2980): n is a, c, g, or t
  misc_feature (2983)..(2984): n is a, c, g, or t
  misc_feature (2987)..(2992): n is a, c, g, or t
  misc_feature (2994)..(2994): n is a, c, g, or t
  misc_feature (2996)..(2996): n is a, c, g, or t
  misc_feature (2998)..(2998): n is a, c, g, or t
  misc_feature (3001)..(3002): n is a, c, g, or t
  misc_feature (3041)..(3044): n is a, c, g, or t
  misc_feature (3046)..(3052): n is a, c, g, or t
  misc_feature (3056)..(3057): n is a, c, g, or t
  misc_feature (3061)..(3063): n is a, c, g, or t
  misc_feature (3065)..(3065): n is a, c, g, or t
  misc_feature (3067)..(3070): n is a, c, g, or t
  misc_feature (3096)..(3096): n is a, c, g, or t
  misc_feature (3098)..(3103): n is a, c, g, or t
  misc_feature (3106)..(3108): n is a, c, g, or t
  misc_feature (3110)..(3110): n is a, c, g, or t
  misc_feature (3112)..(3112): n is a, c, g, or t
  misc_feature (3115)..(3115): n is a, c, g, or t
  misc_feature (3121)..(3122): n is a, c, g, or t
  misc_feature (3124)..(3124): n is a, c, g, or t
  misc_feature (3127)..(3127): n is a, c, g, or t
  misc_feature (3131)..(3131): n is a, c, g, or t
  misc_feature (3133)..(3137): n is a, c, g, or t
  misc_feature (3140)..(3153): n is a, c, g, or t
  misc_feature (3155)..(3158): n is a, c, g, or t
  misc_feature (3160)..(3162): n is a, c, g, or t
  misc_feature (3165)..(3167): n is a, c, g, or t
  misc_feature (3169)..(3172): n is a, c, g, or t
  misc_feature (3174)..(3175): n is a, c, g, or t
  misc_feature (3177)..(3181): n is a, c, g, or t
  misc_feature (3183)..(3184): n is a, c, g, or t
  misc_feature (3189)..(3189): n is a, c, g, or t
  misc_feature (3192)..(3195): n is a, c, g, or t
  misc_feature (3197)..(3197): n is a, c, g, or t
  misc_feature (3202)..(3211): n is a, c, g, or t
  misc_feature (3213)..(3214): n is a, c, g, or t
  misc_feature (3216)..(3218): n is a, c, g, or t
  misc_feature (3220)..(3220): n is a, c, g, or t
  misc_feature (3222)..(3223): n is a, c, g, or t
  misc_feature (3226)..(3226): n is a, c, g, or t
  misc_feature (3229)..(3229): n is a, c, g, or t
  misc_feature (3231)..(3232): n is a, c, g, or t
  misc_feature (3234)..(3237): n is a, c, g, or t
  misc_feature (3239)..(3239): n is a, c, g, or t
  misc_feature (3241)..(3242): n is a, c, g, or t
  misc_feature (3247)..(3249): n is a, c, g, or t
  misc_feature (3251)..(3253): n is a, c, g, or t
  misc_feature (3255)..(3255): n is a, c, g, or t
  misc_feature (3258)..(3260): n is a, c, g, or t
  misc_feature (3263)..(3263): n is a, c, g, or t
  misc_feature (3265)..(3265): n is a, c, g, or t
  misc_feature (3267)..(3267): n is a, c, g, or t
  misc_feature (3270)..(3271): n is a, c, g, or t
  misc_feature (3274)..(3274): n is a, c, g, or t
  misc_feature (3279)..(3281): n is a, c, g, or t
  misc_feature (3283)..(3285): n is a, c, g, or t
  misc_feature (3287)..(3287): n is a, c, g, or t
  misc_feature (3289)..(3289): n is a, c, g, or t
  misc_feature (3291)..(3291): n is a, c, g, or t
  misc_feature (3293)..(3296): n is a, c, g, or t
  misc_feature (3298)..(3298): n is a, c, g, or t
  misc_feature (3300)..(3300): n is a, c, g, or t
  misc_feature (3302)..(3302): n is a, c, g, or t
  misc_feature (3304)..(3304): n is a, c, g, or t
  misc_feature (3306)..(3306): n is a, c, g, or t
  misc_feature (3308)..(3311): n is a, c, g, or t
  misc_feature (3313)..(3313): n is a, c, g, or t
  misc_feature (3315)..(3315): n is a, c, g, or t
  misc_feature (3317)..(3317): n is a, c, g, or t
  misc_feature (3319)..(3322): n is a, c, g, or t
  misc_feature (3324)..(3329): n is a, c, g, or t
  misc_feature (3331)..(3333): n is a, c, g, or t
  misc_feature (3337)..(3337): n is a, c, g, or t
  misc_feature (3340)..(3340): n is a, c, g, or t
  misc_feature (3344)..(3344): n is a, c, g, or t
  misc_feature (3348)..(3348): n is a, c, g, or t
  misc_feature (3352)..(3353): n is a, c, g, or t
  misc_feature (3356)..(3360): n is a, c, g, or t
  misc_feature (3362)..(3363): n is a, c, g, or t
  misc_feature (3365)..(3366): n is a, c, g, or t
  misc_feature (3369)..(3373): n is a, c, g, or t
  misc_feature (3377)..(3378): n is a, c, g, or t
  misc_feature (3381)..(3381): n is a, c, g, or t
  misc_feature (3384)..(3384): n is a, c, g, or t
  misc_feature (3388)..(3388): n is a, c, g, or t
  misc_feature (3390)..(3391): n is a, c, g, or t
  misc_feature (3393)..(3393): n is a, c, g, or t
  misc_feature (3399)..(3399): n is a, c, g, or t
  misc_feature (3404)..(3404): n is a, c, g, or t
  misc_feature (3407)..(3411): n is a, c, g, or t
  misc_feature (3413)..(3414): n is a, c, g, or t
  misc_feature (3418)..(3420): n is a, c, g, or t
  misc_feature (3422)..(3422): n is a, c, g, or t
  misc_feature (3425)..(3425): n is a, c, g, or t
  misc_feature (3427)..(3428): n is a, c, g, or t
  misc_feature (3430)..(3430): n is a, c, g, or t
  misc_feature (3433)..(3438): n is a, c, g, or t
  misc_feature (3442)..(3442): n is a, c, g, or t
  misc_feature (3444)..(3444): n is a, c, g, or t
  misc_feature (3448)..(3448): n is a, c, g, or t
  misc_feature (3450)..(3450): n is a, c, g, or t
  misc_feature (3453)..(3453): n is a, c, g, or t
  misc_feature (3456)..(3458): n is a, c, g, or t
  misc_feature (3460)..(3460): n is a, c, g, or t
  misc_feature (3462)..(3462): n is a, c, g, or t
  misc_feature (3467)..(3475): n is a, c, g, or t
  misc_feature (3477)..(3479): n is a, c, g, or t
  misc_feature (3481)..(3482): n is a, c, g, or t
  misc_feature (3484)..(3484): n is a, c, g, or t
  misc_feature (3486)..(3488): n is a, c, g, or t
  misc_feature (3490)..(3490): n is a, c, g, or t
  misc_feature (3493)..(3494): n is a, c, g, or t
  misc_feature (3498)..(3498): n is a, c, g, or t
  misc_feature (3501)..(3503): n is a, c, g, or t
  misc_feature (3505)..(3506): n is a, c, g, or t
  misc_feature (3509)..(3512): n is a, c, g, or t
  misc_feature (3515)..(3515): n is a, c, g, or t
  misc_feature (3517)..(3518): n is a, c, g, or t
  misc_feature (3520)..(3521): n is a, c, g, or t
  misc_feature (3527)..(3529): n is a, c, g, or t
  misc_feature (3531)..(3531): n is a, c, g, or t
  misc_feature (3533)..(3534): n is a, c, g, or t
  misc_feature (3536)..(3540): n is a, c, g, or t
  misc_feature (3542)..(3542): n is a, c, g, or t
  misc_feature (3544)..(3545): n is a, c, g, or t
  misc_feature (3547)..(3547): n is a, c, g, or t
  misc_feature (3550)..(3551): n is a, c, g, or t
  misc_feature (3553)..(3553): n is a, c, g, or t
  misc_feature (3555)..(3556): n is a, c, g, or t
  misc_feature (3558)..(3564): n is a, c, g, or t
  misc_feature (3567)..(3567): n is a, c, g, or t
  misc_feature (3571)..(3571): n is a, c, g, or t
  misc_feature (3573)..(3576): n is a, c, g, or t
  misc_feature (3579)..(3580): n is a, c, g, or t
  misc_feature (3582)..(3586): n is a, c, g, or t
  misc_feature (3588)..(3588): n is a, c, g, or t
  misc_feature (3590)..(3591): n is a, c, g, or t
  misc_feature (3594)..(3594): n is a, c, g, or t
  misc_feature (3596)..(3599): n is a, c, g, or t
  misc_feature (3601)..(3602): n is a, c, g, or t
  misc_feature (3605)..(3605): n is a, c, g, or t
  misc_feature (3608)..(3610): n is a, c, g, or t
  misc_feature (3612)..(3612): n is a, c, g, or t
  misc_feature (3614)..(3614): n is a, c, g, or t
  misc_feature (3616)..(3618): n is a, c, g, or t
  misc_feature (3620)..(3621): n is a, c, g, or t
  misc_feature (3623)..(3628): n is a, c, g, or t
  misc_feature (3631)..(3634): n is a, c, g, or t
  misc_feature (3636)..(3636): n is a, c, g, or t
  misc_feature (3638)..(3638): n is a, c, g, or t
  misc_feature (3641)..(3642): n is a, c, g, or t
  misc_feature (3646)..(3647): n is a, c, g, or t
  misc_feature (3649)..(3650): n is a, c, g, or t
  misc_feature (3652)..(3653): n is a, c, g, or t
  misc_feature (3656)..(3656): n is a, c, g, or t
  misc_feature (3659)..(3660): n is a, c, g, or t
  misc_feature (3662)..(3668): n is a, c, g, or t
  misc_feature (3670)..(3670): n is a, c, g, or t
  misc_feature (3672)..(3672): n is a, c, g, or t
  misc_feature (3674)..(3681): n is a, c, g, or t
  misc_feature (3683)..(3686): n is a, c, g, or t
  misc_feature (3689)..(3692): n is a, c, g, or t
  misc_feature (3694)..(3695): n is a, c, g, or t
  misc_feature (3697)..(3701): n is a, c, g, or t
  misc_feature (3705)..(3707): n is a, c, g, or t
  misc_feature (3709)..(3710): n is a, c, g, or t
  misc_feature (3712)..(3713): n is a, c, g, or t
  misc_feature (3717)..(3718): n is a, c, g, or t
  misc_feature (3722)..(3722): n is a, c, g, or t
  misc_feature (3725)..(3725): n is a, c, g, or t
  misc_feature (3729)..(3730): n is a, c, g, or t
  misc_feature (3732)..(3733): n is a, c, g, or t
  misc_feature (3735)..(3737): n is a, c, g, or t
  misc_feature (3739)..(3741): n is a, c, g, or t
  misc_feature (3745)..(3745): n is a, c, g, or t
  misc_feature (3748)..(3748): n is a, c, g, or t
  misc_feature (3750)..(3757): n is a, c, g, or t
  misc_feature (3759)..(3759): n is a, c, g, or t
  misc_feature (3761)..(3763): n is a, c, g, or t
  misc_feature (3766)..(3766): n is a, c, g, or t
  misc_feature (3768)..(3768): n is a, c, g, or t
  misc_feature (3771)..(3771): n is a, c, g, or t
  misc_feature (3773)..(3773): n is a, c, g, or t
  misc_feature (3776)..(3776): n is a, c, g, or t
  misc_feature (3778)..(3778): n is a, c, g, or t
  misc_feature (3780)..(3783): n is a, c, g, or t
  misc_feature (3786)..(3789): n is a, c, g, or t
  misc_feature (3793)..(3794): n is a, c, g, or t
  misc_feature (3797)..(3799): n is a, c, g, or t
  misc_feature (3802)..(3802): n is a, c, g, or t
  misc_feature (3805)..(3805): n is a, c, g, or t
  misc_feature (3808)..(3809): n is a, c, g, or t
  misc_feature (3811)..(3811): n is a, c, g, or t
  misc_feature (3813)..(3813): n is a, c, g, or t
  misc_feature (3815)..(3815): n is a, c, g, or t
  misc_feature (3817)..(3817): n is a, c, g, or t
  misc_feature (3819)..(3820): n is a, c, g, or t
  misc_feature (3822)..(3822): n is a, c, g, or t
  misc_feature (3824)..(3828): n is a, c, g, or t
  misc_feature (3830)..(3830): n is a, c, g, or t
  misc_feature (3832)..(3832): n is a, c, g, or t
  misc_feature (3837)..(3837): n is a, c, g, or t
  misc_feature (3839)..(3840): n is a, c, g, or t
  misc_feature (3842)..(3842): n is a, c, g, or t
  misc_feature (3847)..(3847): n is a, c, g, or t
  misc_feature (3854)..(3855): n is a, c, g, or t
  misc_feature (3857)..(3857): n is a, c, g, or t
  misc_feature (3859)..(3861): n is a, c, g, or t
  misc_feature (3863)..(3864): n is a, c, g, or t
  misc_feature (3868)..(3870): n is a, c, g, or t
  misc_feature (3872)..(3872): n is a, c, g, or t
  misc_feature (3874)..(3882): n is a, c, g, or t
  misc_feature (3886)..(3887): n is a, c, g, or t
  misc_feature (3889)..(3890): n is a, c, g, or t
  misc_feature (3892)..(3892): n is a, c, g, or t
  misc_feature (3898)..(3898): n is a, c, g, or t
  misc_feature (3902)..(3902): n is a, c, g, or t
  misc_feature (3904)..(3905): n is a, c, g, or t
  misc_feature (3907)..(3907): n is a, c, g, or t
  misc_feature (3909)..(3909): n is a, c, g, or t
  misc_feature (3911)..(3915): n is a, c, g, or t
  misc_feature (3919)..(3919): n is a, c, g, or t
  misc_feature (3921)..(3921): n is a, c, g, or t
  misc_feature (3923)..(3924): n is a, c, g, or t
  misc_feature (3929)..(3929): n is a, c, g, or t
  misc_feature (3931)..(3931): n is a, c, g, or t
  misc_feature (3933)..(3937): n is a, c, g, or t
  misc_feature (3939)..(3940): n is a, c, g, or t
  misc_feature (3948)..(3948): n is a, c, g, or t
  misc_feature (3954)..(3959): n is a, c, g, or t
  misc_feature (3963)..(3964): n is a, c, g, or t
  misc_feature (3966)..(3966): n is a, c, g, or t
  misc_feature (3969)..(3970): n is a, c, g, or t
  misc_feature (3972)..(3973): n is a, c, g, or t
  misc_feature (3976)..(3976): n is a, c, g, or t
  misc_feature (3978)..(3979): n is a, c, g, or t
  misc_feature (3983)..(3984): n is a, c, g, or t
  misc_feature (3986)..(3986): n is a, c, g, or t
  misc_feature (3988)..(3988): n is a, c, g, or t
  misc_feature (3990)..(3991): n is a, c, g, or t
  misc_feature (3995)..(3995): n is a, c, g, or t
  misc_feature (4000)..(4000): n is a, c, g, or t
aaagcacggctggaaacacataaagacgatccggccaaagcctttgccgagccgttttacaaatacgataaagcaggcaaccgcacccaacaggtaaaagccgtacgcgtagagcaagtacagaaaaccggcgtatgggtgcgcaaccataacggtattgccgacaacgcaaccatggtgcgcgtagatgtgtttgagaaaggcggcaagtattatctggtaccgatttacagttggcaggtcgcaaaagggattttgccgaatagggctgttgtacaaggaaaagatgaagaagattggacggtaatggatgatagttttgagtttaagtttgtactttatgcgaatgatctgattaagctaaccgctaagaaaaatgaatttttaggctatttcgtcagcctaaatagagctacaggagcaattgatattcgtacacatgatacggatagcaccaaagggaaaaacggcattttccaaagtgttggtgtcaaaaccgccctttcattccaaaaataccaaatcgacgaattgggcaaagaaatcagatcatgccgtctgaaaaaacgcccgcctgttcgttaaataaacctatccctgtttcagacgacatgaaacagggattttttgtataaaaataaggggaagaaacatgacttggcgcagtctgcttattcaaaacggcggtaaattatccttgcaacgccggcaactgctgattcaacaaaacggcgagtcccataccgtaccattagaagacatcgccgttatcatcatcgaaaaccgcgaaaccctgattactgccccgctcctatcagccttagccgaacatggctcaaccctgctgacatgtgacgaacagttcctaccctgcggacaatggctgccttatgcccaatatcaccgccaacttaaaatcctcaagctgcagctgaatataagcgaacccttaaaaaagcaactctggcaacatatcatccgccaaaaaatcctaaatcaagcatttgtcgcagacgaaacaggcaatgatcttgccgccaaacggctgcgcactttggcagtcgaagtccgttcgggcgatacaggaaaccgtgaagcccaagctgccgccctctacttccaagccctctttggagaaaagtttactcgcaatgacaacaatgccgtcaatgccgcattgaactacacctacgccgtactccgtgcagcagttgcacgcgccctgactttatatggatggttgcctgcattaggcttgtttcatagaagcgaactaaatccattcaacctcgccgatgactttatcgaacccttacgcccattggccgacctggtcgttatacatttgcatgaacaaggccgtctgaaaactgatctgacccctaatatcaaacaaaaccttatcaagacccttcactgtcaaatctgcatcgaacggcaatacttcagcaccttggctgccatagacaaaatgatttcctcatttcaagccagcgtaactgacaaaaatgccaaacagctgaaactgcctgaaatcttgccattgaaagaataccaatatgagtgaggccaaatttatgaggattattgtcttcttcgacctaccggttaccacagcggcaaagcgcaaagctgccaatcaattccgccagtttctattaaaagatggataccaaatgctccagctttccgtatacagccgtattgtcaaaggtcgagattcgttgcaaaaacaccacaacaggctatgtgcaaacctaccgcaagaagggtcaatccgctgtttggaagtaacggaaaagcaatatgccaccatgaaactactattgggagagctaaaaacccaagaaaaaagagtaaattcagaccaactattattattttaagctcattttttagacaaaataaaacgggaaacccttataaaataaggatttcccgttgaggtattgtagcactgcgaaatgagaaagggagctacaacnnnnnnnnnnnnannnnnnntnntnnnnnnattgtagcactgcgaaatgagaaagggagctacaacnnnnccnnnntnnnnnnnnncgnnntnnngattgtagcactgcgaaatgagaaagggagctacaacannnngntnnnnnnnngnngnnnannnnanattgtagcactgcgaaatgagaaagggagctacaacnnnnnnnntntnnnanngntnnntnntntnattgtagcactgcgaaatgagaaagggagctacaacngngnttntnnnnnannntcgancatntngattgtagcactgcgaaatgagaaagggagctacaactnntnnnnnnanannnnnangngtatnnanattgtagcactgcgaaatgagaaagggagctacaaccnntnnnnnnnnntattnnnnnannnnnnnattgtagcactgcgaaatgagaaagggagctacaacnggnnannnnnnncnnttnannnnnananaattgtagcactgcgaaatgagaaagggagctacaactngnngnnncncntannnnnnnnaannnggattgtagcactgcgaaatgagaaagggagctacaacnnnnnnaggnnnntannnnnnttnnacntnattgtagcactgcgaaatgagaaagggagctanaacnnnncanantnnnctnnncaancncnnnnaattgtagcactgcgaaatgagaaagggagctacaacntgnnntnnnnnnnnnngntngcnntnganattgtagcactgcgaaatgagaaagggagctacaacnngtcnnntnnnttnnnnctcanancnncnattgtagcactgcgaaatgagaaagggagctacaacncnnnntntnnnccnnngcattcnnantnnattgtagcactgcgaaatgagaaagggagctacaacntnatnannnnancnnnaaacncnnagnnnattgtagcactgcgaaatgagaaagggagctacaacnnnnnnaanngannnnnncnancnttnnggattgtagcactgcgaaatgagaaagggagctacaacnnnnannnnnnncgtnncttnnngnannnnattgtagcactgcgaaatgagaaagngnnnnnncannnananaancaccanntnaanaggnannnnnttnnnnnnnnnnnnnntnnnnannngannnannnncnntnnnnncnnattcnacnnnngncaaannnnnnnnnncnncnnnangnnaancgnanntnnnnanannaacannncnnncnttnnnagnancnaanngtngaccnnntnnntnananannnnancnanancntnnnnancncnannnngnnnnnnannnaaanganggtntgcnaaannagnnnnntnncnnaannnnntcannggntcnactncnngncgcaantcttntgnnnnngnnaaannngncangnngnttnnnnnngtcnanaagnanttngcnnnantncgcannnnnnnnncnnngnngntnnnantanngttnaannngnngtnnnnatnannannacgcannncntnntnnnnnantnntnaanntnanngnnnnnnnaancctncnnnnggnnannnnncnannttngnnnntnntgncannncntnannngnnannnnnnctnnnntntnatnnaaanntnnannacncanntnnnnnnncntnannnnnnnngnnnnagnnnntnnannnnnatcnnnannanngtanntatnttnagcnntnngnnnannngctnaangnnnnnnnnantnnnaancntcnanagnangnnnnaannnngganngannngangcnctnntncntnancnncntnnnnngnantaccntnnanatctncaaaaanngncnnntnntcannnangnnnnnnnnngcannanntncagctncttntnnancnannnnnccantngnntcaanancnnnnncnnatttatcnaaatcnnnnnnttgnncnacnngnncangnncaanntnananntaanacgan

SEQ ID NO: 1517 - DNA, 4000 bp, Escherichia coli
  misc_feature (1948)..(1948): n is a, c, g, or t
  misc_feature (1969)..(1970): n is a, c, g, or t
  misc_feature (1972)..(1972): n is a, c, g, or t
  misc_feature (1982)..(1982): n is a, c, g, or t
  misc_feature (1987)..(1987): n is a, c, g, or t
  misc_feature (1990)..(1990): n is a, c, g, or t
gacagaatccgaatgatgctctatcggaacacccttacaaacgcttggcttgtgaatcgtctcgaagaaagaggtattaacaccgaaaaaaccgagatgagttctgtccttcgtggagttcgtaagggtgctaaagcggaaagcattatcgtaacttcccttgacatcctcgaaaactatgagcgagtaatgggaagttcggtgtgagtaccgcagctcaattagagagttggacacaacacagtttgagccgacttctcgcaaaaactgttgcccggtattttgaagatgaagagcatcgccgggaatttgaagaatggtacttcaaccgatatggtcgtgagtaccaatggaagaaaggaggtaaaagaggtgactcaaacacgcagacgaaagaaaggtcttaaaagatggctgagacgaaatcttctctcaatcatccttgcagttctcatcgtgatattctccgtttggacattcgtaatcattgtgaatgcgttttgcccggatgaagtcaaagtcgaggacaagcctgttgtatccaccactcttcctccgctcgtaactacgacaccccttgtggatgtaccgttggaaaccccaaccgtagaaactgtcgaagagaaaactttttacttcgatgttgctcttgattgcgacctacaagactacataagggacttgtgcgaaacctatgatgtcccaatggaacttgtaatcgcaatgattcatcaagaaagttcgtttagagcaaatgttgtgagcggtagtaatgattatggtttgatgcaaattaacaccatcaatcacgagtggctgcaaaaggagcctggagtaacagattttctcgacccgtaccaaaatgttctgtgcggtatctatatcatctcaggacatcttgaaaaaaccgatggtgacatcgaactcgccctaatgcgatacaactgtggagcaaccggggcaaagcgtttgtgggacaaagggatatacgaaacagattatactcgaaagattatgtcctattatgagttctacaaagaagaaagccgccctacggactgcactccgtaagacggcaaggtaaagtttaccatacctattatagcacagaaaggaggaaaaatcaatgtgcgaaatttgtttacagagtccctgtcatccgagatgtcctaacgcacctgaccctcctgttgtatgtctctgctgtcaatgcggaaatgagatttacgagggagacgaggtttacgacatcaacgatgagaaatggtgtgaatcctgtgtgaaggaatgttgctatatcgctgagttggatgagcctgattgggatgaccgatgatttgcccttgtaaagattgtcccaaacgacatcccggctgtcactctacttgttccgactacaaagcgtggaaagaagaacacgagagattgaaagccttggaaagacaacgcaaagaaatggacgaactcggatggcgttcaaactatgtacgaaaaaggagattctgatatatgaacacaatcagaaattttatcgctaaccccggcagcgtgattatgttcggcggtatcgactgtgttgttctcgatgttcacgatgacaaaatgctcgtgattactaaagatgctgtttgcgaaagagcatttgatgagagcaacaagaacaatttcaacatttcctctctccgcacttggctcaatactgagttcattgagatgctgagaaacggtggagcggatgtaaatgccctcgtggaatttaccattgaccttacctcggacgatggattgaaggattatggcgtaagcacgaacaaggttgctttgctgacctgtgatatgtaccgtcagttccgcagctatatccccaaccttgatagttggtggtggcttgctacaccttactctactgagtctaatgggtacgattctcttgctcgctatgtcagcncggatggtagtctgaacgacnncnatgcttacantggtnacngtggcgttcgtcccgcttttgtccttgactcttccatctttgaatctcgtaatctgaatctcagcgagtattctaccgaggagttgcttctcgaactcatcgcacgagaaaaggaatcgaataatgcgtgagttcacattctcgtggaacaacggtcgaggacgaatgaccctcaatctcgattaccttttagagagaaagagcaacaaatttgttcacacaacgaagcctgatgtattgaagataatgaagtacataatcacctcagacgagcctgagaaaatcagcgacttccttcattatctcgactcaaacggttgtgcagacattgctcaacggttccgggagaagcatcatatcgaacaaggaggtatttcaaaatgacactttatgaactgcaaaacaagctcggtgagcagattgacctcatcaccgataagaccaaaccgcccgaagagcgaaagaaattggctgagaccgctatgaccgtttcgagtcttgcaaaacagatgattaacaacgcagatgtcgttcttcgtactgagaaactgattgccgaaggtaagttgaaagacagcgttatcaagaagattgtcggtagcaactgatgagaggtagtcattacaccgaagagcaaaacgcattcattgccgaaaactatatgcggatgacttatcatcaactgaccgagtgttataacaagcgatttaacgctcagatgaatgtttctgcaatgacgaagaagattcattatatgggtctaccgaaaaagccgaaacttttccctacaatgtttacgccggaggttgatgcttatttaatagagaacgcatataactacacttcttccgacctcgcacagaaagtgcaagaaaagttcggcatcacacctgcaacacagaccattaccgaacggctgaataatttgggcgttcaccgtggtagcacttatctcccggatgggtacatcccacgagcgagtaagccgattggcacggaacgcatagacaaaggacgaacggttatggtgaaggtggctcaacccaatgtttggaaaccgaaagttcaagtcgtgacaggatacgaccctaaaaaaagtcaagcaattttcctcgatggaaactctctgaatgtcacgcctgagaacattgtaattgtgagcaagaaagttcacgctcggttagccaaaaatggttggctgaatagcaacaatgaggttttgatggcaggtattaagtggagtgaattgcactacgctcttcgagaaatggaggtaacaatcaatgagtaaccgaaagctcggtaacagctttgaacaagaattttgcgagacccttgcgtttcacggcttttgggtacacaacctcgcacaaaatcaggcaggacaacctgccgatgtaatcgccgtgaaaaacaaaaaggcatacctcatcgactgtaaggtatgctccgggaagactttcccactcagtcgagtcgaagagaatcaggacttggcgatgagcctttggaaagactgtggcaacggagagggttggtttgccattaagattagtgaggctgtttatatgatacctcactttacagtaatggcacacaagaacgctcaacctgctatgagtatttccgaaatcgtagagtgcggaaaacctctcgataaatggattgccaaatgcaaataaccgtaggcagcactattgcagtcgagaatccaaccgaagagttgattcgatggtgcagtcaaaacttaaaaatccgaaacccggattatgtcaaaaaggtaagaatgaacttttggttaggcgatacacctgagttcttgtacctttacgagatacacggaaacactcttgtcgttccctttggtacgctacgcacacttgctccaatgtttcaagggtgtcctacaatcaaggactttggcgatgcggaagtaattgacttctcctgcaaagttcctctgtatgattatcaggagacagcggtcaacgaagtagctgcacaacatta

SEQ ID NO: 1518 - DNA, 4000 bp, Escherichia coli
  misc_feature (1877)..(1877): n is a, c, g, or t
  misc_feature (1992)..(1992): n is a, c, g, or t
  misc_feature (1999)..(1999): n is a, c, g, or t
  misc_feature (2193)..(2193): n is a, c, g, or t
  misc_feature (3033)..(3033): n is a, c, g, or t
  misc_feature (3210)..(3212): n is a, c, g, or t
  misc_feature (3219)..(3219): n is a, c, g, or t
  misc_feature (3222)..(3222): n is a, c, g, or t
  misc_feature (3225)..(3225): n is a, c, g, or t
  misc_feature (3663)..(3663): n is a, c, g, or t
  misc_feature (3665)..(3666): n is a, c, g, or t
  misc_feature (3674)..(3674): n is a, c, g, or t
  misc_feature (3676)..(3677): n is a, c, g, or t
  misc_feature (3679)..(3679): n is a, c, g, or t
  misc_feature (3681)..(3681): n is a, c, g, or t
  misc_feature (3683)..(3684): n is a, c, g, or t
  misc_feature (3687)..(3687): n is a, c, g, or t
  misc_feature (3692)..(3697): n is a, c, g, or t
  misc_feature (3700)..(3700): n is a, c, g, or t
  misc_feature (3705)..(3710): n is a, c, g, or t
  misc_feature (3712)..(3713): n is a, c, g, or t
  misc_feature (3715)..(3716): n is a, c, g, or t
  misc_feature (3718)..(3718): n is a, c, g, or t
  misc_feature (3721)..(3721): n is a, c, g, or t
  misc_feature (3723)..(3723): n is a, c, g, or t
  misc_feature (3726)..(3731): n is a, c, g, or t
  misc_feature (3734)..(3743): n is a, c, g, or t
  misc_feature (3745)..(3745): n is a, c, g, or t
  misc_feature (3747)..(3747): n is a, c, g, or t
  misc_feature (3749)..(3752): n is a, c, g, or t
  misc_feature (3754)..(3754): n is a, c, g, or t
  misc_feature (3756)..(3757): n is a, c, g, or t
  misc_feature (3760)..(3761): n is a, c, g, or t
  misc_feature (3763)..(3763): n is a, c, g, or t
  misc_feature (3766)..(3767): n is a, c, g, or t
  misc_feature (3769)..(3769): n is a, c, g, or t
  misc_feature (3771)..(3771): n is a, c, g, or t
  misc_feature (3773)..(3777): n is a, c, g, or t
  misc_feature (3779)..(3783): n is a, c, g, or t
  misc_feature (3785)..(3786): n is a, c, g, or t
  misc_feature (3788)..(3788): n is a, c, g, or t
  misc_feature (3790)..(3792): n is a, c, g, or t
  misc_feature (3794)..(3797): n is a, c, g, or t
  misc_feature (3799)..(3799): n is a, c, g, or t
  misc_feature (3805)..(3805): n is a, c, g, or t
  misc_feature (3807)..(3807): n is a, c, g, or t
  misc_feature (3813)..(3814): n is a, c, g, or t
  misc_feature (3816)..(3816): n is a, c, g, or t
  misc_feature (3819)..(3820): n is a, c, g, or t
  misc_feature (3822)..(3824): n is a, c, g, or t
  misc_feature (3826)..(3826): n is a, c, g, or t
  misc_feature (3829)..(3829): n is a, c, g, or t
  misc_feature (3831)..(3831): n is a, c, g, or t
  misc_feature (3833)..(3834): n is a, c, g, or t
  misc_feature (3837)..(3838): n is a, c, g, or t
  misc_feature (3840)..(3840): n is a, c, g, or t
  misc_feature (3842)..(3843): n is a, c, g, or t
  misc_feature (3845)..(3845): n is a, c, g, or t
  misc_feature (3849)..(3849): n is a, c, g, or t
  misc_feature (3851)..(3862): n is a, c, g, or t
  misc_feature (3866)..(3866): n is a, c, g, or t
  misc_feature (3868)..(3870): n is a, c, g, or t
  misc_feature (3873)..(3874): n is a, c, g, or t
  misc_feature (3876)..(3876): n is a, c, g, or t
  misc_feature (3879)..(3880): n is a, c, g, or t
  misc_feature (3882)..(3884): n is a, c, g, or t
  misc_feature (3886)..(3890): n is a, c, g, or t
  misc_feature (3892)..(3896): n is a, c, g, or t
  misc_feature (3899)..(3899): n is a, c, g, or t
  misc_feature (3901)..(3901): n is a, c, g, or t
  misc_feature (3903)..(3905): n is a, c, g, or t
  misc_feature (3907)..(3909): n is a, c, g, or t
  misc_feature (3912)..(3914): n is a, c, g, or t
  misc_feature (3916)..(3920): n is a, c, g, or t
  misc_feature (3922)..(3923): n is a, c, g, or t
  misc_feature (3925)..(3928): n is a, c, g, or t
  misc_feature (3930)..(3933): n is a, c, g, or t
  misc_feature (3936)..(3941): n is a, c, g, or t
  misc_feature (3943)..(3943): n is a, c, g, or t
  misc_feature (3945)..(3951): n is a, c, g, or t
  misc_feature (3955)..(3957): n is a, c, g, or t
  misc_feature (3959)..(3965): n is a, c, g, or t
  misc_feature (3967)..(3967): n is a, c, g, or t
  misc_feature (3969)..(3969): n is a, c, g, or t
  misc_feature (3971)..(3971): n is a, c, g, or t
  misc_feature (3973)..(3973): n is a, c, g, or t
  misc_feature (3975)..(3975): n is a, c, g, or t
  misc_feature (3977)..(3977): n is a, c, g, or t
  misc_feature (3979)..(3980): n is a, c, g, or t
  misc_feature (3982)..(3982): n is a, c, g, or t
  misc_feature (3984)..(3986): n is a, c, g, or t
  misc_feature (3989)..(3991): n is a, c, g, or t
  misc_feature (3993)..(3994): n is a, c, g, or t
  misc_feature (3996)..(3998): n is a, c, g, or t
  misc_feature (4000)..(4000): n is a, c, g, or t
gagcccagcaaaccagttacagaataggtattagtctgcactgccccactataaacatttgtagtgctatcaccattaactgtcagattcgctttagcgatattcaaggacccatttacaaatgtgacgttagagtaatcactattactaccgcctacagtattcacgtaagagccaacgttcgttctactcgcgcccgaagccgtgatacctgctaatgaagttggagatgcagcatcggcacctactaaaccggtaatactgtagccacttacactttgagcactagccgtgtaagttacgttactactattacccgtaaccactaccgctccggtatatggcgttatggtgagtgagccattgacatttaccaaagtgtagtttggtgagccaatcgatgtatttaagttatctgtatagacaccaacgtgcacaccagttgatgagccagaaactgccaatgctgtagttattgctgtatcaccacctaagaatccagaaacattgtaagtatttgattgggtagtaccgttatatacggctgtagcagtagcgccagttactgtcaaagtagctggagtgatatttaatgagccattaataaaagtgatattggaatagtcgctattactaccacttggcgtattggtatagctacctacgtttgttgcgctggcgccagaggcaaagatgcccgctagatttgatggggtaatagcatcaactccgagaaggcctgtagaggtatagccactcacggattgtgtagctgctgtataggtcgttgtagagctattgccagtgatgactaccgctccagcgtatggagaaatcgtcaagcttgctgggttatagctgatgctgtaatttgttaaaccactaccaactgcatttgaaagtgtgcccgtgtagctaccagcatgtaaaccgctagcagagccagttacaccagttacagcgtccgttccaagcaaacctgacactgaatagttggcattcgtctgagtggcaccgctgtagatagaggagacattagtgccagaaattactaatgctgccttattgatcgtcaagctgccattagtaaccgtaaagttatagttgctagctaatgtacccgttgcagataatgattcagaatatggtgtagcagaggccaacgttccagttgcatagccagatacgccaatacttgcagcatcattaccctgcaaacccacaaatacagcacctgtattagtttgcgatgtgccgttataggtaacaacgttattcgccccaatcaagctagcactcgccttagtaatggtcattgacccattcacataggtaattgcatagtcagatgattgagttgtcccgttagcggcagcagttaaagcatcactataaggtccgccggcattaatacctgaagccaaaccagtaactgtaaaagtatcgccatttttaagaccaacaacacttgctgcagcattagtttgggtattggcgttgtataccaagttattagtagtcgcaccagtgatagtcagcggtgctggcgtaatagttagattggcattaataacctgaacagagctaaagtgcccttgtgagttagtaaggcctgaattagtagctgttactgcattttggtacaaaccaacgtgtgaggtaatcggcactccagtaatgctcggattgaccgtaatactgccacccagaccatcagaccatgtgccgccaccatcgcttgatgtcagagtgtgtaccagtacggtatttccagagggggtcgcatactgaactgacactacattaccgttactactagagaagctggtagcacttccataagtagtagttgcattattcatcgtaataacggctgnaccagcaggactgattgttaaagtccccggcaaataagtaattgtgtaatttgtcgatgttgcattaccactcggtgtgattgtgtagggtcctggcgtttcacctgccacgcgngtgttgntaacagtaccagctaccgaggacaaggtatcactacccaataaaccacttacagtattagtaaaggttggatctgacagagtaataaatttttgctcattgttggcagcaattaccaagctagccttggtgatagttaggctaggattatttgatgtgatcacatagtttccagcatctacaccagatttggtntagcttgcgttatatgttccaacgcttacccctgatgcgccaccggcaacagttacgttatcacccgcaataatcccactgacagttggtgtagctaatgattgagttgctgcatcataggtagtcgatgctgatgtcccagtaatcgtaatggttgctggcgtaatgttggcagtagtggtgacatttaaaccgccagagagctgataatttgagctggcagttcctagaattgccacaccagaaatattgacagtcttagttgtacccacatttttatcaacaaagttgccaactaaatttccagtattgatagatacactattttgatcggcaggtaatacaccactaaacgaaatagtaccaacattcaaggtagctgccgtagttgcgtcatataccttgttattagcagtaatgccactaaccgtaatgattgccggggtaatcgttaaggagccattagaagtagtgatcttatagtcgctagcattgcccgaggtaaaggcataacttaaattatcgctgtaagttcctgcgttatacccaccagcgcgcccagtcgttgatagtgcatcactacccaagagaccggttaccgttggcaaagaatttgtctgtgttgttgcgttataggctgtactgatatttgcgccaacaatacttaagttagcttgtgtaatggtcatactgccattgacataattgatagcgtaatttgacaaaccactaccttgtgcgccacttaaagcatcagcatatacaccaacgtgtgtgccagaactttgtccaagtacagatgttactgaagcgccatctgccaacaacccactagtagtnaatgctgtggagttggtttgtgcagatccactataaacactagtagttgtgctaccagtaatcgttaatggtgctggtgtgatattggctgttgctgtaataccagtagtggctagctgatagtcgctagcagatgccccgccaatagcaacgccactaaagctcactgtcttcgcnnngcctacnttngcnttggcaaagctagcactgccataggtaatcgataaactatcaccagggaataagtttgctgcattaatggcgcctgttgctgcagtagtagtgtcatacaccctgtcattagccgtggctactaaagacgggctattagcagccccattgggcccaatgatgtaaggggtaatggtcaaagcccggtttacatatgcaatggtgtagtttgataagccagtaccttgagcattggtgaggacatcggcatacgtaccgacgtgtttaccactaccctgacctgttactgaagtaaccgtatctgaacctaataaaccactagttgtaaaggtcgttgcattagtttgggttgcaccgttatatacggtactggtattaacaccggtaattgtcaggctagctggcgtaatcgttaatgagccgttggtgtaggagaantnntagttagncnnancngnnccngctgnnnnnnatngagannnnnnannannancancnttnnnnnnggnnnnnnnnnntncnannnnantnncannancannantnannnnncnnnnngnngnannngnnnnantttgantngcgccnntntanncnnnantantngnngcnncngnnanagtnannnnnnnnnnnntaancnnnaanncnccnntnnnannnnnannnnnatngntnnnannnctnnngnnnnnanntnnnntnnnnacnnnnnnancnnnnnnngtcnnnannnnnnngncncnancntnannantnnntgnnncnntnnnan

SEQ ID NO: 1519 - DNA, 4000 bp, Escherichia coli
  misc_feature (5)..(5): n is a, c, g, or t
  misc_feature (25)..(25): n is a, c, g, or t
  misc_feature (34)..(34): n is a, c, g, or t
  misc_feature (85)..(85): n is a, c, g, or t
  misc_feature (88)..(88): n is a, c, g, or t
  misc_feature (91)..(91): n is a, c, g, or t
  misc_feature (97)..(97): n is a, c, g, or t
  misc_feature (124)..(124): n is a, c, g, or t
  misc_feature (133)..(133): n is a, c, g, or t
  misc_feature (139)..(139): n is a, c, g, or t
  misc_feature (144)..(144): n is a, c, g, or t
  misc_feature (146)..(146): n is a, c, g, or t
  misc_feature (151)..(151): n is a, c, g, or t
  misc_feature (160)..(160): n is a, c, g, or t
  misc_feature (163)..(163): n is a, c, g, or t
  misc_feature (187)..(187): n is a, c, g, or t
  misc_feature (220)..(220): n is a, c, g, or t
  misc_feature (232)..(232): n is a, c, g, or t
  misc_feature (235)..(235): n is a, c, g, or t
  misc_feature (242)..(242): n is a, c, g, or t
  misc_feature (247)..(247): n is a, c, g, or t
  misc_feature (301)..(301): n is a, c, g, or t
  misc_feature (307)..(308): n is a, c, g, or t
  misc_feature (319)..(319): n is a, c, g, or t
  misc_feature (322)..(322): n is a, c, g, or t
  misc_feature (328)..(328): n is a, c, g, or t
  misc_feature (343)..(343): n is a, c, g, or t
  misc_feature (355)..(355): n is a, c, g, or t
  misc_feature (358)..(358): n is a, c, g, or t
  misc_feature (361)..(361): n is a, c, g, or t
  misc_feature (367)..(367): n is a, c, g, or t
  misc_feature (385)..(385): n is a, c, g, or t
  misc_feature (409)..(409): n is a, c, g, or t
  misc_feature (418)..(418): n is a, c, g, or t
  misc_feature (424)..(424): n is a, c, g, or t
  misc_feature (445)..(445): n is a, c, g, or t
  misc_feature (469)..(469): n is a, c, g, or t
  misc_feature (480)..(481): n is a, c, g, or t
  misc_feature (483)..(483): n is a, c, g, or t
  misc_feature (487)..(488): n is a, c, g, or t
  misc_feature (492)..(493): n is a, c, g, or t
  misc_feature (495)..(506): n is a, c, g, or t
  misc_feature (509)..(514): n is a, c, g, or t
  misc_feature (516)..(516): n is a, c, g, or t
  misc_feature (518)..(518): n is a, c, g, or t
  misc_feature (522)..(527): n is a, c, g, or t
  misc_feature (530)..(540): n is a, c, g, or t
  misc_feature (545)..(546): n is a, c, g, or t
  misc_feature (555)..(556): n is a, c, g, or t
  misc_feature (559)..(559): n is a, c, g, or t
  misc_feature (563)..(563): n is a, c, g, or t
  misc_feature (570)..(571): n is a, c, g, or t
  misc_feature (573)..(575): n is a, c, g, or t
  misc_feature (577)..(577): n is a, c, g, or t
  misc_feature (579)..(580): n is a, c, g, or t
  misc_feature (588)..(588): n is a, c, g, or t
  misc_feature (590)..(591): n is a, c, g, or t
  misc_feature (597)..(597): n is a, c, g, or t
  misc_feature (600)..(600): n is a, c, g, or t
  misc_feature (610)..(610): n is a, c, g, or t
  misc_feature (612)..(613): n is a, c, g, or t
  misc_feature (660)..(660): n is a, c, g, or t
  misc_feature (667)..(667): n is a, c, g, or t
  misc_feature (698)..(698): n is a, c, g, or t
  misc_feature (711)..(711): n is a, c, g, or t
  misc_feature (1989)..(1989): n is a, c, g, or t
  misc_feature (2067)..(2067): n is a, c, g, or t
  misc_feature (2263)..(2263): n is a, c, g, or t
  misc_feature (2359)..(2359): n is a, c, g, or t
  misc_feature (2509)..(2509): n is a, c, g, or t
  misc_feature (2560)..(2560): n is a, c, g, or t
  misc_feature (2635)..(2635): n is a, c, g, or t
  misc_feature (2656)..(2656): n is a, c, g, or t
  misc_feature (2704)..(2704): n is a, c, g, or t
  misc_feature (2710)..(2710): n is a, c, g, or t
  misc_feature (2875)..(2875): n is a, c, g, or t
  misc_feature (2911)..(2911): n is a, c, g, or t
  misc_feature (2928)..(2928): n is a, c, g, or t
  misc_feature (2965)..(2965): n is a, c, g, or t
  misc_feature (2983)..(2983): n is a, c, g, or t
  misc_feature (2986)..(2986): n is a, c, g, or t
  misc_feature (3054)..(3054): n is a, c, g, or t
  misc_feature (3100)..(3100): n is a, c, g, or t
  misc_feature (3127)..(3127): n is a, c, g, or t
  misc_feature (3192)..(3192): n is a, c, g, or t
  misc_feature (3269)..(3269): n is a, c, g, or t
  misc_feature (3272)..(3272): n is a, c, g, or t
  misc_feature (3296)..(3296): n is a, c, g, or t
  misc_feature (3389)..(3389): n is a, c, g, or t
  misc_feature (3555)..(3555): n is a, c, g, or t
  misc_feature (3587)..(3587): n is a, c, g, or t
  misc_feature (3671)..(3671): n is a, c, g, or t
  misc_feature (3683)..(3683): n is a, c, g, or t
  misc_feature (3692)..(3692): n is a, c, g, or t
  misc_feature (3719)..(3719): n is a, c, g, or t
  misc_feature (3725)..(3725): n is a, c, g, or t
  misc_feature (3779)..(3779): n is a, c, g, or t
  misc_feature (3809)..(3809): n is a, c, g, or t
  misc_feature (3842)..(3842): n is a, c, g, or t
  misc_feature (3890)..(3890): n is a, c, g, or t
  misc_feature (3935)..(3935): n is a, c, g, or t
  misc_feature (3944)..(3944): n is a, c, g, or t
tcacnttcctttccgtagagaaganggacgttcntgcggttgcggtagaacaggttgtttagaaacttattgttctgcaacaggngtngcnagaacngctcgtgagttcttacaaaattctgangaggattcnttattncgtgnantaaanccagaaaanatnacttctttagatgttagtattgcngctagcaaaggtgacaaacttgcaaaaagagtntatgactttacnggngaaatgntaggngaagcatgtgcagactttgcagctttctcttcacctgaagcttttatcttcttnggtggnntaacaaaagcnggngacttnctaatggaacctttnaaaagaagcttngangancatgtnttgaagatttataagaanaaagcaaaattcttaattagcggnctagaaggntcttcngctgctgtattaggtgcatcngctgtaggatgggatctataattntttaagaatannanattnnaaannannnnnnnnnnnnttnnnnnnantnaaannnnnntannnnnnnnnnnttttnnttaaccttnntcntttnaatccanncnnntntnnaataaagnannccttantanggattggatntnnaaatattttaatgttgtttctttttgagtaggagataggttacaaanccaatanagacaaataagaaacctgcaataatgcaaanattcttatatccnctcataaattgaaaaacactcaatatttgtagcagtacccctatatatataaggtgtaaaccaaaagcattatatatatattctttcattcgcctataataatcttttacgaagcacaaaaatataactatcacttgggatagacaagaattttcaatctattaatttgttaattaaagataattcttcgattattataaaacaccatgtgcgatattcataaaaaagtactaactttgcacctcgaattaataaacatatttttcaataaatttaaagtagtatgaatcattacgaaaccgttttcattttaactcccgttttatctgatgaacagatgaaggaagcggtcgctaagttcaaaaagcttcttaccgataatggtgctgagattttgaacgaagaggcatggggattaaagaagatggcttatgctatcgacaaaaaatctacaggtttttattgcttgttagagttcaaggctgagcctacaattgttaatactctcgaaattggctatcgtcgcgacgagagaattatccgtttcattactgttaagcttgataagtatgcagcagagtatgctatcaagagaaagaataaatacgctaaaaaacaggaggcttaatcatggcagaacaacaaagcgaaattcgttatttaaccccaccatcagttgacaataagaaaaagaaatactgtcgcttcaaaaagagtggtattaagtatattgactataaggatcctgaattcttgaagaagttcttaaacgaacaaggaaagatcttacctcgtagaattacaggtacatctttgaaattccaaagacgtgttgcgcaagcagttaagcgtgctcgccaaattgccttgcttccttatgtaacagatttaatgaaataaaaaggaggtaacgaaatggaaattatacttagagaagatattataggtttaggctataagaatgatatcgtaaacgtaaaatcaggttatggccgtaactaccttatcccaacaggaaaagctatcattgcttcagaatcagcaaagaaagtattagcagaaaacctaagacaacaagctcacaaacttgcagctattaaagctaacgcagaaaagagagctgctgaattagaaggtgttgagctaactatcgaagttaaagtatctgcaacaggtgctacttatggttctgtaaacgctgcaatcgtagcagaagaattaaagaaaaaaggtttcgaaattgaccgtaagatcatcacaatgagtgatatcaagcangtaggtgattttgaagcaactgttcacttccacaaagaagttgaagcaatcgtaccagttaaggttgtagctgagacngcaaaggaagagaaagaaacagctgagaaataataatttattgtaacaattataactatacagttgtagtaatataaaatatcccgataactttatgtttttcgggatattttattcttgtaaatataacataaatattcttttatctaaacgaatttaagaaaaagatgttatatttgtatctccaaatattatnataaataaatagaacatgaaagcatttgtttttccaggtcaaggagctcaatacgtaggaatgggtaaagagttatacaactcaagtgcccttgcnaaagaactattcgacaaagcgaatgaaattcttggcttcaatattacagaaataatgtttaatggtacagatgaggaacttaaacaaaccaaagtaactcagccagccgtattcttagacagcgttataactgcattatctctagaaganaagctagatgcagaaatggttgcaggtcactctttaggtgagttctctgcnttagttgttgcaggagtactttcttttgaagatggtcttagacttgttgcagcacgtgctaacgcaatgcaaaangcttgcgaagctacaaaaggnaccatggctgcaatcattggacttgcagatgagaaggtagaagaaatntgttcntctgtatctacaccagaaaatatcgtagttgcagcaaactataactgtccaggtcaattagttatttctggtagtatcgacgcaatcaatactgcatgtgagaagatgaaagaagcaggagctaagagagcacttcctttacctgtatctggtgcattccattcnccattaatgcaaccagcaaaagatgaacttcaagcngctattgagagtgtaantttcaatacacctcgtatccctgtttatcaaaacgtngatgcattagcacacacngangcagaagaaattaagaaaaaccttgttgctcaattaacaggagcagtacgttggaccgcaactatcantaatatgatagcaaacggagctaatgattttacagaatgtggaccnggaaaagcactacaaggaatgattggncgcatcgataagactgttgctgcccacggagtagaataatataaatcctaaaagattagaagacnatataaaggtgaataagaaattaattatttatcaagtctttactcgccttttcggtaatcgcaatcacaataatatngtnaatggttcgattaccgaaaatggngttggtaaaatgaatgactttaatacatcaaccctgaaacgcattaaaagcatgggatgtacccatgtttggtataccggaataattagacangcaagcacaacttcatacgaagagtatggaattcctacacaacatccagcaattgtaaaaggtaaggcaggttctccatatgcgattgtcgattactatgatgtagatccagatttagcagaaaacgttccagacagaatgcaagagttcgaagctcttctttctngaacaagtaaggttggtttaaaaaccattatngattttgtccccaaccatgtagcacgccaatacaaatcaacaacaaaaccagaaggagtcgaagatttaggtgaaaacgatganaccaccaagaanttcgatgcnaacaataacttttattattgtaatggncttccntttgctccatcttttagtttgtattctgaagctacagacacaacttattttgancaaccagcaaaagctacgggcaatgatcgntttgataatgcaccaaataaagatgattggtangaaaccattaaacttaattatggtgtagattattgcaatccatgtggngaacgtactgaacattttgatcctattccttctacttggaagaanatgaccganatacttctattctgggcaagaaaaggagttgatggatttagatgtgatatggcaga

SEQ ID NO: 1520 - DNA, 4000 bp, Escherichia coli
  misc_feature (3)..(3): n is a, c, g, or t
  misc_feature (5)..(9): n is a, c, g, or t
  misc_feature (11)..(17): n is a, c, g, or t
  misc_feature (19)..(23): n is a, c, g, or t
  misc_feature (25)..(27): n is a, c, g, or t
  misc_feature (29)..(30): n is a, c, g, or t
  misc_feature (32)..(32): n is a, c, g, or t
  misc_feature (34)..(35): n is a, c, g, or t
  misc_feature (37)..(40): n is a, c, g, or t
  misc_feature (42)..(45): n is a, c, g, or t
  misc_feature (47)..(47): n is a, c, g, or t
  misc_feature (49)..(50): n is a, c, g, or t
  misc_feature (52)..(60): n is a, c, g, or t
  misc_feature (63)..(63): n is a, c, g, or t
  misc_feature (68)..(69): n is a, c, g, or t
  misc_feature (71)..(71): n is a, c, g, or t
  misc_feature (73)..(77): n is a, c, g, or t
  misc_feature (79)..(80): n is a, c, g, or t
  misc_feature (82)..(83): n is a, c, g, or t
  misc_feature (85)..(85): n is a, c, g, or t
  misc_feature (87)..(89): n is a, c, g, or t
  misc_feature (91)..(92): n is a, c, g, or t
  misc_feature (94)..(95): n is a, c, g, or t
  misc_feature (97)..(100): n is a, c, g, or t
  misc_feature (103)..(109): n is a, c, g, or t
  misc_feature (111)..(112): n is a, c, g, or t
  misc_feature (114)..(114): n is a, c, g, or t
  misc_feature (116)..(129): n is a, c, g, or t
  misc_feature (133)..(134): n is a, c, g, or t
  misc_feature (136)..(136): n is a, c, g, or t
  misc_feature (138)..(140): n is a, c, g, or t
  misc_feature (143)..(154): n is a, c, g, or t
  misc_feature (156)..(158): n is a, c, g, or t
  misc_feature (161)..(166): n is a, c, g, or t
  misc_feature (168)..(173): n is a, c, g, or t
  misc_feature (175)..(176): n is a, c, g, or t
  misc_feature (180)..(180): n is a, c, g, or t
  misc_feature (182)..(184): n is a, c, g, or t
  misc_feature (765)..(765): n is a, c, g, or t
  misc_feature (782)..(782): n is a, c, g, or t
  misc_feature (1014)..(1014): n is a, c, g, or t
  misc_feature (1842)..(1842): n is a, c, g, or t
  misc_feature (1990)..(1990): n is a, c, g, or t
  misc_feature (2158)..(2158): n is a, c, g, or t
  misc_feature (2462)..(2462): n is a, c, g, or t
  misc_feature (2609)..(2609): n is a, c, g, or t
  misc_feature (2696)..(2696): n is a, c, g, or t
agnannnnntnnnnnnnannnnntnnngnngntnntnnnntnnnntntnntnnnnnnnnntgntgatnntntnnnnnannannangnnntnntnntnnnncannnnnnnannantnnnnnnnnnnnnnntatnntngnnnaannnnnnnnnnnngnnnaannnnnnannnnnnannaatnannngttatcgtgtaagtgcaaaaaagaaagcttgtgtaaggtttgaaatatcgccactggcagttgctagattatttacagctgattttgcaacttcgaaatagactgaaccaccaatttccggattttcctttacaatatttgtaaaatcatctaggcttaaaattccatattgtactggcgtagtggaatgaacatgggctgtacgtattgcattatccaaaactagtgagaattctccaattccaaatgctggcgcttctactacgaacacggtagattctgtttctggttctgatgccgggggaggatcagttgtttctaaacgaatgataggtttccttgacgttgcaataccactggcagtttttaccatcatatttttagatacttctacctggccttgaaaaacaagtaccatggtatcgcctgtatccccttcagtgagtagctgttctttgggaccgcactcctgtatttctaccacactggcgatctttgcacacatatctatatgtaccttgctgaaatgattgatcttttgaatttgttctgctgatggattcatactctacctcaatacnagtgcgctgtgtttttnatcaatcttgtaatcatccggaggattaatttcaacaacaacatgctcatcgctggtcaggtttattcccgcaccatccagctgttctttaatcatattccgaataagcgggctgccactttctcccatttgttcatccaggctaaaccctgccttacggatcgcatatccaaccagtaaccagccatatttgaatttataaaaagcagatatcttattatgggtttgcccntttaatgtcctggggatttttacctcctgaagacctttatcatcttcttccttcaaaataagatcatcaaaaaattgcggtacgcccggatctgtaacgtgttttgccaacagatgcggcacatgttcatccggaataacaatctcatttgcattggcgcgttgaaggtgggatacattttctacatctagaacatgcgcaacaacattgcaagattcagaaattgactttgcagtgagacaggtcaaaacagttttatcttcatcgggctcttcatggggcagtaatccggaattatccggcagaatcatgaatgttcctgctttttccaaaaacgcttttcttaaaacagactcgtgagtgaagttttctgatatatgggtaatatccaatctttcatagcctgtcatggcccgttgtataatatctcgatccgttacattcaccaagattactacgtctgtagaatcttcatttgcatcgataagtttcaaaatggatggaaccgttgcgttccatcctgcgatgaccaggtggtcattaaatttgctctcgtccaaggtatcatctccttttaatcgttcagcaaccaatacggatgctacagccccgccgagtaaggtgacgacgccaaagtttaataacatgattattattgtgagaaatttcccaaggtgggttatggggcttacatcaccatatcccacggtagtaaatgttacgactgaccaccagaatgtatgaaaaaaagtgtccagccagttaggttctgttttaccaaatataaaacttccatccacatcttcagccaaattactattgaacatntcgtactcaagaattgtcagggcagttgtggatatcaggatcattaccatggcccatgctgcatatctgaccagatcattttctgtgtataaagattttattttatgtacaacatccaataatggatgagtttcatcaccctcttttncactctcctcatcttcctctaatacagtacccaaggcttcaatctcaggaatcttattcagtttatcaaagagatccttgtttgcaccaataacttcatccaattctgaagtggaaacttctggttcttgtatctggtctagtggcgggtcgttattcattattattntttatttctctcgttctaaattgaacggatgatgataaaaatactatcgaattattttagaataagcaaacatgaagtttaggcatgatattcctgtattgattgtacctgtattggtttcgccgctaaacgaatagccctcacagctgcgcttgcccctgataatgtagtaatcgccacaattcctttttggatacaggcacggcctattgattcttcgtcgtatctcgcctgggcacccattggcgtattgattactaggtttatttcaccatttttaattccatccacaacattggggcgnccctctccaactttaaacacagaagttacttgtaggccgttccttttcagctgccttgccgttcccgaagttgctaccagtttaaatccaatttcaatcatatccctggcaatgggaatcacatccagtttatctgcgttgttgacngaaataaatactatacctgtactgggaataatattgcctgcactgatggatgcccgtcgaaacgattctcctaatgttttagaaatncccatgacttctccggtggatttcatttccggactcaagaagatcgactcttcaggaaatttattaaacggcaatacggcttcttttacggccacataggggtttctatcccagggttttagagcaaattgagatagggtggctccagttgctaattgtgctgcaatccgtgctaagggtgtattcgttgttttacttacaaagggaattgttcgactggctcttgggtttacttccaagacgtagacctgaccatccttatatgcgaattgcaggttaatcaggccaacaacatttaattttagagccagagcttctgtaatccggattatttcttccaatgcctctgtcgtgattcgatagggaggtaaaacacaggcagaatcgccagaatgaatccctgcttcctcaatatgctgcataacagcaccaatatgaactgattttccatcacataacgcatcaacatcaaactcaaaagcatcttctaagaattcatcaatcaagattggatgtccttctgtaacatctgcggagcgagcgatataatcaatcaattgtttcttagaatacacaatttccatggcccgcccgcccagaacataactgggacgagccaaaacagggaatcctatcttttctgccacagtaataacctcatccagagtgcgccctgtcccatactgtggacagacaacatctaatttctgaaggattgctccaaacttttcacgatcttccgcaaggtcaatattttcaggagaggtgccaatgattggaactcctgaattctttagcgcatttgctattttaagcggtgtttgtccaccaaattgaactaacacaccatcaggattttcaaattcaacaatatttaatacatcttcgaacgtcactggctcaaaataaagcctgtctaccaaatcaaaatctgtgcttactgtttctggattacaattgaccataatggttttaaagttctgatctttcaagccaaatacagcttggacacaacaataatcaaattcaatgccctgaccaatgcgattaggcccgctgccgagaatgatcacttttttaccttccagaggttcaatttcattctctttatcataagtggaataacaatagggtgtttgtgcaacaaattccgctgcacaggtgtccacaactttatatgcaggaaaaacagctgttctttttcgcatctctcgaatttcaagttctgtcttatccatcatgcgtcctatctgacagtcagagaatccattatgttttaattcatacaatgaattctgatctgt

SEQ ID NO: 1521 - DNA, 4000 bp, Escherichia coli
  misc_feature (3)..(8): n is a, c, g, or t
  misc_feature (10)..(10): n is a, c, g, or t
  misc_feature (12)..(24): n is a, c, g, or t
  misc_feature (27)..(29): n is a, c, g, or t
  misc_feature (31)..(32): n is a, c, g, or t
  misc_feature (35)..(37): n is a, c, g, or t
  misc_feature (40)..(45): n is a, c, g, or t
  misc_feature (47)..(54): n is a, c, g, or t
  misc_feature (56)..(57): n is a, c, g, or t
  misc_feature (59)..(60): n is a, c, g, or t
  misc_feature (63)..(64): n is a, c, g, or t
  misc_feature (66)..(66): n is a, c, g, or t
  misc_feature (69)..(70): n is a, c, g, or t
  misc_feature (72)..(75): n is a, c, g, or t
  misc_feature (78)..(80): n is a, c, g, or t
  misc_feature (83)..(85): n is a, c, g, or t
  misc_feature (88)..(88): n is a, c, g, or t
  misc_feature (90)..(106): n is a, c, g, or t
  misc_feature (108)..(110): n is a, c, g, or t
  misc_feature (114)..(114): n is a, c, g, or t
  misc_feature (116)..(120): n is a, c, g, or t
  misc_feature (122)..(123): n is a, c, g, or t
  misc_feature (125)..(126): n is a, c, g, or t
  misc_feature (129)..(129): n is a, c, g, or t
  misc_feature (132)..(133): n is a, c, g, or t
  misc_feature (135)..(135): n is a, c, g, or t
  misc_feature (137)..(138): n is a, c, g, or t
  misc_feature (140)..(142): n is a, c, g, or t
  misc_feature (145)..(145): n is a, c, g, or t
  misc_feature (147)..(150): n is a, c, g, or t
  misc_feature (152)..(154): n is a, c, g, or t
  misc_feature (156)..(156): n is a, c, g, or t
  misc_feature (158)..(158): n is a, c, g, or t
  misc_feature (160)..(160): n is a, c, g, or t
  misc_feature (162)..(163): n is a, c, g, or t
  misc_feature (166)..(172): n is a, c, g, or t
  misc_feature (175)..(175): n is a, c, g, or t
  misc_feature (177)..(183): n is a, c, g, or t
  misc_feature (186)..(187): n is a, c, g, or t
  misc_feature (190)..(190): n is a, c, g, or t
  misc_feature (194)..(194): n is a, c, g, or t
  misc_feature (196)..(197): n is a, c, g, or t
  misc_feature (199)..(199): n is a, c, g, or t
  misc_feature (201)..(206): n is a, c, g, or t
  misc_feature (208)..(210): n is a, c, g, or t
  misc_feature (212)..(214): n is a, c, g, or t
  misc_feature (216)..(216): n is a, c, g, or t
  misc_feature (218)..(222): n is a, c, g, or t
  misc_feature (227)..(229): n is a, c, g, or t
  misc_feature (231)..(234): n is a, c, g, or t
  misc_feature (237)..(241): n is a, c, g, or t
  misc_feature (244)..(244): n is a, c, g, or t
  misc_feature (246)..(251): n is a, c, g, or t
  misc_feature (253)..(253): n is a, c, g, or t
  misc_feature (255)..(261): n is a, c, g, or t
  misc_feature (264)..(264): n is a, c, g, or t
  misc_feature (268)..(269): n is a, c, g, or t
  misc_feature (271)..(271): n is a, c, g, or t
  misc_feature (273)..(276): n is a, c, g, or t
  misc_feature (278)..(283): n is a, c, g, or t
  misc_feature (285)..(288): n is a, c, g, or t
  misc_feature (292)..(292): n is a, c, g, or t
  misc_feature (298)..(298): n is a, c, g, or t
  misc_feature (301)..(311): n is a, c, g, or t
  misc_feature (313)..(313): n is a, c, g, or t
  misc_feature (315)..(316): n is a, c, g, or t
  misc_feature (320)..(321): n is a, c, g, or t
  misc_feature (323)..(325): n is a, c, g, or t
  misc_feature (334)..(339): n is a, c, g, or t
  misc_feature (343)..(343): n is a, c, g, or t
  misc_feature (345)..(345): n is a, c, g, or t
  misc_feature (347)..(347): n is a, c, g, or t
  misc_feature (353)..(355): n is a, c, g, or t
  misc_feature (357)..(358): n is a, c, g, or t
  misc_feature (360)..(360): n is a, c, g, or t
  misc_feature (362)..(363): n is a, c, g, or t
  misc_feature (367)..(368): n is a, c, g, or t
  misc_feature (371)..(371): n is a, c, g, or t
  misc_feature (373)..(374): n is a, c, g, or t
  misc_feature (378)..(378): n is a, c, g, or t
  misc_feature (380)..(381): n is a, c, g, or t
  misc_feature (383)..(383): n is a, c, g, or t
  misc_feature (385)..(385): n is a, c, g, or t
  misc_feature (387)..(389): n is a, c, g, or t
  misc_feature (393)..(393): n is a, c, g, or t
  misc_feature (395)..(395): n is a, c, g, or t
  misc_feature (398)..(401): n is a, c, g, or t
  misc_feature (403)..(403): n is a, c, g, or t
  misc_feature (405)..(405): n is a, c, g, or t
  misc_feature (407)..(407): n is a, c, g, or t
  misc_feature (409)..(411): n is a, c, g, or t
  misc_feature (413)..(413): n is a, c, g, or t
  misc_feature (415)..(417): n is a, c, g, or t
  misc_feature (419)..(425): n is a, c, g, or t
  misc_feature (427)..(427): n is a, c, g, or t
  misc_feature (430)..(432): n is a, c, g, or t
  misc_feature (434)..(434): n is a, c, g, or t
  misc_feature (436)..(443): n is a, c, g, or t
  misc_feature (447)..(449): n is a, c, g, or t
  misc_feature (451)..(456): n is a, c, g, or t
  misc_feature (458)..(458): n is a, c, g, or t
  misc_feature (462)..(464): n is a, c, g, or t
  misc_feature (467)..(467): n is a, c, g, or t
  misc_feature (469)..(471): n is a, c, g, or t
  misc_feature (474)..(475): n is a, c, g, or t
  misc_feature (478)..(483): n is a, c, g, or t
  misc_feature (487)..(487): n is a, c, g, or t
  misc_feature (489)..(489): n is a, c, g, or t
  misc_feature (491)..(494): n is a, c, g, or t
  misc_feature (496)..(499): n is a, c, g, or t
  misc_feature (501)..(501): n is a, c, g, or t
  misc_feature (503)..(506): n is a, c, g, or t
  misc_feature (508)..(511): n is a, c, g, or t
  misc_feature (513)..(513): n is a, c, g, or t
  misc_feature (515)..(518): n is a, c, g, or t
  misc_feature (520)..(522): n is a, c, g, or t
  misc_feature (524)..(524): n is a, c, g, or t
  misc_feature (526)..(527): n is a, c, g, or t
  misc_feature (530)..(531): n is a, c, g, or t
  misc_feature (533)..(536): n is a, c, g, or t
  misc_feature (538)..(538): n is a, c, g, or t
  misc_feature (543)..(551): n is a, c, g, or t
  misc_feature (553)..(558): n is a, c, g, or t
  misc_feature (561)..(561): n is a, c, g, or t
  misc_feature (564)..(566): n is a, c, g, or t
  misc_feature (568)..(569): n is a, c, g, or t
  misc_feature (572)..(573): n is a, c, g, or t
  misc_feature (576)..(576): n is a, c, g, or t
  misc_feature (580)..(580): n is a, c, g, or t
  misc_feature (582)..(584): n is a, c, g, or t
  misc_feature (586)..(586): n is a, c, g, or t
  misc_feature (588)..(588): n is a, c, g, or t
  misc_feature (590)..(595): n is a, c, g, or t
  misc_feature (597)..(597): n is a, c, g, or t
  misc_feature (599)..(600): n is a, c, g, or t
  misc_feature (603)..(603): n is a, c, g, or t
  misc_feature (606)..(606): n is a, c, g, or t
  misc_feature (611)..(611): n is a, c, g, or t
  misc_feature (615)..(615): n is a, c, g, or t
  misc_feature (617)..(618): n is a, c, g, or t
  misc_feature (621)..(623): n is a, c, g, or t
  misc_feature (626)..(626): n is a, c, g, or t
  misc_feature (628)..(644): n is a, c, g, or t
  misc_feature (646)..(647): n is a, c, g, or t
  misc_feature (649)..(650): n is a, c, g, or t
  misc_feature (652)..(652): n is a, c, g, or t
  misc_feature (656)..(659): n is a, c, g, or t
  misc_feature (662)..(664): n is a, c, g, or t
  misc_feature (666)..(667): n is a, c, g, or t
  misc_feature (670)..(670): n is a, c, g, or t
  misc_feature (672)..(672): n is a, c, g, or t
  misc_feature (675)..(686): n is a, c, g, or t
  misc_feature (688)..(689): n is a, c, g, or t
  misc_feature (691)..(691): n is a, c, g, or t
  misc_feature (695)..(696): n is a, c, g, or t
  misc_feature (698)..(699): n is a, c, g, or t
  misc_feature (701)..(701): n is a, c, g, or t
  misc_feature (703)..(705): n is a, c, g, or t
  misc_feature (709)..(712): n is a, c, g, or t
  misc_feature (715)..(715): n is a, c, g, or t
  misc_feature (717)..(717): n is a, c, g, or t
  misc_feature (721)..(733): n is a, c, g, or t
  misc_feature (735)..(735): n is a, c, g, or t
  misc_feature (740)..(742): n is a, c, g, or t
  misc_feature (744)..(744): n is a, c, g, or t
  misc_feature (746)..(746): n is a, c, g, or t
  misc_feature (748)..(752): n is a, c, g, or t
  misc_feature (755)..(757): n is a, c, g, or t
  misc_feature (759)..(760): n is a, c, g, or t
  misc_feature (763)..(767): n is a, c, g, or t
  misc_feature (769)..(769): n is a, c, g, or t
  misc_feature (771)..(775): n is a, c, g, or t
  misc_feature (777)..(777): n is a, c, g, or t
  misc_feature (779)..(779): n is a, c, g, or t
  misc_feature (782)..(787): n is a, c, g, or t
  misc_feature (790)..(791): n is a, c, g, or t
  misc_feature (793)..(796): n is a, c, g, or t
  misc_feature (798)..(799): n is a, c, g, or t
  misc_feature (801)..(804): n is a, c, g, or t
  misc_feature (806)..(809): n is a, c, g, or t
  misc_feature (812)..(812): n is a, c, g, or t
  misc_feature (815)..(815): n is a, c, g, or t
  misc_feature (820)..(822): n is a, c, g, or t
  misc_feature (824)..(824): n is a, c, g, or t
  misc_feature (826)..(832): n is a, c, g, or t
  misc_feature (834)..(835): n is a, c, g, or t
  misc_feature (840)..(845): n is a, c, g, or t
  misc_feature (850)..(850): n is a, c, g, or t
  misc_feature (852)..(856): n is a, c, g, or t
  misc_feature (860)..(860): n is a, c, g, or t
  misc_feature (862)..(863): n is a, c, g, or t
  misc_feature (865)..(865): n is a, c, g, or t
  misc_feature (867)..(871): n is a, c, g, or t
  misc_feature (873)..(875): n is a, c, g, or t
  misc_feature (877)..(877): n is a, c, g, or t
  misc_feature (879)..(881): n is a, c, g, or t
  misc_feature (884)..(887): n is a, c, g, or t
  misc_feature (889)..(891): n is a, c, g, or t
  misc_feature (893)..(894): n is a, c, g, or t
  misc_feature (896)..(897): n is a, c, g, or t
  misc_feature (899)..(903): n is a, c, g, or t
  misc_feature (906)..(906): n is a, c, g, or t
  misc_feature (908)..(908): n is a, c, g, or t
  misc_feature (911)..(914): n is a, c, g, or t
  misc_feature (916)..(917): n is a, c, g, or t
  misc_feature (919)..(924): n is a, c, g, or t
  misc_feature (926)..(929): n is a, c, g, or t
  misc_feature (932)..(937): n is a, c, g, or t
  misc_feature (939)..(945): n is a, c, g, or t
  misc_feature (947)..(949): n is a, c, g, or t
  misc_feature (954)..(956): n is a, c, g, or t
  misc_feature (958)..(959): n is a, c, g, or t
  misc_feature (961)..(961): n is a, c, g, or t
  misc_feature (964)..(964): n is a, c, g, or t
  misc_feature (967)..(974): n is a, c, g, or t
  misc_feature (976)..(979): n is a, c, g, or t
  misc_feature (981)..(987): n is a, c, g, or t
  misc_feature (989)..(990): n is a, c, g, or t
  misc_feature (992)..(992): n is a, c, g, or t
  misc_feature (994)..(999): n is a, c, g, or t
  misc_feature (1001)..(1006): n is a, c, g, or t
  misc_feature (1008)..(1011): n is a, c, g, or t
  misc_feature (1013)..(1014): n is a, c, g, or t
  misc_feature (1017)..(1018): n is a, c, g, or t
  misc_feature (1020)..(1021): n is a, c, g, or t
  misc_feature (1024)..(1029): n is a, c, g, or t
  misc_feature (1031)..(1035): n is a, c, g, or t
  misc_feature (1037)..(1037): n is a, c, g, or t
  misc_feature (1039)..(1039): n is a, c, g, or t
  misc_feature (1041)..(1041): n is a, c, g, or t
  misc_feature (1043)..(1043): n is a, c, g, or t
  misc_feature (1046)..(1049): n is a, c, g, or t
  misc_feature (1051)..(1056): n is a, c, g, or t
  misc_feature (1058)..(1059): n is a, c, g, or t
  misc_feature (1062)..(1063): n is a, c, g, or t
  misc_feature (1067)..(1068): n is a, c, g, or t
  misc_feature (1073)..(1073): n is a, c, g, or t
  misc_feature (1075)..(1075): n is a, c, g, or t
  misc_feature (1077)..(1078): n is a, c, g, or t
  misc_feature (1080)..(1084): n is a, c, g, or t
  misc_feature (1086)..(1086): n is a, c, g, or t
  misc_feature (1089)..(1089): n is a, c, g, or t
  misc_feature (1092)..(1092): n is a, c, g, or t
  misc_feature (1094)..(1094): n is a, c, g, or t
  misc_feature (1096)..(1100): n is a, c, g, or t
  misc_feature (1103)..(1111): n is a, c, g, or t
  misc_feature (1115)..(1115): n is a, c, g, or t
  misc_feature (1211)..(1211): n is a, c, g, or t
  misc_feature (1218)..(1218): n is a, c, g, or t
  misc_feature (1985)..(1985): n is a, c, g, or t
  misc_feature (1988)..(1988): n is a, c, g, or t
  misc_feature (2168)..(2168): n is a, c, g, or t
  misc_feature (2177)..(2177): n is a, c, g, or t
  misc_feature (2331)..(2331): n is a, c, g, or t
  misc_feature (2549)..(2549): n is a, c, g, or t
  misc_feature (2576)..(2576): n is a, c, g, or t
  misc_feature (2597)..(2597): n is a, c, g, or t
  misc_feature (2636)..(2636): n is a, c, g, or t
  misc_feature (2651)..(2651): n is a, c, g, or t
  misc_feature (2708)..(2708): n is a, c, g, or t
  misc_feature (2888)..(2888): n is a, c, g, or t
  misc_feature (3188)..(3188): n is a, c, g, or t
  misc_feature (3191)..(3191): n is a, c, g, or t
  misc_feature (3198)..(3198): n is a, c, g, or t
  misc_feature (3209)..(3209): n is a, c, g, or t
  misc_feature (3332)..(3332): n is a, c, g, or t
  misc_feature (3365)..(3365): n is a, c, g, or t
  misc_feature (3390)..(3390): n is a, c, g, or t
ttnnnnnngngnnnnnnnnnnnnnctnnnanngannnagnnnnnnannnnnnnnanngnnaannantgnngnnnnttnnnttnnnganannnnnnnnnnnnnnnnngnnnaaanannnnnannannttnaanntnanncnnnaanannnntnnnantnanannaannnnnnngancnnnnnnnaanncantaanannanannnnnnannnannnantnnnnnctctnnnannnnttnnnnnaanannnnnngntnnnnnnntanattnngncnnnnannnnnngnnnnatgnttttanttnnnnnnnnnnnanannagtnnannnattctacannnnnnattntntnttattnnncnnantnncttnntgntnnattntnngnantnnntttnanttnnnngnananannngntnnntnnnnnnntntannnantnnnnnnnntttnnnannnnnnanaaannnatntnnnttnnttnnnnnnttgnanannnntnnnnantnnnnannnntntnnnntnnncntnnttnntnnnnanatagnnnnnnnnntnnnnnntanatnnnannaanntanttcntnnnanancnnnnnnananntcnttnttgtntttnannaannnaanannnnnnnnnnnnnnnnnanncnnanaatnnnnttnnnannaantnaannnnnnnnnnnntnntnaaanngnnanannnaatnnnnaananaatnnnnnnnnnnnnnanattannnantngnnnnntcnnncnnttnnnnntntnnnnntnanaannnnnnaannannnntnnannnntnnnnatnatnctttnnncntnnnnnnntnnagatnnnnnnttaanannnnnaaantnnantnnnnntnnnantnnnttnnnntnnncnngnnannnnntcntnagnnnntnngnnnnnnannnncannnnnnannnnnnncnnnttttnnngnnanctnatnnnnnnnntnnnnannnnnnngnntnannnnnntnnnnnncnnnntnnttnncnnttnnnnnntnnnnncntntnanccnnnnannnnnntnnttnnttcnnttttntntnntnnnnncntcntancnannnnnaannnnnnnnntttngtgctacatacatcgtatgtagcgtaaaaattacatttttgctcttagaatcatgcatgctcacacgcaaagaaacttctctatatgcaccaacangctaacnatctataaacaagaaagagaactttgtttccaaaattctctttccttgtagtggtgattccgttgggattcgaacccaagacccacagcttagaaggctgttgctctaatccaactgagctacggaacccctacatataaaacgtgtgcaaaagtaatcttttctattgagatatgcaaatcttttgaaaagtttttctaactttgcaaacatattagaattaaaaagataacaaaatgcaatactttattattgaaaatggtgcacaagcagggcctttctcaccagaagaacttgtcaacacaaagaatatatctgctgaaactttagtttggactgagggactaaaagattggacgcctgcatggcaaattgaggagataagacaagccttagagaatcgtataaacactcaacagactccgccacctgttcccgaagcaatacaaaataatacaaaggaggaaaagccacaaaatgaaaagaaatgtcataaagcatggtggtttattctcgcgacgatatttgtgattttaattatactgatggttagtaacccaaacaaacaagatcataaagaggctattaaaacagaagttacaacggctatcaataaattggctgataaggacaatgacgaagatgacctcctcacaatgggagttaaaacgctaatgcgcttatttgctggcacaactgttgatgtaacactcgatcagattcttaattatcacaattatcttatttattcttcaacagatgtcacnttngatggagagcaacacaaggtttcttatggtattcttggccatgtattcacattcaacgcagatgatgtggtaaggagttatgaagactatagcaagacaacgaatgaagcttcttcaaccgacaatgaagaacaaacaaccaataatattgatagtttaaagagcaatattgataaaacngtaagcaangaagctggaaaactcgtagataaagttagtaagaaggttgaggataaattaaacaaagagcttgacagcaaacttgatgaggtttctgatagtgcagagaatgttatcgacaaaattatcaaggctttaggactttaatctttcaaatataatnggaaaagaatgattgacagttctgcttttcaaggtaagaaagcaacatattacacactgggttgtaaactcaatttttcagagacatctacctttggcaagatgttatctgatatgggagtagtcactgtagacaagggcgaaaaggctgatatttgtcttatcaatacgtgtagcgtcacagaagtggctgaccataaatgcaggcaggccatccanagaatggcacgtgagaatccaggtgcnttcattattgtgacaggttgntatgcccagcttgaatctgagaaagtaagtaagattccnggtgtagatctcgtnttaggttcaaacgagaaagcaaatctcattcaatatctaaacgaagcctttacaaanagggaaacaggcgaaacacttcatcaattccattctgtaaagacaaaagacatcaagacttttcaagcttcatgctcgaagggtaatcgcactcggtatttcttgaaagtacaagatggatgcaactatttttgcacttattgtactattccctatgcgcgtggattctcaagaaatccnacgatttcatcgctaattaaacaggccgaagaagctgcagctgagggaggtaaagaaattgttttaactggtgtcaacataggtgatttcggagagaccacgcatgaaagatttatagatttagtaaaagccttagacaaggttgaaggcatcaaacgattccgaatcagtagtttggaaccagatttaattgatgacgagttaattgctttttgcgcagaaagtcgggctttcatgcctcatttccacattccattgcaaagtggaagtgataccgttttgaaactgatgcacaggcgntangatacanctttgtttgcncataaaataaaacttattaaagaattgatgcctgatgcctttattggtgtagatgtcatggttggtagtagaggtgaaaaacctgaatacttcgaagaatgttataacttcttagaacaactncccatcacacaattgcatgtcttcccttatagngaacgtccaggaactacagcattancaattccttacgttgtaaatgagaaagataagaaactacgttcaaaacgcttgttagaattaagcgataaaaagacccagctcttttatcagaagtttattggctcagaacgagaagttttgtttgaaaaggcaccacgcggtaaagctatgcatgggtttacagacaactatatccgtgttgaacttccagcatcacttgcaaaggaagagtatgacaacgaacttatacgcgttaagttgggtgacttcaatcacgacaaatccgctcttaaagtagaacttatttagacatgtaagcatgaaacttgcaatagtgattttaaattggaatgggaaaaagatgttagaacaatatctgccaagtgtaatcaaatactcttctaactatgcagatatatttgttgcagataatgcctctacagatgattccataaaaatattggaaagcaaattccctgaaataaaaatcattgcattaaacaagaacttcggttttgcggaaggttataatcaagcattaaaagaaattgaagcagaatactttcttttattaaattcggatgttagggtgaccgaaagttggcttgttccacttatagattatatgg

SEQ ID NO: 1522 - DNA, 4000 bp, Escherichia coli
  misc_feature (2)..(5): n is a, c, g, or t
  misc_feature (7)..(10): n is a, c, g, or t
  misc_feature (13)..(18): n is a, c, g, or t
  misc_feature (20)..(21): n is a, c, g, or t
  misc_feature (23)..(26): n is a, c, g, or t
  misc_feature (29)..(32): n is a, c, g, or t
  misc_feature (34)..(36): n is a, c, g, or t
  misc_feature (38)..(38): n is a, c, g, or t
  misc_feature (40)..(40): n is a, c, g, or t
  misc_feature (42)..(47): n is a, c, g, or t
  misc_feature (50)..(51): n is a, c, g, or t
  misc_feature (54)..(57): n is a, c, g, or t
  misc_feature (59)..(60): n is a, c, g, or t
  misc_feature (62)..(67): n is a, c, g, or t
  misc_feature (70)..(70): n is a, c, g, or t
  misc_feature (72)..(72): n is a, c, g, or t
  misc_feature (74)..(74): n is a, c, g, or t
  misc_feature (77)..(77): n is a, c, g, or t
  misc_feature (79)..(79): n is a, c, g, or t
  misc_feature (82)..(82): n is a, c, g, or t
  misc_feature (86)..(86): n is a, c, g, or t
  misc_feature (88)..(89): n is a, c, g, or t
  misc_feature (91)..(92): n is a, c, g, or t
  misc_feature (94)..(96): n is a, c, g, or t
  misc_feature (98)..(98): n is a, c, g, or t
  misc_feature (100)..(100): n is a, c, g, or t
  misc_feature (104)..(104): n is a, c, g, or t
  misc_feature (106)..(106): n is a, c, g, or t
  misc_feature (109)..(110): n is a, c, g, or t
  misc_feature (112)..(113): n is a, c, g, or t
  misc_feature (115)..(119): n is a, c, g, or t
  misc_feature (121)..(122): n is a, c, g, or t
  misc_feature (124)..(128): n is a, c, g, or t
  misc_feature (130)..(132): n is a, c, g, or t
  misc_feature (134)..(134): n is a, c, g, or t
  misc_feature (136)..(155): n is a, c, g, or t
  misc_feature (157)..(161): n is a, c, g, or t
  misc_feature (163)..(178): n is a, c, g, or t
  misc_feature (180)..(180): n is a, c, g, or t
  misc_feature (182)..(185): n is a, c, g, or t
  misc_feature (187)..(189): n is a, c, g, or t
  misc_feature (191)..(193): n is a, c, g, or t
  misc_feature (195)..(197): n is a, c, g, or t
  misc_feature (199)..(203): n is a, c, g, or t
  misc_feature (206)..(207): n is a, c, g, or t
  misc_feature (209)..(210): n is a, c, g, or t
  misc_feature (212)..(212): n is a, c, g, or t
  misc_feature (214)..(215): n is a, c, g, or t
  misc_feature (218)..(218): n is a, c, g, or t
  misc_feature (221)..(221): n is a, c, g, or t
  misc_feature (223)..(226): n is a, c, g, or t
  misc_feature (229)..(240): n is a, c, g, or t
  misc_feature (242)..(243): n is a, c, g, or t
  misc_feature (245)..(246): n is a, c, g, or t
  misc_feature (248)..(248): n is a, c, g, or t
  misc_feature (250)..(251): n is a, c, g, or t
  misc_feature (254)..(255): n is a, c, g, or t
  misc_feature (257)..(263): n is a, c, g, or t
  misc_feature (266)..(267): n is a, c, g, or t
  misc_feature (270)..(272): n is a, c, g, or t
  misc_feature (274)..(275): n is a, c, g, or t
  misc_feature (277)..(277): n is a, c, g, or t
  misc_feature (279)..(281): n is a, c, g, or t
  misc_feature (284)..(284): n is a, c, g, or t
  misc_feature (286)..(287): n is a, c, g, or t
  misc_feature (289)..(290): n is a, c, g, or t
  misc_feature (293)..(299): n is a, c, g, or t
  misc_feature (305)..(306): n is a, c, g, or t
  misc_feature (308)..(308): n is a, c, g, or t
  misc_feature (310)..(314): n is a, c, g, or t
  misc_feature (318)..(319): n is a, c, g, or t
  misc_feature (322)..(349): n is a, c, g, or t
  misc_feature (352)..(355): n is a, c, g, or t
  misc_feature (357)..(357): n is a, c, g, or t
  misc_feature (360)..(361): n is a, c, g, or t
  misc_feature (363)..(364): n is a, c, g, or t
  misc_feature (366)..(366): n is a, c, g, or t
  misc_feature (372)..(379): n is a, c, g, or t
  misc_feature (381)..(384): n is a, c, g, or t
  misc_feature (386)..(392): n is a, c, g, or t
  misc_feature (396)..(401): n is a, c, g, or t
  misc_feature (404)..(404): n is a, c, g, or t
  misc_feature (406)..(407): n is a, c, g, or t
  misc_feature (409)..(410): n is a, c, g, or t
  misc_feature (413)..(414): n is a, c, g, or t
  misc_feature (417)..(421): n is a, c, g, or t
  misc_feature (423)..(423): n is a, c, g, or t
  misc_feature (426)..(428): n is a, c, g, or t
  misc_feature (431)..(452): n is a, c, g, or t
  misc_feature (455)..(455): n is a, c, g, or t
  misc_feature (457)..(465): n is a, c, g, or t
  misc_feature (467)..(467): n is a, c, g, or t
  misc_feature (472)..(476): n is a, c, g, or t
  misc_feature (479)..(480): n is a, c, g, or t
  misc_feature (482)..(485): n is a, c, g, or t
  misc_feature (487)..(487): n is a, c, g, or t
  misc_feature (491)..(492): n is a, c, g, or t
  misc_feature (494)..(497): n is a, c, g, or t
  misc_feature (500)..(500): n is a, c, g, or t
  misc_feature (503)..(506): n is a, c, g, or t
  misc_feature (508)..(510): n is a, c, g, or t
  misc_feature (512)..(513): n is a, c, g, or t
  misc_feature (515)..(517): n is a, c, g, or t
  misc_feature (520)..(524): n is a, c, g, or t
  misc_feature (526)..(529): n is a, c, g, or t
  misc_feature (531)..(532): n is a, c, g, or t
  misc_feature (534)..(534): n is a, c, g, or t
  misc_feature (536)..(537): n is a, c, g, or t
  misc_feature (539)..(548): n is a, c, g, or t
  misc_feature (551)..(555): n is a, c, g, or t
  misc_feature (557)..(560): n is a, c, g, or t
  misc_feature (562)..(564): n is a, c, g, or t
  misc_feature (567)..(567): n is a, c, g, or t
  misc_feature (569)..(573): n is a, c, g, or t
  misc_feature (575)..(576): n is a, c, g, or t
  misc_feature (578)..(580): n is a, c, g, or t
  misc_feature (582)..(582): n is a, c, g, or t
  misc_feature (584)..(584): n is a, c, g, or t
  misc_feature (586)..(588): n is a, c, g, or t
  misc_feature (590)..(593): n is a, c, g, or t
  misc_feature (595)..(597): n is a, c, g, or t
  misc_feature (603)..(608): n is a, c, g, or t
  misc_feature (610)..(612): n is a, c, g, or t
  misc_feature (614)..(615): n is a, c, g, or t
  misc_feature (617)..(621): n is a, c, g, or t
  misc_feature (624)..(626): n is a, c, g, or t
  misc_feature (631)..(633): n is a, c, g, or t
  misc_feature (635)..(641): n is a, c, g, or t
  misc_feature (643)..(643): n is a, c, g, or t
  misc_feature (645)..(646): n is a, c, g, or t
  misc_feature (648)..(648): n is a, c, g, or t
  misc_feature (651)..(655): n is a, c, g, or t
  misc_feature (657)..(659): n is a, c, g, or t
  misc_feature (661)..(661): n is a, c, g, or t
  misc_feature (664)..(664): n is a, c, g, or t
  misc_feature (667)..(667): n is a, c, g, or t
  misc_feature (669)..(669): n is a, c, g, or t
  misc_feature (673)..(673): n is a, c, g, or t
  misc_feature (675)..(675): n is a, c, g, or t
  misc_feature (681)..(681): n is a, c, g, or t
  misc_feature (690)..(691): n is a, c, g, or t
  misc_feature (696)..(700): n is a, c, g, or t
  misc_feature (703)..(703): n is a, c, g, or t
  misc_feature (707)..(707): n is a, c, g, or t
  misc_feature (709)..(709): n is a, c, g, or t
  misc_feature (711)..(711): n is a, c, g, or t
  misc_feature (715)..(716): n is a, c, g, or t
  misc_feature (718)..(718): n is a, c, g, or t
  misc_feature (721)..(721): n is a, c, g, or t
  misc_feature (725)..(726): n is a, c, g, or t
  misc_feature (728)..(728): n is a, c, g, or t
  misc_feature (731)..(731): n is a, c, g, or t
  misc_feature (734)..(735): n is a, c, g, or t
  misc_feature (737)..(738): n is a, c, g, or t
  misc_feature (740)..(740): n is a, c, g, or t
  misc_feature (743)..(743): n is a, c, g, or t
  misc_feature (745)..(745): n is a, c, g, or t
  misc_feature (747)..(747): n is a, c, g, or t
  misc_feature (756)..(756): n is a, c, g, or t
  misc_feature (761)..(763): n is a, c, g, or t
  misc_feature (765)..(767): n is a, c, g, or t
  misc_feature (770)..(770): n is a, c, g, or t
  misc_feature (772)..(772): n is a, c, g, or t
  misc_feature (774)..(774): n is a, c, g, or t
  misc_feature (778)..(780): n is a, c, g, or t
  misc_feature (783)..(784): n is a, c, g, or t
  misc_feature (791)..(791): n is a, c, g, or t
  misc_feature (794)..(794): n is a, c, g, or t
  misc_feature (796)..(799): n is a, c, g, or t
  misc_feature (801)..(801): n is a, c, g, or t
  misc_feature (808)..(812): n is a, c, g, or t
  misc_feature (814)..(814): n is a, c, g, or t
  misc_feature (818)..(818): n is a, c, g, or t
  misc_feature (826)..(826): n is a, c, g, or t
  misc_feature (832)..(832): n is a, c, g, or t
  misc_feature (834)..(834): n is a, c, g, or t
  misc_feature (836)..(836): n is a, c, g, or t
  misc_feature (838)..(838): n is a, c, g, or t
  misc_feature (841)..(842): n is a, c, g, or t
  misc_feature (844)..(845): n is a, c, g, or t
  misc_feature (848)..(848): n is a, c, g, or t
  misc_feature (854)..(855): n is a, c, g, or t
  misc_feature (859)..(859): n is a, c, g, or t
  misc_feature (867)..(867): n is a, c, g, or t
  misc_feature (869)..(870): n is a, c, g, or t
  misc_feature (874)..(876): n is a, c, g, or t
  misc_feature (878)..(883): n is a, c, g, or t
  misc_feature (885)..(885): n is a, c, g, or t
  misc_feature (887)..(887): n is a, c, g, or t
  misc_feature (893)..(893): n is a, c, g, or t
  misc_feature (898)..(899): n is a, c, g, or t
  misc_feature (901)..(902): n is a, c, g, or t
  misc_feature (904)..(904): n is a, c, g, or t
  misc_feature (910)..(912): n is a, c, g, or t
  misc_feature (915)..(915): n is a, c, g, or t
  misc_feature (917)..(917): n is a, c, g, or t
  misc_feature (921)..(922): n is a, c, g, or t
  misc_feature (924)..(924): n is a, c, g, or t
  misc_feature (928)..(928): n is a, c, g, or t
  misc_feature (930)..(930): n is a, c, g, or t
  misc_feature (935)..(935): n is a, c, g, or t
  misc_feature (938)..(938): n is a, c, g, or t
  misc_feature (941)..(941): n is a, c, g, or t
  misc_feature (943)..(943): n is a, c, g, or t
  misc_feature (952)..(952): n is a, c, g, or t
  misc_feature (954)..(954): n is a, c, g, or t
  misc_feature (957)..(960): n is a, c, g, or t
  misc_feature (964)..(964): n is a, c, g, or t
  misc_feature (966)..(966): n is a, c, g, or t
  misc_feature (968)..(974): n is a, c, g, or t
  misc_feature (976)..(977): n is a, c, g, or t
  misc_feature (986)..(987): n is a, c, g, or t
  misc_feature (990)..(990): n is a, c, g, or t
  misc_feature (993)..(993): n is a, c, g, or t
  misc_feature (995)..(995): n is a, c, g, or t
  misc_feature (997)..(998): n is a, c, g, or t
  misc_feature (1002)..(1003): n is a, c, g, or t
  misc_feature (1010)..(1011): n is a, c, g, or t
  misc_feature (1021)..(1022): n is a, c, g, or t
  misc_feature (1029)..(1029): n is a, c, g, or t
  misc_feature (1031)..(1032): n is a, c, g, or t
  misc_feature (1036)..(1036): n is a, c, g, or t
  misc_feature (1038)..(1038): n is a, c, g, or t
  misc_feature (1043)..(1046): n is a, c, g, or t
  misc_feature (1049)..(1049): n is a, c, g, or t
  misc_feature (1051)..(1052): n is a, c, g, or t
  misc_feature (1057)..(1057): n is a, c, g, or t
  misc_feature (1059)..(1061): n is a, c, g, or t
  misc_feature (1063)..(1064): n is a, c, g, or t
  misc_feature (1067)..(1070): n is a, c, g, or t
  misc_feature (1073)..(1075): n is a, c, g, or t
  misc_feature (1079)..(1079): n is a, c, g, or t
  misc_feature (1084)..(1086): n is a, c, g, or t
  misc_feature (1089)..(1091): n is a, c, g, or t
  misc_feature (1300)..(1300): n is a, c, g, or t
  misc_feature (1987)..(1989): n is a, c, g, or t
  misc_feature (2725)..(2725): n is a, c, g, or t
  misc_feature (2975)..(2978): n is a, c, g, or t
  misc_feature (2981)..(2982): n is a, c, g, or t
  misc_feature (2985)..(2985): n is a, c, g, or t
  misc_feature (2989)..(2990): n is a, c, g, or t
  misc_feature (2993)..(2993): n is a, c, g, or t
  misc_feature (2996)..(2996): n is a, c, g, or t
  misc_feature (3000)..(3000): n is a, c, g, or t
  misc_feature (3003)..(3004): n is a, c, g, or t
  misc_feature (3007)..(3007): n is a, c, g, or t
  misc_feature (3009)..(3018): n is a, c, g, or t
  misc_feature (3020)..(3020): n is a, c, g, or t
  misc_feature (3027)..(3027): n is a, c, g, or t
  misc_feature (3029)..(3030): n is a, c, g, or t
  misc_feature (3033)..(3033): n is a, c, g, or t
  misc_feature (3037)..(3037): n is a, c, g, or t
  misc_feature (3043)..(3043): n is a, c, g, or t
  misc_feature (3047)..(3050): n is a, c, g, or t
  misc_feature (3052)..(3058): n is a, c, g, or t
  misc_feature (3061)..(3062): n is a, c, g, or t
  misc_feature (3064)..(3067): n is a, c, g, or t
  misc_feature (3069)..(3071): n is a, c, g, or t
  misc_feature (3073)..(3076): n is a, c, g, or t
  misc_feature (3078)..(3095): n is a, c, g, or t
  misc_feature (3097)..(3099): n is a, c, g, or t
  misc_feature (3101)..(3107): n is a, c, g, or t
  misc_feature (3109)..(3109): n is a, c, g, or t
  misc_feature (3113)..(3114): n is a, c, g, or t
  misc_feature (3116)..(3116): n is a, c, g, or t
  misc_feature (3118)..(3118): n is a, c, g, or t
  misc_feature (3122)..(3122): n is a, c, g, or t
  misc_feature (3125)..(3125): n is a, c, g, or t
  misc_feature (3127)..(3130): n is a, c, g, or t
  misc_feature (3133)..(3134): n is a, c, g, or t
  misc_feature (3136)..(3137): n is a, c, g, or t
  misc_feature (3139)..(3154): n is a, c, g, or t
  misc_feature (3157)..(3157): n is a, c, g, or t
  misc_feature (3159)..(3159): n is a, c, g, or t
  misc_feature (3161)..(3161): n is a, c, g, or t
  misc_feature (3163)..(3172): n is a, c, g, or t
  misc_feature (3175)..(3176): n is a, c, g, or t
  misc_feature (3178)..(3182): n is a, c, g, or t
  misc_feature (3184)..(3185): n is a, c, g, or t
  misc_feature (3187)..(3191): n is a, c, g, or t
  misc_feature (3194)..(3194): n is a, c, g, or t
  misc_feature (3196)..(3196): n is a, c, g, or t
  misc_feature (3198)..(3203): n is a, c, g, or t
  misc_feature (3206)..(3207): n is a, c, g, or t
  misc_feature (3210)..(3216): n is a, c, g, or t
  misc_feature (3218)..(3220): n is a, c, g, or t
  misc_feature (3225)..(3226): n is a, c, g, or t
  misc_feature (3228)..(3230): n is a, c, g, or t
  misc_feature (3233)..(3238): n is a, c, g, or t
  misc_feature (3241)..(3241): n is a, c, g, or t
  misc_feature (3247)..(3252): n is a, c, g, or t
  misc_feature (3254)..(3255): n is a, c, g, or t
  misc_feature (3257)..(3257): n is a, c, g, or t
  misc_feature (3259)..(3264): n is a, c, g, or t
  misc_feature (3266)..(3270): n is a, c, g, or t
  misc_feature (3273)..(3273): n is a, c, g, or t
  misc_feature (3275)..(3276): n is a, c, g, or t
  misc_feature (3278)..(3280): n is a, c, g, or t
  misc_feature (3282)..(3283): n is a, c, g, or t
  misc_feature (3285)..(3285): n is a, c, g, or t
  misc_feature (3287)..(3287): n is a, c, g, or t
  misc_feature (3290)..(3294): n is a, c, g, or t
  misc_feature (3297)..(3297): n is a, c, g, or t
  misc_feature (3299)..(3301): n is a, c, g, or t
  misc_feature (3304)..(3304): n is a, c, g, or t
  misc_feature (3307)..(3307): n is a, c, g, or t
  misc_feature (3312)..(3315): n is a, c, g, or t
  misc_feature (3318)..(3319): n is a, c, g, or t
  misc_feature (3324)..(3324): n is a, c, g, or t
  misc_feature (3326)..(3330): n is a, c, g, or t
  misc_feature (3332)..(3332): n is a, c, g, or t
  misc_feature (3334)..(3335): n is a, c, g, or t
  misc_feature (3337)..(3339): n is a, c, g, or t
  misc_feature (3341)..(3343): n is a, c, g, or t
  misc_feature (3345)..(3345): n is a, c, g, or t
  misc_feature (3347)..(3347): n is a, c, g, or t
  misc_feature (3350)..(3351): n is a, c, g, or t
  misc_feature (3353)..(3362): n is a, c, g, or t
  misc_feature (3364)..(3364): n is a, c, g, or t
  misc_feature (3366)..(3366): n is a, c, g, or t
  misc_feature (3368)..(3372): n is a, c, g, or t
  misc_feature (3375)..(3378): n is a, c, g, or t
  misc_feature (3380)..(3381): n is a, c, g, or t
  misc_feature (3383)..(3384): n is a, c, g, or t
  misc_feature (3387)..(3396): n is a, c, g, or t
  misc_feature (3399)..(3400): n is a, c, g, or t
  misc_feature (3402)..(3403): n is a, c, g, or t
  misc_feature (3405)..(3405): n is a, c, g, or t
  misc_feature (3407)..(3408): n is a, c, g, or t
  misc_feature (3410)..(3411): n is a, c, g, or t
  misc_feature (3413)..(3413): n is a, c, g, or t
  misc_feature (3415)..(3422): n is a, c, g, or t
  misc_feature (3425)..(3426): n is a, c, g, or t
  misc_feature (3428)..(3432): n is a, c, g, or t
  misc_feature (3434)..(3439): n is a, c, g, or t
  misc_feature (3443)..(3444): n is a, c, g, or t
  misc_feature (3446)..(3452): n is a, c, g, or t
  misc_feature (3454)..(3456): n is a, c, g, or t
  misc_feature (3458)..(3458): n is a, c, g, or t
  misc_feature (3460)..(3461): n is a, c, g, or t
  misc_feature (3465)..(3473): n is a, c, g, or t
  misc_feature (3475)..(3475): n is a, c, g, or t
  misc_feature (3480)..(3481): n is a, c, g, or t
  misc_feature (3483)..(3495): n is a, c, g, or t
  misc_feature (3497)..(3501): n is a, c, g, or t
  misc_feature (3503)..(3503): n is a, c, g, or t
  misc_feature (3505)..(3512): n is a, c, g, or t
  misc_feature (3515)..(3516): n is a, c, g, or t
  misc_feature (3519)..(3520): n is a, c, g, or t
  misc_feature (3522)..(3522): n is a, c, g, or t
  misc_feature (3524)..(3528): n is a, c, g, or t
  misc_feature (3531)..(3531): n is a, c, g, or t
  misc_feature (3533)..(3538): n is a, c, g, or t
  misc_feature (3540)..(3541): n is a, c, g, or t
  misc_feature (3543)..(3546): n is a, c, g, or t
  misc_feature (3548)..(3548): n is a, c, g, or t
  misc_feature (3550)..(3551): n is a, c, g, or t
  misc_feature (3554)..(3556): n is a, c, g, or t
  misc_feature (3558)..(3558): n is a, c, g, or t
  misc_feature (3560)..(3566): n is a, c, g, or t
  misc_feature (3568)..(3573): n is a, c, g, or t
  misc_feature (3575)..(3576): n is a, c, g, or t
  misc_feature (3579)..(3581): n is a, c, g, or t
  misc_feature (3583)..(3584): n is a, c, g, or t
  misc_feature (3587)..(3589): n is a, c, g, or t
  misc_feature (3593)..(3599): n is a, c, g, or t
  misc_feature (3601)..(3604): n is a, c, g, or t
  misc_feature (3606)..(3608): n is a, c, g, or t
  misc_feature (3610)..(3611): n is a, c, g, or t
  misc_feature (3613)..(3613): n is a, c, g, or t
  misc_feature (3617)..(3617): n is a, c, g, or t
  misc_feature (3621)..(3622): n is a, c, g, or t
  misc_feature (3624)..(3624): n is a, c, g, or t
  misc_feature (3627)..(3627): n is a, c, g, or t
  misc_feature (3631)..(3631): n is a, c, g, or t
  misc_feature (3636)..(3636): n is a, c, g, or t
  misc_feature (3643)..(3650): n is a, c, g, or t
  misc_feature (3652)..(3660): n is a, c, g, or t
  misc_feature (3662)..(3664): n is a, c, g, or t
  misc_feature (3666)..(3667): n is a, c, g, or t
  misc_feature (3669)..(3674): n is a, c, g, or t
  misc_feature (3676)..(3677): n is a, c, g, or t
  misc_feature (3679)..(3682): n is a, c, g, or t
  misc_feature (3684)..(3685): n is a, c, g, or t
  misc_feature (3687)..(3694): n is a, c, g, or t
  misc_feature (3696)..(3704): n is a, c, g, or t
  misc_feature (3706)..(3707): n is a, c, g, or t
  misc_feature (3709)..(3710): n is a, c, g, or t
  misc_feature (3712)..(3716): n is a, c, g, or t
  misc_feature (3719)..(3721): n is a, c, g, or t
  misc_feature (3723)..(3730): n is a, c, g, or t
  misc_feature (3732)..(3739): n is a, c, g, or t
  misc_feature (3742)..(3742): n is a, c, g, or t
  misc_feature (3745)..(3745): n is a, c, g, or t
  misc_feature (3749)..(3749): n is a, c, g, or t
  misc_feature (3751)..(3753): n is a, c, g, or t
  misc_feature (3755)..(3773): n is a, c, g, or t
  misc_feature (3775)..(3781): n is a, c, g, or t
  misc_feature (3783)..(3783): n is a, c, g, or t
  misc_feature (3785)..(3789): n is a, c, g, or t
  misc_feature (3791)..(3792): n is a, c, g, or t
  misc_feature (3796)..(3803): n is a, c, g, or t
  misc_feature (3806)..(3806): n is a, c, g, or t
  misc_feature (3808)..(3809): n is a, c, g, or t
  misc_feature (3811)..(3811): n is a, c, g, or t
  misc_feature (3813)..(3813): n is a, c, g, or t
  misc_feature (3815)..(3815): n is a, c, g, or t
  misc_feature (3818)..(3819): n is a, c, g, or t
  misc_feature (3823)..(3825): n is a, c, g, or t
  misc_feature (3827)..(3827): n is a, c, g, or t
  misc_feature (3829)..(3840): n is a, c, g, or t
  misc_feature (3842)..(3843): n is a, c, g, or t
  misc_feature (3845)..(3847): n is a, c, g, or t
  misc_feature (3849)..(3856): n is a, c, g, or t
  misc_feature (3858)..(3859): n is a, c, g, or t
  misc_feature (3861)..(3866): n is a, c, g, or t
  misc_feature (3868)..(3871): n is a, c, g, or t
  misc_feature (3875)..(3877): n is a, c, g, or t
  misc_feature (3880)..(3880): n is a, c, g, or t
  misc_feature (3883)..(3884): n is a, c, g, or t
  misc_feature (3886)..(3888): n is a, c, g, or t
  misc_feature (3894)..(3894): n is a, c, g, or t
  misc_feature (3896)..(3896): n is a, c, g, or t
  misc_feature (3899)..(3901): n is a, c, g, or t
  misc_feature (3905)..(3906): n is a, c, g, or t
  misc_feature (3908)..(3909): n is a, c, g, or t
  misc_feature (3911)..(3912): n is a, c, g, or t
  misc_feature (3914)..(3921): n is a, c, g, or t
  misc_feature (3923)..(3925): n is a, c, g, or t
  misc_feature (3927)..(3933): n is a, c, g, or t
  misc_feature (3936)..(3940): n is a, c, g, or t
  misc_feature (3943)..(3943): n is a, c, g, or t
  misc_feature (3945)..(3946): n is a, c, g, or t
  misc_feature (3948)..(3950): n is a, c, g, or t
  misc_feature (3953)..(3953): n is a, c, g, or t
  misc_feature (3955)..(3957): n is a, c, g, or t
  misc_feature (3959)..(3963): n is a, c, g, or t
  misc_feature (3965)..(3965): n is a, c, g, or t
  misc_feature (3967)..(3976): n is a, c, g, or t
  misc_feature (3978)..(3978): n is a, c, g, or t
  misc_feature (3984)..(3987): n is a, c, g, or t
  misc_feature (3989)..(3990): n is a, c, g, or t
  misc_feature (3994)..(3994): n is a, c, g, or t
  misc_feature (3997)..(4000): n is a, c, g, or t
gnnnncnnnncgnnnnnngnngnnnncgnnnncnnngngngnnnnnncgnnggnnnngnngnnnnnngcncngnggngntcnccgngnncnncnnncngncgtncnccnngnncnnnnngnngnnnnngnnnangnnnnnnnnnnnnnnnnnnnngnnnnngnnnnnnnnnnnnnnnncngnnnncnnngnnncnnngnnnnngcnncnngncnncgncgncnnnngcnnnnnnnnnnnncnncnngncnncgnngnnnnnnncgnnggnnncnncncnnncgncnncnncgnnnnnnncgacgnngncnnnnncgannccnnnnnnnnnnnnnnnnnnnnnnnnnnnnccnnnncntcnncnncntcgtcnnnnnnnntnnnncnnnnnnnggtnnnnnncgngnngnnggnngtnnnnntngtnnnggnnnnnnnnnnnnnnnnnnnnnncgncnnnnnnnnngncgtcnnnnncgnngnnnngnacgnngnnnncgnggnnnngnnngnngnnncgnnnnncnnnncnncngnngnnnnnnnnnncgnnnnncnnnncnnngancnnnnngnngnnnancncnnncnnnngnnngaagannnnnngnnngnngnnnnngannnggagnnngnnnnnnngnannanaannnnnannntnacnaananaacnancaaaanaaccaaaannaccannnnnccnccgngntntccnncnttnttcnngnccncgnncnngngtncnangcgggggtntgggnnnannnacngngngagnnnganncgacgangangnnnntnctcttcnnnnntncgtncccgctgntggtgncngngnacnncnnggnggaggnngagnacgacgangnngcgnnngnnnnnntntncccggnggggnncnncnactgcnnnaanangagnngncaanangaggnggnggngnggctgtggnantcnnnnatcnancnnnnnnnanngctgcacgnncgngancncnncttnngccgcgnngactacttannagagggngnngggnanggggnnnncgngnnggggnannncnncgnnnngcnnngccncgccnnnaannnttagcgactttagcttgatatagacaggacctggaccttacaaaggtattcacagctacgctcgttggcgtaaaggtatgtagtatcacgatcattccgccgcgggctcgggcgcggcgtcgccggcgccctcgtctccctcgtctccctcgtcgccgagaaccgggggctcaacctcggggggaaaacccgcggcttgctcctcctgnagcgccctcaccgccatctcgagctccttgatctcctcgaggtacttcttcttacctctcagcacgttgagctgctcgagcatctccttggggaccgggagatcctcggacgcgacctcgtccgcctccgtcgcgggctcgacgccgtcatccgcgggggcggccggggcatccccggtcgctccatccgccgccccatccgccgggccctctccgttcgcggcagcctcctccgcgaggaccctgtccgcgatcgcctgcgcgtcttcctcgtccgtcgtcttcccttccagccggttcatgtagccggtcaggttggcgaggttggcggtgagggacgtcatgttatcccactccgccttgggcttcatcccctccatcatggcgacggcgtcttggagctgatcgtcggaggggttggagagcatcaacttcatgagcttatcctgcatgccggacggtccgttcccggcgttgacgtcgtcgttaccggagcccttcgaggcgcccggacggccctccatctgctccacggtgtcctgctcgatgtgatccacgagtttcagcacgacggaatccagcgcgtcgccgctcttcttgaccatctcgagcgacgccgcgatgaggttggcgagctgcgagacacgcgaggtcctcgcctcgcggacagcctcggcggctaccttnnncgcgaggacctcgcgcttgtgctgcgcgatggccgcctccgccatctgcttgtccagctccccgagcttgtcttcgtaatccttgcggagggaatccttgtggccgtgcatggcggcgactttggccgcgaggtcgccgttgcggccgacgtcgaagcccttgagctcgccgtcggcggggtcatcgtcgccggggggctcgccgggctgagcggcggcggcggcggcggcggcgtcgtcatccgcggcggtggcggcgactgcgggtgggtcatccggggattcctgtcgatccccgacgttggctccgatctcgttggagaccttcatggacgccatcttggcctggaccttgccgggcgggatggccaccatcatggagtcggacacctggaggccgggggcggccttcggggcgggcgggggcggcggcgggggattgaggagcgccctctgcttcgcctccctctcggcgagctcgagctcgcgctccttgatcttgagcgcgcgctcagcctgctggttggcgatgcgctccctgcgctccgcgaggtcgagctcgagcatcgcgagcttgagctgctccttcttcatctccagctcccgcgcagcctggctcgcgaatccccccagcgcgtcgggattcatctccgagacattgttccgcgccggcggtgggggcgagggcgggggcatgagcaccgcgctgtcgatgccgccgccgggcaggacctcngccccggacatggcgtcttgtgcgagactctggcttcaagcgacgcggtgtttggggacgccgtacgggggtgtgacctcgtacgcgccttcacgattgggcgacgaaccgcgtcggggatgaaaaacgctttcgtgacacgcttcctaaatcgggggtacgagcgttgacttgactaatgtgtgaccatttagtgagaagtatttattttgtccgaattagcgaaatatcaaaggcaaatggaatgttnnnnaannttntttnnacnttnaaanagnnagnannnnnnnnnncncggcgcngnntcncggngcgccngtgnnnncnnnnnnngcnncnnnntnnncnnnnannnnnnnnnnnnnnnnnncnnncnnnnnnncnccgnncntncccngcncnnnnccnngnncnnnnnnnnnnnnnnnnagngncncnnnnnnnnnnccnntnnnnncnngnnnnnacncnannnnnnacnnaannnnnnntnnncatanntnnncannnnnnaanaactcnnnnnnanncncnnnnnnannnnnagngnnannnanngncncgnnnnngcncnnntcntcncccgnnnncgnntgggnannnnngntnngnnncnnntngntcnngnnnnnnnnnncnanannnnncgnnnngnnanngcnnnnnnnnnnccnngnngntnncnncngnnnnnnnncgnncnnnnntnnnnnntcgnngnnnnnnnannncntnntaannnnnnnnnanaaaanngnnnnnnnnnnnnnannnnncnannnnnnnnaannatnnanannnnntcncnnnnnntnngnnnncncnngtnnncncnnnnnnncnnnnnncnncgnnncnncgnnncgcnnnnnnncnnnncnnncnntngcgncccnncncgncccnccccnccccggnnnnnnnngnnnnnnnnncnnncnngnnnnnncnngnnnnanncnnnnnnnncnnnnnnnnncnngnngnnnnncgnnnannnnnnnnannnnnnnncanacncgcncnnncnnnnnnnnnnnnnnnnnnncnnnnnnncncnnnnncnncgcnnnnnnnncgngnntncncncgnntatnnncncnnnnnnnnnnnncnngnnncnnnnnnnngnntnnnnnngnnnngcgnnngtntcnnannntttctnanaannntttnnanngnntnnnnnnnngnnnannnnnnntgnnnnnaananncnnnctnannncnnnnncncnnnnnnnnnnanaaagannnnannaaantcnnnn

SEQ ID NO: 1523 - DNA, 4000 bp, Escherichia coli
  misc_feature (325)..(325): n is a, c, g, or t
  misc_feature (372)..(372): n is a, c, g, or t
  misc_feature (623)..(623): n is a, c, g, or t
  misc_feature (626)..(626): n is a, c, g, or t
  misc_feature (692)..(692): n is a, c, g, or t
  misc_feature (708)..(708): n is a, c, g, or t
  misc_feature (765)..(765): n is a, c, g, or t
  misc_feature (775)..(775): n is a, c, g, or t
  misc_feature (931)..(931): n is a, c, g, or t
  misc_feature (1014)..(1014): n is a, c, g, or t
  misc_feature (1992)..(1992): n is a, c, g, or t
  misc_feature (2438)..(2438): n is a, c, g, or t
  misc_feature (2565)..(2566): n is a, c, g, or t
  misc_feature (2987)..(2987): n is a, c, g, or t
  misc_feature (3199)..(3199): n is a, c, g, or t
  misc_feature (3227)..(3227): n is a, c, g, or t
  misc_feature (3727)..(3727): n is a, c, g, or t
  misc_feature (3830)..(3830): n is a, c, g, or t
  misc_feature (3912)..(3912): n is a, c, g, or t
  misc_feature (3928)..(3928): n is a, c, g, or t
gaactgggaggagagctggctcatcacaatcagccgatctgaaagctcagcaatctgttccatgaccatcaactggtttgggtcgggctcgcggaggaccgtatgcaaggtggtcacgacgggcattttcagcccgcgcaacagatgcaaaatgtggcttccggcagggccgccaaagattccgtactcgtgctgcaggcagaccatgtcgatattgttgaagttcaggaaccgagcggcgtcttcgtacgacgcgacctcgttctggtcaagcgaccatcggacccgtgcgggatagtcatagccttgttctatgtcgtttacnggcagcgccaacaatcgagccgttccgtactccgcggcgatcgcgcnacaaaggtccgttgtgaacgtcgcaattccacactggcgcggcagatagttcccaatcacagcaattcggctcggcagggatggcttcggctgtagtctcaggcgagaatccaatcctccagcctgaaccagtggaagcgggtcgacgattttgagcggtgcccgggaaagcccggtgtttgcgagtgacatgagccccggattcgctggagatggagcgggtgaggtttcaggtgtgctcgatgccaatntgntgcgtagggcactaagttcggttgagcgcatccaagttgtacggacgattcgtgttttttctagtnttcaacgaaagggggntcgggaactggtcaaaattgaccacatgcgccttcggagcttcggtgctggcggctnacgtaaaacngaatacgcggaggtatgcctcgtgaagctaccaggggtgaaaccttgtgccccaaggctcccgggcgtacagtagggcggattcaacattgaaaccaaggtctcggattgatgcgatcgggcagaactgattccagggcgaagcttctcttcctcnctgttttgttggtttcgatagtccgtctcgtattggctcgacaggacaatgagaccaagccggaatcctggtccggcgtcctngtgtctagcgcctgcaacgcggacgaagcctttaacgaatctcccgagtgcaccaggaacgtccccggtgcgaagatcgcgctgtatgacgacacgaaccgggtcatctacggcatcgacgcgcaggaaaaagtaatcgcgcgcctgggcgacacggtcacagtccggggaacacttcatggcgataccattcagatggcttctatcgagttgatgtcgattggcctcgcggtgggcgagaaggcgccggccttttccgttcgcgaccagtttggccggacgcagagtctcgctgccttgaaaggcgccaacggcaccgttcttctctttttccggtccgccgactggtgacctttctgcaaagggcagctggtgcagctgcaaagtgcaattccgcgatttgagaaacaaggcgtcaagttggcagcgatcagctacgactccgaagaaatcctaaagttttttgctgagcggcacaaaatcgaattccctctgctcggcgaccccgactcgaagatcatcaaggcctacggcgtcttcaacgcggaagcgaccgggatgcagaaaggcttcgcgcgccccggctatttcttcatcgatgccaagggcacgattcgagaaaagttcttcgaggcgaaataccgcgagcggcttacgggaaatagtttgcttgcgaagctgtttccggaattgggccaggaggtcacagaaacgatcgaagccccgcaccttcaactggcgcttgagcaatccgatcacaccggtgttcccgggacacgcgttacgctggccgccgaagtgcgcctacccgtggacgtgcacgtgtatgcccctggcgctcagggctataagccgatcaagctcgtgattgacccgatgcccgaaatggagatgaagccggccctgtatccgctgtctaaaacccttttcttgccggtaatcaaccagcgcgttccggtgttcgacgggacgtttcgnatcagccaggatgtgagagtaagctccgggatggacttcgccgcctcgctcggaaaggatggaaaaacctttacgatcgcaggcaagctggagtaccaggcgtgcgaccagaccaagtgctacctgcccacgtcagttccggtgaaatggcaactgcaagtgtttcccctcgatcggacccgcgccccagtcgacgttcgacacaaatagccaggcgacttggaaatctggaacgtatttggaaccttaccccgatgaattcgtcgatggcaaaggccgtcgggcgcacatttgccgaacgtccacaatcgccaggccgtcagggacggtgatacgagctggcttgctgagaaacgcaactgaactatgctgatttcagtggaaactggatctcgagcatctgctcaaggtaaatctcacgtttcggacccgcgagctgatgatcngtgacattcatccattttcggatggcctcataaccccgctcggcgctctcgtcatccaacctggagtaggcacaggcgacggtggccgcgggaagctgcttcaggtcgtaaaaactccgaaacggtnnctggtgcttcagcgccacaaagggctcgccttccagcgaacccgagtccgcgcaactatgccagagaacgccccgggggctgccgatggattggggcgggagggcagccagcaactcctgctcgaactgcagaatgtccgcatagctccgcactttcgcgcgaacggacgcgataggagtggccggacgacgcttcaccaccacggcaatcgggtgtttcgaatcatccgtctcttccagcgccgcgtcgatgcatttcaaagattgcgtggccgtctggattgaccgctgaattgtccgtttgagtttggtgaggacgtctcggcgatgctcactagatcccactttatggatcagatcgcgggcatcggcgagcgatactcccagacttttgagggcgaggatcgcggccaactcttcnagttgctgcggacgatagttccggtaaccggtgcgagcgtccacgctggcgggccgcaataggccaatctggtcgtaaaagcggagcgtcttcgtggaaacaccgctcaaattcgagaactcaccgatgcggtactgcacgtccatgaaaatctctttccttggcaaggttgtttagaaacccgatgtcatttgcgtgggatcgcatcgcanccatatttagcttgatccttcccctgtnctggaatgttttactcgtaccgaggaggaaggctatgaactttctaccaaaaccagttggcttgcttctgatctctttgtttccgttcggcctcctacgacctgcaggggcacaaacacgggcgaaaccgggaacagaagaagaccctagggcagccatcgagggttacttcgccgcacatgctctaggcaacggcgagtttatcacgcagaccttcacgctcgacgccaaaatccaattcgtcgaaggcggtgaatcaaaggtgtggacacgcgacgagtttgcaaaacggttcttgcaacctgcgacggacgaataccggagggtgcgtcgcgtcgagaggctggatgttagcggcacggcggccagcgccgtggttacgctggactaccctcaggtactgttcaccgatcacatgtcgctgttgaagatcggcgggcggtggaagactgtgagcaaggtattttcagccgatcgaagggacgccgggcaagaagccntcaaggagacgctgcgggactggactcttccgtttgaaccaagaagaattgccggcaacatctattatgtgggcagcaacctgatcagctcattcctgattgngacccctgcaggaaacattctgctggatacaggccccattcaaatgctgccgcaagtgacagccaacatcgagaaacttggntttagaacgcgagacntgaagctcttgctgaacagccacgcacattttgaccactgtgggggcttcgcagagatgaaacgccgcacgg

SEQ ID NO: 1524 - DNA, 4000 bp, Escherichia coli
  misc_feature (1986)..(1986): n is a, c, g, or t
gtgtgggcggccttgcgggcggtcggatagagcgggttgaaatcgagacaggtgcgatgcgccacttcgaccgccacaaactgaaactcggcctgttcgggctgaactgttctggcgggctgtcggcgacgctggcgccggaacggtgggaagggacgtgggaggaaaaccttgccgccgccgggctggcggatcgcgcggggctcgatttcctgctgccgctggggcgctggaagggctatggcggcgagaccgatcacaacggcggcagcctcgagacgctgacctgggccgccggcattctagcggcgaccgagagcatcatggcgttcggcaccgtccatgtgccgctgttcaatcccgtcgtcgcggccaagcagatggtgaccgccgacctgatcggcggtgggcggttcgggctcaacatcgtgtgcggctggaacacggatgaattcgccatggcgggggtggagatgaacgcccatgaagcgcgctacgaacagggccaggaatgggtcgatatcgtcacgcgcgcatggacgtccgacgaagcgttcgattacgccggcgagcattattcggtgacaggcgcgctgttgaagccgaaaccggcttcggcggagcggccgatgatcgtcagcgccggcaattccgaccgggggcgggaattcgcggcgcgcaattccgacatgatgtttaccgggatccgcaccgtggaggacgagatcagcgacgatatcgcgtcgctgaaagcgctcgccgccggtcatggccgcgacatcgggatgttcaccaactgctacgtcgtctgccgcccgaccgcgaaggaggccgaggagtatcatcattactacgcggtcgagatggcggaccagggcgcggtggatgcgctggtcgcccgccgcgcccggcggggccggttcgacgatctgccggaagaaatgaaacgcaacctgcgccagcgcgccggcggcggcaacggcgcctatcccatcgtcggcgacccggatcaggtggccgcgcagttcctacgcctgcacgaagccggaattgacgccttcgcgatggggttcgcgaactacgtcgatcatttgccgtatttcagggacgaggtattgccgaggctggcggaagcgggggtgcgctagacgttctttctgcggcgcagatacacaagcccgcccattccgagacccaacaacgcaatcgcgcctggttcggggacgaccggggcatccaccagcacgatcgacgtcgtgaagttgaagttcgagcccgtggtctggcgttccgcatggaagatgtcgaggtcgtaggtctcgccgatggtcatgccaaggaacgcggccgtgcccgcattcagcgtgatgctgtcggatgccggtccgtgaacgccgcccaggtcaatagccaggatgccgttgatgaacacccacacgtcgtcgtcgccggtgaaggaaaacgtctcgtcgcccacgaaggtgaattcggtgttgatctctgtggtgaagtggaaattgccggcgcctgcggggaaatacgacccgttgatgtattcgtacaggcccgaccccgggctcgtttccgtcgcggtcagcgtcgtggtgaacgtggtgttgacgccgggggtgtcattgtaccactggttgaagttcgcggtgccgttcgtcgtcgtcgacgcggcgcccgtgatgcctttcacagcttcattatagaccggtttgccgtccgggcccaatgcgctgagcacgatacccgtctccgaagcggcgaagccctgctcgaaatcggcatgactgctcgaaaaatcgcggatcgtcgcagtgacggtgatgctggcggcgctggcggcttcggcctgcagaaacagggctgcgacgccgatgacggcgacccggctgaatgatttgggatcaaagcggggaaacttgagggcgaccgacatatttactctcctaccgaacaaaatggccttgtccgaaatanagcaattttcgtgccagaatatttttgcccataatatcagtatcttagtgggccagcggcgatgtttttgactgaagttgtcaaattttccgacagtcgccgaggcgcccggctcccgccctgaaggtgacggtcaggcggtcgcttcgccctcgaccgtggtccggtacagatgccggatgtcgggataggtgtatccgccggtcgcgcggtgattgacgcagcggttgtcccacatcaccacgtcgccgtcttcccatgtgtgtctgtacctgaactccgtcttgacggaatgcgcgatcagttcgtccagcagggcgtcggcttcgtcttcgtccagcccctcgccttttatcgcgatggtgaaacggggcgagcaatagagacttttgcgccccgtgaccggatgcacccgcacaagcggatgttcgacatccgggatctcccgttcctggcgtttgtagaattcgaccgcgtcttcccgcgcgcctgatatttccacccgcttgttcttcagcttgctgatggaatgaaccccgcgcaggcccgcgatttgggctttcatatcgtcggacagcgcgtcgtaggcggcgtacatgttggcgaaatccgtgtgcccgccctgcgacggatttttcagggaatggaggatcgtacagttcgccgggtgggtcttgaagctgtggtcgctgtgccaggcgtcgcccgcgtcgatgacgccgatctgattgccgtcttcgtccacgtcgttggacaggacgaggatcttgggctgttccttcagtgtgaatttgagattgtcgtgcggatacaccacaccgaagcgttccgaaaacgacaccatcgcatgcggttccagtttctggtcgcggaagcacagcatctgatgttccagataggcatcgttgatcagaccgaaggtggcgtcgtccagccggttcaggtcgacgccgataacctcggcgcccatcgcggcgctgagccggttgatttcaatggtatcgggcatcgtcacgcggtttcgcgcagccccgccgcttccgcctgttcgtcggcgatcagtccgtccatcaggcggcgcacctgaatgttgggcgcatcgccgttgatgtcgatctccggcgcgtccggcatggccgacatgcgtttctgctgctcgttcaggatgatctggtcttcctcgaacacctgggtgaactgggtgcggtaaatctcgtcccattcgggatcatccaccttgaagtgcctggcatgcgcatagaagtaatgcgtcgaggtttcggtttccggcgtcggcaggttcatgaccttcatctcgacgccgatatcctccgtcacttcgcccggctgggcgttgaggccgacctggtacgttcccgcatggttgacgatgtaacccggcatgtccgacgtcgtgaccaggaagcggtcgacattgccttcgaacccgccggctttcttgtagaacggcgccgggggccggtcggtgaccaggcgggtcatcttcacgccgcgctcgaagcgttcggtcttcggcgggaaatccacgatcgcgtcgttgccgatcgacgtgacatggacgtaggacagatgcgtgatgtcgaacagattgtcggatatcagcaggtaattcgcttccaccggcatgggcgtgccgccccggcccgggatcgttttccattccggactgtcgagccaccaccagtcgggcagcagatccgcatcggccttggcgggatcgcccgtccatatccagaccatgccccagcgttcgatcaccgggtaggaccgcaccgcggcgcccggcggaatcttcgactggcccggcaccttcacgcaatcgcccgccgcatcgaattccagcccgtgatagccgcactggatgttgtcgccgacaaccttgcccatcgacaggggcagcgcccggtggcagcagcggtcttccagcgccacgatgccgtccggggtgcgaaatatgacgacgggcttgttcaggatggtgcgcgaaaacggg

SEQ ID NO: 1525 - DNA, 4000 bp, Escherichia coli
  misc_feature (61)..(62): n is a, c, g, or t
  misc_feature (65)..(67): n is a, c, g, or t
  misc_feature (70)..(71): n is a, c, g, or t
  misc_feature (73)..(75): n is a, c, g, or t
  misc_feature (77)..(77): n is a, c, g, or t
  misc_feature (83)..(86): n is a, c, g, or t
  misc_feature (89)..(89): n is a, c, g, or t
  misc_feature (96)..(96): n is a, c, g, or t
  misc_feature (98)..(100): n is a, c, g, or t
  misc_feature (103)..(104): n is a, c, g, or t
  misc_feature (110)..(110): n is a, c, g, or t
  misc_feature (112)..(112): n is a, c, g, or t
  misc_feature (116)..(116): n is a, c, g, or t
  misc_feature (118)..(120): n is a, c, g, or t
  misc_feature (122)..(122): n is a, c, g, or t
  misc_feature (125)..(127): n is a, c, g, or t
  misc_feature (132)..(132): n is a, c, g, or t
  misc_feature (135)..(135): n is a, c, g, or t
  misc_feature (138)..(139): n is a, c, g, or t
  misc_feature (141)..(141): n is a, c, g, or t
  misc_feature (152)..(153): n is a, c, g, or t
  misc_feature (155)..(157): n is a, c, g, or t
  misc_feature (165)..(165): n is a, c, g, or t
  misc_feature (172)..(172): n is a, c, g, or t
  misc_feature (177)..(178): n is a, c, g, or t
  misc_feature (180)..(180): n is a, c, g, or t
  misc_feature (189)..(190): n is a, c, g, or t
  misc_feature (192)..(193): n is a, c, g, or t
  misc_feature (195)..(196): n is a, c, g, or t
  misc_feature (198)..(199): n is a, c, g, or t
  misc_feature (201)..(201): n is a, c, g, or t
  misc_feature (203)..(203): n is a, c, g, or t
  misc_feature (206)..(206): n is a, c, g, or t
  misc_feature (215)..(218): n is a, c, g, or t
  misc_feature (222)..(226): n is a, c, g, or t
  misc_feature (229)..(229): n is a, c, g, or t
  misc_feature (234)..(234): n is a, c, g, or t
  misc_feature (236)..(236): n is a, c, g, or t
  misc_feature (238)..(238): n is a, c, g, or t
  misc_feature (240)..(240): n is a, c, g, or t
  misc_feature (243)..(243): n is a, c, g, or t
  misc_feature (248)..(248): n is a, c, g, or t
  misc_feature (250)..(250): n is a, c, g, or t
  misc_feature (254)..(254): n is a, c, g, or t
  misc_feature (257)..(258): n is a, c, g, or t
  misc_feature (260)..(260): n is a, c, g, or t
  misc_feature (264)..(265): n is a, c, g, or t
  misc_feature (267)..(267): n is a, c, g, or t
  misc_feature (272)..(272): n is a, c, g, or t
  misc_feature (274)..(274): n is a, c, g, or t
  misc_feature (277)..(277): n is a, c, g, or t
  misc_feature (280)..(281): n is a, c, g, or t
  misc_feature (285)..(285): n is a, c, g, or t
  misc_feature (295)..(295): n is a, c, g, or t
  misc_feature (297)..(297): n is a, c, g, or t
  misc_feature (300)..(300): n is a, c, g, or t
  misc_feature (306)..(306): n is a, c, g, or t
  misc_feature (308)..(308): n is a, c, g, or t
  misc_feature (311)..(312): n is a, c, g, or t
  misc_feature (315)..(315): n is a, c, g, or t
  misc_feature (320)..(322): n is a, c, g, or t
  misc_feature (328)..(331): n is a, c, g, or t
  misc_feature (334)..(335): n is a, c, g, or t
  misc_feature (338)..(338): n is a, c, g, or t
  misc_feature (341)..(342): n is a, c, g, or t
  misc_feature (346)..(347): n is a, c, g, or t
  misc_feature (354)..(354): n is a, c, g, or t
  misc_feature (356)..(356): n is a, c, g, or t
  misc_feature (360)..(362): n is a, c, g, or t
  misc_feature (364)..(366): n is a, c, g, or t
  misc_feature (369)..(369): n is a, c, g, or t
  misc_feature (371)..(374): n is a, c, g, or t
  misc_feature (376)..(376): n is a, c, g, or t
  misc_feature (378)..(379): n is a, c, g, or t
  misc_feature (383)..(383): n is a, c, g, or t
  misc_feature (385)..(386): n is a, c, g, or t
  misc_feature (389)..(389): n is a, c, g, or t
  misc_feature (391)..(391): n is a, c, g, or t
  misc_feature (395)..(397): n is a, c, g, or t
  misc_feature (401)..(401): n is a, c, g, or t
  misc_feature (403)..(403): n is a, c, g, or t
  misc_feature (405)..(406): n is a, c, g, or t
  misc_feature (409)..(409): n is a, c, g, or t
  misc_feature (413)..(413): n is a, c, g, or t
  misc_feature (423)..(425): n is a, c, g, or t
  misc_feature (427)..(428): n is a, c, g, or t
  misc_feature (433)..(433): n is a, c, g, or t
  misc_feature (435)..(436): n is a, c, g, or t
  misc_feature (438)..(439): n is a, c, g, or t
  misc_feature (444)..(447): n is a, c, g, or t
  misc_feature (451)..(452): n is a, c, g, or t
  misc_feature (454)..(455): n is a, c, g, or t
  misc_feature (457)..(463): n is a, c, g, or t
  misc_feature (465)..(465): n is a, c, g, or t
  misc_feature (468)..(471): n is a, c, g, or t
  misc_feature (473)..(473): n is a, c, g, or t
  misc_feature (476)..(478): n is a, c, g, or t
  misc_feature (480)..(481): n is a, c, g, or t
  misc_feature (485)..(485): n is a, c, g, or t
  misc_feature (489)..(489): n is a, c, g, or t
  misc_feature (493)..(495): n is a, c, g, or t
  misc_feature (497)..(497): n is a, c, g, or t
  misc_feature (499)..(501): n is a, c, g, or t
  misc_feature (503)..(503): n is a, c, g, or t
  misc_feature (511)..(511): n is a, c, g, or t
  misc_feature (513)..(513): n is a, c, g, or t
  misc_feature (515)..(516): n is a, c, g, or t
  misc_feature (518)..(518): n is a, c, g, or t
  misc_feature (522)..(523): n is a, c, g, or t
  misc_feature (526)..(527): n is a, c, g, or t
  misc_feature (531)..(533): n is a, c, g, or t
  misc_feature (535)..(535): n is a, c, g, or t
  misc_feature (537)..(541): n is a, c, g, or t
  misc_feature (546)..(548): n is a, c, g, or t
  misc_feature (553)..(553): n is a, c, g, or t
  misc_feature (557)..(557): n is a, c, g, or t
  misc_feature (562)..(563): n is a, c, g, or t
  misc_feature (567)..(569): n is a, c, g, or t
  misc_feature (571)..(571): n is a, c, g, or t
  misc_feature (579)..(579): n is a, c, g, or t
  misc_feature (584)..(585): n is a, c, g, or t
  misc_feature (588)..(588): n is a, c, g, or t
  misc_feature (590)..(590): n is a, c, g, or t
  misc_feature (592)..(593): n is a, c, g, or t
  misc_feature (597)..(598): n is a, c, g, or t
  misc_feature (600)..(603): n is a, c, g, or t
  misc_feature (606)..(606): n is a, c, g, or t
  misc_feature (608)..(608): n is a, c, g, or t
  misc_feature (610)..(610): n is a, c, g, or t
  misc_feature (614)..(614): n is a, c, g, or t
  misc_feature (618)..(618): n is a, c, g, or t
  misc_feature (621)..(621): n is a, c, g, or t
  misc_feature (623)..(625): n is a, c, g, or t
  misc_feature (630)..(630): n is a, c, g, or t
  misc_feature (632)..(633): n is a, c, g, or t
  misc_feature (642)..(642): n is a, c, g, or t
  misc_feature (648)..(649): n is a, c, g, or t
  misc_feature (652)..(653): n is a, c, g, or t
  misc_feature (655)..(656): n is a, c, g, or t
  misc_feature (665)..(666): n is a, c, g, or t
  misc_feature (669)..(669): n is a, c, g, or t
  misc_feature (674)..(676): n is a, c, g, or t
  misc_feature (681)..(682): n is a, c, g, or t
  misc_feature (685)..(686): n is a, c, g, or t
  misc_feature (690)..(690): n is a, c, g, or t
  misc_feature (692)..(692): n is a, c, g, or t
  misc_feature (697)..(700): n is a, c, g, or t
  misc_feature (704)..(706): n is a, c, g, or t
  misc_feature (708)..(709): n is a, c, g, or t
  misc_feature (712)..(713): n is a, c, g, or t
  misc_feature (716)..(716): n is a, c, g, or t
  misc_feature (718)..(718): n is a, c, g, or t
  misc_feature (726)..(727): n is a, c, g, or t
  misc_feature (729)..(729): n is a, c, g, or t
  misc_feature (732)..(733): n is a, c, g, or t
  misc_feature (735)..(735): n is a, c, g, or t
  misc_feature (737)..(737): n is a, c, g, or t
  misc_feature (740)..(740): n is a, c, g, or t
  misc_feature (742)..(742): n is a, c, g, or t
  misc_feature (746)..(747): n is a, c, g, or t
  misc_feature (750)..(751): n is a, c, g, or t
  misc_feature (753)..(755): n is a, c, g, or t
  misc_feature (759)..(759): n is a, c, g, or t
  misc_feature (762)..(764): n is a, c, g, or t
  misc_feature (768)..(772): n is a, c, g, or t
  misc_feature (775)..(775): n is a, c, g, or t
  misc_feature (778)..(778): n is a, c, g, or t
  misc_feature (781)..(782): n is a, c, g, or t
  misc_feature (784)..(784): n is a, c, g, or t
  misc_feature (788)..(788): n is a, c, g, or t
  misc_feature (790)..(791): n is a, c, g, or t
  misc_feature (793)..(794): n is a, c, g, or t
  misc_feature (796)..(796): n is a, c, g, or t
  misc_feature (800)..(800): n is a, c, g, or t
  misc_feature (802)..(802): n is a, c, g, or t
  misc_feature (806)..(807): n is a, c, g, or t
  misc_feature (809)..(810): n is a, c, g, or t
  misc_feature (813)..(813): n is a, c, g, or t
  misc_feature (816)..(816): n is a, c, g, or t
  misc_feature (818)..(818): n is a, c, g, or t
  misc_feature (820)..(820): n is a, c, g, or t
  misc_feature (824)..(824): n is a, c, g, or t
  misc_feature (826)..(827): n is a, c, g, or t
  misc_feature (829)..(829): n is a, c, g, or t
  misc_feature (835)..(837): n is a, c, g, or t
  misc_feature (842)..(843): n is a, c, g, or t
  misc_feature (845)..(845): n is a, c, g, or t
  misc_feature (848)..(850): n is a, c, g, or t
  misc_feature (852)..(853): n is a, c, g, or t
  misc_feature (855)..(855): n is a, c, g, or t
  misc_feature (859)..(859): n is a, c, g, or t
  misc_feature (861)..(862): n is a, c, g, or t
  misc_feature (867)..(868): n is a, c, g, or t
  misc_feature (873)..(874): n is a, c, g, or t
  misc_feature (877)..(880): n is a, c, g, or t
  misc_feature (882)..(886): n is a, c, g, or t
  misc_feature (889)..(889): n is a, c, g, or t
  misc_feature (899)..(899): n is a, c, g, or t
  misc_feature (1090)..(1090): n is a, c, g, or t
  misc_feature (1199)..(1199): n is a, c, g, or t
ccgcagaagatcatcagggtgtcgaaccgctgcaacaacaaagccagctttcaccaggcgnnttnnnaanngnnnanggttcnnnncgnttccgcnannnccnngcgagntngcantnnntngannntggcntgncgnngncgcggaatttnngnnnaccgaganttcccanggtcnnanccttgtttnngnntnncnntnangcntcgggtagnnnncccnnnnnggngcctngntncntgnaactncngtgntgnngnggcnnangccgntnttntanncttntgcctgagcngngcnacaggncngcnncancaggnnngcaacnnnnaannacntcnnatcnncagcccngncctnnncnnngcntnnnncngnncagncnngcncngatnnncggncnanncgngtgnaaagccaatnnncnnggaananngnntgagnnnncaanntnntnnnnnnnangtnnnngntgnnntnnagangccntaannngncnnnantgccgtgngnanncngtgnngcnnccgnnngncnnnnnagcgnnncttgnactncccanncacnnntnaagacctntgcannccncngnngccnngnnnnaanantntgcncggnggnannnccggncnncgcctgccngccccnnggnngnngcattcacnntcngggcnnnctggnnccnntggngnctgcnnnnattnnncnnggnnttnancaccgctnncnggnncncnccnangccnncgnngnnntcanttnnngttnnnnnggngtnatnnanaggncnnanntnatgncnattnnannccnacnananagananntngcgaannnttggnnanggnnncnnangggngnnatctnntggcnntgnnnngnnnnngancctttcagtnacaggaagttaaggggtcagagtgacgctttgattggccgctgcattgtgatgtgtgatgcgcccgctgggccatgcgacggtgatctcggcctgggtcgcagcgccaaggccgaaatgcagcggaccggcttgtccgccggcatgtccgccaccgatgatcgtgcgctgcatatcgccgttgacggttanactcgcgccgatcgcatggcgattgccgcccggttgtaggagtgaaaccgccagccagtgaccggcatctggggtttcgttgcggtaaatttccaatggcgcgcggcgnttcagcaccacgacatccagccggccatcaccatcgaaatctgccagcgcagctccgcgcccgcgttccgtgctggccaagccggcactttggcccatttcccgaaaggtcccatccgcttgctgcatcaacagattattgggatctttgatcgcattggacggcatttgatccacattgcctttggagatgaacagatcaacccgcccgtcattgtccatatccccaaattgcgcatgccagccggttgaagggcgcccatcatcgccaaaataggggcgatgcgcataggttccgatggaaaacggagcactggcataggtgccgtcgggctgggctatttgcatcagctgatcgcccatggaggtgagcatgacctcttcgcgctggtcgccagtgatatcgcggctggcaatgcccatgccccagatagagattttttcccagccgtctggagcccccagaaaccggccttctttgagatcccacatttgctcatatccgccgcgcacatagtattgccggtcatttgagatacgcaggcgctgcgcaccgctggcatcctttgtggccaacatggataggctgcaaaatccgggttccagcggggtggagtgatacccatccgcaagcggcgtgagtagttcatggctgtcacaggcgaaaaacggaccctcggggttctttaaatccacataatttcccacggccatatgtgggcgtccgtcatccagccaccaggcgctaaaggctgtcgaccattgatcggcgggcaggagggggaattcgggggtggcctgggtaaagctgcagtctgggccacccataaggatcatgttttgcccaatgcgcagcacgaagagatccatgaagccatcggcattgatgtcgatgggataggcacctgtggtggcgcggatgtcgggcaaggggtgggcggtgaaggtgaaattgccttgattgacaaataggccggccggcccggtgccgccagcggcgaaaatatcgggcagcgcgtcgccattgcagtccaggaccgcgacaccgccgccgacaaaatggttccacccccccaaatagcggtgctcaggcaggcgatgtgagaggtcgcgaaacagcggctcggcctgtccaaccccggcgagaagacacaagattacccaaagagatttcacagtttttgacgcccttcgacaatgacagtgcgggtcaattcggtcaaagcaagggccgttgcgccgcgggcccaaaccatatccccccaagtttgcacctcaacccgcgtctcatggcggctgtgatagagtgcaagcgcgcgcatttcggcctgcatctctttggcattgaggaaatcatagcgcatcaattggcctgatagaataatcaattcaggatctaagagatggataatatttgataaagccaccgcgaggtagcggcctgcgcgcttgaaaatggtgcgaatatgcggatcactgctggcggccttttcgtagagcgatttgagcgcatcgggcaggttatggggcttttctggcgacaatccaaataccgtggaagcctcgcgggcgagggcgtaatcggccaaataggcctccaaacatccgcgctgaccgcatcggcacagcgcgccatcaagctgcactttcgtgtggccaagttccaaccccataccatgggcaccgcggaacaattggttgtcgctgacaaagcccatgccgacgccattttcaaccgtcaccacaacgaagttgctcaaagcgcgccccgcgccgaaccataattcggcaagggtcaaaacattggcgtcattgtcgatgcgcaccggggtttcgaagtgatcggcaaagatctggcccagcggtacatcggcgttttgcagcagcggtgaccaggcgaccatgccggattcgaaatccacgatcccagcaatcccgacgccaatggcggaaatcgtatccatggggatctcggctgcggtacaaagctgggtcactagattttctgtgtctttcagcaggtcttctgccgtcttcttgtctgtgttgcttcctagggcggcactggccagtagatttccggccagatcggtcaagaccgctgtgtgtgtttcgtcagagagtttcacgccgaccacgcgcagcgcttcgggcaccacctccagagcgaccggagggcggccccggctggtttcgcgtgcggcgccctcgacctcacgcaaaaatccatctgcgatcaattcagcggtgagtgcggtgaccgagcccgggctgacatcaaggcttcgggctatggttgcacgggcgacacggccactggcgcggacctgctcaaagatctgctggcgcagcgagaaagattcgcgcgccgaggtgcgtagaataggcccatagccggtggccagcgcagctgattcgatttcctcatgaaacccatcctcaaacataaattcaccctttgaactataagctaccgaatttctccagctatgccgcaaaacctgtatttatttgcgattggcaccgctgatatttgccattttacacattttgtcggctaaaaatagtaaattttaatttgacaactgaattaaatcgcgcagtatgtccaagtggctcagatctggcgtctgctcgatcgggctaaatttttgggaggactacaatgaataagctaatcatcgcagccgcagtcgcggcagctggttttacagggtccgctgctttggcagagggcatgtccatcggtgtgtcttgggcaagtttccaagaggagcgttggaaaatcgacgaagcggcaat

SEQ ID NO: 1526 - DNA, 4000 bp, Escherichia coli
  misc_feature (1)..(11): n is a, c, g, or t
  misc_feature (13)..(53): n is a, c, g, or t
  misc_feature (55)..(84): n is a, c, g, or t
  misc_feature (86)..(106): n is a, c, g, or t
  misc_feature (108)..(128): n is a, c, g, or t
  misc_feature (131)..(165): n is a, c, g, or t
  misc_feature (167)..(239): n is a, c, g, or t
  misc_feature (241)..(283): n is a, c, g, or t
  misc_feature (285)..(292): n is a, c, g, or t
  misc_feature (294)..(305): n is a, c, g, or t
  misc_feature (307)..(316): n is a, c, g, or t
  misc_feature (318)..(348): n is a, c, g, or t
  misc_feature (350)..(366): n is a, c, g, or t
  misc_feature (368)..(370): n is a, c, g, or t
  misc_feature (372)..(382): n is a, c, g, or t
  misc_feature (384)..(396): n is a, c, g, or t
  misc_feature (398)..(425): n is a, c, g, or t
  misc_feature (427)..(437): n is a, c, g, or t
  misc_feature (439)..(456): n is a, c, g, or t
  misc_feature (458)..(468): n is a, c, g, or t
  misc_feature (471)..(479): n is a, c, g, or t
  misc_feature (481)..(546): n is a, c, g, or t
  misc_feature (548)..(612): n is a, c, g, or t
  misc_feature (614)..(640): n is a, c, g, or t
  misc_feature (642)..(697): n is a, c, g, or t
  misc_feature (699)..(705): n is a, c, g, or t
  misc_feature (707)..(717): n is a, c, g, or t
  misc_feature (719)..(792): n is a, c, g, or t
  misc_feature (794)..(796): n is a, c, g, or t
  misc_feature (798)..(800): n is a, c, g, or t
  misc_feature (802)..(810): n is a, c, g, or t
  misc_feature (812)..(835): n is a, c, g, or t
  misc_feature (837)..(864): n is a, c, g, or t
  misc_feature (866)..(894): n is a, c, g, or t
  misc_feature (896)..(1032): n is a, c, g, or t
  misc_feature (1034)..(1046): n is a, c, g, or t
  misc_feature (1048)..(1140): n is a, c, g, or t
  misc_feature (1142)..(1159): n is a, c, g, or t
  misc_feature (1161)..(1162): n is a, c, g, or t
  misc_feature (1164)..(1170): n is a, c, g, or t
  misc_feature (1172)..(1175): n is a, c, g, or t
  misc_feature (1177)..(1183): n is a, c, g, or t
  misc_feature (1185)..(1197): n is a, c, g, or t
  misc_feature (1199)..(1219): n is a, c, g, or t
  misc_feature (1221)..(1224): n is a, c, g, or t
  misc_feature (1226)..(1296): n is a, c, g, or t
  misc_feature (1298)..(1307): n is a, c, g, or t
  misc_feature (1309)..(1331): n is a, c, g, or t
  misc_feature (1333)..(1335): n is a, c, g, or t
  misc_feature (1337)..(1344): n is a, c, g, or t
  misc_feature (1346)..(1361): n is a, c, g, or t
  misc_feature (1363)..(1364): n is a, c, g, or t
  misc_feature (1366)..(1366): n is a, c, g, or t
  misc_feature (1370)..(1402): n is a, c, g, or t
  misc_feature (1404)..(1416): n is a, c, g, or t
  misc_feature (1418)..(1431): n is a, c, g, or t
  misc_feature (1433)..(1433): n is a, c, g, or t
  misc_feature (1435)..(1457): n is a, c, g, or t
  misc_feature (1459)..(1474): n is a, c, g, or t
  misc_feature (1476)..(1494): n is a, c, g, or t
  misc_feature (1496)..(1499): n is a, c, g, or t
  misc_feature (1501)..(1507): n is a, c, g, or t
  misc_feature (1509)..(1520): n is a, c, g, or t
  misc_feature (1522)..(1550): n is a, c, g, or t
  misc_feature (1552)..(1563): n is a, c, g, or t
  misc_feature (1565)..(1565): n is a, c, g, or t
  misc_feature (1567)..(1567): n is a, c, g, or t
  misc_feature (1569)..(1569): n is a, c, g, or t
  misc_feature (1571)..(1571): n is a, c, g, or t
  misc_feature (1573)..(1579): n is a, c, g, or t
  misc_feature (1581)..(1581): n is a, c, g, or t
  misc_feature (1583)..(1630): n is a, c, g, or t
  misc_feature (1632)..(1632): n is a, c, g, or t
  misc_feature (1634)..(1634): n is a, c, g, or t
  misc_feature (1636)..(1636): n is a, c, g, or t
  misc_feature (1638)..(1638): n is a, c, g, or t
  misc_feature (1640)..(1643): n is a, c, g, or t
  misc_feature (1646)..(1646): n is a, c, g, or t
  misc_feature (1648)..(1648): n is a, c, g, or t
  misc_feature (1650)..(1678): n is a, c, g, or t
  misc_feature (1680)..(1691): n is a, c, g, or t
  misc_feature (1693)..(1697): n is a, c, g, or t
  misc_feature (1699)..(1700): n is a, c, g, or t
  misc_feature (1702)..(1702): n is a, c, g, or t
  misc_feature (1704)..(1704): n is a, c, g, or t
  misc_feature (1707)..(1711): n is a, c, g, or t
  misc_feature (1715)..(1757): n is a, c, g, or t
  misc_feature (1761)..(1761): n is a, c, g, or t
  misc_feature (1763)..(1764): n is a, c, g, or t
  misc_feature (1768)..(1768): n is a, c, g, or t
  misc_feature (1774)..(1776): n is a, c, g, or t
  misc_feature (1778)..(1778): n is a, c, g, or t
  misc_feature (1782)..(1784): n is a, c, g, or t
  misc_feature (1786)..(1824): n is a, c, g, or t
  misc_feature (1826)..(1827): n is a, c, g, or t
  misc_feature (1830)..(1831): n is a, c, g, or t
  misc_feature (1834)..(1834): n is a, c, g, or t
  misc_feature (1836)..(1836): n is a, c, g, or t
  misc_feature (1838)..(1838): n is a, c, g, or t
  misc_feature (1842)..(1842): n is a, c, g, or t
  misc_feature (1844)..(1845): n is a, c, g, or t
  misc_feature (1850)..(1850): n is a, c, g, or t
  misc_feature (1852)..(1859): n is a, c, g, or t
  misc_feature (1861)..(1883): n is a, c, g, or t
  misc_feature (1885)..(1888): n is a, c, g, or t
  misc_feature (1921)..(1953): n is a, c, g, or t
  misc_feature (1956)..(1956): n is a, c, g, or t
  misc_feature (1960)..(1960): n is a, c, g, or t
  misc_feature (1963)..(1963): n is a, c, g, or t
  misc_feature (1966)..(1970): n is a, c, g, or t
  misc_feature (1974)..(1977): n is a, c, g, or t
  misc_feature (1982)..(1986): n is a, c, g, or t
  misc_feature (1988)..(1993): n is a, c, g, or t
  misc_feature (1995)..(2008): n is a, c, g, or t
  misc_feature (2010)..(2022): n is a, c, g, or t
  misc_feature (2149)..(2149): n is a, c, g, or t
  misc_feature (3822)..(3822): n is a, c, g, or t
nnnnnnnnnnngnnnnnnnnnnnnnnnnnnnnnnnnnnnnnnnnnnnnnnnnngnnnnnnnnnnnnnnnnnnnnnnnnnnnnnntnnnnnnnnnnnnnnnnnnnnncnnnnnnnnnnnnnnnnnnnnnctnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnntnnnnnnnntnnnnnnnnnnnnannnnnnnnnncnnnnnnnnnnnnnnnnnnnnnnnnnnnnnnntnnnnnnnnnnnnnnnnntnnncnnnnnnnnnnngnnnnnnnnnnnnnannnnnnnnnnnnnnnnnnnnnnnnnnnntnnnnnnnnnnncnnnnnnnnnnnnnnnnnngnnnnnnnnnnnaannnnnnnnntnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnntnnnnnnnnnnnnnnnnnnnnnnnnnnncnnnnnnnnnnnnnnnnnnnnnnnnnnnnnnnnnnnnnnnnnnnnnnnnnnnnnnnncnnnnnnncnnnnnnnnnnngnnnnnnnnnnnnnnnnnnnnnnnnnnnnnnnnnnnnnnnnnnnnnnnnnnnnnnnnnnnnnnnnnnnnnnnnnntnnnannntnnnnnnnnncnnnnnnnnnnnnnnnnnnnnnnnncnnnnnnnnnnnnnnnnnnnnnnnnnnnnannnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnanncnnnnnnngnnnncnnnnnnngnnnnnnnnnnnnncnnnnnnnnnnnnnnnnnnnnntnnnncnnnnnnnnnnnnnnnnnnnnnnnnnnnnnnnnnnnnnnnnnnnnnnnnnnnnnnnnnnnnnnnnnnnnnnncnnnnnnnnnncnnnnnnnnnnnnnnnnnnnnnnncnnnannnnnnnnannnnnnnnnnnnnnnnanncncacnnnnnnnnnnnnnnnnnnnnnnnnnnnnnnnnnannnnnnnnnnnnntnnnnnnnnnnnnnncncnnnnnnnnnnnnnnnnnnnnnnntnnnnnnnnnnnnnnnncnnnnnnnnnnnnnnnnnnncnnnncnnnnnnncnnnnnnnnnnnnannnnnnnnnnnnnnnnnnnnnnnnnnnnnannnnnnnnnnnncncncncncnnnnnnngngnnnnnnnnnnnnnnnnnnnnnnnnnnnnnnnnnnnnnnnnnnnnnnnncncncncncnnnnggngngnnnnnnnnnnnnnnnnnnnnnnnnnnnnntnnnnnnnnnnnntnnnnncnncncnccnnnnngggnnnnnnnnnnnnnnnnnnnnnnnnnnnnnnnnnnnnnnnnnnnttcnanncacncacccnnncngggnnngnnnnnnnnnnnnnnnnnnnnnnnnnnnnnnnnnnnnnnntnncannccncncncccncnnggggngnnnnnnnnannnnnnnnnnnnnnnnnnnnnnnannnngtttcaatccacgcacccacacggggtgcgacnnnnnnnnnnnnnnnnnnnnnnnnnnnnnnnnntgntttnaanccnnnnncccnnnnggggnnnnncnnnnnnannnnnnnnnnnnnngnnnnnnnnnnnnngtttcaatccacgcacccacacggggtgcgacagtgtgcaaagttacatattataagtcaataaattagacctattaatatgcgaattctcatttttatttcagcttaatggctgcaatcgccttanagacgggttaatctgctaattattaaggggtgcgaaaatactacttttttcgtaatactccacattcgcataaattatatgataagagcattattaactttgtaagcagtttcaacacctatcacttttacccttttattctcgtttttattgagaatataaaatctaacgctatcaagagacatatcaataatacgcttgattcgttcaatcaagagacaatattgtgcttctgtcacctcacactcaaagacagaattctgtaccctttggccataatctatgcaagccttagccacatgtcgtaggcggcgagctccttctttgctcgtagtatccacatcataagtcacaagaatatgcataatcgtaaatcattttattagaaataccggataattatcaatatcttgcctgatatatcttgccatcaacatggcctgtacataaggcagaagccctatctctattttttcattaagataaggatggattatcacctcccttttccttgcctgccatgcggaaataaatgtctttttccctttatccgtcataacaaccccattatcaccttgaaacaaaaaatccttggatgttatctgtcttttattaatcaacgacaagacaaaacgatcaccaagataggctcgcaattcttccatcatatccaatgctaaggatgtacgtcccggacgaagtgtatggagaaatcctacgtatggatcaaggccaactgtttcgagtgcggcagatgtatcattagcaatcaaagtataagcaaaagacaacatggcattcactgcatctttaggaggacggcgattccggccatgaaacgggaaatcagccttctgattaagtatcaaaacaggcaacacttcaaaataggcatttgaagccatgccttcataccctattagggtcgtcttatcttgggtcgccaaagcttcacgcttggcatgttccaacacttgtaccgcccgattaatgttttcattctctccataatcacgaatatatctctttaatatattacgatagttttgaatcttaccaccaatcatcagtcgtgccacatgtaatgaccaggattcatcatccgacaattgatattgtctcttgcgtaacagtacattccctttcgttgcgctctgtaccctgctgataaatctgccatgaggagataggaatgtaagtgatatgctattgtcactgcacaatttcatcacgcccggacttgcgcccatatatccgaacgtcacaatgccttctatgtttatcgcaggaatacggaacacttcctcttgcttgactgatactacgacattctgcccatccttactcagataggcttcaggtgtcgtcacatacaaagtattcaacaattttctcatgtatataagtgtttattgaggtaagtatctaccgtggtacaattcttggctatcgtcggcatacagatttctttcaatgagcatttgtcgcaatgtcgttcatattttgcttttgggataacagccttactgaatatttcatgcatatccctggcgcattgtctgacgatattgcgcaactcatctgttatagccacctctatccgatgacgaagttctccataaaagaacacaccgtagggtatatggattgcgtacatttcttcaagacacatngtttgtgccgccaactgcacttcatccacttcatcctttttgggtctgccatgcttatactccacagccaccggtcgccaacgtcctggatatttaggatgcaagatcgtatcttccaaagatggagaaggtagcaactctatggcatcggaaatgccatagagccccaactcacgcg

SEQ ID NO: 1527 - DNA, 4000 bp, Escherichia coli
  misc_feature (345)..(345): n is a, c, g, or t
  misc_feature (969)..(969): n is a, c, g, or t
  misc_feature (1992)..(1992): n is a, c, g, or t
  misc_feature (3077)..(3077): n is a, c, g, or t
gtaattcaagtccaacatcggggcatctgtcgtgaacagctttgatacatttacgataatgctctgcacctccatcagctaagtcgtcgcggttaacaacggtaattacggcatggttaacgcccatccgatctacggcttctgcgagttctgcaggctcattaggattcaatggtgcaggggttttctctgtgccgactgcacagaacctgcatccgcgtgtgcatactccccctgcgatcatgaaagttgcagtgcctctgccccagcaatcatggatgtttggacatcttgcttcttcgcagacagtgtgtagcccatgttcatgtacattcgatttggttngattaaatcgactttgagcattccctgttggaagcgttgttttgaaccaaggtgggagtcgcttcctttccgctttccggcgttcttcagcattaactctgagcgcaccgtcacacctttcggtcgacacttcagtgccattagcttggggcagcggtacacccattgaggaagaggagtggacacacagggttaatcattcgccttggacacttagatgagggcattcaaaacgaggagagatatacgagactctcctcccaagtatcgatggctagcagtgcagcactcgtgacggggggcgcaaaaagaattggtgctgcaatttgtcttcacctagcgaaaaaaggctactcagtcgcagttcaccacaattcatcgtctaaagccgccgaggatttagttgaggtgattaaagcactcggagtcaatgcttgcacggttaagggtgatttatcgaatccggaagagtttacccaaattatttccgaagcatcatcacaaattgggcctattctccacctggtcaataatgcatcgaagttcgttcatgatgatttggacaatttcgatgatgaatcctggaacgcgcacatggacattaataccaaagccccattgatnttaactcgggaattgttacaaaatctccctgataatgaagtagggtcagtggtaaatatcttggatcaaaaaatcgcgtctcccaatccagatcatatctcctacacagcgtcgaggtttgctctgctggggattactgaagctttagccagaggcctagctccaaaattacgaattaatgcagtcgcccccgggcatacattggcaagccccgaccaaagcgaggaaggattcaaccaagcccaaagcgagagtcctttgggttatggcccatctccagaagacatcgctcaagcagtgattttcttaatcgaaggtaaatcaatcactggacaagtaattttcgttgacgccggcgaaagattcctctcaagaaaccgagatgttgtgtttgaaactgagggtgttttatgacttcacattccgacgcaataatgcaaatattatctaaaaatcaagccgctactgtactttttttggaaaaggtaattcgggaggttgatataggagtgcacaactacgaaattggctcaccacaacgtctctctttcgacatacacgtcatgctttgtggagatagttcccctcaagaagatgaaatttctcaagttttgaattatgaatacctacttaccactttagacgagaccttgaaattggaacgtgcatcccttttggaaacgttagcaaataggttgttagatagaattctagaacctccttcggtcgagggtgcaaccgttgtaattactaagctagatgtcctggacggggatggtcaactgggctgttcaattactcgaatgaagtaatggtgcagggggtgggatttgaacccacgaagctctatgcaccggagcttaagtccggcccctttgaccactcgggtacccctgcgagccctctgaggacctcattagacttgaaccgagcggatttacgcccccttttgggggcgtgaaaaaagcgatgcaaagagcaatcgaactttacgaacgctttaacactcctccgattacgggnaggtgatgactaggcgcagtgtgccgttccagaatggtcggttcacccaagttgcgatattcctggcaattttgatgataactccccaaatggctacatttttcgctgaaccaacataccttcaggtagactcccgggctgaaaattcagatgaatttgaatcaaaactctacacgctatatttcgcagaagccaatgcgtcctccggaggcgatggccacatttctacaatggtccctgaatctgggggtcaatcaacctctagtgcactagattctacaatagaattcacgactggagaccttctaagttcccttgaaattactggtcgtcccaaacacggttcttccagtggtcaattttacattccagtgcattttttccttcgtgctcaaggacctagcaactctcaggtgacctgggacatcgtgattagtgcaaatggtaatactgttggttcagagtcatgggaggccgatgcatgcaatcccggcataactaattcatgcaacttcgaccacgaattattcgaggttatattgaattcaggtgactcatttaccatacaagatggtaacgaattaacagtggaggtctctgctgaaatgtcaggttgtgaaggttctggtggccccttcggaggtagttgcgaagcagaagttgcttggaacgagatagatggagaaagcaatcggtattcacaaatggaagtagaaaccaacgcgattgcagatagcgaggtcgtcctgcaaagagacggggctgaactcgcagatggtgtagaattggaatggtatccgaacgatgttttgactgatagaacaatgcaattttcctttgatgtgaagagcgccttcggcagagatgatatggattctgtgaagttattgatgcgggatccaaatggaaactaccgtatagatcacgagatttcatccgatgatgatggtattagagacacaagtcaaggaatttttggcacctatacatggacatatccaagcggacttccatccggagaatacaccgtagaattggaaattacggatgttcaaggtaacgccttcctagtcgaacacgaaccngttgaaatgaaacaatggggagttgcgattaaccacagggaagatagaacagtggaatatattgcacctgacgaaacaacaccggtaccacttcagttagtccacagaggtgactctaccaaatcgatgtctgtagaacttgaattactcacaaacttaggtagctcatggcttgtagagttcgactctcctggtggctacactttgaattcaggaggcgatatattgaatccaatacttaccataactgctcctgatgacttgacaggagcacctaacaaaattgagattagagctgttgctgaagccacaatagaaggtgttcaaactgttgtccatcaagatctacttactcttgatttggaaaaattagaagtttaccaacctccagatgtatcgatatggaatgaagttcatgacataccgattgctaactctagccgagtcggtgatatcgatccaacaattcctagatatgtcgaggataaccaattcaataccttcttactagaaattttcaacacaggattcgacacggataatttcagagtggatattcttaagcgctcgaaatcaattatccagatttatgataatgatacgggcgaacgaatcctagaagatgagggggatggaactttccatatacctcccttagagagacattcaactcaggttcttcggttgaatgtaaaaccttccgcagacagagaagattctgatataggaatgatagaggtcgaagtgataagtagtggaaatgcctcacttagaacgacagttgaatttacaattcagaggacatttggaattcgtgcagaagtatcccaagattgcgacggcaccccgctaggtcacatccaagtatctctttgttcaactctaaacgaccctgaagtgaatcttcgcgctcgtataacaaa

SEQ ID NO: 1528 - DNA, 4000 bp, Escherichia coli
  misc_feature (864)..(864): n is a, c, g, or t
  misc_feature (991)..(992): n is a, c, g, or t
  misc_feature (1046)..(1046): n is a, c, g, or t
  misc_feature (1088)..(1088): n is a, c, g, or t
  misc_feature (1090)..(1090): n is a, c, g, or t
cgttcgcgaccggaacgtcttttcctaatttcttcgccagcttttcgaacgcattcttcgtcgaatccgtcgcgcccttgatctttttgccgcgcttaccttgcacggcttcgtcttcttcttcatcatcatcgtcgtcgccgctcgcctccgcctcctgcatcgcgcgcgcggcgtcctcgtcttcatcgtcgtcaaacacgtaatcttgctcctcaaatccatcgtcgtccgggaaatcgacgtcgtcgtctgggaaatcgacgtcgtcggcgaccgtcgccgtcgccggcgcctcgtcgtcgtcgtcgtccgggaaatcgatgtcttcgccgccttcacccgcgttttccccgcgctccatcgcatccacggcctcgccgacaccgccgccgaaatctaattcgttaaactcccgcaccgccatcttcacgctcttgtcgctttgcaacttgtccaccctcgccagcgtctcctccgccggcgcgtacgggtacatcttcaccgcccactccttgtacatcgtcgccaacaaattcatatcgtgttcctcgtgtccctcgcccttcgaccgcgcggcaaacttctccgggaactctctgtacatcgccccgagcccgttcggcccgagcaagtgatcgtgcacgctaaacttcggtcgccgcgtcgtcccggcgctcgacttccgcttctccgcgcgcgcgccgcgatcatcgcccgagccctcgccgcgcgcgccgccctcgacgtcgtccgtcgtcgtcgtcgtcgcgccgtcctcgcgcgttttcagcgcgtcgctcgcctcttttgaaatccatcgctcgcgcggcaccgtgcagtccttcgcccagtgtccgcccngtccgcacttgtagcacggtttatttttgctcgacatcgccgtcgccgtcgccgcgccgcgtcgcgccgtgccgcgccgcgcgccgtcgcgggcgcggcggtttgaaaatttgaaacgccgcgtgtnngtccgtgtgtgattgatgttaccgaccgccgacgacgcctcgacatcgtcgcgngcgacgcgtcgacgcggcggacgcgcgcgcgaggcgacgcgngngcgatgtcggcgaacgcgatggaccacctgctcgtcctgggcgcgctcggcgagatccacgcggcgtcggcgtgggcgaaaacgccgatcgaggagctcgtggaggaaattcaaggcttcgcgggacgcgcgcgcgacgcgagaatggcggcgacgacgccggtgggcgcgttcggagacgcgctgggacggtttggattggtgatgagcgagtgcgtgcgggagacggcgctggagtcggtgatggtggacgacgaggggagcgacgaccagggacgcgcggcgaagacgacgcgattgttgattttgttgggagtgctgtgtaaggggagtttcgagacgaaggtcgagctcgtgtttcgagcgatggacgcgcgaggggtgcgagggatcacgtcggagcaagcgatggaattcgcgggtgattgcgtgagcgtcgtcggcgcgttgctcgaggaacgcggcgaccgcgtggatttaggttgggcttcaaacatgtggacgcggtgcgtcaaagacgcggtcgacgcgtcgaacgcggatgatgatctcggaatgtttacgctggaagaattcaagacgctgatgcggaagatgttcgataagatgacgcgggcgagcctggagagcccggatttggacagacgaaggcgggcgagcgggggcgagacgcaacgtcgacggagcttgggatcggcgagcgagcgacgattgtcgcaaggttcggcacatggctttttagacgcaccgatcgttcaggctggtttggagtacttgacgggcgccagcagcgggggtcagcgagactctcgcggcagcggcggctcgccggcgtccgccgcaattttgtcgaaagttttagaaaccgtggcgagtccgcaacaatcgacgcgtgatgcatcttatcattcgcgcagtcatagtggcgagcacgacgtcaaaacgtcgggcggattacatcgagcgtcagggtcgtcaaactgggcgagcatgattcccgaaggcatcgcgcacgtgctcggagtcggccctcgaggggctacggacactcacgagctaaagcgcgagcccggaatgacggacgaggaatgggaacacgcaaaaattgtatccgaggtcgaggcggcgagacacgagacggatgatgcggagatgggacaggcggtacaggaatcaaactggagcggcatagtcgacttcgtaaaggaactcgtcatacgtattttcctcttcaacaccgtccgtctgcttcttacaattgcgctcctgggcggagatgccgcgttgtgcgtgtacgtcatcggtcacttcggcaccgtcgccggtctaggtttcgttgtcgtcatcaacgtcgtcatcagcgtgattttcatatggttcattgtgagcttcaacaagcgcgaacgcggtaaggacaacatgcaattcggtgcgaacttgatgcagagcatccaagacatcgccaagtccaaggctaccttcgagcagggattaggtgcgtttagaggcgcgaacgagtcggacacagatcacatctcgccgcgttcttggaacatggatggcgagacgacgcctcgcgcgttcgggcaagcgtcgatcacgggcgatcaacgaagatttcggaggaccgtatccggcacggttctcggcgagcgggtgtaggtactaatctagcgaaggtaaatttacaacaagaattacactcagatcgcgcgacgcgccaccgccaactcctcggcgagggcgtccgcgagaaaaggcgtgacgccccacgttgaacacatgtgatcatactcttcccacgccgccttcgacgccgacgcgttcgtgcggatcgctcgaatgagagtatttcgaggcgtgtgctcccctcctacgaattccatgacgtcgacgcgatatcccagcagtcgcaaaatgtgagctctgaatgcgtccgtgagaacgtcaccgagacgttcgctgaggatgccgtgcctcgccatcggcgggaaagcaacatgaggtgcgcttttcaaacgcacttggagatcgtgatgacagcacggcgcgatgagcgccagtggagcgcaccaacgcaccgttcgaacgatggactcatccgtcgccgtgtcgcacgcgtgcaaagcgagcactacgtcggtgaacgcgtcctcctctgaaccgtctacgaaagtcacgtcggcgtcggcgatcgtgccttcaatgaatctcatcgacgcatcccaacctagctctttggccacccgcgagttatgttcgcgcgcttggcgcttcacgtcgacgcccactacgtttgtaggcacgcgtctcttcgagctcaagagcgagtacgccccaaacgtgagatacgcgttcccgcatcctaaatcgcacacacgaagcgggcgagtctcatcgccgcccttcatgtgtcccgccgacgtcgcggtgtcgtaagcaacgttcaaaatcttcagaaactcctccacttgcttgtacttgtcccgcttgctcgccttgatggttccatccttggcgacgacgccgacgtatcgcaaaaacgggtcctcccccgtcagtaacctcgacttctcgcggtcgtgcccttgtgggccgacgacgatcgtctgtgttctcgcattaccgtctatcagcgtccccttactcgcgttgtccctagaaatcgtcgcccgagccttcttcgcgttcgccgtcacgttgtaaccgccgcgcgcgtgttcgacgcgccaatgtttatatcccgccctcagcgcctcctccagcgcctccctcgccccgatcgcgtcctcatccccgctcgcgctcttcgaaacgagccctccttcgccctcgatcgcgtgattactcgtgaacgcctgtcgttcgtcgtaccgcgtccgctgcagcgccgtccgcccccgaatcgtc

SEQ ID NO: 1529 - DNA, 4000 bp, Escherichia coli
  misc_feature (3)..(6): n is a, c, g, or t
  misc_feature (9)..(9): n is a, c, g, or t
  misc_feature (11)..(12): n is a, c, g, or t
  misc_feature (16)..(19): n is a, c, g, or t
  misc_feature (21)..(21): n is a, c, g, or t
  misc_feature (25)..(25): n is a, c, g, or t
  misc_feature (27)..(30): n is a, c, g, or t
  misc_feature (36)..(36): n is a, c, g, or t
  misc_feature (38)..(39): n is a, c, g, or t
  misc_feature (41)..(41): n is a, c, g, or t
  misc_feature (43)..(43): n is a, c, g, or t
  misc_feature (46)..(46): n is a, c, g, or t
  misc_feature (49)..(49): n is a, c, g, or t
  misc_feature (52)..(52): n is a, c, g, or t
  misc_feature (55)..(55): n is a, c, g, or t
  misc_feature (58)..(61): n is a, c, g, or t
  misc_feature (63)..(67): n is a, c, g, or t
  misc_feature (70)..(70): n is a, c, g, or t
  misc_feature (72)..(72): n is a, c, g, or t
  misc_feature (74)..(77): n is a, c, g, or t
  misc_feature (80)..(85): n is a, c, g, or t
  misc_feature (88)..(89): n is a, c, g, or t
  misc_feature (91)..(91): n is a, c, g, or t
  misc_feature (94)..(96): n is a, c, g, or t
  misc_feature (100)..(101): n is a, c, g, or t
  misc_feature (104)..(105): n is a, c, g, or t
  misc_feature (108)..(109): n is a, c, g, or t
  misc_feature (111)..(112): n is a, c, g, or t
  misc_feature (114)..(114): n is a, c, g, or t
  misc_feature (118)..(118): n is a, c, g, or t
  misc_feature (124)..(124): n is a, c, g, or t
  misc_feature (128)..(128): n is a, c, g, or t
  misc_feature (131)..(134): n is a, c, g, or t
  misc_feature (138)..(144): n is a, c, g, or t
  misc_feature (146)..(147): n is a, c, g, or t
  misc_feature (149)..(149): n is a, c, g, or t
  misc_feature (151)..(151): n is a, c, g, or t
  misc_feature (154)..(154): n is a, c, g, or t
  misc_feature (157)..(160): n is a, c, g, or t
  misc_feature (162)..(162): n is a, c, g, or t
  misc_feature (165)..(167): n is a, c, g, or t
  misc_feature (169)..(169): n is a, c, g, or t
  misc_feature (171)..(174): n is a, c, g, or t
  misc_feature (178)..(178): n is a, c, g, or t
  misc_feature (180)..(182): n is a, c, g, or t
  misc_feature (184)..(184): n is a, c, g, or t
  misc_feature (186)..(188): n is a, c, g, or t
  misc_feature (190)..(191): n is a, c, g, or t
  misc_feature (193)..(193): n is a, c, g, or t
  misc_feature (195)..(197): n is a, c, g, or t
  misc_feature (199)..(199): n is a, c, g, or t
  misc_feature (201)..(207): n is a, c, g, or t
  misc_feature (209)..(209): n is a, c, g, or t
  misc_feature (211)..(216): n is a, c, g, or t
  misc_feature (223)..(224): n is a, c, g, or t
  misc_feature (226)..(230): n is a, c, g, or t
  misc_feature (232)..(232): n is a, c, g, or t
  misc_feature (234)..(236): n is a, c, g, or t
  misc_feature (238)..(242): n is a, c, g, or t
  misc_feature (245)..(245): n is a, c, g, or t
  misc_feature (247)..(247): n is a, c, g, or t
  misc_feature (249)..(252): n is a, c, g, or t
  misc_feature (257)..(258): n is a, c, g, or t
  misc_feature (261)..(261): n is a, c, g, or t
  misc_feature (263)..(263): n is a, c, g, or t
  misc_feature (267)..(267): n is a, c, g, or t
  misc_feature (269)..(270): n is a, c, g, or t
  misc_feature (272)..(272): n is a, c, g, or t
  misc_feature (277)..(279): n is a, c, g, or t
  misc_feature (281)..(281): n is a, c, g, or t
  misc_feature (283)..(283): n is a, c, g, or t
  misc_feature (285)..(285): n is a, c, g, or t
  misc_feature (288)..(291): n is a, c, g, or t
  misc_feature (294)..(294): n is a, c, g, or t
  misc_feature (298)..(302): n is a, c, g, or t
  misc_feature (304)..(304): n is a, c, g, or t
  misc_feature (306)..(307): n is a, c, g, or t
  misc_feature (310)..(312): n is a, c, g, or t
  misc_feature (315)..(316): n is a, c, g, or t
  misc_feature (318)..(320): n is a, c, g, or t
  misc_feature (322)..(322): n is a, c, g, or t
  misc_feature (331)..(332): n is a, c, g, or t
  misc_feature (334)..(334): n is a, c, g, or t
  misc_feature (336)..(337): n is a, c, g, or t
  misc_feature (339)..(340): n is a, c, g, or t
  misc_feature (343)..(343): n is a, c, g, or t
  misc_feature (345)..(345): n is a, c, g, or t
  misc_feature (348)..(356): n is a, c, g, or t
  misc_feature (358)..(358): n is a, c, g, or t
  misc_feature (361)..(368): n is a, c, g, or t
  misc_feature (370)..(370): n is a, c, g, or t
  misc_feature (372)..(375): n is a, c, g, or t
  misc_feature (377)..(379): n is a, c, g, or t
  misc_feature (381)..(381): n is a, c, g, or t
  misc_feature (384)..(384): n is a, c, g, or t
  misc_feature (386)..(386): n is a, c, g, or t
  misc_feature (390)..(392): n is a, c, g, or t
  misc_feature (395)..(395): n is a, c, g, or t
  misc_feature (397)..(398): n is a, c, g, or t
  misc_feature (400)..(401): n is a, c, g, or t
  misc_feature (403)..(410): n is a, c, g, or t
  misc_feature (413)..(416): n is a, c, g, or t
  misc_feature (418)..(421): n is a, c, g, or t
  misc_feature (423)..(423): n is a, c, g, or t
  misc_feature (425)..(431): n is a, c, g, or t
  misc_feature (433)..(434): n is a, c, g, or t
  misc_feature (436)..(439): n is a, c, g, or t
  misc_feature (441)..(442): n is a, c, g, or t
  misc_feature (444)..(444): n is a, c, g, or t
  misc_feature (446)..(448): n is a, c, g, or t
  misc_feature (450)..(451): n is a, c, g, or t
  misc_feature (453)..(454): n is a, c, g, or t
  misc_feature (458)..(463): n is a, c, g, or t
  misc_feature (466)..(468): n is a, c, g, or t
  misc_feature (470)..(470): n is a, c, g, or t
  misc_feature (472)..(474): n is a, c, g, or t
  misc_feature (476)..(476): n is a, c, g, or t
  misc_feature (478)..(484): n is a, c, g, or t
  misc_feature (487)..(494): n is a, c, g, or t
  misc_feature (496)..(497): n is a, c, g, or t
  misc_feature (499)..(501): n is a, c, g, or t
  misc_feature (503)..(505): n is a, c, g, or t
  misc_feature (508)..(509): n is a, c, g, or t
  misc_feature (512)..(512): n is a, c, g, or t
  misc_feature (516)..(516): n is a, c, g, or t
  misc_feature (518)..(518): n is a, c, g, or t
  misc_feature (520)..(520): n is a, c, g, or t
  misc_feature (522)..(522): n is a, c, g, or t
  misc_feature (524)..(526): n is a, c, g, or t
  misc_feature (534)..(538): n is a, c, g, or t
  misc_feature (540)..(545): n is a, c, g, or t
  misc_feature (547)..(548): n is a, c, g, or t
  misc_feature (550)..(552): n is a, c, g, or t
  misc_feature (554)..(554): n is a, c, g, or t
  misc_feature (557)..(558): n is a, c, g, or t
  misc_feature (560)..(560): n is a, c, g, or t
  misc_feature (562)..(567): n is a, c, g, or t
  misc_feature (570)..(572): n is a, c, g, or t
  misc_feature (576)..(578): n is a, c, g, or t
  misc_feature (581)..(585): n is a, c, g, or t
  misc_feature (587)..(588): n is a, c, g, or t
  misc_feature (590)..(598): n is a, c, g, or t
  misc_feature (600)..(602): n is a, c, g, or t
  misc_feature (605)..(605): n is a, c, g, or t
  misc_feature (607)..(608): n is a, c, g, or t
  misc_feature (610)..(611): n is a, c, g, or t
  misc_feature (614)..(615): n is a, c, g, or t
  misc_feature (617)..(623): n is a, c, g, or t
  misc_feature (626)..(626): n is a, c, g, or t
  misc_feature (628)..(628): n is a, c, g, or t
  misc_feature (630)..(631): n is a, c, g, or t
  misc_feature (633)..(636): n is a, c, g, or t
  misc_feature (638)..(639): n is a, c, g, or t
  misc_feature (644)..(645): n is a, c, g, or t
  misc_feature (647)..(647): n is a, c, g, or t
  misc_feature (649)..(649): n is a, c, g, or t
  misc_feature (651)..(654): n is a, c, g, or t
  misc_feature (657)..(657): n is a, c, g, or t
  misc_feature (659)..(659): n is a, c, g, or t
  misc_feature (661)..(662): n is a, c, g, or t
  misc_feature (664)..(664): n is a, c, g, or t
  misc_feature (666)..(666): n is a, c, g, or t
  misc_feature (671)..(671): n is a, c, g, or t
  misc_feature (673)..(673): n is a, c, g, or t
  misc_feature (675)..(677): n is a, c, g, or t
  misc_feature (679)..(680): n is a, c, g, or t
  misc_feature (682)..(684): n is a, c, g, or t
  misc_feature (687)..(687): n is a, c, g, or t
  misc_feature (691)..(694): n is a, c, g, or t
  misc_feature (696)..(706): n is a, c, g, or t
  misc_feature (710)..(710): n is a, c, g, or t
  misc_feature (712)..(712): n is a, c, g, or t
  misc_feature (715)..(715): n is a, c, g, or t
  misc_feature (717)..(721): n is a, c, g, or t
  misc_feature (723)..(723): n is a, c, g, or t
  misc_feature (727)..(728): n is a, c, g, or t
  misc_feature (730)..(731): n is a, c, g, or t
  misc_feature (733)..(733): n is a, c, g, or t
  misc_feature (738)..(738): n is a, c, g, or t
  misc_feature (740)..(740): n is a, c, g, or t
  misc_feature (742)..(742): n is a, c, g, or t
  misc_feature (744)..(746): n is a, c, g, or t
  misc_feature (749)..(749): n is a, c, g, or t
  misc_feature (751)..(751): n is a, c, g, or t
  misc_feature (753)..(753): n is a, c, g, or t
  misc_feature (756)..(756): n is a, c, g, or t
  misc_feature (758)..(760): n is a, c, g, or t
  misc_feature (762)..(766): n is a, c, g, or t
  misc_feature (772)..(772): n is a, c, g, or t
  misc_feature (775)..(776): n is a, c, g, or t
  misc_feature (778)..(778): n is a, c, g, or t
  misc_feature (780)..(780): n is a, c, g, or t
  misc_feature (782)..(782): n is a, c, g, or t
  misc_feature (784)..(784): n is a, c, g, or t
  misc_feature (788)..(788): n is a, c, g, or t
  misc_feature (790)..(791): n is a, c, g, or t
  misc_feature (793)..(797): n is a, c, g, or t
  misc_feature (799)..(800): n is a, c, g, or t
  misc_feature (803)..(807): n is a, c, g, or t
  misc_feature (809)..(810): n is a, c, g, or t
  misc_feature (812)..(814): n is a, c, g, or t
  misc_feature (817)..(820): n is a, c, g, or t
  misc_feature (877)..(877): n is a, c, g, or t
  misc_feature (1307)..(1307): n is a, c, g, or t
  misc_feature (1986)..(1986): n is a, c, g, or t
  misc_feature (2158)..(2158): n is a, c, g, or t
  misc_feature (2462)..(2462): n is a, c, g, or t
  misc_feature (2528)..(2528): n is a, c, g, or t
  misc_feature (2780)..(2780): n is a, c, g, or t
  misc_feature (2783)..(2783): n is a, c, g, or t
  misc_feature (3074)..(3074): n is a, c, g, or t
  misc_feature (3218)..(3218): n is a, c, g, or t
  misc_feature (3400)..(3400): n is a, c, g, or t
  misc_feature (3591)..(3591): n is a, c, g, or t
  misc_feature (3615)..(3615): n is a, c, g, or t
  misc_feature (3636)..(3636): n is a, c, g, or t
  misc_feature (3831)..(3831): n is a, c, g, or t
gcnnnnatngnntcgnnnntnaccnannnncggaantnncngnatnccnggnttnacnnnntnnnnntgntnannnngtnnnnnngcnngnggnnnaagnngcnnaanngnntnatcngcatcngctnggnnnnttgnnnnnnngnngnanagncgnnnnanccnnncnannnnctgnannngntnnngnngntnnngngnnnnnnngncnnnnnnattttanngnnnnngngnnncnnnnncgncngnnnngcggnnatncnggtnanncnggtannntngntnaannnnttnaacnnnnngnanntannnacnntnnnancgtcgatgnngncnntnntgncntgnnnnnnnnngngcnnnnnnnngnannnnannncngtnanccgnnnaancnncnnannnnnnnngannnngnnnntngnnnnnnngnngnnnnanncngnnnanncnntgannnnnnagnnnangnnngnannnnnnnaannnnnnnngnngnnnannnggnnatncggncntnangnnnttacggtnnnnncnnnnnntnnannnanacnncnannnnnngcnnngctnnnttnnnnnannannnnnnnnntnnncangnnannagnnannnnnnngcnantnngnnnntnngggcnntngngnnnntgnancnntnantattnancnnntnnannnatngagnnnngnnnnnnnnnnnacgnanatnannnnnanaaanncnnanaacgncnanannntgntnanctnannntnnnnngataantcnnanantntnatananntnnnnntnncannnnnanncnnnttnnnnttttctagcagccgaatagttactaaataattaaactcacttacctagcgtaaacancgactaaatgatcaacttcactaaaatgcacggcctcggtaatgattttgtggtcattgacgccatcaatcagcacatcgacttaacgcccgaacaaatccggctgatgtccgaccggcacttcggcataggcttcgatcagctgttattggtcgaaaaggcggtaaacgccaatgccgacttcaaataccggatctttaacgcagacggcggcgaagtcgcccagtgcggcaatggcgcacgctgctttgcccgctttgttcgcgataaaaagctgtcggacaagaatgaaatctgcgtcgacaccaattcaggtcaattgttactgcgctttgatgccgacaacctgatcaccgtcaatatgggcatcccaaggcacgcacctgctgaaatccctttgctggccgaagaagaatcccgattttatacngtgctggttaacgagactgaaaaagcttttggcgctgtatccatgggcaatccgcacgcggttattcaagtcacggatgttaaaaccgcgccggtggctgaactgggaaaagccctggaaagccatacttttttcccggagcgggttaatgtcggttttatgcaagtcgtagatcgccaacacattaagctgcgcgtgtatgaacgcggcgctgccgaaacactggcttgcggcagcggcgcttgtgccgccgtggtcatcggcattgaacacaatctgctggatcatacggtcagtgttgacctgcccggcggaacgctaagcatcaactggcttggccgtggcgaaccggttttaatgacgggacccgccatttctgtttttgaaggacaaataacgctatgaacgaacacccctcagaactcacttcaacccaggttgaagactacctgcgcaaacatcccgagttcttccatgagcatttgaatttgctggaacacatgagcatcccgcatcctaccggcaatgcggtctccttaatttcaaaacagctggagctgtttagaagtcggcatcatgacatggaaaaccagctcactgcgctgatagaaatagccagggataacgatacctcgctgaaccgtatgcataaactgactctcgcgctgctggatgccanaacgctggaagaagcggttgccaatctggatgtcgtgctgtcggaatattttttgatcgattttgttgcggtgcgcatcatcaaacacaatccggacgccgctattaccaacctgtttattgaaccggacagcaaagacctggaaccgtttgcggttgaactggccggcaancagcccaaatgcggccgcccgactatagctcaggcaagagtattattcggcgagctggcgtttgaagtaaaatcctgcgccattatccccctggcctttaccgaactggaaggcattttagccatcggcagccgggaagaaggccggttccattacagcatgggcaacctgtttttaaatcaaatgagcgaaatcatagcgacccggctgatcaccttgttgcagcagcgttaacaacatggattccgatgccgaactgatgctggctgactttttcaagcagctcactgttgaagttcgcgcntcggaacacaccgtaaaaagttatcagcgggatcttaaacatctatcccgctattgcacagacaancccataacccgctgggccgacctgaagcacaccgatattcgcgcccatatcgccagtcggcatcggaaaggcctaagcagcaaaagtctgcaacgcgagctgtccgctattcgcagtttttataactacctgttaaaaaagggccaggccgacgtaaatcctgcgcagcatattcaagcgcccaaacaagccaggaagctgcctaaaacactggatgtcgatcagttatccggcttgctggaagccggggcnagntcattgcttgaaatacgcgacctggccatgttcgaattattctattcatccggcctgcggttgagcgagctgtcggcgcttgatttaaccgacctggatttgccggacagcaccttgactgtccgcataggcaagggcggtaaatccagagtattaccggtaggcagcaaagccgttacggcgattgaaaactggttacagcagcgagccgtaaaaatccccgctatcgagcccgcgctattcgtttcaacgcggggcacccggctcggtcaacgcaacattgagttaagnctggaacggtggtgcaaagcaaaaggtattgccgaacatatccatccgcacatgctgagacattccttcgccagccatttacttgaatccagccatgacttaagagccgttcaggaactgctcggacacagcaatatcagcacnacccagatatacacccacctggactttcagcatctggctgaaatctatgataaagcgcatccaagagccaaaaaaaaaccgttataacaacttgcgccgtaagcaaatagcaaaaaaacctgctaccatgtagccaatttttcatataaaaaagcagtgggatgaaatgtttttcgatcctncgaaaaaacctctttacgggatttcaaaaatggcggcaaacgatacactgaacgatataaaatctaaagggatactgtggggctttggcgtttttaccctcattgtggtgatcatcctgatcttcctgggcgcttggtggggcagagagccggatcagtttaatgttctggacgaagccgtaaaacgcgcngaagaaacccacgccactgaaagnatgccggtcggctatgtctanaccaacaccctggcccatatcgccgaggttctgttgcataaaagcggcggctatattactaacgacgtcgcgcctcccggcgtattactggacaacatttccaactgggaatacggcgcattagtcatgctgcgcgacgccacatcggcattaagaaaccactttgccagggatcaatcccaatcggccgaagancctgatctggcgattgcagaaccttatttctattacgaaaacgactcatgggccctgccgtcaacggaagccgaatatcaaaaaggcgttgaagcgctgcataaatacatggaacgcctgcaaaaatacggcggccccataaaaaaagctcaattttattcccgtgccg

SEQ ID NO: 1530 - DNA, 4000 bp, Escherichia coli
  misc_feature (411)..(411): n is a, c, g, or t
  misc_feature (3233)..(3233): n is a, c, g, or t
ctggaatccgccttctttaagcctttgcgatatgacctttatcccctcgccgctccatccataacacccgaatgcagctgcttttttattctggaacttcaaacccctcatttcttccaggatggcagctgcagcagaaaggattcccttattcaccgttggggatcctatcaaaactgcctttgatttgaatatttccgtgatcaaatcgcttttgtctgatcgggcgatgttaaacagctttacggtaacctctggatcggccgccgtgattccttccgcgatcgcttcagccatgcgacgcgttccgttccacatggtgtcataggcaatcgtaatctggttttcagaataggcgtgggcccattgaatatattgtttcacaatctgtagtggatcgttccgccatancaccccgtggctcggacagatcatatccactggaatattcaaagctataatctccttaattttcttatcaaccagcttactgaacggggtcaggatgttcgcatagtatttaatggcctcctgaaataactctgcctgatccaccagatcattgtacatcaattctgaggctatgtgttgaccgaacgcatcgttgctgaaaaggacgttatcgcccgtgagataactcatcatgctgtccggccagtggagcatcggggcttcaatgaatgtcagctctttcgatccaatgctgagcgtatcccctgtctttaccacctgaaaattccagtcctcgtgataaagacccgttagcgagtctatcgcgcgggatgtgcagtatatcgggacatcggggatatggcgcatcagttccggcaaggcaccactgtggtcagattctccgtgatttgctataacatagtcaatctcgtcaagtgagatctcttttttaagattctcaacaaattcacccgaaaacggaccccataccgtatcgatcaacgctgttttgttatcccttactaagtaggaattgtaactcgagccgcgatgtgtcgaaagctcctgcccatgaaatgtcctcagttcccagtcaacctttccaatccacgaaatagtctcgttgatcctaaataccatgtccatctcctctttgcgtgttaatcagatcgcgaaacgcataaacgtataacgaccttattattcgctcttgtttataaatatcctgacctcatgatctagtccagttcaacggcgtaagatcagccgatactgcggcgctggaagcccagaaggccgattaccataagaagcactgttactcccatcagcgcaatcaacggcgtcgccgaaaactcgcttacaaggatcttcggcacgtgggtaaacggcgagacgtcttgtatcgactggcctatctgtaggagctcaccgagcaattcgatgacgatgattcctaacaacgcgccccagctcaaaaacgtaagcttaggtatgaggccgtagagcgccatcgcgattccagccatcacaaggattgcaggcagatatgccatcgaggcggcgaacacgcgcggcagctcgtagccgacgtttccgacgctcaaaccgtaggtaagtccagcaggcacgctaaacgccgcaagcacaaccgtggtaccgacgactgtcagtaacaagtaacttcccgcccaacgcagccgaccgactggagtagccagcacgggatcgacgcgcgcctccttttcctcagactgcatttgcagcattgtgacaatggcgtacacggcagctatctcgacaactatcgttagagctaaggtgaaaaaactatcactcactccggagctgcctccaagacgggcaagcagacccacgagctgcggactagttgcaagctggtcagcgccggctttagcgagatcgcctgtgacgacaccaaatacagcgaacccaacggcccatgcgagcagcgagcggcggtttagccgccagacgagcgctgccgggcttcgcagtctcggcgacgccgaggcggggccgggccgcggccgcacaagacctgaaccgacgtcccgctgagaagacagagcaaacgccattgccgttaataacgcgatggcgccgatgaagagtacaaaaacaccccagcgttcgtcagcaaagggtttgatctgttgcatccaaccaagcggcgacagccaagatagtacgctgtgctcgcctatatcgccagcagcccgcagcagatatccaatgccgagaacggcgacggcaatgccttttgcagtgcccgcgcgctcagtgagctgcgcagcgacccccgctaccgcagcaaacgttgctccgacggccgcaactgacaggccgagcgcgacagagccggcgacgggaagtccatatacaattaatccgcccgcaacgagcgcggcgattaccaaatttgcgccgagcgtcacaagcagactcgccgacagcgctgcctgccgacccaccacggtcgcgtctagcagttcaaatcgtccagcctcctcctgcgtacgggtatggcgaacgacaaagagagcactgccgagcccgacaagcactgcgctatagacgctccatctccacgcggtgagcccggcgatggtcggaatgtaaatatgcccgagcagcgctacctctgctgggatgttcgcggtctcggagacgaacgcttcaagcgatgtggctgagggaagaagctgattgaaggtcgccacggtgacaaccgcaaagagggccggcagtatcacacagaccgacaatatgagccaatcccgccgaaggatcagacggagcagtgccctcgtgccggtgtacgcgttcaggttcatctcatgacgccttcctgaagcttataatggcgcaaaaacagatcttcaagcgtaggaggggcgctcgtaagtgcacgcacgtcaaattgggtcaggtaccgcaagacgcgattgaccgcgtcggcatctacgctgaatcgggcgtgggcgccttcgacggtgaggttgtaaacgcctggcagccgggtaagtccagtgatcggtcgccgggtctcgaccgacactgtggtgcgcgtcaggtgacgcagttcggcgagtgacccagtctcaacgattctgccctcattaataatgctaatacggtcacagagcgcttcgacttctgagaggatgtggctcgacagcaacacggtggtgccggcccccttggcctcgacgacgcactctcggaatattgcctccatcaagggatccaagcccaangtaggctcgtcgagaatgagcagttccacgttagagacgagcgccgcgattagggcaaccttctgctggttaccctttgaatacgtgcgacactgccttgtcgggtcgagtttgaagcgtgcgacaagctcatcacgtcgcgattggtcaaagccaccgcgcagcctcgccaagaggtcgattacctcaccaccagagaggtacggccataggttcacatcaccgggcacataagccagtcggcggtggagcgctacgacgtcgcgccagggatcacctccgagcagcgtgaccgttcctgagtccttgcggagcaatccgagcaggatccgcaaagtagtggtctttccggcaccgtttggaccgatgaagccgaacacctcaccgcgctcaacctcgagatcgacgccgtcaagggcaatgtgtttgccgtagcgttttgtcaagctgtgaatttcgattacggacaacctacacacctccgatcgtacgttctgtgcgtttcaggagagtagcgtacgttacgatcttgaagctctttaaccgaatgagatggcgccgtttatgcatagctcttccgattcttgttgcgtcgcccgtcaaaaatttcattttagtcaaaacagaggagcttctcttaaaaagaggagatgctcgtctagctgaagcatagaacccctccctcttccattaattttgagataagaacgacacatatatttagctcagggccttttcgtttgtagctgtgaacaggaccaaagaac

SEQ ID NO: 1531 - DNA, 4000 bp, Escherichia coli
  misc_feature (1)..(1): n is a, c, g, or t
  misc_feature (4)..(5): n is a, c, g, or t
  misc_feature (8)..(8): n is a, c, g, or t
  misc_feature (10)..(11): n is a, c, g, or t
  misc_feature (13)..(17): n is a, c, g, or t
  misc_feature (20)..(21): n is a, c, g, or t
  misc_feature (24)..(24): n is a, c, g, or t
  misc_feature (27)..(27): n is a, c, g, or t
  misc_feature (32)..(32): n is a, c, g, or t
  misc_feature (35)..(36): n is a, c, g, or t
  misc_feature (39)..(39): n is a, c, g, or t
  misc_feature (41)..(42): n is a, c, g, or t
  misc_feature (46)..(47): n is a, c, g, or t
  misc_feature (49)..(49): n is a, c, g, or t
  misc_feature (54)..(54): n is a, c, g, or t
  misc_feature (58)..(59): n is a, c, g, or t
  misc_feature (61)..(61): n is a, c, g, or t
  misc_feature (63)..(63): n is a, c, g, or t
  misc_feature (65)..(65): n is a, c, g, or t
  misc_feature (69)..(69): n is a, c, g, or t
  misc_feature (75)..(75): n is a, c, g, or t
  misc_feature (79)..(79): n is a, c, g, or t
  misc_feature (81)..(87): n is a, c, g, or t
  misc_feature (89)..(89): n is a, c, g, or t
  misc_feature (91)..(91): n is a, c, g, or t
  misc_feature (94)..(94): n is a, c, g, or t
  misc_feature (96)..(96): n is a, c, g, or t
  misc_feature (104)..(104): n is a, c, g, or t
  misc_feature (111)..(111): n is a, c, g, or t
  misc_feature (113)..(113): n is a, c, g, or t
  misc_feature (115)..(115): n is a, c, g, or t
  misc_feature (118)..(118): n is a, c, g, or t
  misc_feature (122)..(122): n is a, c, g, or t
  misc_feature (126)..(126): n is a, c, g, or t
  misc_feature (129)..(129): n is a, c, g, or t
  misc_feature (133)..(133): n is a, c, g, or t
  misc_feature (135)..(136): n is a, c, g, or t
  misc_feature (138)..(138): n is a, c, g, or t
  misc_feature (142)..(142): n is a, c, g, or t
  misc_feature (146)..(146): n is a, c, g, or t
  misc_feature (149)..(149): n is a, c, g, or t
  misc_feature (151)..(153): n is a, c, g, or t
  misc_feature (155)..(155): n is a, c, g, or t
  misc_feature (157)..(160): n is a, c, g, or t
  misc_feature (163)..(164): n is a, c, g, or t
  misc_feature (166)..(167): n is a, c, g, or t
  misc_feature (174)..(174): n is a, c, g, or t
  misc_feature (180)..(180): n is a, c, g, or t
  misc_feature (182)..(183): n is a, c, g, or t
  misc_feature (185)..(185): n is a, c, g, or t
  misc_feature (193)..(196): n is a, c, g, or t
  misc_feature (199)..(199): n is a, c, g, or t
  misc_feature (207)..(208): n is a, c, g, or t
  misc_feature (211)..(212): n is a, c, g, or t
  misc_feature (221)..(224): n is a, c, g, or t
  misc_feature (226)..(226): n is a, c, g, or t
  misc_feature (231)..(231): n is a, c, g, or t
  misc_feature (235)..(235): n is a, c, g, or t
  misc_feature (241)..(242): n is a, c, g, or t
  misc_feature (246)..(246): n is a, c, g, or t
  misc_feature (251)..(251): n is a, c, g, or t
  misc_feature (254)..(255): n is a, c, g, or t
  misc_feature (257)..(258): n is a, c, g, or t
  misc_feature (261)..(262): n is a, c, g, or t
  misc_feature (267)..(267): n is a, c, g, or t
  misc_feature (269)..(271): n is a, c, g, or t
  misc_feature (273)..(275): n is a, c, g, or t
  misc_feature (278)..(278): n is a, c, g, or t
  misc_feature (280)..(281): n is a, c, g, or t
  misc_feature (284)..(286): n is a, c, g, or t
  misc_feature (288)..(288): n is a, c, g, or t
  misc_feature (292)..(294): n is a, c, g, or t
  misc_feature (296)..(297): n is a, c, g, or t
  misc_feature (300)..(301): n is a, c, g, or t
  misc_feature (303)..(307): n is a, c, g, or t
  misc_feature (311)..(312): n is a, c, g, or t
  misc_feature (314)..(314): n is a, c, g, or t
  misc_feature (316)..(317): n is a, c, g, or t
  misc_feature (321)..(321): n is a, c, g, or t
  misc_feature (323)..(323): n is a, c, g, or t
  misc_feature (326)..(326): n is a, c, g, or t
  misc_feature (328)..(330): n is a, c, g, or t
  misc_feature (334)..(334): n is a, c, g, or t
  misc_feature (336)..(336): n is a, c, g, or t
  misc_feature (339)..(342): n is a, c, g, or t
  misc_feature (346)..(347): n is a, c, g, or t
  misc_feature (352)..(352): n is a, c, g, or t
  misc_feature (355)..(355): n is a, c, g, or t
  misc_feature (358)..(358): n is a, c, g, or t
  misc_feature (363)..(369): n is a, c, g, or t
  misc_feature (372)..(372): n is a, c, g, or t
  misc_feature (374)..(375): n is a, c, g, or t
  misc_feature (377)..(379): n is a, c, g, or t
  misc_feature (381)..(381): n is a, c, g, or t
  misc_feature (383)..(385): n is a, c, g, or t
  misc_feature (387)..(400): n is a, c, g, or t
  misc_feature (402)..(407): n is a, c, g, or t
  misc_feature (410)..(412): n is a, c, g, or t
  misc_feature (414)..(421): n is a, c, g, or t
  misc_feature (423)..(428): n is a, c, g, or t
  misc_feature (430)..(431): n is a, c, g, or t
  misc_feature (433)..(436): n is a, c, g, or t
  misc_feature (438)..(438): n is a, c, g, or t
  misc_feature (442)..(447): n is a, c, g, or t
  misc_feature (449)..(455): n is a, c, g, or t
  misc_feature (459)..(459): n is a, c, g, or t
  misc_feature (461)..(468): n is a, c, g, or t
  misc_feature (470)..(471): n is a, c, g, or t
  misc_feature (474)..(476): n is a, c, g, or t
  misc_feature (478)..(489): n is a, c, g, or t
  misc_feature (492)..(495): n is a, c, g, or t
  misc_feature (497)..(497): n is a, c, g, or t
  misc_feature (499)..(500): n is a, c, g, or t
  misc_feature (502)..(503): n is a, c, g, or t
  misc_feature (1535)..(1535): n is a, c, g, or t
  misc_feature (1987)..(1987): n is a, c, g, or t
  misc_feature (1992)..(1992): n is a, c, g, or t
  misc_feature (2260)..(2260): n is a, c, g, or t
  misc_feature (2485)..(2485): n is a, c, g, or t
  misc_feature (2590)..(2590): n is a, c, g, or t
  misc_feature (2786)..(2786): n is a, c, g, or t
  misc_feature (2817)..(2819): n is a, c, g, or t
  misc_feature (2824)..(2824): n is a, c, g, or t
  misc_feature (2826)..(2828): n is a, c, g, or t
  misc_feature (2834)..(2834): n is a, c, g, or t
  misc_feature (2839)..(2839): n is a, c, g, or t
  misc_feature (2845)..(2845): n is a, c, g, or t
  misc_feature (2849)..(2851): n is a, c, g, or t
  misc_feature (2855)..(2856): n is a, c, g, or t
  misc_feature (2861)..(2862): n is a, c, g, or t
  misc_feature (2864)..(2864): n is a, c, g, or t
  misc_feature (2867)..(2867): n is a, c, g, or t
  misc_feature (2872)..(2873): n is a, c, g, or t
  misc_feature (2875)..(2875): n is a, c, g, or t
  misc_feature (2877)..(2880): n is a, c, g, or t
  misc_feature (2882)..(2882): n is a, c, g, or t
  misc_feature (2885)..(2885): n is a, c, g, or t
  misc_feature (2887)..(2897): n is a, c, g, or t
  misc_feature (2900)..(2904): n is a, c, g, or t
  misc_feature (2906)..(2906): n is a, c, g, or t
  misc_feature (2913)..(2917): n is a, c, g, or t
  misc_feature (2919)..(2920): n is a, c, g, or t
  misc_feature (2922)..(2922): n is a, c, g, or t
  misc_feature (2924)..(2932): n is a, c, g, or t
  misc_feature (2935)..(2935): n is a, c, g, or t
  misc_feature (2937)..(2939): n is a, c, g, or t
  misc_feature (2941)..(2941): n is a, c, g, or t
  misc_feature (2944)..(2952): n is a, c, g, or t
  misc_feature (2954)..(2955): n is a, c, g, or t
  misc_feature (2960)..(2962): n is a, c, g, or t
  misc_feature (2967)..(2969): n is a, c, g, or t
  misc_feature (2971)..(2981): n is a, c, g, or t
  misc_feature (2983)..(2986): n is a, c, g, or t
  misc_feature (2988)..(2988): n is a, c, g, or t
  misc_feature (2990)..(2990): n is a, c, g, or t
  misc_feature (2992)..(2992): n is a, c, g, or t
  misc_feature (2994)..(2994): n is a, c, g, or t
  misc_feature (2996)..(2996): n is a, c, g, or t
  misc_feature (2998)..(2998): n is a, c, g, or t
  misc_feature (3000)..(3004): n is a, c, g, or t
  misc_feature (3007)..(3007): n is a, c, g, or t
  misc_feature (3009)..(3012): n is a, c, g, or t
  misc_feature (3016)..(3016): n is a, c, g, or t
  misc_feature (3019)..(3021): n is a, c, g, or t
  misc_feature (3027)..(3029): n is a, c, g, or t
  misc_feature (3037)..(3037): n is a, c, g, or t
  misc_feature (3040)..(3040): n is a, c, g, or t
  misc_feature (3042)..(3045): n is a, c, g, or t
  misc_feature (3049)..(3049): n is a, c, g, or t
  misc_feature (3051)..(3053): n is a, c, g, or t
  misc_feature (3055)..(3058): n is a, c, g, or t
  misc_feature (3060)..(3060): n is a, c, g, or t
  misc_feature (3062)..(3063): n is a, c, g, or t
  misc_feature (3066)..(3068): n is a, c, g, or t
  misc_feature (3070)..(3072): n is a, c, g, or t
  misc_feature (3075)..(3077): n is a, c, g, or t
  misc_feature (3079)..(3079): n is a, c, g, or t
  misc_feature (3083)..(3083): n is a, c, g, or t
  misc_feature (3086)..(3087): n is a, c, g, or t
  misc_feature (3090)..(3090): n is a, c, g, or t
  misc_feature (3093)..(3093): n is a, c, g, or t
  misc_feature (3096)..(3096): n is a, c, g, or t
  misc_feature (3099)..(3101): n is a, c, g, or t
  misc_feature (3104)..(3105): n is a, c, g, or t
  misc_feature (3107)..(3107): n is a, c, g, or t
  misc_feature (3110)..(3110): n is a, c, g, or t
  misc_feature (3116)..(3119): n is a, c, g, or t
  misc_feature (3123)..(3123): n is a, c, g, or t
  misc_feature (3125)..(3125): n is a, c, g, or t
  misc_feature (3127)..(3127): n is a, c, g, or t
  misc_feature (3129)..(3129): n is a, c, g, or t
  misc_feature (3132)..(3134): n is a, c, g, or t
  misc_feature (3138)..(3138): n is a, c, g, or t
  misc_feature (3140)..(3145): n is a, c, g, or t
  misc_feature (3147)..(3147): n is a, c, g, or t
  misc_feature (3152)..(3152): n is a, c, g, or t
  misc_feature (3154)..(3156): n is a, c, g, or t
  misc_feature (3158)..(3158): n is a, c, g, or t
  misc_feature (3160)..(3160): n is a, c, g, or t
  misc_feature (3162)..(3162): n is a, c, g, or t
  misc_feature (3164)..(3166): n is a, c, g, or t
  misc_feature (3168)..(3169): n is a, c, g, or t
  misc_feature (3172)..(3174): n is a, c, g, or t
  misc_feature (3176)..(3176): n is a, c, g, or t
  misc_feature (3179)..(3179): n is a, c, g, or t
  misc_feature (3183)..(3183): n is a, c, g, or t
  misc_feature (3185)..(3185): n is a, c, g, or t
  misc_feature (3188)..(3190): n is a, c, g, or t
  misc_feature (3192)..(3195): n is a, c, g, or t
  misc_feature (3201)..(3201): n is a, c, g, or t
  misc_feature (3203)..(3203): n is a, c, g, or t
  misc_feature (3206)..(3206): n is a, c, g, or t
  misc_feature (3208)..(3209): n is a, c, g, or t
  misc_feature (3211)..(3213): n is a, c, g, or t
  misc_feature (3215)..(3218): n is a, c, g, or t
  misc_feature (3220)..(3221): n is a, c, g, or t
  misc_feature (3226)..(3228): n is a, c, g, or t
  misc_feature (3232)..(3234): n is a, c, g, or t
  misc_feature (3236)..(3239): n is a, c, g, or t
  misc_feature (3241)..(3242): n is a, c, g, or t
  misc_feature (3244)..(3245): n is a, c, g, or t
  misc_feature (3248)..(3248): n is a, c, g, or t
  misc_feature (3251)..(3253): n is a, c, g, or t
  misc_feature (3255)..(3258): n is a, c, g, or t
  misc_feature (3260)..(3261): n is a, c, g, or t
  misc_feature (3264)..(3265): n is a, c, g, or t
  misc_feature (3267)..(3268): n is a, c, g, or t
  misc_feature (3270)..(3270): n is a, c, g, or t
  misc_feature (3272)..(3275): n is a, c, g, or t
  misc_feature (3277)..(3277): n is a, c, g, or t
  misc_feature (3279)..(3279): n is a, c, g, or t
  misc_feature (3281)..(3281): n is a, c, g, or t
  misc_feature (3283)..(3283): n is a, c, g, or t
  misc_feature (3285)..(3285): n is a, c, g, or t
  misc_feature (3287)..(3287): n is a, c, g, or t
  misc_feature (3289)..(3289): n is a, c, g, or t
  misc_feature (3291)..(3291): n is a, c, g, or t
  misc_feature (3293)..(3293): n is a, c, g, or t
  misc_feature (3296)..(3297): n is a, c, g, or t
  misc_feature (3303)..(3323): n is a, c, g, or t
  misc_feature (3325)..(3329): n is a, c, g, or t
  misc_feature (3331)..(3336): n is a, c, g, or t
  misc_feature (3338)..(3340): n is a, c, g, or t
  misc_feature (3343)..(3343): n is a, c, g, or t
  misc_feature (3345)..(3346): n is a, c, g, or t
  misc_feature (3351)..(3353): n is a, c, g, or t
  misc_feature (3355)..(3355): n is a, c, g, or t
  misc_feature (3357)..(3358): n is a, c, g, or t
  misc_feature (3361)..(3361): n is a, c, g, or t
  misc_feature (3365)..(3368): n is a, c, g, or t
  misc_feature (3370)..(3370): n is a, c, g, or t
  misc_feature (3372)..(3381): n is a, c, g, or t
  misc_feature (3384)..(3384): n is a, c, g, or t
  misc_feature (3387)..(3387): n is a, c, g, or t
  misc_feature (3392)..(3396): n is a, c, g, or t
  misc_feature (3398)..(3399): n is a, c, g, or t
  misc_feature (3404)..(3404): n is a, c, g, or t
  misc_feature (3409)..(3410): n is a, c, g, or t
  misc_feature (3416)..(3420): n is a, c, g, or t
  misc_feature (3423)..(3424): n is a, c, g, or t
  misc_feature (3426)..(3428): n is a, c, g, or t
  misc_feature (3430)..(3430): n is a, c, g, or t
  misc_feature (3432)..(3433): n is a, c, g, or t
  misc_feature (3435)..(3435): n is a, c, g, or t
  misc_feature (3437)..(3441): n is a, c, g, or t
  misc_feature (3443)..(3444): n is a, c, g, or t
  misc_feature (3446)..(3447): n is a, c, g, or t
  misc_feature (3449)..(3451): n is a, c, g, or t
  misc_feature (3454)..(3454): n is a, c, g, or t
  misc_feature (3456)..(3457): n is a, c, g, or t
  misc_feature (3460)..(3464): n is a, c, g, or t
  misc_feature (3466)..(3468): n is a, c, g, or t
  misc_feature (3470)..(3476): n is a, c, g, or t
  misc_feature (3480)..(3480): n is a, c, g, or t
  misc_feature (3485)..(3486): n is a, c, g, or t
  misc_feature (3488)..(3488): n is a, c, g, or t
  misc_feature (3490)..(3490): n is a, c, g, or t
  misc_feature (3493)..(3493): n is a, c, g, or t
  misc_feature (3495)..(3500): n is a, c, g, or t
  misc_feature (3502)..(3506): n is a, c, g, or t
  misc_feature (3508)..(3508): n is a, c, g, or t
  misc_feature (3510)..(3513): n is a, c, g, or t
  misc_feature (3515)..(3518): n is a, c, g, or t
  misc_feature (3520)..(3539): n is a, c, g, or t
  misc_feature (3542)..(3546): n is a, c, g, or t
  misc_feature (3549)..(3550): n is a, c, g, or t
  misc_feature (3552)..(3555): n is a, c, g, or t
  misc_feature (3557)..(3563): n is a, c, g, or t
  misc_feature (3566)..(3570): n is a, c, g, or t
  misc_feature (3572)..(3572): n is a, c, g, or t
  misc_feature (3574)..(3575): n is a, c, g, or t
  misc_feature (3578)..(3578): n is a, c, g, or t
  misc_feature (3580)..(3581): n is a, c, g, or t
  misc_feature (3583)..(3584): n is a, c, g, or t
  misc_feature (3589)..(3589): n is a, c, g, or t
  misc_feature (3591)..(3592): n is a, c, g, or t
  misc_feature (3599)..(3600): n is a, c, g, or t
  misc_feature (3604)..(3607): n is a, c, g, or t
  misc_feature (3609)..(3609): n is a, c, g, or t
  misc_feature (3612)..(3613): n is a, c, g, or t
  misc_feature (3615)..(3617): n is a, c, g, or t
  misc_feature (3620)..(3621): n is a, c, g, or t
  misc_feature (3627)..(3632): n is a, c, g, or t
  misc_feature (3634)..(3636): n is a, c, g, or t
  misc_feature (3638)..(3639): n is a, c, g, or t
  misc_feature (3641)..(3643): n is a, c, g, or t
  misc_feature (3645)..(3661): n is a, c, g, or t
  misc_feature (3663)..(3663): n is a, c, g, or t
  misc_feature (3665)..(3678): n is a, c, g, or t
  misc_feature (3680)..(3680): n is a, c, g, or t
  misc_feature (3682)..(3683): n is a, c, g, or t
  misc_feature (3685)..(3698): n is a, c, g, or t
  misc_feature (3700)..(3704): n is a, c, g, or t
  misc_feature (3706)..(3706): n is a, c, g, or t
  misc_feature (3709)..(3711): n is a, c, g, or t
  misc_feature (3713)..(3720): n is a, c, g, or t
  misc_feature (3724)..(3725): n is a, c, g, or t
  misc_feature (3731)..(3734): n is a, c, g, or t
  misc_feature (3737)..(3743): n is a, c, g, or t
  misc_feature (3745)..(3747): n is a, c, g, or t
  misc_feature (3749)..(3750): n is a, c, g, or t
  misc_feature (3752)..(3756): n is a, c, g, or t
  misc_feature (3758)..(3759): n is a, c, g, or t
  misc_feature (3761)..(3772): n is a, c, g, or t
  misc_feature (3775)..(3775): n is a, c, g, or t
  misc_feature (3778)..(3778): n is a, c, g, or t
  misc_feature (3781)..(3781): n is a, c, g, or t
  misc_feature (3783)..(3786): n is a, c, g, or t
  misc_feature (3788)..(3796): n is a, c, g, or t
  misc_feature (3798)..(3801): n is a, c, g, or t
  misc_feature (3804)..(3806): n is a, c, g, or t
  misc_feature (3809)..(3809): n is a, c, g, or t
  misc_feature (3811)..(3811): n is a, c, g, or t
  misc_feature (3813)..(3814): n is a, c, g, or t
  misc_feature (3817)..(3817): n is a, c, g, or t
  misc_feature (3819)..(3823): n is a, c, g, or t
  misc_feature (3827)..(3833): n is a, c, g, or t
  misc_feature (3835)..(3835): n is a, c, g, or t
  misc_feature (3837)..(3841): n is a, c, g, or t
  misc_feature (3843)..(3843): n is a, c, g, or t
  misc_feature (3845)..(3845): n is a, c, g, or t
  misc_feature (3847)..(3847): n is a, c, g, or t
  misc_feature (3852)..(3853): n is a, c, g, or t
  misc_feature (3859)..(3859): n is a, c, g, or t
  misc_feature (3861)..(3864): n is a, c, g, or t
  misc_feature (3868)..(3869): n is a, c, g, or t
  misc_feature (3879)..(3880): n is a, c, g, or t
  misc_feature (3891)..(3891): n is a, c, g, or t
  misc_feature (3928)..(3929): n is a, c, g, or t
  misc_feature (3934)..(3936): n is a, c, g, or t
  misc_feature (3939)..(3941): n is a, c, g, or t
  misc_feature (3950)..(3950): n is a, c, g, or t
  misc_feature (3954)..(3956): n is a, c, g, or t
  misc_feature (3961)..(3961): n is a, c, g, or t
  misc_feature (3963)..(3963): n is a, c, g, or t
  misc_feature (3968)..(3968): n is a, c, g, or t
  misc_feature (3974)..(3975): n is a, c, g, or t
  misc_feature (3978)..(3981): n is a, c, g, or t
  misc_feature (3984)..(3984): n is a, c, g, or t
  misc_feature (3987)..(3987): n is a, c, g, or t
  misc_feature (3993)..(3993): n is a, c, g, or t
  misc_feature (3996)..(3999): n is a, c, g, or t
ntcnncgncnncnnnnnctnnccnccnaactnacnnccntnncccnncnaccancccnncnancnggtnatcttngggncnnnnnnntncnccncncccccgtncctcaantncntcnaaancatnaanaaantnngngggntcanggngnnnangnnnncgnncnnggagatntgggantnngnggaggagnnnnagnacatgaannacnnacacgaccnnnngnacggngacnagaagnncaanaaganaannannaanngccgngnnngnnnggngnnggnnnanggannnannaanngnnnnnacanntngnncatntngancnnntagnantannnntcanntattnagncanatagnnnnnnnaantnngnnncngnnntnnnnnnnnnnnnnncnnnnnncgnnncnnnnnnnngnnnnnnanngnnnntnaagnnnnnntnnnnnnngccncnnnnnnnncnnttnnngnnnnnnnnnnnnggnnnncnanngnngccagaacgcgtgacgcgaggctcgttcccgctcacccgcatctgtacgacttcggagctaccgtcagtcgtatcgcatccgtctcgtcgagcgcagaagcctcgcgagtcagaacgcctcgcggccgttcgccgacgcccatcaagtttccgagtgacgtcgtaggacgcgcgtggaccaaaggagcgaccaccatgtcgagcggccaactcgagacgaagaagtctggtgacttctactggagcaaggatgatgtacgtgccctcatccgtcccgcgttcccactcgcgcacgtccgcgtcgcgtcgtccgcccgaccgcatcgctaccgacggcgcgcgggcggccacgtcgctgtttctgtgtttccacctctccgccatccgaatccgtcgccgcgtggccgtgacgcccgaatcccgtatacgcacgtccgctgacgccgatctctctcccacacctaacccgcgaccccacaggagcctcacgcgaagcgaaggagggagatcctcgagaagtacccgcagatcaaggacctgtatggcccggactggaccacctgcccgcagatcttcgccgtcgtgagcctccagctcgcggtggcctggtggctggggaacaacgcgtcgtggcccgtgctgctgctcaccgcgtatgcctttgggggtttcgtcaccgctaacctgttcctggcgaaccacgagctgagccacaacctcgcgttcaagagcgccggcgcgaaccgcgcgctgggcctcgtggtgaaccttcccatcggcatccccttctccgtggcgttcaagaagtaccacctcgagcaccacatgttccagggccacgacgccatcgacacggatattcccaccgccggcgaggcgaggctcttctctctgggtggatccctgctcaagatcgtgtgggtgattggtcagctcttcttctacgccatcaggccgctctttgtgcgcccgaagccgatgggcaagtgggacgccctcaacctgatcacgcaggcttctttcgacatggcnttcattcatttcgcgggtccccgggccttcgtctacctgctcgcctcggtgttcctcggcggcggtcttcaccccatggccggtcacttcatctccgagcactacgtgttccaccccggacaggagacgtactcgtactacggccccctcaacgtgtttgtgtacaacgtcgggtaccacaacgagcaccacgatttccccaaggtggctgggagcaggctgcccaaggttcgcgagattgcgcctgagtactacaacaacctcaagtaccacacctcctggaccaaggtcattgtcgactacatcgcggacccgaacatggggccctttgcgcgcaccatgaggaagaaggtgagcaagtcggactgagaatggccgatgggactattactcgcgcactctagaagctagtttcgttatattatttggcatgcgttcattatcccgggccnttcangcccttcatagcttggtcgcactgaaaccacatgtgctcgggcgggtcctccgtgccgcccaacccttcacccaccccaccatctgctcgcttcaccttcatcacgaaatccaccgcaaccttggtctgcctgagaagcggtgcgaatcccctcttgggcagaaaaccttcggtctcgccaccaaccgtctccagcgtcggcactttcaccaacaggaacactttcatcggcgtcgccgccggtggacagcccgccacggccggaagncattctctgattacccgtcgcgcggcgttgtccatcgttttttcaatacccgacgtgtgttcgtacgacgcgtaacagctcgacgcgtcgctcagaacgaaggtgtacatctccttgggtctcaacggcgtggacccaaggagaattgccagctccgtggcgcgcgtttcccgcagcatcttcgccgtgactcgggcaagcatggcctcgagttccttgaagagnttcagggatcgcctctcgtcggatgtcgcgcgctttcgcttcgagccgggctggacaccagccgtctgctgcccctccccctcccccaacacttcggcgcccaangactcaaccaacccgcccttcagatcgtcgtaggagcatgggagctgctgcctgacgaagaggaggaacttgatgacctccctgagagtgtgggcgacgagctcggcggtcgcgggtgacggtatcctgacctcatctcgcgttcgttccatcgcccctgaacactgagggacctgtcagaatcgcgttcgaaaanagcaaataaggccaagcccagctccttgaannncaaanannntccccncgcgncacgcntcgnnnaccnnggganncncgngagannanannnnanccnannnnnnnnnnntcnnnnngngtgagannnnntnngngnnnnnnnnncanannntnaannnnnnnnncnnctccnnnacgcnnnannnnnnnnnnncnnnngncncngngngncnnnnncanannnncccncannncccgcnnngcgcgganatntnnnnttanannntnnnnangnncannnannncannnanatcnagnncgntcnagngcnnnccnncnccnccccgnnnntccncntntntannncgangnnnnnncnccgcncnnncncncncnnnanncgnnnanacncgcnancgnnncnnnntctcgngncgngnncnnncnnnntnntcccnnnttcnnngnnnncnngnnccnccnnncnnnncnnccnncnncngnnnncncncncncncncncncnccnncgcccnnnnnnnnnnnnnnnnnnnnncnnnnnannnnnnannnacnannaaacnnnanannggncccnnnngncnnnnnnnnnnggngancgggnnnnngnngcccnccccnncccccnnnnnccnngnnncncnngngnnnnntnntnntnnnaantnnccnnnnncnnncnnnnnnncccnccccnncncnccncnnnnnncnnnnncncnnnncnnnnannnnnnnnnnnnnnnnnnnnccnnnnnccnncnnnncnnnnnnnccnnnnncncnnccncnncnnccgcncnncccgccnncccnnnnanccnngnnnccnncgcccnnnnnncnnncnngnnncnnnnnnnnnnnnnnnnncngnnnnnnnnnnnnnnanannannnnnnnnnnnnnncnnnnncnccnnngnnnnnnnncccnncccccnnnnccnnnnnnncnnncnncnnnnntnncnnnnnnnnnnnnggnggnggngnnnngnnnnnnnnncnnnnggnnnggntngnnggngnnnnnggcnnnnnnngngnnnnncncncnccccnngccccncnnnngggnngggggggggnncggggggcccnggggttccccgccccccgggggggccccgcccccccnnggggnnnggnnnccccccccncgcnnnggccngnccccngggggnnttnnnnttnaanccccgnttnnnna

SEQ ID NO: 1532 - DNA, 4000 bp, Escherichia coli
  misc_feature (1189)..(1189): n is a, c, g, or t
  misc_feature (1198)..(1198): n is a, c, g, or t
  misc_feature (1985)..(1985): n is a, c, g, or t
  misc_feature (2637)..(2637): n is a, c, g, or t
  misc_feature (3128)..(3128): n is a, c, g, or t
  misc_feature (3131)..(3131): n is a, c, g, or t
  misc_feature (3697)..(3697): n is a, c, g, or t
aactacattaaagtatttactggtgatattattattgcacaacgcataatttctgatttaaaaaaagaaaacataattcccgtagtaaaagatcaaaccgattctggacttattcctatttttggctcttccaattcaatacttaaacaagttttcgtccataaagacgaacttgataaggcggttttagcagttgaaaatattacttcagaattacaatcttgattaagtggttactgcgtacattttatcgcgtaattccttaatttttttgtcttgcatatattcatcgaacgtagtgtatcggtctataacaccacatggagttaattctacgactctattcgccacagtctgtgcaaattcatggtcatgtgtagtaaataaaatagtgcctttaaagtttttaagcgaattattaaatgccgtaatactctctaaatctaaatgatttgttggctcatctaattgtaacacatttgccctcatcatcatcattcgagatagcatacacctcactttctctcctcctgataatactgatgattttttaaaagcctcttctccactaaaaatcattttacctaaaaaccctcgaatattaacttcttcacgctcttcctctgtagttgcccattggcgtaaccaatctattaacgttaactcattattaaaaaattcactattgtctagtggtaaataggattgcgttgttgtaacaccccacataaatttaccagaatcagctttttctttattatttaatatttcataaaaggcggtagtagctctagaatctcttgaaaacacaaccactttatcccctttagccaggttcaaatcaatatttttaaataacgtttcaccctcagtagaagctgataatccttcaatatttaaaatttgatctcctgcttctctttcgcgttcaaaaataatagcaggataacgacgactagttcgtctaatatccccaatattcagtttttcaatcattttctttctactggttgcttgtttactttttgcaacgttagcagaaaaacgacgaataaattcttctaattcttttttcttgtcttctgcctttttattttgttgagcatgctgtcttgccgctaattgcgaagactcataccaaaaggtatagttaccagaaaagtgatttattttcccgaagtcaatatcngatatgtgngtacaaactgcgtctaaaaagtgtctatcgtgagacacaacaataacacaattatcatagtttgctaagaagttttccaaccacgagatagtttcataatctaaatcgttggtaggctcatccataattaacacatcgggatttccaaataatgcctgtgccaatagcacacgtactttttgtttaccatccaaatcggccatcaaagtataatgaaactcttccttaatacccaaattagataacattgaagctgcattactatctgcattccatccatccatttcttcaaacttaacttgaagttctcctattttttcagcattctcatctgtataatcagcataaagcgcatcaatttcagtttttatcttatgtaatggtttgtttcccattaaaatcgtttctaaaaccgtatgggcatcatataaattatgattttgttctaaaacagacatacgcttcccagactctaaagacacatggcctgaagttggatcttgttttccagaaataatttttaaaaatgtagattttccagacccatttgctccaataataccataacaattaccattattaaaagaggtattaacttcatcgaaaagaacacgtttaccgaactgaacagaaagatttgatactgataacatagagaatatttaatttttgcaaaagtaaaaaaaatccattggttatacgaaacatctataactaataatttacttattagcagaagtaatgatatggatgctacatgtgacaaataaaaataataagtttttgnacatgacatataatgagtctatttttaagtatttaaagctgttatgggtgtatttgtttagtaaatatttaacaacgcattaacatgactttataaatacaagctatatttttgtaggtataaatgactcggaaaggatttatgaagttatactttactttgatatgtattcttttaacaatcatcggttgtaaaaaagatagtaacgaggttaccattgattatgcttacctcggtggtgagataattaacccgaataccaattacattgttttgtctaaaaacgaagtaattcttgatacggttaagttagatggtagaaacagatttctatacaaaattgatgagttaaatgaaggtttgtacacgtttagacacggtggtgaatttcaacttatattattagaacctaaggatagcttattatttagattaaacactttagattttgatgaatcactagtttatagtggaaacggagataaaaaaaataattattttatcaatgagtatttacaaagcgagcaggaagaaaaatatattgttgaactttgtcagcttgacggtattacatttcaaaaacgtgtagattctttaaatgcttcaaaagtgacagcattagaaaattttagtaataaatatgatccgtccnctttattcttaaaaatagcaaaagcaaatattgattattcctttttttctagtaaagaagtttatccatttgtgcattacggaaaaaataaagctgctattttaaaatcattacctgaagatttttacaattacagaaaagctattgattataatgatggttttttaagtaatcaccataattataataagttcttaaggtataatttgagtaacttaacgcttaaaactcatgataaacacgacaataatgcttgttttgatagaaattcattgtgttataatttagatagactaaagcttattgatagtttaattaccaacccaaaggttaaagatgatttattatatcatttcgccatgggttatctatcaaaaaataaaaatgaggaaagcaacaatgcactcttgaagtcttttttaggcaaaagtgaaagtgaaaaaggtaaagagttgatggtacgttatacaaattcagttaacagcttgaanganggcgtaaaactgccacaaattaatgtagtaagttataatgaagatgtgcttaaaattagtgctcttatagattcgccaacggttttaagtttctggtctcatacttattataaacattttaaggaaagtcattataaactaaaagaactaaaagcaaaatacccagaagtaaagtttattgttattaatatagataattatggtttagagaaatctaaaagactattggaaggccatgggttcaataaaacgaatgaatttaagtttaaaaacccggaagaggctttagatatctttgctgtttatcctatgacaaaaaccgtacttgttgataagaataaaaaaataacaaacagtaacaccaatattttttcaactcatttcgaagagcaacttcttggtttaataaataagtaaattacaacttgtaatgcttcatcaaaagtttttcataaaccttatctggaagaattcgctttaaaacaatagagaatttctgcataaactcccctactttataatgcccttttggatttggagtgtttataattctgtaaaccgatttngccatcatatcaggatcactgccattatcaacgtgagtattcattaaatctaaagtatctccatatggctttttatatggtgaatcgtcaagtagcggcgcatgatatctcccagcagcaatattggttgcaaaatctccaggggcaatgttagtcatttttatgttgaagtcttttatttccattctaaaagcttctgttaaaagctctaaagcacctttgctagcactataaacacctctgtatggtaatcccatataaccagcaatagatgtaatgtttattattaagccagagtgttgt

SEQ ID NO: 1533 - DNA, 4000 bp, Escherichia coli
  misc_feature (903)..(903): n is a, c, g, or t
  misc_feature (2492)..(2492): n is a, c, g, or t
  misc_feature (3412)..(3412): n is a, c, g, or t
  misc_feature (3457)..(3457): n is a, c, g, or t
  misc_feature (3465)..(3465): n is a, c, g, or t
ctgtattattctggtcaagcacttctccaattccaatagcactctctttcttaaatggtcgaatacagagctgtttattaaaaatcaagcctggttttttatataatttatagagcgcttcttttgcagtccaaatatgagtaagataaatgacctcactcatgttcttagggatttgaaattctgaagtatgcaaaaaccttggagcaattcgcttaattttctcttgataatgttctaaatcaatcccaaccaaatttgaagaaatcacgactgctgcaacatcttttgtatggctaattgaaatatatcgcccatcggtaagataaggcgctccaattttgtcatactgatgcgtctttggcaaaactcccaaagacttaagcagctgcctaattgctaaatagcccttacggtgaacgatgcttttacgatttgaaagtcgttctatcgcttccggagaaagcgataatccatgttgtaattcagactccgtttctgtaatctcccaaacagccatttcagtatcctcagctataatttcacggtgacattctggcatttgttattgtatagaaaggttgtacttttgctcctcaaaacaaaggtacaactatggattctaataaaacaaagtacatcccctataaagtaaaagacatatctcaagcttcttggggaagaaaagaaatcaccttggctgaaaaagaaatgccgggtttaatggccttaagagaagagtatggtccttcacaacctttaaaaggcgcacgtatcgctgggtgtcttcacatgactatccaaacagcagtattgatagaaactttagttgcactaggcgctgatgttacttggagttcttgtaatattttttctactcaagatcatgcagcagcagccatngctgaagctggaattcctgtttatgcatggaagggaatgaacgaagaagaatttgactggtgtatcgagcaaacacttcttttcggagaagatcgtcaaccgctaaacatgattttagatgatggtggtgatttaaccaatatggttttggatcgttttccagaattaatcgaagaaattcgtggtctttctgaagaaactactactggagttcaccgtttatacgaacgtatgaaaaacgggacactccccatgcctgcaattaatgtaaacgactctgtaactaaatctaaatttgacaacaaatacggctgtagagaaagtgctgttgatgctatccgaagggctacagatgtaatgttggctgggaaacgagttgttgtttgtggttacggtgatgttggaaaagggactgctgcttcttttagtggcgctggagctattgttactgttacagaaatagaccctatatgtgctcttcaggctgctatggacggttacgaagtaaaaaaactttcaacggtaattggtaatgcagatattgtctgtactgctactggaaacaaagacattcttaaaaaagagtatttccttaatatgaaggacaaagccatcgtttgtaacatcggtcattttgataatgaaatagatatggcatggttaaacgaaaattatggtcacaccaaatcagaaatcaagcctcaggtagatctctatacccttgaagaaggaaagcaaatcattgtacttgctgaaggtcgtttggttaatttaggctgcgctacagggcatcctagttttgtgatgagtaattcctttacaaatcaaaccttagcgcaaattgaattatggttacacaccgatcaatatgaaaataaagtttacatgcttccaaagcatcttgatgaaaaagttgctgctttgcacctagatcatcttagtgtagagctagaaacgctttcagaagaacaagcagattatattggcgttacagttaaaggtccttataaacccgattattaccgctactaagaaaataatagtagtcataaaaaaaccccgcaaaagcggggttttttatttgtacaggtattcgattatgcttcaaagggtactatagaaacgaaagatttgttatcttttttctttgtaaactttacaacaccatctactctagcgtgaagcgtatgatctttccctaggtaaacattttcaccagggtagtgagctgttccacgttgacggatgatgatgttccctgcacgtgcagcttgaccaccaaagatctttacgcctaagcgtttcgattctgattctctaccgtttttcgaactacctactccttttttgtgtgccatgatcgtatggttttaagtgtttattttgaaagggcagcaatcaaatctgcttttttcattgaagaaattccttcaatacctttctttttagctgcttcttttaattctgctacggttagtttgctgtaatctaccgcctcaactttttttgctgctggctttttagctgcaggttttgctgttgctttcttggctacaggttttttctccgctttggaaggtgctgctacngcttttgcaggagctgcttttggctttgcaccactagcctgaatactttcaataactagttctgtcaaagcttgacggtgtccgtttttaacacggtacccttttcttctctttttcttaaatacgatgactttgtcacctttgaggtgacttaccacttttgcttctacagaagctccagcgatagccggggcgccaagggtcactttctttccatcgtctagcaagtatactttgtcaaaagaaactttcgctccttctttgtctgccaaacggtgtacaaaaagcttttggtcttgcacaactttaaattgctgccctgctatttctactattgcgtacattttcgtttgtttttatggacggcaaatatagcgatttttaaaacaaaacaaacatttttcttttattccttgcctattgcatactttcctgaaccagtaaaaaaaagcgttaaaaatgcaaagaaatagacaaaggctttttctttattggaaaaaggatctccatcatgggcaatcacaaaggcaaccaacatagtgagcgttgggaaaagggtcacaagacgagtcttccatcctaaaataatcaaaataggagcaacaaattcgccaatcgtagcaaggattagagaaaaggtagggccaatcccaatagggtcaccaaactcaaaatttccttgaataacttttaagaattttccataaccgtgagttagcatcccgacggaaaatccaacacgcataataaataaaccgaggtcaattgaagtttttttcatgataggggtttttataatttaatcctaaggtactcaattttaaagataaaatttaatcgtattatttattcctacttcaaaagtagttgatgctttccagcctaattctttttcaattttggatgcatctattgcatancgatagtcatgccccaaacgatccgtaacaaattcaatgagtttnagagaggntccttcaggacggcttaactttttatcaacctgctgaattaaatgatgtactaaatctaaatttttctgttcattatttccccctagggcataagtttcaccaggtttgcctttatgtaaaatcagatctattgcttcagcgtgatcctctacgaatagccaatcgcgaatgttgtctcctttaccatataccggtaggggtttttcagcaactatatttttgatcattaaaggaataagcttttctgaatgttgccctgggccgtaattattggaacaattagacagtactacaggcaatccataggtgtgaaaatacgcccgtaccaaatgatcagaagaagcctttgaagccgaatagggagaacgagggtcataagaagtcttttcagtgaaatatccttcagtacccaaactaccgaaaacctcatcggtagaaatatggtaaaaacgttggttctgggcattgttgccccaatgctgtcgtgccgcttccaaaagattcaacgttccttgaatattggtctgagcaaaa

SEQ ID NO: 1534 - DNA, 4000 bp, Escherichia coli
  misc_feature (2)..(17): n is a, c, g, or t
  misc_feature (19)..(21): n is a, c, g, or t
  misc_feature (23)..(42): n is a, c, g, or t
  misc_feature (44)..(49): n is a, c, g, or t
  misc_feature (51)..(52): n is a, c, g, or t
  misc_feature (58)..(65): n is a, c, g, or t
  misc_feature (67)..(71): n is a, c, g, or t
  misc_feature (75)..(79): n is a, c, g, or t
  misc_feature (81)..(91): n is a, c, g, or t
  misc_feature (93)..(95): n is a, c, g, or t
  misc_feature (100)..(104): n is a, c, g, or t
  misc_feature (106)..(108): n is a, c, g, or t
  misc_feature (113)..(117): n is a, c, g, or t
  misc_feature (121)..(131): n is a, c, g, or t
  misc_feature (133)..(134): n is a, c, g, or t
  misc_feature (136)..(136): n is a, c, g, or t
  misc_feature (143)..(146): n is a, c, g, or t
  misc_feature (148)..(148): n is a, c, g, or t
  misc_feature (152)..(153): n is a, c, g, or t
  misc_feature (161)..(161): n is a, c, g, or t
  misc_feature (163)..(163): n is a, c, g, or t
  misc_feature (186)..(186): n is a, c, g, or t
  misc_feature (190)..(190): n is a, c, g, or t
  misc_feature (196)..(196): n is a, c, g, or t
  misc_feature (224)..(224): n is a, c, g, or t
  misc_feature (229)..(229): n is a, c, g, or t
  misc_feature (263)..(263): n is a, c, g, or t
  misc_feature (329)..(329): n is a, c, g, or t
  misc_feature (334)..(335): n is a, c, g, or t
  misc_feature (341)..(341): n is a, c, g, or t
  misc_feature (344)..(344): n is a, c, g, or t
  misc_feature (352)..(352): n is a, c, g, or t
  misc_feature (500)..(500): n is a, c, g, or t
  misc_feature (542)..(542): n is a, c, g, or t
  misc_feature (763)..(763): n is a, c, g, or t
  misc_feature (879)..(879): n is a, c, g, or t
  misc_feature (882)..(882): n is a, c, g, or t
  misc_feature (918)..(918): n is a, c, g, or t
  misc_feature (1008)..(1008): n is a, c, g, or t
  misc_feature (1473)..(1473): n is a, c, g, or t
  misc_feature (1677)..(1677): n is a, c, g, or t
  misc_feature (2223)..(2223): n is a, c, g, or t
  misc_feature (2734)..(2734): n is a, c, g, or t
  misc_feature (2759)..(2759): n is a, c, g, or t
  misc_feature (3176)..(3176): n is a, c, g, or t
  misc_feature (3341)..(3341): n is a, c, g, or t
  misc_feature (3347)..(3347): n is a, c, g, or t
  misc_feature (3381)..(3381): n is a, c, g, or t
  misc_feature (3801)..(3801): n is a, c, g, or t
  misc_feature (3840)..(3840): n is a, c, g, or t
  misc_feature (3876)..(3876): n is a, c, g, or t
annnnnnnnnnnnnnnncnnnannnnnnnnnnnnnnnnnnnntnnnnnngnntttttnnnnnnnntnnnnntttnnnnntnnnnnnnnnnnannnttttnnnnntnnnaaaannnnnaaannnnnnnnnnntnntnttttttnnnncngcannttttttcncngaatgctgtcggatgcctctctncaantgtccncacgatttaaaacttttccataattttntccgnccattccggaggatattcagcattacgggcctcntccagaacagtatcactgagagtattatttccaagcggatgcaggatgtgcgctccatgggctaancctanntcctgnganacttccancgcacggttggtcatactgaatttgacccatttgcctgcaaaccattcaagtactatttctccaaaaatcaactgaatctgctgaatattatctccatcatcaatccagaaaaaaccgtgagcatccgctctattttcacaacataangtgtgcttttttagaccattcaccacttcctctgactttttngaaatgatgagataaaattgacaatgtctcataaatcagtgctctgtgtcttgtcttttcctgctgtttcgctgattatattgattgaactttaagcgttttataaaaacagcagagagtctgttttgaatgaaggtgaaccataaaatcgattttaacagccatgagtctcatacgagtattaatcaacggatccaaaggtcggatgggtcaggaatccntcaaggcggtcagcgcggatgcagaattggatttagtcgcacaaactgatttgagtgataatctagctcaaatcattgaacaatccaaggcccaagttgtgctggacttcacaacngcngcggttgccatggaagtttcagcgagtatcattcantcaggcgcacgtcccgtaatcggtaccagcggcttacttccagaacaagttgctgaacttaaaaaactttgtaaagaacaaaacatcggnggtgttattgcgccgaattttgcgattggcgcagtgctgatgatgaaatattctcaggatgcagcccggtatttcccgcaggcagaagttattgaactgcatcataacggtaaactggatgcgccttcaggaaccgcaatcaagaccgcaaatttaattgctgaagcacgtgactcagttccgcaaaaaattgcagaaaaagaaattcttcccggagcacgcggagccaatgcagaagaaatccgcatccactctatacgtcttcccgggctggttgcacatcaggaagtgcttttcggcggacaaagccagacattgaccatccggcacgattcaacacaccgtgactctttcatgcctggtgtttgccttgcctgtaaaaaagtcatggatttgaacgaactagtttacggactggagcatctcctttaaaagaaaaacctgtctaaaattcattcacctgcngtgtttttctgaccacgtggatgaagttcatggtagaccttgaaaaaatcaggacggtttacatgtgcatactgcagagttgcgtccagactgacataaccgaataattgcttaatatccgacaagtcaatcccgttctgcagtaggtgtaccgcaaatgagtgacgtaatattctcggattaatacgactggtgatgcctgcncggagagcatgttttttgatcatagaccaaaatcctaccctgctcattcttgtaccgttacgtccgggaaacaaacacgaatcttccggatgtagtaaacgtccggctcttgcctgctcaagataaggccgcagtacctcaaccgcggttgaagtcattggtaccatgcgttcacgtttggaacgtactttcaaaaattctaaatccagaaacaaatcctctacatccagtccgagcagttcgttgactttaagtccgcttgaataaagcagttccagcattgctctgtcacgcaagcccagataatgagcgagcgaaggtgcttcaagcagggctacaacctcttctgttgacaaaatttctggtgcgtcaggaatgatttccggaaaacggagatgatgtgccggactggttttgatcaaaccgcttaattcaaggtgatcgaggaatagacgcagtgaggaaatgtgtctcgctaaagttcttggtttgtaggattcccgcaggaaggcaaggtaattttcaatgtcatcagagctaagtttncgaatctggaccagcagcttttgactgtccgaatcctcctcatcaagctcgagccactttaagaatttacgcagatcaagacggtgactctggatactgtttgtagaatatttttttgtgtgaagcgagtctaaaaactctaaaaccagcggttgcatgagattcaactggtcaagggggaagattaaaatttgttttgaagaatatgtctgctgtcgaaaagcagaaaacccgcgatgccgtgtgtgaaagataagcttttgtttccttggccacgcaaggtggagtaatgtggtagaaggtttaggcgtcctgctcatcggcaggctggctcaccccctccagggacgaactcctttctgaaaaaatcaggaagcaaaagtttcacatcacgtacatcgcagactctaatgctctgtattaacaataaccagctctgtgagaacaatcaaggatgatgcaagaaaaaagcaaattatctttaaatcagcagatattttagctcttcagnaaaaaaacctgaagtgcttgaaatnttgcgagctgtgttttcctgtcttgtttgcagaaaattttcgatttatttttctgttaaaacctcatccagtttgtagcataaattatccagatcttcttcaataccttcgaactttgagactctttttttcaagctcagcagtttatctgctaaatttaaggcaaccagtaaagcaacgtttgttggaccaaatgcgtcagtgtgttctgtgacttccgcgatctgctggtccagaaatttttccacttcacggacgtgttcttctccataaggactagaaattgagaaacggttaccgctgatatttatctggtattgcctactgtcgttatcctccacaataaccccttttctgcaaacgatgtttttgtaatccgcagcataacggatcacggaatttattttttaatgagcnacatccagagaagctgatgcgaaatactacaggatgtgataaagtaaaccttgcgctaacttataggataatgctttcgtaaaaacccctgaactaatgatctgtcatctcgaacgaagagagagatcttaaaagtgtcagtacttaacataaaacagctttctngctttntaagcaagctcacgtttttatgactttttactgnttcagtataggataattttctaacagtttttagctgagaaagcaatccgattttggtttgagtaatgaaagtaacacatttcgtttagaaagttaatcatgaaatctccccatttaagcaaattaaatactgaatcacgtcaggaatatggggcattgctgttgttggatcaacttatgcgttatgaactgcccaggcaggaaaaagataatttgcaggaaacagtcgctcaactggaagaagaagtagcagaacttaaaaaaggtttttttcattcagatgaacaggatcaggaactgaattttgaaaaagatgaactgagtgaagcacgggaggcactctcagaggttgaaaaagaaatggaggaaaacgaacattgccgactcaatctcgcgctgatagaaacggatgatgaaggcntggaaccgctgctgaagtttatggaggaaggtggaacantgactgtgagtgaagaaaatttttatctgccgaccncaaaaggagaagaggtttatcaacatttagtggaacagctcgaagcgtatgttgtgcattttgacgtctttgcttatgttgatctggaagaaggcgcattcggtgatccgaaaacggatttgct

SEQ ID NO: 1535 - DNA, 4000 bp, Escherichia coli
  misc_feature (2685)..(2685): n is a, c, g, or t
gggcctttgcccgcgccgcggattgttcgagttctgcggcgatgtcctcgtcgggcccgctggccgattgggcgcgatgccacgcgcggcgatcagggtctcgcgcagcatcggtcgcgccggccagggcgcggtgaacgttctggcgatcagccaccggtgctgtccggtagatcgcggagcggaccagcggatgccggaaggcgacacgagcgccgatcgacaccagcccctcccgttcggctggggcggcagcgtcgaaaccgatgcccagatcactggccgcccgccacagcagcgcgggatcgccctgcgggtcggcggcagccaccaacagcagcatccgcgtcggtgccggcagagtcgcgatgcggcggcggaagctggcctcgacccgatcccgcaccggcacgctctgaggtaaaccgaagccgccggccagcccctctgccgaccagccgtgtggcaactccagcagggcgagcgggttgcccgcagattcggcgacgatgcgctcgctcacctgcccgtcgagcttgccgggaattgccgacatcagcagtgtgcgagcgtccacatcggccagcccggtcaggttcacttccggcagcccggcgaagggatcggtctcgtccccgtcgcggatcccgacgaggaatgcgaccgactcgccgtaaagacggcgggccacgaatgccagcgtttgagccgaagcctggtcgagccactgcgcgtcatcaatcaggcagagaagcggctggctctcggcctgaccggacagcagactcaacacggcaaggctgaccaggaaccggtccggcggtggtccggcgcgcagaccgaaggcgatgcgcagcgcggccgcctggggctctggaaggcggtcgaggtgatcgagcatcggtctgcacagttgatggaccgcggcgtagggcagttccatttccgactcgaccccgtcggcgcgggccacgtgaaagtccgggcctgtttcggcggcgtactgcatgagggctgatttaccgatcccgggttcaccgcgcagcaccatcacccggctgcggccagaccgggcctcggcgatcagggcgtcgatcagccggcactgctcgttacgaccgcgcagcatcatggcaggcctccttctaagccctcagccgcccattgtccgcgcctacggtccgccacgcgtcggcacggatgaacgggcgcatctgcactgggcacttactggggtcacaccgatgcgaccaggccccgtctggccggacgctgttcgcagaggcatcggcctcaccaccgcgtcacaccgctgactagttctggaggaacagcacatgccgttcgtcaacgtcaaactcgttgaaggcgtctttaccgaaaagcagaagcacgacatggccgcgagactcaccgacgtcatggtcgagttcgaaggatctgaggcgttccgcgaggtcgtctgggtcctgatcgaggagctgcaccccgacggctggcacatcggcggcgagcccttcttcggccccgccacgctgatgagtgtgctgggacgttccaaagccgcctacgacgctatcgacggcacccccaccacccacgacgaattcgtcgccgagtcaccggtcatcccccgctagccccgccctcccaacagccacccgcatcgcggcgaactcaaggaaaacacccatgtcctacatcggtaaggaaaacaccaccgacaccgtcgagggcggcgaccatctgctgctgttcggactgttcaccaagctcagcaaggccgcaagggttcatccgcggccgggcgtagcggccgtgacgacgtcggtaggtatgagcgcgcgccaggtggccagcatgcgagacgctgagaacctggccagcgcctggaatgcggccctgcacgtcgcggtggacggccgcccgtacctcgagctcgagacagcccagggcccggagcgcgtcgacctggtactcgcgggtaggttctagtgtcctcaagcatcacgcagccgtcggttggctgcaaatcgtcagaaaaaagtggccatggatgacagcaatgttgctatccgactgaaagggcaacccccgatgaagctgggttaccactcgatcacatggggccagggcgtcgtcggtgacccctcaggggtcacctcgatcaaggacctctactaccgctcccccggctcgatggaacaggccatcaccgacatcgccgccgccggctacgccgggaccgaaatgtttgacggcaatcttgccgacttcgctgccacaccagaggttctcaccgagtcgctgtacaacagcggccttgaactgatcagcgtgtacaccggggcgaattttatctactcggatgtgttgcccgacgagttgtaccggatcaaccgggccgcggaactagccgtgatgttcggggcccgacgcctagtggtcggcggcggggcacgacgcgcggccggcaccaccaacgaggactacacgctccttggtgcaggacttgaccgcgtggtggacattgccgagcagcatggactcgcggccagctatcacccgcaccttggcacgatcgccgagagcccggatgagatcgagcgggtcttcaccagtagtcgcatcgccttctgccccgacaccgcccacctggcagccggcggcggtgacccagcggcnttgatcagggcacattcggatcgcatcgcacacgtccatctcaaagatctcaccacggcaccattcgcgttccaaccgctcggccagggtgacctcgactttgacgaaatcctgtccgctgtccgtgaagtcgggtatgacgattggctggtggtcgagctggacacctatgacggcgatccgaagaccgccgccgagatcagcaagaaattcctggagacccggctcggctgaaaagccgggcgtgcagctaccgctgaggaccatctggtcggttggtgggcgctcctcgcatcgaagtcctgtcacgccccacttggaggcatcatgaaacgctctatccgatccatcgcggtcaccaccgcactcgcagcagtgctcaccaccgtattattgaccggctgcgcctttcccggcggcagtcagactctggcgaagccgacctccaccgtggccgatcaggccctcgaggagatcgccgggcaggttttcagcaagggtcccaacggtgaaaccgcctcaccaccaagcagtgccgacctcaccgacgaggaggtagcgcaaatcaagtcgttgggactcaaagccgccatcgtcatgcacacgggcggcgacgactggtcgcaggcccagatcaatggcctcaattccgagttcgaacgtttgggcatcgaggtcgtcgccaccaccgacgccaagttcgacccgaaaacccaggtcgccaacctgcagacggtgatggccaagaagccggacatcatcgtgtcgctgcccaccgacccggtcgccaccgccgcggcctaccgcgaagcggccgcagggggcgccaagctggtcttcatggacaatatcccggacggtttcgaagccggaaaggattacgtctcagcggtttccgcggacaattacggcaacggtgtcatatccgcgcacctcatggccagagcgctcggtggccagggaaagatcggcgttgtctaccacgatgccgacttcttcgtcaccaagcagcgctacgacggcttccgcaccaccatggagcaggactatccaggcatcgagatcatagagagtaagggcgtcggcggcccggacttcgccacccaggcacagaacgccgccgccgcgatgttgagcaaacactccgagctggacgggatctgggcggtgtgggacgtgccggcagagggtgtgctggccgccgcccgcgccgccgggcgcctgaacctcatgatcgcaaccgaggacctcggcaagatcgtcgcgatcaatatggccaggaacaccatggtcgttggcctgggcgcccaggtcc

SEQ ID NO: 1536 - DNA, 4000 bp, Escherichia coli
  misc_feature (43)..(43): n is a, c, g, or t
  misc_feature (72)..(72): n is a, c, g, or t
  misc_feature (853)..(853): n is a, c, g, or t
  misc_feature (1035)..(1035): n is a, c, g, or t
  misc_feature (1132)..(1132): n is a, c, g, or t
  misc_feature (1177)..(1177): n is a, c, g, or t
  misc_feature (1231)..(1231): n is a, c, g, or t
  misc_feature (1246)..(1246): n is a, c, g, or t
  misc_feature (1249)..(1249): n is a, c, g, or t
  misc_feature (1255)..(1255): n is a, c, g, or t
  misc_feature (1351)..(1351): n is a, c, g, or t
  misc_feature (1479)..(1479): n is a, c, g, or t
  misc_feature (1515)..(1515): n is a, c, g, or t
  misc_feature (1635)..(1635): n is a, c, g, or t
  misc_feature (1647)..(1647): n is a, c, g, or t
  misc_feature (2526)..(2526): n is a, c, g, or t
  misc_feature (2538)..(2538): n is a, c, g, or t
  misc_feature (2676)..(2676): n is a, c, g, or t
  misc_feature (2720)..(2720): n is a, c, g, or t
  misc_feature (2730)..(2730): n is a, c, g, or t
  misc_feature (2739)..(2739): n is a, c, g, or t
  misc_feature (2748)..(2748): n is a, c, g, or t
  misc_feature (2914)..(2914): n is a, c, g, or t
  misc_feature (2989)..(2989): n is a, c, g, or t
  misc_feature (3001)..(3001): n is a, c, g, or t
  misc_feature (3163)..(3163): n is a, c, g, or t
  misc_feature (3166)..(3166): n is a, c, g, or t
  misc_feature (3202)..(3202): n is a, c, g, or t
  misc_feature (3239)..(3239): n is a, c, g, or t
  misc_feature (3271)..(3271): n is a, c, g, or t
  misc_feature (3289)..(3289): n is a, c, g, or t
  misc_feature (3681)..(3681): n is a, c, g, or t
  misc_feature (3693)..(3693): n is a, c, g, or t
  misc_feature (3807)..(3807): n is a, c, g, or t
  misc_feature (3810)..(3810): n is a, c, g, or t
  misc_feature (3867)..(3867): n is a, c, g, or t
  misc_feature (3885)..(3885): n is a, c, g, or t
  misc_feature (3933)..(3933): n is a, c, g, or t
  misc_feature (3963)..(3963): n is a, c, g, or t
  misc_feature (3987)..(3987): n is a, c, g, or t
  misc_feature (3999)..(3999): n is a, c, g, or t
atagtccgctgtaatggtggatgtcgcattggctgcgtcagcngctttggtttcagggcttacaggggttanccatgtgccttggcaatacgcggagcttaagtaacgaccttggcgctgttgagcttcaggagatgacttatcgacatagtattgttcgaaaaacttttgcccaggatagctttcttgtagtgcttgttttagcgattgttgttcgtctgaaatagacgtggttggtgttgcagcatagcttgtgattgagctaccacaaagaagggtaaatatcgcagtcgctaaaggattaaatttaaactgatgcttcatgtgtctcatttaccaagtatgcttaaaacgcaattaattattgtcgcatcatagagaaaaagttgataagtggctacacttagcactttaaaaactcagcctgtattagaatttatcgcaaatgaatacacaacgtgaacaattgatacaaacatggatttcatctgtacttggttcagatcaatttgaaattaactttttagcaggcgatgcaagtttccgtcgttatgcacgaatcaagttgaataataaaacatttatgctgatggatgcaccaccagaaaaagaagattgtgtgccttttgtgacgattgatgaattttttgatacgaacggtgttcgtgtaccacatattgtggcgaaagatttggagcaaggcttcttattgcttgaagattttggtgatgtgctactgtctacacagctcgatgacaagactgtcgatgcacattatgagcaaagttttaagcagttgattcaattgcaatctattgatggtgaaggtcatttcccagcttattcttatganaagttaatgaccgaaatgtcgctattgacagattggttattgccaagtttacagattcaaccttctgatgatgagtctgcgctgattaaacgtacatttgcaattttagccaatgctgctttggctcagcctcaagtgattgtacatcgtgatttccatagtcgtaatctcatgcttttggnagatgagcaagagcaaggcgtaattgactttcaggatgctgtgattggtgcagatacttatgatctgatctcaattacacgtgatgcgtatgtacantggaatcctgagcgcgtttatcattggtttaaagtgttttatganctattgccagcttctgccaaagaagggcgtgactttgaacagtttaagcaagangctgacctgatggcnatncaacgncatattaaaattttaggtatttttgtgcgtttatttgaacgtgacggaaaatcaggttatctgaaagatttaccacgtgtgatgtggtatttactngaagaaagcaaaccttatgcagaactacaacctttcatgcaatttatttgcgataaagtgatgccgaaatttgaagcaaaatatggcaaatatgaggttgttgcagcatgaaagcaatgattttggcngcggggcttggaaaccgtatgcgtcctttaacattntataaaccgaaacctctgcttgaagttggtggcaaaccactgatcgtttggcatattgaaaaactcaagcaaattggggtcacagaaattgtgatcaattctgcatggttggccgatgtnttgattggtgcncttggcgatggttcgcagtttggagtgactattcgttggacgcgtgaagaagaggggcttgaaacagcgggtggtattatcaatgctctaccactgttggggacagaaccgtttattttagtgaatggcgatgtttggaccacttttgattttgcatctttacttgatgtgcaattggacgccgattttgcgcatctcgtatttgtacccaacccgacacaacatcccaaaggcgactttatcttaaatcaagggcgtgcttatacctttgaacaagagcagtcaggcgaagcactgacttatagtggtgttgcagttatacatccacagatgtttaagggattggaagcaggtaagcgtccgttggctccattgctaaaagaagcgatgtctgctggaaaaatttctgccgagaaaatgcaagccgcatgggtggatgttggcacacctgagcgattaagtgatctagatctacagattcgtcaaggtatgtacgtttaagtgcataatcactaagcgttagctactgttccacggctgagaaatcggtatacttcagtttaattttattgagatgtcttctttatgcatccattttttcaagacttaaagcaaggtagtcaaaagcttggcttagatttgagtgaagaagcattaaatttattgctgaagtatcaagacgcacttgtgctgtggaacaaagcttacaatttaacagcgattcgcgatcctaaagaaatgctggtgaagcatttattagatagtttaagtattttaaaagatttgccgaaaggtcgtttgctggatattggtacaggcggtggtatgccgggcatgattattgctctatgccaacctgagcgccaatgtgttttgctngattccaatggnaaaaaaattcgttttttaaagcagtttattgcagacttaaaattaaccaatgtaattgcagttcaaacgcgtgttgaaaatgaagatagcatccatgatttgggtcagtttgatgtgattaccagtcgtgcatttgcntctttaaccgattttatcaatgcatcgaagccttatatgcaccnagacagcatnattgcgtcnatgaaaggnttggttccgcatgacgaagttgaagcgttcaaaaacgaatttagttgtgacattattgcgttaaaagttccacgtttggacgaacaacgacacttacttttattaaaacgtatctaaaaaaattcaaaggattgggcgggtcatggcacaaattattgcgattgcnaaccaaaaaggtggtgtaggtaaaaccacaaccgcagtaaatttggctgcatctttagcagtacttaaaaagcgngttttattggtngatatggactcgcaaggcaatgcgaccatgggttcaggcattcaaaaaaatgacctactgtattcagtgaccgatgttttactgggtgaagtgcctatagagactgcgattaccaaggcggaagtgggttataaggtcttgggtgcaaaccgtgatttggcnggngttgaacttgcgattgctgagcaagaagggcgtgantttattctgcgtgatgcgttgcaagaaattgaacaancatatgactacatcattgtggactgtgcgccnagcttaagcttgatcacngttaatgcactggcagcggtggatggtgtgatgattccaatgcagtgtgaatactatgctttggaaggcttggcagatttaacacagaccattgatcgcattcaacaagcattgaatcctgagttaaaaattattggtgttctacgcaccatgtatgatgcacgtaatgcactgacacgtgatgtgtctgaagaattagaacaatactttggcaaaaaactctatgacacggtcattccacgtaatgtgcgtctagctgaagcacctgcgcatggtttgcctgtgatttattttgaaaaaagctcgaagggcgcagttgcttatttacatttagcagctgaaatgattaagaaaagcaaagtgaaaaaaggaagtaacgcatgaccgttaanaaacgtggactngcaaaaggtcgtggtttagatgccttactcggttccattcaaaaagagaaattacaacttgaagcacaagctcttgatcacggtcagctaaaacaaattgatgtgcatttattncancgtggtgaatatcagccacgtcgttttattaatgagcaagacttacaagagttagcngcatcgattgaaaaacanggtgtgatgcagccgattgtgattcgtccaattgataatgaaaagcanccctatgaaattattgcgggtgagcgtcgntggcgtgcggctcaacttgctggnttaacgcaagtnc

SEQ ID NO: 1537 - DNA, 4000 bp, Escherichia coli
  misc_feature (1215)..(1215): n is a, c, g, or t
  misc_feature (1496)..(1496): n is a, c, g, or t
  misc_feature (1990)..(1990): n is a, c, g, or t
  misc_feature (2960)..(2960): n is a, c, g, or t
  misc_feature (3061)..(3061): n is a, c, g, or t
  misc_feature (3092)..(3092): n is a, c, g, or t
  misc_feature (3175)..(3175): n is a, c, g, or t
  misc_feature (3556)..(3556): n is a, c, g, or t
aatgctaaaactatagatatgataaccaacaccgtagcctttgttctgttggaagtggaaacacctccgtctaggattccagcacccaagaatattaacccgaagaaaaataacagacctgtaagtgcatgcagtccatcaacgaatgtatgggctattcctgcataggatagaactataccagtcaatccaattgcagttagtccgccaccaggcatgattagttcccaattactcatctaagcttgttgaaaaatattatatattaatcgttttgcaatccaggaatagattcgaagaaattaaatcttatgttattccgctgacaataattgggattaaaagaaatatttgaggtttcaaaaccacgaatcataattttacttgttataacggctgtaacatccatgtatgctggaagtaaatttgtaggtcctgagctaagcgaattgggaatattgcatattataattgcaggatctcttgcttcggctggatctagtgcactcaaccatttttacgatagagatattgatctaaaaatgaagcgaacaagcaaaagaccaatcccatcaggtagaattaagcccattacggtttttgtgtatggtctaggtgtaagcataacttctgtggtttatgcagcattgactttgaattatttgtgtacgttctttattgctttgggcatatttttttatgttgtaatttatacagtgtggctgaaacgccttaactcctccaatattgtgataggtggatttgcaggtagtgctgcgtctatggctggttggtctgcagctacaggttctattgatattctaggatttttgataggctttttgatttttgtgtggaccccatctcatttttggtgtctagccatgaagattcgtgatgagtatgcggaagtaaaaattccaatgttacctgttttgattggcatggaaagaacgtcgaagtatatacttgccaatactatcattttgttaccatattcgttaatgttgtatgcatttggtatgggagtaatctatactgtatttgctgctgttgcaggtggactcatgctgttatatcattacaagctaacaaagacacctacatcagattttgcgtggaaggcatacaaggtgactgcaccatatctaacgataatctttataggaattgctttggatgcagctttccactttaggtttagttaaatattgntttttgtagcaggaaaacttgattcataatcattttctaatgattttttattttccaactcaacatcgtcctcttcatttttgttagaaacaatctctattctacgcgtatttttattcagccaagtgacattgattaatcccataatttccagatcaagcaatgttttgttaattacatcttcgtgtaaaagatagccatcttttgtaagacttttagttagggatgtgtcagtgatagagcctgattcttttaccttttcaaatactaaatttttgtantgcattattcatcatctataaaaagtctcatccgtagacttgggaattatgtttgatacctcatcttttatcgatgtataccattggtctatttgcttagtgatagatggtttaaccttctttagtgctaatgcaaagtcattgctgttaatttttttagaattattctgcattgcatttacaactgcctctctgcatagagatgccaggtcagcaccagtatagttttgcgtagaaacagcaatctcatccagatcaacatcactagtaagcggcatcttttcagttaatatttttattatctccaatctacctttctcgtccggtggttgaataaataaaacaatatcaagcctgccagtacgaagcatagaattatcaatcagatctggtctatttgtaattccaacaattatgatcctagatgtaccaccttcttccatctcagttaacatttgactaagtattgtttccccacggtttccttcttctgntgttcttgattttgccagagaatctaattcatcaaaaatgattacacatggtgcagatgtctttgctttcctgaaaatttctctaattgctttttcggattcaccaacccactttgataatatttccggacccctgaccaaaatcatgtttgcaccacattcagctgctagtgctctagcaagaatggtctttccacatccaggcggtccgtaaagcaacacacccttaggtggttttattcccatcttagtaaatttgctagggtcattgacagatgtgatcatgttgtcctctaacgttttttttgcatagtctaaaccacccacatctttccaccaaacttttgctcgttcaacataaaactcacgcatagctgttggtacaacatcatgcattgcatcgtaaaagtcacgtgattttatttccatcgattgtaacatcttagacggtatacgctcattttcaagatcaatttcgggcagataacgtcgtattgcttttatggcgctctccctacacagagatttaatatctgcaccagtatacccatgaagctcggatgcaagatttttcaaatctatatcatccgaaagtggcattccacgtgtatgtatatgtaaaatctccaatctaccatctgagttaggaactgaaatttccatttctctgtcaaacctacccggtcttcttaacgcaggatctatactgtcaggacgattagacgctccaagtacgataacatttcctctttcagtcaatccatccattagtgctaaaagctgggctactactcgtttttcaacatcgccataagcttcttctctctttggagcaattgcatcaatttcatcaatgaagattatactgggtgagttgtcttttgcttccttgaaaatctctcgaagtctagcttcagtttccccataatacttgttcatgatttcaggaccgttaattaaatacatgttngcatctgattcacttgcaataaccttagcaaggagtgtctttccacatccaggcggtccgtagagcaaaactccgctatgtggttctactccaagcctggnaaaaagttctggatgcctcagcggtagttcnacaatttcacgcattgcggttatctcaactcccagcccaccaatttcttcatatgtgattctattttttttgtcagttgccgnctcagaaagtatttttagattggagagacgatcaattttaacaactcgttttggtgagatcttactgatcttaaaatccatcgagtttcccaaaatcattactgaaatctcatcaccactagttaatggtagacccttcaatctattttttacaaaatcagtgaactccttatcaatagtcacaacgtcatttattggcataagtacgacagttttggcggtttttacttcaactttttgaacttcaactatgtcatcaagtgtcagcccaacgttctttctagtttgaccatcgatattgacgcaatcagggtttttttcatcttcattagctggccaaacaacagcactgctcgttctttttccttttatctcaataanatcaccaggtgcaacatgtagatagtccattgcttcaggaccaattctagctcttttcttaccaacatctctttgttttgattctcctattcgcatttgcagtggctgtgtatctttttgtggcaacaaatcacctatttcatgtcaactgacattctactcatatttagtacttcaaactgacttactccatctacttttcgtactgcattttctaatgaatccatctgacctgctttatcatctaaaataaattcagcattgaggtaatacagaccaaaagcaagtggaagtttttggaattttttaagctgaatattatcttttagtgtgttttttattgattctgccaaattgtccaaatcaatttctgtcccagtaggaagaatttttgtaatcagaagtaattgtgccatttttaaggcccctgaaaattacatgatg

SEQ ID NO: 1538 - DNA, 4000 bp, Escherichia coli
  misc_feature (1)..(1): n is a, c, g, or t
  misc_feature (4)..(7): n is a, c, g, or t
  misc_feature (9)..(11): n is a, c, g, or t
  misc_feature (13)..(19): n is a, c, g, or t
  misc_feature (22)..(24): n is a, c, g, or t
  misc_feature (26)..(26): n is a, c, g, or t
  misc_feature (28)..(30): n is a, c, g, or t
  misc_feature (32)..(36): n is a, c, g, or t
  misc_feature (40)..(40): n is a, c, g, or t
  misc_feature (42)..(42): n is a, c, g, or t
  misc_feature (45)..(47): n is a, c, g, or t
  misc_feature (49)..(53): n is a, c, g, or t
  misc_feature (55)..(57): n is a, c, g, or t
  misc_feature (59)..(61): n is a, c, g, or t
  misc_feature (64)..(69): n is a, c, g, or t
  misc_feature (71)..(71): n is a, c, g, or t
  misc_feature (74)..(76): n is a, c, g, or t
  misc_feature (79)..(81): n is a, c, g, or t
  misc_feature (85)..(86): n is a, c, g, or t
  misc_feature (88)..(88): n is a, c, g, or t
  misc_feature (91)..(92): n is a, c, g, or t
  misc_feature (94)..(96): n is a, c, g, or t
  misc_feature (99)..(100): n is a, c, g, or t
  misc_feature (102)..(106): n is a, c, g, or t
  misc_feature (110)..(114): n is a, c, g, or t
  misc_feature (116)..(122): n is a, c, g, or t
  misc_feature (124)..(125): n is a, c, g, or t
  misc_feature (128)..(130): n is a, c, g, or t
  misc_feature (132)..(137): n is a, c, g, or t
  misc_feature (139)..(149): n is a, c, g, or t
  misc_feature (152)..(152): n is a, c, g, or t
  misc_feature (154)..(158): n is a, c, g, or t
  misc_feature (162)..(166): n is a, c, g, or t
  misc_feature (168)..(172): n is a, c, g, or t
  misc_feature (174)..(180): n is a, c, g, or t
  misc_feature (186)..(190): n is a, c, g, or t
  misc_feature (193)..(197): n is a, c, g, or t
  misc_feature (199)..(203): n is a, c, g, or t
  misc_feature (205)..(206): n is a, c, g, or t
  misc_feature (208)..(210): n is a, c, g, or t
  misc_feature (213)..(213): n is a, c, g, or t
  misc_feature (215)..(217): n is a, c, g, or t
  misc_feature (219)..(225): n is a, c, g, or t
  misc_feature (227)..(231): n is a, c, g, or t
  misc_feature (234)..(236): n is a, c, g, or t
  misc_feature (238)..(239): n is a, c, g, or t
  misc_feature (241)..(245): n is a, c, g, or t
  misc_feature (247)..(247): n is a, c, g, or t
  misc_feature (249)..(251): n is a, c, g, or t
  misc_feature (254)..(259): n is a, c, g, or t
  misc_feature (261)..(261): n is a, c, g, or t
  misc_feature (265)..(269): n is a, c, g, or t
  misc_feature (271)..(271): n is a, c, g, or t
  misc_feature (273)..(273): n is a, c, g, or t
  misc_feature (275)..(276): n is a, c, g, or t
  misc_feature (280)..(280): n is a, c, g, or t
  misc_feature (282)..(283): n is a, c, g, or t
  misc_feature (285)..(285): n is a, c, g, or t
  misc_feature (289)..(296): n is a, c, g, or t
  misc_feature (298)..(298): n is a, c, g, or t
  misc_feature (301)..(305): n is a, c, g, or t
  misc_feature (307)..(311): n is a, c, g, or t
  misc_feature (314)..(317): n is a, c, g, or t
  misc_feature (319)..(323): n is a, c, g, or t
  misc_feature (325)..(325): n is a, c, g, or t
  misc_feature (327)..(328): n is a, c, g, or t
  misc_feature (331)..(331): n is a, c, g, or t
  misc_feature (333)..(334): n is a, c, g, or t
  misc_feature (337)..(337): n is a, c, g, or t
  misc_feature (339)..(339): n is a, c, g, or t
  misc_feature (344)..(344): n is a, c, g, or t
  misc_feature (346)..(346): n is a, c, g, or t
  misc_feature (351)..(352): n is a, c, g, or t
  misc_feature (355)..(355): n is a, c, g, or t
  misc_feature (357)..(357): n is a, c, g, or t
  misc_feature (359)..(360): n is a, c, g, or t
  misc_feature (362)..(363): n is a, c, g, or t
  misc_feature (366)..(366): n is a, c, g, or t
  misc_feature (372)..(372): n is a, c, g, or t
  misc_feature (374)..(376): n is a, c, g, or t
  misc_feature (378)..(378): n is a, c, g, or t
  misc_feature (380)..(380): n is a, c, g, or t
  misc_feature (382)..(382): n is a, c, g, or t
  misc_feature (385)..(388): n is a, c, g, or t
  misc_feature (390)..(395): n is a, c, g, or t
  misc_feature (397)..(398): n is a, c, g, or t
  misc_feature (401)..(401): n is a, c, g, or t
  misc_feature (403)..(404): n is a, c, g, or t
  misc_feature (407)..(407): n is a, c, g, or t
  misc_feature (409)..(410): n is a, c, g, or t
  misc_feature (415)..(417): n is a, c, g, or t
  misc_feature (421)..(421): n is a, c, g, or t
  misc_feature (423)..(426): n is a, c, g, or t
  misc_feature (428)..(428): n is a, c, g, or t
  misc_feature (430)..(430): n is a, c, g, or t
  misc_feature (432)..(433): n is a, c, g, or t
  misc_feature (437)..(438): n is a, c, g, or t
  misc_feature (440)..(445): n is a, c, g, or t
  misc_feature (448)..(454): n is a, c, g, or t
  misc_feature (457)..(459): n is a, c, g, or t
  misc_feature (462)..(466): n is a, c, g, or t
  misc_feature (468)..(468): n is a, c, g, or t
  misc_feature (473)..(474): n is a, c, g, or t
  misc_feature (476)..(476): n is a, c, g, or t
  misc_feature (478)..(478): n is a, c, g, or t
  misc_feature (481)..(482): n is a, c, g, or t
  misc_feature (484)..(484): n is a, c, g, or t
  misc_feature (487)..(489): n is a, c, g, or t
  misc_feature (491)..(491): n is a, c, g, or t
  misc_feature (495)..(499): n is a, c, g, or t
  misc_feature (502)..(503): n is a, c, g, or t
  misc_feature (506)..(506): n is a, c, g, or t
  misc_feature (510)..(514): n is a, c, g, or t
  misc_feature (516)..(517): n is a, c, g, or t
  misc_feature (519)..(520): n is a, c, g, or t
  misc_feature (522)..(523): n is a, c, g, or t
  misc_feature (525)..(531): n is a, c, g, or t
  misc_feature (536)..(537): n is a, c, g, or t
  misc_feature (539)..(540): n is a, c, g, or t
  misc_feature (544)..(547): n is a, c, g, or t
  misc_feature (549)..(553): n is a, c, g, or t
  misc_feature (555)..(560): n is a, c, g, or t
  misc_feature (562)..(562): n is a, c, g, or t
  misc_feature (567)..(568): n is a, c, g, or t
  misc_feature (571)..(572): n is a, c, g, or t
  misc_feature (574)..(574): n is a, c, g, or t
  misc_feature (576)..(577): n is a, c, g, or t
  misc_feature (579)..(582): n is a, c, g, or t
  misc_feature (584)..(586): n is a, c, g, or t
  misc_feature (588)..(588): n is a, c, g, or t
  misc_feature (591)..(595): n is a, c, g, or t
  misc_feature (598)..(598): n is a, c, g, or t
  misc_feature (601)..(601): n is a, c, g, or t
  misc_feature (603)..(605): n is a, c, g, or t
  misc_feature (608)..(608): n is a, c, g, or t
  misc_feature (612)..(613): n is a, c, g, or t
  misc_feature (615)..(615): n is a, c, g, or t
  misc_feature (622)..(623): n is a, c, g, or t
  misc_feature (625)..(625): n is a, c, g, or t
  misc_feature (628)..(628): n is a, c, g, or t
  misc_feature (630)..(631): n is a, c, g, or t
  misc_feature (634)..(634): n is a, c, g, or t
  misc_feature (637)..(641): n is a, c, g, or t
  misc_feature (644)..(644): n is a, c, g, or t
  misc_feature (647)..(653): n is a, c, g, or t
  misc_feature (657)..(657): n is a, c, g, or t
  misc_feature (659)..(664): n is a, c, g, or t
  misc_feature (666)..(666): n is a, c, g, or t
  misc_feature (668)..(668): n is a, c, g, or t
  misc_feature (671)..(671): n is a, c, g, or t
  misc_feature (673)..(673): n is a, c, g, or t
  misc_feature (675)..(675): n is a, c, g, or t
  misc_feature (678)..(679): n is a, c, g, or t
  misc_feature (681)..(687): n is a, c, g, or t
  misc_feature (690)..(691): n is a, c, g, or t
  misc_feature (694)..(696): n is a, c, g, or t
  misc_feature (698)..(699): n is a, c, g, or t
  misc_feature (701)..(703): n is a, c, g, or t
  misc_feature (705)..(705): n is a, c, g, or t
  misc_feature (707)..(707): n is a, c, g, or t
  misc_feature (709)..(710): n is a, c, g, or t
  misc_feature (712)..(713): n is a, c, g, or t
  misc_feature (715)..(722): n is a, c, g, or t
  misc_feature (725)..(731): n is a, c, g, or t
  misc_feature (733)..(738): n is a, c, g, or t
  misc_feature (740)..(747): n is a, c, g, or t
  misc_feature (749)..(751): n is a, c, g, or t
  misc_feature (753)..(758): n is a, c, g, or t
  misc_feature (760)..(765): n is a, c, g, or t
  misc_feature (767)..(768): n is a, c, g, or t
  misc_feature (771)..(772): n is a, c, g, or t
  misc_feature (776)..(776): n is a, c, g, or t
  misc_feature (779)..(780): n is a, c, g, or t
  misc_feature (782)..(783): n is a, c, g, or t
  misc_feature (785)..(786): n is a, c, g, or t
  misc_feature (788)..(788): n is a, c, g, or t
  misc_feature (790)..(791): n is a, c, g, or t
  misc_feature (793)..(793): n is a, c, g, or t
  misc_feature (795)..(795): n is a, c, g, or t
  misc_feature (798)..(801): n is a, c, g, or t
  misc_feature (803)..(803): n is a, c, g, or t
  misc_feature (805)..(805): n is a, c, g, or t
  misc_feature (808)..(809): n is a, c, g, or t
  misc_feature (811)..(815): n is a, c, g, or t
  misc_feature (817)..(825): n is a, c, g, or t
  misc_feature (827)..(827): n is a, c, g, or t
  misc_feature (833)..(836): n is a, c, g, or t
  misc_feature (844)..(847): n is a, c, g, or t
  misc_feature (850)..(855): n is a, c, g, or t
  misc_feature (857)..(862): n is a, c, g, or t
  misc_feature (864)..(871): n is a, c, g, or t
  misc_feature (873)..(878): n is a, c, g, or t
  misc_feature (880)..(882): n is a, c, g, or t
  misc_feature (884)..(888): n is a, c, g, or t
  misc_feature (890)..(892): n is a, c, g, or t
  misc_feature (894)..(895): n is a, c, g, or t
  misc_feature (902)..(902): n is a, c, g, or t
  misc_feature (905)..(907): n is a, c, g, or t
  misc_feature (911)..(917): n is a, c, g, or t
  misc_feature (922)..(923): n is a, c, g, or t
  misc_feature (925)..(926): n is a, c, g, or t
  misc_feature (929)..(931): n is a, c, g, or t
  misc_feature (938)..(945): n is a, c, g, or t
  misc_feature (947)..(948): n is a, c, g, or t
  misc_feature (950)..(950): n is a, c, g, or t
  misc_feature (952)..(952): n is a, c, g, or t
  misc_feature (954)..(956): n is a, c, g, or t
  misc_feature (958)..(958): n is a, c, g, or t
  misc_feature (960)..(960): n is a, c, g, or t
  misc_feature (966)..(973): n is a, c, g, or t
  misc_feature (975)..(975): n is a, c, g, or t
  misc_feature (977)..(977): n is a, c, g, or t
  misc_feature (979)..(981): n is a, c, g, or t
  misc_feature (983)..(983): n is a, c, g, or t
  misc_feature (986)..(990): n is a, c, g, or t
  misc_feature (992)..(992): n is a, c, g, or t
  misc_feature (1000)..(1001): n is a, c, g, or t
  misc_feature (1005)..(1005): n is a, c, g, or t
  misc_feature (1007)..(1007): n is a, c, g, or t
  misc_feature (1011)..(1012): n is a, c, g, or t
  misc_feature (1016)..(1019): n is a, c, g, or t
  misc_feature (1021)..(1021): n is a, c, g, or t
  misc_feature (1023)..(1027): n is a, c, g, or t
  misc_feature (1029)..(1029): n is a, c, g, or t
  misc_feature (1031)..(1035): n is a, c, g, or t
  misc_feature (1037)..(1042): n is a, c, g, or t
  misc_feature (1044)..(1045): n is a, c, g, or t
  misc_feature (1048)..(1051): n is a, c, g, or t
  misc_feature (1053)..(1054): n is a, c, g, or t
  misc_feature (1056)..(1056): n is a, c, g, or t
  misc_feature (1061)..(1062): n is a, c, g, or t
  misc_feature (1065)..(1065): n is a, c, g, or t
  misc_feature (1068)..(1068): n is a, c, g, or t
  misc_feature (1070)..(1072): n is a, c, g, or t
  misc_feature (1075)..(1075): n is a, c, g, or t
  misc_feature (1077)..(1079): n is a, c, g, or t
  misc_feature (1082)..(1083): n is a, c, g, or t
  misc_feature (1085)..(1085): n is a, c, g, or t
  misc_feature (1087)..(1087): n is a, c, g, or t
  misc_feature (1089)..(1089): n is a, c, g, or t
  misc_feature (1091)..(1091): n is a, c, g, or t
  misc_feature (1095)..(1095): n is a, c, g, or t
  misc_feature (1097)..(1100): n is a, c, g, or t
  misc_feature (1102)..(1105): n is a, c, g, or t
  misc_feature (1107)..(1107): n is a, c, g, or t
  misc_feature (1109)..(1116): n is a, c, g, or t
  misc_feature (1118)..(1119): n is a, c, g, or t
  misc_feature (1121)..(1121): n is a, c, g, or t
  misc_feature (1123)..(1123): n is a, c, g, or t
  misc_feature (1125)..(1131): n is a, c, g, or t
  misc_feature (1133)..(1133): n is a, c, g, or t
  misc_feature (1135)..(1137): n is a, c, g, or t
  misc_feature (1139)..(1141): n is a, c, g, or t
  misc_feature (1143)..(1148): n is a, c, g, or t
  misc_feature (1152)..(1152): n is a, c, g, or t
  misc_feature (1154)..(1155): n is a, c, g, or t
  misc_feature (1160)..(1161): n is a, c, g, or t
  misc_feature (1163)..(1165): n is a, c, g, or t
  misc_feature (1168)..(1169): n is a, c, g, or t
  misc_feature (1172)..(1177): n is a, c, g, or t
  misc_feature (1181)..(1184): n is a, c, g, or t
  misc_feature (1187)..(1187): n is a, c, g, or t
  misc_feature (1189)..(1198): n is a, c, g, or t
  misc_feature (1200)..(1200): n is a, c, g, or t
  misc_feature (1204)..(1205): n is a, c, g, or t
  misc_feature (1207)..(1208): n is a, c, g, or t
  misc_feature (1212)..(1213): n is a, c, g, or t
  misc_feature (1217)..(1217): n is a, c, g, or t
  misc_feature (1220)..(1225): n is a, c, g, or t
  misc_feature (1228)..(1232): n is a, c, g, or t
  misc_feature (1235)..(1236): n is a, c, g, or t
  misc_feature (1238)..(1239): n is a, c, g, or t
  misc_feature (1242)..(1248): n is a, c, g, or t
  misc_feature (1250)..(1255): n is a, c, g, or t
  misc_feature (1257)..(1260): n is a, c, g, or t
  misc_feature (1262)..(1263): n is a, c, g, or t
  misc_feature (1265)..(1265): n is a, c, g, or t
  misc_feature (1267)..(1268): n is a, c, g, or t
  misc_feature (1270)..(1272): n is a, c, g, or t
  misc_feature (1274)..(1274): n is a, c, g, or t
  misc_feature (1278)..(1279): n is a, c, g, or t
  misc_feature (1281)..(1282): n is a, c, g, or t
  misc_feature (1284)..(1286): n is a, c, g, or t
  misc_feature (1288)..(1298): n is a, c, g, or t
  misc_feature (1300)..(1305): n is a, c, g, or t
  misc_feature (1307)..(1312): n is a, c, g, or t
  misc_feature (1314)..(1314): n is a, c, g, or t
  misc_feature (1316)..(1317): n is a, c, g, or t
  misc_feature (1319)..(1323): n is a, c, g, or t
  misc_feature (1325)..(1325): n is a, c, g, or t
  misc_feature (1327)..(1327): n is a, c, g, or t
  misc_feature (1331)..(1336): n is a, c, g, or t
  misc_feature (1338)..(1340): n is a, c, g, or t
  misc_feature (1344)..(1344): n is a, c, g, or t
  misc_feature (1349)..(1353): n is a, c, g, or t
  misc_feature (1355)..(1359): n is a, c, g, or t
  misc_feature (1361)..(1361): n is a, c, g, or t
  misc_feature (1364)..(1368): n is a, c, g, or t
  misc_feature (1370)..(1383): n is a, c, g, or t
  misc_feature (1389)..(1389): n is a, c, g, or t
  misc_feature (1391)..(1398): n is a, c, g, or t
  misc_feature (1400)..(1402): n is a, c, g, or t
  misc_feature (1404)..(1407): n is a, c, g, or t
  misc_feature (1409)..(1410): n is a, c, g, or t
  misc_feature (1412)..(1412): n is a, c, g, or t
  misc_feature (1415)..(1417): n is a, c, g, or t
  misc_feature (1420)..(1425): n is a, c, g, or t
  misc_feature (1428)..(1429): n is a, c, g, or t
  misc_feature (1432)..(1434): n is a, c, g, or t
  misc_feature (1436)..(1436): n is a, c, g, or t
  misc_feature (1438)..(1443): n is a, c, g, or t
  misc_feature (1445)..(1446): n is a, c, g, or t
  misc_feature (1448)..(1452): n is a, c, g, or t
  misc_feature (1454)..(1459): n is a, c, g, or t
  misc_feature (1465)..(1469): n is a, c, g, or t
  misc_feature (1472)..(1475): n is a, c, g, or t
  misc_feature (1477)..(1477): n is a, c, g, or t
  misc_feature (1480)..(1481): n is a, c, g, or t
  misc_feature (1483)..(1485): n is a, c, g, or t
  misc_feature (1487)..(1494): n is a, c, g, or t
  misc_feature (1578)..(1578): n is a, c, g, or t
  misc_feature (1590)..(1590): n is a, c, g, or t
nttnnnnannnannnnnnnaannntnannnannnnngggntnttnnngnnnnnannnannnttnnnnnncnaannnaannnaaanntnggnngnnnttnnannnnnaaannnnngnnnnnnntnnaannncnnnnnntnnnnnnnnnnnttnannnnnaaannnnnannnnncnnnnnnnaaattnnnnnaannnnngnnnnngnnannnaangnnntnnnnnnngnnnnnggnnnannannnnngnannnttnnnnnnangttnnnnncnantnncttnannanaaannnnnnnnanaannnnntnnnnnttnnnntnnnnngncnnaanannatntnatttnanttttnnttnangnngnnaangggttngnnntnancnaannnnannnnnntnnttnannttntnnaaatnnntttnannnntnangnnaaanncnnnnnntgnnnnnnnaannnttnnnnntnaaccnncntntannanttnnncntttnnnnnccnnttnaatnnnnntnntnntnnannnnnnnaaaannannttannnntnnnnntnnnnnntnaaaannaanntngnntnnnngnnnanttnnnnnttnaantnnnaantttnncnaaaaaannanccnannaanttnnnnnaanttnnnnnnntttncnnnnnnantnaantnanttnnannnnnnnttnnaannntnncnnnantnanngnncnnnnnnnnttnnnnnnncnnnnnnannnnnnnntnnnannnnnnannnnnngnnaannaaantanntnntnngntnntngnaannnnananttnnannnnngnnnnnnnnngnaaaaannnnaaaaattnnnnggnnnnnncnnnnnnannnnnnnnannnnnntnnntnnnnntnnnanntaaaaanttnnnaaannnnnnngttgnngnnggnnnaaccaannnnnnnntnntngngnnnantnaagggnnnnnnnntnantnnnanttnnnnntnaaaatttnnaaangntttnntttnnnntntnnnnnancnnnnnannnnnncnngannnnanncnaaaannatnaantnnnaangnnnaanngncntnantttngnnnntnnnngntnnnnnnnnanngntncnnnnnnngntnnntnnnannnnnntttncnnaaaannannnttnnggnnnnnnaaannnnaangnnnnnnnnnngnaaannannaaannaaanttnnnnnnttnnnnnaannannagnnnnnnntnnnnnngnnnntnntngnngnnnantttnntnngnnngnnnnnnnnnnnannnnnntnnnnnntngnnannnnncntnaaannnnnnannnaaangaaannnnntnnnnntnaannnnnannnnnnnnnnnnnnaaaaantnnnnnnnntnnntnnnnannanggnnnccnnnnnnaannttnnntngnnnnnntnntnnnnnannnnnnaaaaannnnnaannnntnaannannnannnnnnnncccttaattaaattaaaataattaattagcgcataaaagtgtaaatactatctttattaagcgcataaaagtgttatgatatcngtgttaattacntaaacagacttccagatgaagcgaatattattaaataaattactagattggaaaaatcaagccagtagaaagcctctattaattgacggcgctagacaaacaggaaaaacctttcttttacaaactttatttgctgacgagtttcccagcgtcttatatatagactttctgaaaacgccacagatggcggacgccttctcaggggagctatcccctgatgttattatttctaatatagagttattgacaggtcaagtttttaatccagaatcagacctgttgattttagatgaaattggcgaatgtcaaaaagctgtaaccgctttgaaatacttcgcccaagaggcgccaacctattatgttgcggcaagcggttcaaatattggtttattagctagtttcccagtaggaaaagttgagcactgttatctaaatccttttacatttaaggaatttttgtgggctgcaaacgaacctttgttgcttaaggtttatgagcaacaagccaactctaaagctgtccatacaaaactatttgataagttgacagattattactttacaggtggtatgcccgaggctgttgccgcttggttcgaatattcagaaacaagcatacttaagcgtatcaaccaagttgaacaaattcatgctgatttactggagggttataagcgcgattttggcaaatatgctaacaaggtagatgcccagttaattgagtcggtttttagcagcattccttcgcaactctcctctgtgtttgacggctctgttaatcgctttaagtttaaaggagtttttgcaaaaaaatcacgttatgctgaatttgaaagtgcaattaactggctgcatcgatgtcgactggttttgaaaaaccatcctattgagggtttgccaaaatcaccactggcggcctatcaaaaaaacaataaagtaaagttatttttctttgatgttggcttattaaatcacagtttgagcactacctacaaagagataaagcagcaagcttatgaatacaagggttacattgcagagaatttcgtacagcaagagctggcagcgctaggatttgaaccaagtttttcatggaatgatgctcgggcagagattgagttcatcgtcagtaataaacaaggcgaaattattccaattgaagttaagagtggagggcgcacgcgcgcaaaatcattaaaatcttatatagttaagtgcgcgcctagcaaaaccattaaattaacgggcacacaaggttcgaacaacctagaaaagattaatattgtaatgccattgtattacgcagaatttataatagacaagattaataattagtgatgtgtttgcgaactgtacgtttaaaaccagtgattaaaaaaaggtgtgaacttaatttattaattctgttgaattcgacagaattaggataaaaaagtgagccggatattactcaatggattgtctggtttttagagtaagttaaacctcacacacaaagtagtgtgtataagttcaacattgcattttgctaattgggtttaaagtaacaaccctttctaagtgttctggtgataaatgagcatagcgcattgtcatttttaaatcactgtgtcccagtgttttttgtagggtgagaatatcaccaccattcatcataaagtgactggcaaacgagtgtcttagaatatgggttaactggccttttggcatgtctatttccaggcttctaatgacacggacaaaggttgagtagccatctttaaaaggtgcattttctctaacctcatcagccaactctttggtgagtggcaattgcctaatttttccatttttagtgtcagttaagctgattcgattgttagcgatatttctggccttaatgccggtagcctcactccatcttgtgccaacacttaagcagatcttagtggtaatgtaggtgtcaatacttattcgtttgagcgtttcaaggagtagtttaatttgttctttggttaggtaggtaagttctgtttcattaaatcttagctttctaattcctatcattgggtttgcttcaagtaagtccaatctaacgagctcaccaaatacagcagctaaatatgcatggtgatggttaatggtattcgctgttatgtcagtacgtttattgcgatactttaaaaaatcatgttttgtaaagttgcatatttttgggtcttttaaatactcaacaagtactattagtgctcttaaccggccgcccaggtcatggcaaaaacatctatgctttaaccttcttagagcagcaagagtttatcaattacgataaagaaaccaaaacctttagttctaccattgatagacctttgttctttattgcctttgacggtattaatattgttgatagtactacggctaaatatgaaga

SEQ ID NO: 1539 - DNA, 4000 bp, Escherichia coli
  misc_feature (258)..(258): n is a, c, g, or t
  misc_feature (260)..(260): n is a, c, g, or t
  misc_feature (536)..(536): n is a, c, g, or t
  misc_feature (614)..(614): n is a, c, g, or t
  misc_feature (650)..(650): n is a, c, g, or t
  misc_feature (653)..(653): n is a, c, g, or t
  misc_feature (2028)..(2028): n is a, c, g, or t
  misc_feature (3366)..(3366): n is a, c, g, or t
  misc_feature (3374)..(3374): n is a, c, g, or t
  misc_feature (3380)..(3381): n is a, c, g, or t
  misc_feature (3393)..(3393): n is a, c, g, or t
  misc_feature (3834)..(3834): n is a, c, g, or t
ttatggattcaattaaaaaaagcggaggatttgatataacctctctgggagaggaaaagtaaagcaccttagttccatacaattttggagtatgtatggattttttaacattagattctaatcttaccggtcttaccgaaggttatgcctcttcaactggttcaagtcttgatactggcgatttaaggcgaacttttggttttttaccaataccggaagcaacgcaagtggggccggcgaacactccactactggcgntnatgagtaaatatcgcaagagacctacggatgatcctcagcctaaaacgctggagagacgcagttctattcatcgtcgttatgcttatgttgttgctcacggaacgagtattgctggatattctacaactgatgctactgttacttataccaatgtaaatgctggtgatacttattatgttcgtatggctactgactataagtcggctggcaatattggtattgtctataatgcagagggaacagctagaaatgcatttgaggttggggcttcaggnactcgacctgaatttttcttagttggacaattagtaaagattccgtgtattgcgtcgggggcgggtgcaactcatacngatgcggcttcttttaatactattgatcattttacnggncgtattgagcaagttattctcaatactaatactgttgacttgaaacttacgattgttgatggactttctgaaaatcgtgatcttgctggttggggtagtgctgataatactgctgattatccaatttcaagtttatcggcagctaatttggttaagttacgagtttttgatcagttagaaagagctcgttcgtatgttgttatgactggatttgctcgtggtactggttacccgaatagctggagtgataatccgttctctactggttatactaatacgcagattttcaaaacaacgctggcaatggatgaaactactcgtgctactgttttgaaaattgaaccaaatgagtttgctcgtttgtggcgtgataaagttattgagcataatgtcgatgtcgaaggtggtatgttatggtcaactcttggaactggcactgatagttcaggcaagtcaatttattatactcaaggtatagctgattatgccttgaattatagcccgattttccaattggcttcaactacaaatgctgataattttctggataatatggcgacatttatggatggtcgtatgaaagctgaaaatgaaaaggctacaatgtggttagttgataagtggacgcttaattggctaatgaaaatttctggttatgctttgcaaaatcttaaagcagctacatcatcgacttatgcttcaatgagtatggattataaaggatggcgagacattaaacttggcgatggttctgttaccagtcacgaaatctggactccttatgggaatatgaatttggtttatatgccacaatttgacggaactggcatttcaattctggctgttaatatgaatgatgtcgaatatcgtccattagttggaaatgggattaatcgagatactcgtgttattcctggtgtgcaaacactggaaaactctggtattgatggtcgtgtcgatttaatccaaactgaggcggctttagcttgtaaagcccctgaacatcacgccgtttggaaacgggcttaaggagttattatgggtaaagaacctttaattgggtctattgatcatataaacgaagttagcaagatgatcggtggcgtcgaaactatcactgctgctaagactcttacaatcgctgatagtggcaagacatttatttttgatgttgcttctggtgcaactgtgacactgccaactgcttatgatggttgtagatttaaatttctatttaaaactgcggtaaccagtaataactatggcattgacacggcagctgcaacgtctttattttatggcagaattgtcattcacgataaggatgttagcacttatgattccacattagcgcattttgctgctgatcaatctnatgacgattcaattgatatgaatggtagcactactggcgggcttgctggcggctatatcgaccttgtggcttatggcggtcattggttcgtagatggcgagatttacggtgatggtaatcttgtcactccatttagttgatatgagtgagttatttgtttagacatcgggaaatgggtggtcgtgagaccaccctatacccttttctaaatggtgattgatggcaaaagaactattgacggcaataagagcaattactggctcggtagtgagtggcacacctgctactactgatgaccaattaattatattcttaaataacgcctctaatttcgttattaataatctaccaatagaatatgccatcccattttggaaagatagttcagcaattacgtcaaatgctggttttactgttatttcagaccgaattgttcaagtaaggcgtaatggcagagcttgtaagcaaattggattgggacttgcttatgctcaagatttaacgcctacttttacaataactgttagtgattatgctaatatagcagttggtaaagcaataactatagatggtattaaactttattgtcaagaatcagctactactgagaaaagtgatttcattaaggaaacatcaaatcagattactgctcaaaatattgtagatgcaataactaatactttttctgctccgatagtggcaagtttaaatgatgcaactatatcaataacaggtgctaatagtgttacaagtgaagatgcaataagattaattgtaacgcaatctgcaacatctacaagtctatataaggcaactgaattgtttcctgcttattatgttatggcaaataaagtctatatcaagcccgacccgacagcaagtgcagttggttatgtaacttatgtttcaccattgacttttactaatggtgatagttctgagatgacggtaagtggggtaaagacaattattttagattatgctattcatcaggattatgcccatttggctggtgtatggcgggatttggcgcaaacagaattggctaaagttacaacggctacaactggttatttggcattattcaatgcagcacttcctacttggtcagatgttacagctccgacaatgcctaccttgacaattgagccaatgacaaccttgccaactcttaccctttccaatgcaagtgattcctggcctacttttagtgaaacaattactctgccagaattggtattaccagttatgacagctttaccagttctgcaacgaacaattgcttcaaatgtatttgtaactggtgaggctaatacgtctgatgcaactgctgagacnattcttanagttgnnatggaagatganacaactttacaaatgcaattatggattactggtattacggatgatggtgcaaatagtggtagttatgcgttatttatcgcttataaaaaagatggcactaacgatccagtccaaattggtgattatgaaacgggagcgcatattgaagttactgatgaagaatggaatggggtaacatttgaagtatcgtcttctaatatattggtaaaagtttctggtaaggcagatacaaatataagttggaatgctttggcattaaaaactacaggtggaagttctattgcacttgaggatgtaaaaattaccaatcctggtacgctttcaatgcctatagcgccatctttaccagtgttagcattaagtacaatggatactttgccaacggcattaattgaagctgatatggatttcagtgggctaacagagccttcctatacagcncctacagcacccgatagtataaccttgccaacattgacagtcccagcacttgatactttgccagatgcacttgaatatagtaatattgatttatctggtataaaagttccagtttatactcaaccagatgcacctgctccaatagaattacctaccttagttgtgc

SEQ ID NO: 1540 - DNA, 4000 bp, Escherichia coli
  misc_feature (1985)..(1985): n is a, c, g, or t
  misc_feature (3198)..(3198): n is a, c, g, or t
  misc_feature (3347)..(3347): n is a, c, g, or t
  misc_feature (3594)..(3594): n is a, c, g, or t
  misc_feature (3597)..(3597): n is a, c, g, or t
  misc_feature (3600)..(3600): n is a, c, g, or t
  misc_feature (3604)..(3606): n is a, c, g, or t
  misc_feature (3609)..(3609): n is a, c, g, or t
  misc_feature (3612)..(3612): n is a, c, g, or t
  misc_feature (3615)..(3615): n is a, c, g, or t
  misc_feature (3620)..(3621): n is a, c, g, or t
  misc_feature (3624)..(3624): n is a, c, g, or t
  misc_feature (3626)..(3627): n is a, c, g, or t
  misc_feature (3632)..(3633): n is a, c, g, or t
  misc_feature (3636)..(3637): n is a, c, g, or t
  misc_feature (3639)..(3639): n is a, c, g, or t
  misc_feature (3643)..(3644): n is a, c, g, or t
  misc_feature (3647)..(3647): n is a, c, g, or t
  misc_feature (3666)..(3667): n is a, c, g, or t
  misc_feature (3673)..(3673): n is a, c, g, or t
  misc_feature (3675)..(3678): n is a, c, g, or t
  misc_feature (3685)..(3685): n is a, c, g, or t
  misc_feature (3687)..(3688): n is a, c, g, or t
  misc_feature (3693)..(3694): n is a, c, g, or t
  misc_feature (3696)..(3698): n is a, c, g, or t
  misc_feature (3707)..(3707): n is a, c, g, or t
  misc_feature (3715)..(3716): n is a, c, g, or t
  misc_feature (3721)..(3722): n is a, c, g, or t
  misc_feature (3732)..(3732): n is a, c, g, or t
  misc_feature (3737)..(3738): n is a, c, g, or t
  misc_feature (3740)..(3742): n is a, c, g, or t
  misc_feature (3746)..(3746): n is a, c, g, or t
  misc_feature (3750)..(3750): n is a, c, g, or t
  misc_feature (3753)..(3758): n is a, c, g, or t
  misc_feature (3760)..(3762): n is a, c, g, or t
  misc_feature (3764)..(3765): n is a, c, g, or t
  misc_feature (3769)..(3770): n is a, c, g, or t
  misc_feature (3774)..(3774): n is a, c, g, or t
  misc_feature (3777)..(3777): n is a, c, g, or t
  misc_feature (3779)..(3779): n is a, c, g, or t
  misc_feature (3783)..(3792): n is a, c, g, or t
  misc_feature (3796)..(3797): n is a, c, g, or t
  misc_feature (3802)..(3802): n is a, c, g, or t
  misc_feature (3807)..(3808): n is a, c, g, or t
  misc_feature (3811)..(3811): n is a, c, g, or t
  misc_feature (3814)..(3815): n is a, c, g, or t
  misc_feature (3819)..(3819): n is a, c, g, or t
  misc_feature (3822)..(3823): n is a, c, g, or t
  misc_feature (3826)..(3827): n is a, c, g, or t
  misc_feature (3832)..(3833): n is a, c, g, or t
  misc_feature (3837)..(3837): n is a, c, g, or t
  misc_feature (3841)..(3841): n is a, c, g, or t
  misc_feature (3846)..(3846): n is a, c, g, or t
  misc_feature (3851)..(3853): n is a, c, g, or t
  misc_feature (3868)..(3869): n is a, c, g, or t
  misc_feature (3872)..(3873): n is a, c, g, or t
  misc_feature (3875)..(3875): n is a, c, g, or t
  misc_feature (3879)..(3880): n is a, c, g, or t
  misc_feature (3887)..(3887): n is a, c, g, or t
  misc_feature (3890)..(3892): n is a, c, g, or t
  misc_feature (3894)..(3899): n is a, c, g, or t
  misc_feature (3903)..(3904): n is a, c, g, or t
  misc_feature (3922)..(3922): n is a, c, g, or t
  misc_feature (3927)..(3927): n is a, c, g, or t
  misc_feature (3932)..(3932): n is a, c, g, or t
  misc_feature (3941)..(3941): n is a, c, g, or t
  misc_feature (3947)..(3947): n is a, c, g, or t
  misc_feature (3950)..(3950): n is a, c, g, or t
  misc_feature (3961)..(3961): n is a, c, g, or t
  misc_feature (3966)..(3966): n is a, c, g, or t
  misc_feature (3974)..(3974): n is a, c, g, or t
  misc_feature (3980)..(3982): n is a, c, g, or t
  misc_feature (3989)..(3989): n is a, c, g, or t
  misc_feature (3992)..(3993): n is a, c, g, or t
  misc_feature (3995)..(3996): n is a, c, g, or t
tctttgttaattatattcaagagcatcgagcatataatttaaatcaaaaattaaaagtattagttactgataacttttttgttctaaatcaaaaaattgacaatattaatacttttaattttaatgaaacaaacaaaaatttaattcaaattaatcaaaatgatttagtaattggtgatgttattgttttaaaacaaggtgatttaattcctgctgatgctagaattatttgagaagataatttatcagttgatcaatcaacattaactggcgaaaataatccaattaaaaaaagtattactaataaaagtaaaaaaattgttgaatataacaatattctatttgcgcaaacaattattacttcaggtaaatgttatgcggtaattattaacattggtgatagtaattactcacaatcaattttaactatggccgaacaaattgcaactaaatctgatttcagtaaaggaataagtaaactaacaataatgctagttattgcaattttagcagtaattccgtttatttttattgctaatggtttacgaacttcacaatgaattgcagctttagtattcactttatcaattgttgtttctttaacacccgaggcattaccagccgttattgctactaacttaaaaattggtagtaaaaaacttgttaaagaaaatgttgttgttaaaaataatgaagtaattcaaaatatggggagtgttaatatcttaacaactgataaaacaggaactttaacagttgatgaaattgaagttgcagatatcattgatattaatggtaacagttctgaatgtattgcaaaatgtgcttatattaatgctttttttgaaagaaatttaattaataaaattgatgaagcaatttatcataaacttaataaaaaatttaatactaacaaaatccaattaattgctgatatccaatttgatcatgaaacgaaaattagtacagttttaattaaagaagataataaaacaaaacaaattactaaaggttcttttactgaaatgatgaatatcattaccaaagttaaaattgataacaaaattgttactttaaatgatcaacataaaaataaaattaatcaattagttaataatttagctcaaaaaggttttcgagtaattcttgttgcttcaaaaaaaacaagtaaaattacaactaacaatttagtttttgaaggaattatttcgtttgaagataaattaaaagatgatatcaaaaaagtcattaaaaccatttatgagtcaggaattgatttaaaaattttaacaggagatgccttagaagtttcacaaactattgctaataaattagcaatgaaaaaagaaaatgctgtacttggtcaagatttagcaattagtaataatgaaaaactatatcaacaacttataacagcaaatatttttgctaaattatcaccctttgaaaaagcaaaaattgttgaaactttaaaatcaaataatgttgttgcttttttgggtgatggtgttaacgatgccggtgctttaaaattagcagatgttggaatttcagttaataatggtacgccaattgccaaatatgcttctgatgttatcttattaaaaaaagatttagatgtgttagaaaaatcatttattaaaggaagagaaattttttataatgctcttaagtatattaaattaactgttgcttcaaactttggtttaatgttaactttattaattggatcaatttgatttgactttgctactatgtcaccaattcagttattaatgcaaaacttaacttttgatttagctaatttattgtttgttattgataaagttgataaccaagcaattaaaaaaccattaaaatgaaatattaaaacaatatttcctttcgtgcttattaatagtattttaatgtcaattattagtattactaatttcttaattgttggttatggttttaatttttttgaacatattaatcataatganctatcaagagccttatatattaaacaatttcaaacaatgttctttattgaatcaatggtcagtcatattttctttattttctttgctcgaacagcaaaaatatcatttattcaatcatgaccggcaattactttcttatttagtatgctaagttttttaataatccctttcttatttacctttgttaatccgattgcaaatgtctttcaattatcaaaaccaccattattatgactaccagtattaccaggattaataattgttaattgaattttagttgaatcaacaaaagcagtaatgacaaaaaaatttaaaatttgaatttaataagtaattaaaaattgttaatttaacggcagtgaattttaaatattcactgtttttttatcattattttcaaaaatattgctccccctcctcctgagagtgatataattttaaaaaaataaaggagataacctaaaatggcacaagatttaacaaaagaaattcttccaattgaagaacaaaaacaaacaaagaaaatattatataagaattgaaaattttatgctacagcattaggaatcataacggttggtttagctgtcggtttaggaataggattaggtgttgaaaatagttctcataatactattactccagcacaaaaaattgttaatgaaattaacaagatcacaaatcttgaagtaatagcaaatactactgatagcacagtaacatctattaataatctaattactagtgattttattagtgcaaaattaacaggtgacaataaaactacatttgaagctaataaaaataaatttgcacttgtaaaaattactgttggtaaaaacaatttagtagataataatctaaaaacaattggaacaattaatgctaaacttatttataattatgactcaattaaaaatcaaacaaccaatctaataattacagtttcagataaaaatactactgatatagttaatcaaattaatattactacttatgaaacaaatgttgaaattaatagcacaattgatgatttaatatttatgcctttattcattcaatcaaaattaacattccaaaataaaacaggatttaatgctaatttgtttacttttaataaaattactgttaatggtaatgatttacaaaatagtgatttaacaacagaacaaacaattaatgctaagattaattacaattatgataatattgnaaaccaaacaacaaacttaacaatgacagtcggtactaatgtttgatctgaagatgtaataactaagcaattaaatacattaacaggttttacagttaattatgatcaaacaacagcaacaattacaacagttacagaccaattaaaanctatgtatgttgatacttttacgagcattaagattcaaaatgaaattaaagaaaatttaataatttctaatttaaatcgtagtataagtggtactcatactccatgaacagatgatgacttaagaaatggagcaactagtggtacaacttgattcaatcttacttttaaaaatatattattaagtagcactaaaattgtccatcttaatcctgttattattgatgcaactttacttaattatttaantancanaaannnttnaanaanaattnnttntnntaaannaanngnaaannttnattcaattaaaaaccaaannttaaanannnnaattaanannattannannnaaaaaattnaaaattannttaannaaaatttaanaattnntnnnttanatanatnnnnnngnnnanntggnnaaanaananaaannnnnnnnnnaaannaaagnttaannaanggnnaaanaannggnnattannaatntttnttaanaaaannnattcttggaattaannaannanaaannaaagttnttnnncnnnnnntttnnccaaattaaataattaanaaaanatttnttcaaaatnaaaaanttnagtttataaantgaantttttttntttttnnnaattaanaannannactg

SEQ ID NO: 1541 - DNA, 4000 bp, Escherichia coli
  misc_feature (1)..(1099): n is a, c, g, or t
  misc_feature (1621)..(1621): n is a, c, g, or t
  misc_feature (1658)..(1661): n is a, c, g, or t
  misc_feature (1665)..(1669): n is a, c, g, or t
  misc_feature (1671)..(1674): n is a, c, g, or t
  misc_feature (1676)..(1677): n is a, c, g, or t
  misc_feature (1680)..(1680): n is a, c, g, or t
  misc_feature (1683)..(1687): n is a, c, g, or t
  misc_feature (1725)..(1731): n is a, c, g, or t
  misc_feature (1733)..(1734): n is a, c, g, or t
  misc_feature (1737)..(1746): n is a, c, g, or t
  misc_feature (1749)..(1749): n is a, c, g, or t
  misc_feature (1751)..(1753): n is a, c, g, or t
  misc_feature (1791)..(1791): n is a, c, g, or t
  misc_feature (1793)..(1796): n is a, c, g, or t
  misc_feature (1798)..(1801): n is a, c, g, or t
  misc_feature (1804)..(1804): n is a, c, g, or t
  misc_feature (1807)..(1809): n is a, c, g, or t
  misc_feature (1811)..(1814): n is a, c, g, or t
  misc_feature (1816)..(1819): n is a, c, g, or t
  misc_feature (1856)..(1859): n is a, c, g, or t
  misc_feature (1861)..(1867): n is a, c, g, or t
  misc_feature (1869)..(1869): n is a, c, g, or t
  misc_feature (1871)..(1874): n is a, c, g, or t
  misc_feature (1876)..(1878): n is a, c, g, or t
  misc_feature (1880)..(1883): n is a, c, g, or t
  misc_feature (1885)..(1885): n is a, c, g, or t
  misc_feature (1922)..(1937): n is a, c, g, or t
  misc_feature (1939)..(1942): n is a, c, g, or t
  misc_feature (1945)..(1951): n is a, c, g, or t
  misc_feature (1988)..(2002): n is a, c, g, or t
  misc_feature (2004)..(2010): n is a, c, g, or t
  misc_feature (2012)..(2014): n is a, c, g, or t
  misc_feature (2016)..(2016): n is a, c, g, or t
  misc_feature (2573)..(2573): n is a, c, g, or t
  misc_feature (2803)..(2803): n is a, c, g, or t
  misc_feature (3584)..(3584): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaatatatacaaaagacaacccatagatacgattacgctagttttctgtgaaaactagcgattttcaaactcccctacagatcaggtaatggtataattattttcccacctctccctagcagtggcaagttatagctcccctacagatcaggtaatggtataatctttgtgtatctatatagtgtactatactgttatagctcccctacagatcaggtaatggtataattcttttttaataacaaaatgtccgaaatacgttatagctcccctacagatcaggtaatggtataattcagtaactcatactaaaggaggcgcacggttatagctcccctacagatcaggtaatggtataatatttcataatagccaaccaggtgcgagtgcgttatagctcccctacagatcaggtaatggtataatagtttttcttccttcctgccagtctttcagttatagctcccctacagatcaggtaatggtataatgaagtcctgatgataaagacgatgcgtaangttatagctcccctacagatcaggtaatggtataatnnnngaannnnnannnncnnggnacnnnnngttatagctcccctacagatcaggtaatggtataattnnnnnnnannagnnnnnnnnnnatncnnngttatagctcccctacagatcaggtaatggtataattngnnnntnnnnatnccnnnannnncnnnngttatagctcccctacagatcaggtaatggtataatnnnntnnnnnnnanannnncnnngnnnnangttatagctcccctacagatcaggtaatggtataatnnnnnnnnnnnnnnnncnnnnatnnnnnnngttatagctcccctacagatcaggtaatggtataatnnnnnnnnnnnnnnntnnnnnnnannntnggttatagctcccctacagatcaggtaatggtataatagattgagaaaatacccatactacataatatagtatgggtatttctcttgcaaaaactgagattaaaataggagtaattgtgattcattaattcttttttcttgtacttttttatcacctgttactattaccgcttctgaaaactgcttatttgtgatcaaaataaccctaactgcaccttttggaggagcccacaatttcatccttttaatatgaatgcgagcatcatcaccatcgcggcaaattcttgaatagactgagaattgtatcatatcatatccgtcacgaagtaaaaagttgcgaaattgtccgtaattttttttgctctcttttgtctctgttgggagatcaaacataactacaatacgcataaatctattttccatatttaagtattggtaatagtaggcgtgaagggtctttttcagtagttaccgttactaaactttgagctgtaatttccattgctcttagaatcgtttgttttgattcgttaattattacacgatgagttaagatncctactaattcatttcgcatttctttatttaataattcggcatttacagaaatttttgtaaaaactaaataatcaacataaggtctatacacttccatcaaatcgtctgccaaagaataattgtttaactcatttttatgttgaataccgatacttgataaaaatccgtaagttacaattgaacgagccatagctccgcgtaaaatagcataaccataatttaaagacgngtttattacatgatcactattacgcacacatccttttggtaaaagctcaccaaaatataatctcgctgctgaagcttcacgatttagggtgtcaccagaattaactgatgcagtataatttataaaattaggaaattctcttttagaaatttcagttagtaccgcgtactgattttccagtttttgtttaattatactttgccagactcttttctttaatggttctgtccataacaattgttcttttataactttactttgtcgggagtgttgctggtatccaagaagagttccgctaggggtgtgtttttcatcacatattaaaaccgcaattttatgttgaatacaagcatcaagtaacgcgaccgaagtagtgatagttctattttcaagcacaataacgctaatatcctctaacgggactttgaattcgcctgaatcttgttttatcaccaaattttctagattaagcgataaatatgatttttcagcaatgctgactattcgccatgacatattttacaagcacaaaaaagtcctgtgaataaggactcttttgtcaaagttacttactgcaatttagttaaacttaagtcgtttttcccccttaaccaaactgtagttacctaatacatctaccacatacttatcgaacttgtcaagtgttttgattcctatgttggattccgaacttttatcatgagtagcgactacaagagacgccactgagattccggccttaatgtagtaccctaacgaattctcattctttttagtaatntgtaccaaatcaccaggatataagctgaacttaaaattaaatgttttatctagttttgtccaatcgctttcatgtttcccaggagaacatactctgtcaggaagttctttagcaacaacatgatgagcgtagattggtacaaaataaaattcatcttttaaattcttgttaggtttggagaaaatgtcaatccggaccattgatgcacggtccaccagagcattcccgtcattaattaaaataccagatttctgtgtattattttgcaactttacactacgaacgacaggacctctggtgccatctttttgtattttataaaatggttcagcaaaggcttttttaccatcgccactatattcatctaattttaatttaagtgctgtatataattttggatctaaataacgaccttc

SEQ ID NO: 1542 - DNA, 4000 bp, Escherichia coli
  misc_feature (172)..(172): n is a, c, g, or t
  misc_feature (592)..(592): n is a, c, g, or t
  misc_feature (733)..(733): n is a, c, g, or t
  misc_feature (974)..(974): n is a, c, g, or t
  misc_feature (986)..(986): n is a, c, g, or t
  misc_feature (1274)..(1274): n is a, c, g, or t
  misc_feature (1355)..(1355): n is a, c, g, or t
  misc_feature (1415)..(1415): n is a, c, g, or t
  misc_feature (1550)..(1550): n is a, c, g, or t
  misc_feature (1553)..(1554): n is a, c, g, or t
  misc_feature (1847)..(1847): n is a, c, g, or t
  misc_feature (1952)..(1952): n is a, c, g, or t
  misc_feature (1973)..(1973): n is a, c, g, or t
  misc_feature (2055)..(2055): n is a, c, g, or t
  misc_feature (2142)..(2142): n is a, c, g, or t
  misc_feature (2178)..(2178): n is a, c, g, or t
  misc_feature (2300)..(2300): n is a, c, g, or t
  misc_feature (2355)..(2355): n is a, c, g, or t
  misc_feature (2400)..(2400): n is a, c, g, or t
  misc_feature (2433)..(2433): n is a, c, g, or t
  misc_feature (2483)..(2483): n is a, c, g, or t
  misc_feature (2541)..(2541): n is a, c, g, or t
  misc_feature (2576)..(2576): n is a, c, g, or t
  misc_feature (2589)..(2589): n is a, c, g, or t
  misc_feature (2604)..(2604): n is a, c, g, or t
  misc_feature (2670)..(2670): n is a, c, g, or t
  misc_feature (2787)..(2787): n is a, c, g, or t
  misc_feature (3727)..(3729): n is a, c, g, or t
  misc_feature (3788)..(3788): n is a, c, g, or t
  misc_feature (3894)..(3894): n is a, c, g, or t
  misc_feature (3902)..(3902): n is a, c, g, or t
  misc_feature (3908)..(3908): n is a, c, g, or t
  misc_feature (3949)..(3949): n is a, c, g, or t
  misc_feature (3972)..(3972): n is a, c, g, or t
  misc_feature (3998)..(3998): n is a, c, g, or t
cgacgccggggtcgaatgggacgacctggtggagtgggccgtacagcgcggattgtgggggctcgaaaacctctcgctgatcccgggcaaggccggggcggcgcccgttcagaacatcggcgcctacggctgcgaggcgaaggacgcgatcgagcgggtacacatgttctgngtggaaaactgcaaatgcatgacgctcgacgccgcgcactgctgtttcggttaccgcgaaagcatcttcaagcacgacctgcggggacgtgtcgtcatcacggcggtcgacatccgcctttcgcgcacgccgcaaccccggctggggtacggcgacgtggagcgcgaggtcgaggcccgcggcggcacgacgctgcgcaacatccgcgaggcaatctgcgccatccgccgcgccaaactacccgacccgaaggtgacgggcaatgcggggagcttcttcaaaaacccggtcgtcgatgaatccgtggcgcaacaattgcgggccagctggcccgacatgccgctctaccccgccgccctttcgggcaaggccaaactcgccgccgggtggctcatcgacaaggcggggctgaaaggctgncgaagcggacgggtcggcatccatgaacggcaggcactggtattggtgaacctgggaggcgccacgggcggcgagatactcgatttcgcccgtatggtacaggcccgcgtacacgaaaagttcggcatagagatagacacngaagtcaacatattgtaatatggcacttttagaggctttccagaggtatgtcgccgagaatgacctggcgacgcacgacgaccgcatcctgctgaccgtttcggggggcgtggattcgatggtcatgctgtcgcttttcacccgcagcggctattcggtgggcgtggcgcactgcaatttccagctgcggggcgccgagagcgacgaggacgaagtgctggtggaagaagaggcgaagaantacggcgtgganttctacaacaagcggttcgaaaccacggccgaaatggaacgcacgggcgagtcgatggaaatggcggcacggcgcctgcgctatgcgtggttcgacaccctgagccgcggtcagggctacacggccgtggcgatcgcccaccatgccgacgactcgatcgagacgttcttcatcaacctgctgcgcggcacggggctgcgcgggctgacgggcatctcgacgcaggtgggcaggatcatccgtccgctgatgttcgcctcgcgcaaggagatcctcgaatatgccgtngccaaccgcatcccgttccgcgaggattcgtcgaaccgctcgaccaaatacctgcgcaacaagatccggctcggactgatnccccgcatccgggagatcaaccccaagttcacgagcctcatgagccgcaacctggcacgnctgaccgatgcccagctgttcatcaaccacggcatcgaacgtatccgcggcgaggcggtgacttcggcggacgggttcgacacgatccacctcgaccgcatcgacccggcattcccgcaggagttcgtgatttanganntgctgagttcggcctacgggttcaagggtgacgtcgtcgactcgctctgccattcgctccggcacgatatgacggggcgacgcttctactcgcgcgaacgggtggcctacgtcgaccgcggcaagatcgtcgtggcgccgatcacccccgacgacgcctgcatgacgcaggtggaaaggggcgcacagcggagctactgcggcaattcggtgctctacttcgaatatacggacatcgacacgatcaagaatttcggcgtgccggagcatatcgcccaggtcgacgccgaccgnttgcaattcccgctcacgctgcgccgctggcgcgaaggcgactccttcgtgccgttcggcatgacggggcgcaagaaagtgagcgattttttgatcgacgccaangtctcgatggccgaaaaacancggcagttcgtactgctgtcgggcggcgagatcgtatggctcgtcggccgccgcatcgacgaccgctaccgcctgacgcccnacacggagaacgtgctgcgtatcaccaaagaaatcgtctgacatggctaaaagcgcactgaaattcaaggattccgtcgccgcatangaacaactcgccggccagatcgccgcacggcggttngtccccatctacctgctcatgggcgaagagagctacttcatcgacgccatcgccgagcagatagccacgaccgtgctgggcgaagccgaacgggctttcaaccagctcaccgtctacggcanggactccgaggcggggcaggtcatcaacctctgccgccagatgccgatgatgggntcctaccaggtcgtcatcctcaaggaggcgcagcagctgcgcggnctggacaagctctcgctctacacccagaagccntcgccgacgacgatcctcgtaatctgccacaaggagaaaaacgccgacangcgttcggccttctacaagggttgcgccgccaacggcgcggtgctcgagtcggtgcgnccgcgcgactacgagatcgcctcgtggctccagcnattcatcgccggnaaagggttggccatngacacgaaggcgctgtcgatgctgaccgaccacctgggcaccgacatttcgaaaatctcgaacganctgggcaaactggtcgtctcgctgcccgaaggcacgaagcgcatcaccgacgccgacatcgaggccaacatcggcatctcgaaggactacaacaacttcgagctgtgcaaggccgtngcgacccgggacatggcgcgggcgctgatgatcgccgagcatttcgcccgcaaccccaaggacaacccgctgctggtcaccgtactggcgcttttcgggcagttcaaggagctcttcgtcgtgaactacctccgctggctctcgcggcacaagggaaccgcattcccgcccgacacggagctgatgcgcatcctcaagaagagcaacgtctatgtcatcggcgagatcaagcagaacgccgccaactgggacaaccgcaaggtattcaacatcctcggcctgctgcgcgaatacgacgccaagagcaagggcatgaacgccggaggtgcatcggacggcgaactgctgcgcgaactgctgctcaaaatcttcatgctctgatgcgggaagtctacctataccagaccgtacatgtcctcgacggagagtgcctctgcctgcgggaacacctggccgtactcgaccgctggtcgcgcacgctcttcgggtgcccggggccacaggacgcccgggaggtcgggacggccgtcgcggcggtggtcggacgggaagcccccggcagcgaccgttcgaaattcgtgcggctcgtcctgccggcatcgggctccctgcggctggaattcgaaggcgtttcgctctaccgcggctacgacctgcgcagcctgatgcccgaagccgtgacgctgcaatacgaaccgccgctgttcgacgcccccacctcggcacgcgaggctgccgtagagctggcacggcaatatgccgggttgcagggtgcgagcgtcgccgtacgctgcgaccgcaacgggactctcatggcggccgacgaagcggcgctgttcgccatccggggcaggcgggtctacgccccgccgggcgaagcgagcatcgggcgcagccttgcagtcaggagcatccgcgccgccgggctggaactggccgnnncgcccgtcgggcgcgacgacctgccgcgcatggacgaacttttcttcatcgaccaccgnggcgtcaccgccctttcccgctgcgacgggcagccctacatggccatcttcgccgaacgcatcgccggggcgctccgcgggctgtttccgaatatgtagaaacccncccggganggcacncgctatcttcgccgcaaaacccggaaaccatgaaaaaatancttttcctttacgccgtcctcanaacggcgctgctggcatacggctatncc

SEQ ID NO: 1543 - DNA, 4000 bp, Escherichia coli
  misc_feature (807)..(807): n is a, c, g, or t
gaagggatgttcaaacaactggggatttataccaccgaaggtcagaaatacattccacacgatgtcgaccaggtgttgtcttaccatgaagataaagccggccagattctcgaagaagggatcaacgaatcgggtgcgttttcagcttggatggcttgtgctacctcctatgctaaccataaccaaccattaatcccgttctatatttattactcgatgtttggtcatcagcgagtgggtgacctcacctgggctgcgggtgatatccaggcgaaaggcttcttactgggcgcaacttcaggccggaccactttaaatggggaagggttgcagcaccaagacggacatagtcatattctggcgggcactgtcccgaatcagcgttcttatgatccaacctatagttacgaagttgcggtcatcgttcagcacggtctaaagcagatgtatgacgaaaatcagagtgtgttttattacatcaccctgatgaatgaaaactacaaccatccggatatgcccgaaggtgttgaatcagacatcatcaaggggatgtatctgctgaagcctgctgcgcctaagatgaagcacagtgttcgtctgctgggctcaggaacgattctgagagaggttgaggcggcagctgaaatgctagtcgattttggcgtcggtgctgaagtgtatagcgcgaccagctttaatgagttgcgtcgtgatggccagtcggcagcacgttataacttattgcatccagaagagaaaacggctcggatcagtcacgttgaaaccatgttgggtggatctgatgcnccagtggtggcggcgactgatcatatccagctttactccgagcagattcggccattccttggaaaacggacctacattacgcttgggactgatggatttggtcgttcggattcacgtaagaaattgcgtgagcactttgaagtggatcgtcgattcgtcacgattgcggcgctcagagcgctgtcaatggacggaaagattgatcctaaagtcgtgactcaagccatcaaagatttcgacatcgatcccgatcgtcttgatccggtgacattgtaaggaggtatgacatgacaacgattcgtgtaccagatattggtgatgcctcgaacgtcacagtcattgaagtggctgttgctcaaggcgatacagtcgccgaaggggataccttaattgttttagagtctgataaggcctcaatggaaattccagccgacgcatccggtgttgtgggtgcgatccatgtgtctgagggttctgaggtcaatgaaggtgatgcaatttgtgaattggacagtgcggatgctgttggctcggcgcctattgagccgcctcctgccgaggctctgactgctgcgccagtcgcagctgctccagtatcccaagaagccacggtgagtgagcaggtggttgtgcctgacactgggagtgctgacggcgtgactgtgattgaggtcgcggtttcagtgggtgataccgttgccgagggcgatacgctgatcgtcctagagtcagataaagcgtccatggaaattcctgcgcctagggctggagtgatcagtgcactgatcgtgaccgaaggccagcaagtggtgcagggtgatccaatttgcgagatgtcagtgaccgatggcagtccggctgtggctccctcgcaagctccggtagccgacactccatcgacacctgtgtctgctgcagcctcaaatcgtgcaggcggtctggaaaaagtggtcgttcctgacaccggaaatgccgatggtgtgactgtgatcgaggtcagtgttgcgattggtgataccgttgccgaaggcgatacattaattgttctcgaatcggataaagcctcgatggaaataccgtcgccggtgagtggaaaaatcgtcgcacttgctgtgaaagagggcgattccgtggctcaaggtgatccgattgctgatgtggaatccaccagcggttctgcgacccttgcaagcccagtagcacaaccgagtgaacctgtggctccagtcgctccagcggccgctcaaagcaagaagatagaacctcctgcagctgagatttcagggtcactagtgcatgcaggtccagcggtgcgtgcgttagcgcgtgagcttggtgtcgatttgaccaaagtgccgtcatctggcccacgaggccggatcaccaaagatgacttgcataattttgtgaaggcgaaattgagccaaaaagaagcgggtccagcggtcacgggtggaacaggaattccagcaattccaccggttgattttgctgcctttggtcctgtggaacgaattccaatgaccaaaattcacaaactcacagcggataacatgactcgctgttggctcaatgttccagccgtgacacagtttgatgaagccgacatcacggatctggaagccttccggaaatccatgaaagctgaggctgagaagaagggtgtgaagctcaccccgcttccatttttgattaaggcctctgcctacgccttggctgaactaccacaagtcaatgcctcgatcgatcctgcaactgacgaaatcgtcagaaaagggtatatccatatcggtattgccgtggatacacctgatggattgatggttccggtgattcgtgatgcggatcaaaaagggatttgggagattgccgctgaagcatctgagttggccgataaagcgaagaataagaagttaaaacccgcagaaatgcagggtgcgaccttcacgatttcatcgcttggatccattggtggtacagcctttactccaatcgttccttcaccacaggcggcgatcctcggaatatccaaggcatcgattcagccggtttgggatggtgctgcattccaaccgcggttgatgctaccgttgtgtttgtcctacgaccaccgtgtgattaacggtggagatggtgctcggtttaccactgtcttaagcaaggtgctcgctgatatcagacacttggtcttttgactgaaagcccggttcgccgggctttttttattgagtgcgtgctgacttccaaaacacctcatggccaccatcgcgtcgagccaagtgccgagccatcacgaacagaacgtctgagagccggttaatgtagtgttttaagtcgtcgccaaccgcctcttgtttggctaaagcgacaatgatgcgttcggctcgtctcgccacagcgcgagccatgtgacacaaacctgctgatttggatccaccaggaagaataaactctttcagcgccggcagttcgtcattgagttgatcacacaaggtctcaagatctgaaaccatctctgggtgaatcagttggaatccaggaactgcaagttcaccgccgaggtcaaacaagcgatgctggatgtctgtgagtggtgcggtcaggggctcgttgtcagagaactccgcgatgagtaatcccatccaggaattgagttcatcaatcgtgccgactgcttcgattcggagactatcttttgacgtccgtgatccatcacccagtccggtcgtgccatcatcgcctgttttggtatagagctttgttaatcggttacccattggaatccttgtgatgtgttgaaatttgctcgagtggtttgcgaatgagtaccagaagcaatagccctggaatgaccattactgcagttaacacgaaaaatagaggccaattgccacccgtccaatcgacaaaccatcctccgcttgatgccagcacggttcgacccgcattgccaatggatgccagtaaggcatattgagtggccgagaatgcttttccagtcagcgccgttaagaaactcacgaaagcgacggtcgagaacgccgtggtgaaattatcggtcaagatcgcaaacagcagaatggatttatcaggaccagccattgcaagccaggcaaacagtaaattactgccggccatcgcaacgccaccgataaacaaaccgcgtgtgactcctagccgaacgttgatgatg

SEQ ID NO: 1544 - DNA, 4000 bp, Escherichia coli
  misc_feature (199)..(199): n is a, c, g, or t
  misc_feature (201)..(201): n is a, c, g, or t
  misc_feature (203)..(204): n is a, c, g, or t
  misc_feature (207)..(210): n is a, c, g, or t
  misc_feature (212)..(223): n is a, c, g, or t
  misc_feature (227)..(228): n is a, c, g, or t
  misc_feature (230)..(230): n is a, c, g, or t
  misc_feature (232)..(233): n is a, c, g, or t
  misc_feature (238)..(238): n is a, c, g, or t
  misc_feature (240)..(243): n is a, c, g, or t
  misc_feature (245)..(245): n is a, c, g, or t
  misc_feature (357)..(357): n is a, c, g, or t
  misc_feature (394)..(394): n is a, c, g, or t
  misc_feature (397)..(397): n is a, c, g, or t
  misc_feature (415)..(415): n is a, c, g, or t
  misc_feature (485)..(485): n is a, c, g, or t
  misc_feature (497)..(497): n is a, c, g, or t
  misc_feature (503)..(503): n is a, c, g, or t
  misc_feature (723)..(723): n is a, c, g, or t
  misc_feature (736)..(736): n is a, c, g, or t
  misc_feature (761)..(761): n is a, c, g, or t
  misc_feature (1010)..(1010): n is a, c, g, or t
  misc_feature (1021)..(1021): n is a, c, g, or t
  misc_feature (1038)..(1038): n is a, c, g, or t
  misc_feature (1082)..(1082): n is a, c, g, or t
  misc_feature (1130)..(1130): n is a, c, g, or t
  misc_feature (1163)..(1163): n is a, c, g, or t
  misc_feature (1687)..(1687): n is a, c, g, or t
  misc_feature (1712)..(1712): n is a, c, g, or t
  misc_feature (2699)..(2699): n is a, c, g, or t
  misc_feature (2708)..(2708): n is a, c, g, or t
  misc_feature (2792)..(2792): n is a, c, g, or t
  misc_feature (2798)..(2798): n is a, c, g, or t
  misc_feature (3317)..(3317): n is a, c, g, or t
  misc_feature (3323)..(3323): n is a, c, g, or t
  misc_feature (3341)..(3341): n is a, c, g, or t
  misc_feature (3344)..(3346): n is a, c, g, or t
  misc_feature (3351)..(3353): n is a, c, g, or t
  misc_feature (3359)..(3359): n is a, c, g, or t
  misc_feature (3361)..(3361): n is a, c, g, or t
  misc_feature (3365)..(3365): n is a, c, g, or t
  misc_feature (3377)..(3377): n is a, c, g, or t
  misc_feature (3380)..(3380): n is a, c, g, or t
  misc_feature (3383)..(3383): n is a, c, g, or t
  misc_feature (3386)..(3386): n is a, c, g, or t
  misc_feature (3394)..(3395): n is a, c, g, or t
  misc_feature (3400)..(3400): n is a, c, g, or t
  misc_feature (3402)..(3402): n is a, c, g, or t
  misc_feature (3413)..(3415): n is a, c, g, or t
  misc_feature (3418)..(3420): n is a, c, g, or t
  misc_feature (3422)..(3422): n is a, c, g, or t
  misc_feature (3427)..(3430): n is a, c, g, or t
  misc_feature (3432)..(3432): n is a, c, g, or t
  misc_feature (3437)..(3437): n is a, c, g, or t
  misc_feature (3440)..(3440): n is a, c, g, or t
  misc_feature (3444)..(3444): n is a, c, g, or t
  misc_feature (3447)..(3451): n is a, c, g, or t
  misc_feature (3455)..(3455): n is a, c, g, or t
  misc_feature (3458)..(3458): n is a, c, g, or t
  misc_feature (3464)..(3464): n is a, c, g, or t
  misc_feature (3467)..(3467): n is a, c, g, or t
  misc_feature (3472)..(3473): n is a, c, g, or t
  misc_feature (3476)..(3476): n is a, c, g, or t
  misc_feature (3482)..(3482): n is a, c, g, or t
  misc_feature (3485)..(3485): n is a, c, g, or t
  misc_feature (3488)..(3488): n is a, c, g, or t
  misc_feature (3497)..(3497): n is a, c, g, or t
  misc_feature (3503)..(3503): n is a, c, g, or t
  misc_feature (3506)..(3507): n is a, c, g, or t
  misc_feature (3510)..(3510): n is a, c, g, or t
  misc_feature (3517)..(3517): n is a, c, g, or t
  misc_feature (3519)..(3519): n is a, c, g, or t
  misc_feature (3521)..(3522): n is a, c, g, or t
  misc_feature (3524)..(3524): n is a, c, g, or t
  misc_feature (3536)..(3537): n is a, c, g, or t
  misc_feature (3539)..(3539): n is a, c, g, or t
  misc_feature (3545)..(3545): n is a, c, g, or t
  misc_feature (3548)..(3550): n is a, c, g, or t
  misc_feature (3552)..(3553): n is a, c, g, or t
  misc_feature (3555)..(3555): n is a, c, g, or t
  misc_feature (3557)..(3557): n is a, c, g, or t
  misc_feature (3566)..(3566): n is a, c, g, or t
  misc_feature (3569)..(3569): n is a, c, g, or t
  misc_feature (3581)..(3583): n is a, c, g, or t
  misc_feature (3590)..(3590): n is a, c, g, or t
  misc_feature (3593)..(3593): n is a, c, g, or t
  misc_feature (3595)..(3595): n is a, c, g, or t
  misc_feature (3600)..(3600): n is a, c, g, or t
  misc_feature (3602)..(3602): n is a, c, g, or t
  misc_feature (3604)..(3605): n is a, c, g, or t
  misc_feature (3611)..(3611): n is a, c, g, or t
  misc_feature (3613)..(3613): n is a, c, g, or t
  misc_feature (3615)..(3615): n is a, c, g, or t
  misc_feature (3617)..(3617): n is a, c, g, or t
  misc_feature (3619)..(3619): n is a, c, g, or t
  misc_feature (3629)..(3629): n is a, c, g, or t
  misc_feature (3632)..(3632): n is a, c, g, or t
  misc_feature (3635)..(3635): n is a, c, g, or t
  misc_feature (3640)..(3640): n is a, c, g, or t
  misc_feature (3645)..(3645): n is a, c, g, or t
  misc_feature (3652)..(3653): n is a, c, g, or t
  misc_feature (3656)..(3656): n is a, c, g, or t
  misc_feature (3662)..(3662): n is a, c, g, or t
  misc_feature (3666)..(3667): n is a, c, g, or t
  misc_feature (3686)..(3686): n is a, c, g, or t
  misc_feature (3692)..(3695): n is a, c, g, or t
  misc_feature (3702)..(3702): n is a, c, g, or t
  misc_feature (3707)..(3707): n is a, c, g, or t
  misc_feature (3710)..(3710): n is a, c, g, or t
  misc_feature (3713)..(3713): n is a, c, g, or t
  misc_feature (3716)..(3716): n is a, c, g, or t
  misc_feature (3719)..(3719): n is a, c, g, or t
  misc_feature (3723)..(3723): n is a, c, g, or t
  misc_feature (3725)..(3725): n is a, c, g, or t
  misc_feature (3728)..(3728): n is a, c, g, or t
  misc_feature (3731)..(3731): n is a, c, g, or t
  misc_feature (3734)..(3734): n is a, c, g, or t
  misc_feature (3742)..(3742): n is a, c, g, or t
  misc_feature (3744)..(3746): n is a, c, g, or t
  misc_feature (3749)..(3749): n is a, c, g, or t
  misc_feature (3754)..(3754): n is a, c, g, or t
  misc_feature (3756)..(3756): n is a, c, g, or t
  misc_feature (3758)..(3758): n is a, c, g, or t
  misc_feature (3770)..(3770): n is a, c, g, or t
  misc_feature (3785)..(3785): n is a, c, g, or t
  misc_feature (3794)..(3794): n is a, c, g, or t
  misc_feature (3800)..(3800): n is a, c, g, or t
  misc_feature (3803)..(3803): n is a, c, g, or t
  misc_feature (3807)..(3807): n is a, c, g, or t
  misc_feature (3809)..(3810): n is a, c, g, or t
  misc_feature (3812)..(3812): n is a, c, g, or t
  misc_feature (3831)..(3831): n is a, c, g, or t
tcgaaattttatgtgtgtttgttgatggatatcacctgagatgtgaaggttttcataacgtgagagccagtcctcacggatagaatattttgattctaccttgtttggactttgatcttccaacggtgtcatcaaaatagtaagtcgccacgcgtagagtaactagcagcactttaagttgcgatcattgtacccaaantnannttnnnngnnnnnnnnnnnnaaannantnnaaaantnnnnantttttttcgagtgagaccgatctgcccacataaatagatgggtggtcgaaaaagcaacgccgcggtgatgcttctaaccatctaaatcattgacgatccaaaggcgcgtacntcgacgtcaatggatttctattgccgaaaggaatttncantatgagattaaacaaaanccaacaagaaacactcatgtatcaatctagactgttatttaagcatgataatgttgaatcagcattaganagatcattagcnattacnatatatacaaatgaagtatttgatacagaacactttaagagagcagtcttccagaagatacatcgagcaatttatggagctatatcagcaccagataactttacctattctatgatgattgcaggtgatgttgaaagctcaaggtctgggacagttgggttggaaaccttaaaggcagcttatgaacctcatttccatggtttactggtcttttctaaancagattggtgtcncattgaggcagacctacccaaatanatatatctaatacaatcagcaatttcagacatacgggaagtgaaaaaacctcttatcgatgatgatggtgtgtgcagttggaatacgatttgggtcaggaagtttgaggaaagtactaagccaaagcataagttctcctcgtcgttttcgaactacatcaattacatattcaagtctgacaaccatgcgcagaagcacggtatcgacacttatgtacctagtgtttttcctcatgatctttacccaccnaagactaaatnttcgtcaacagaggctntgttcaagcaattatgtttgattgaagaggagtttcagcagaancgggaaaaataccttaattgaggatattaagtgattttctagttcggntagtagtgaaatatgtaactaaattgcgctgtngtgattgatgtgtttgttttagatcgtagcgagcgatttgagatattcagcgacaaattatggttatctttattagttgccaaagttatgctgaacgctggatcgctgccctttgcatcaatggatttcttcgctgtggctgacaaaccattggatgagtaaaaggctttggcatcagacttgatatgccaattactaatgcctgctgatagttccattttgaggcttttggtggggctgaaccttacaccaactgaaaagtcatttgcattgatacttgtgtctgatgagcccgttaaatctaagttgtttcgctttccaatcagattagaggctttgagctttcttcgcgttatctccgctgtagtgaagaggttgaagtgtttttgttgaaaaaattggtatcgaccgtttaaacttaaataggtacctgtaacctttccattaaaattagcgcccgcaaaagatgtcttttgattgttgttttgcccatagcctaggtggctggagatggtaaaatttgnattgaaagttttgtgcacttggatnccggcgacacccaaagcgtattttgtggatacgccatcgatgaggatattacgatcagcttgttcaaaaagtgcgaaaggttcaattttataactgtcggcaatgcctgtagtggcaaataaaattaatgctaatgaacggattaggattataattttatattttgtcaattaatttggtccatttgcgttgttcctatctaaacttcatttaagcatattaaatctcattgcgatatcaaatcattcgtcctaacgttgttgcctaaatgaatggttggaaatagtcatgaaacatttgtcatccgctgcgtttagtaaacgaaattttgcttttgggatgtcgcccctcgcgcttctcacgctgactgcttgtggcggtggtggcggtggcggcagtacatcaagtggtgcgacgccttctgtttctgttgggggtagtgttgttaaggggccgttgagcaacgcacttgtaggcttggattatgacggtgatggcgttgtggacagtgcaacagtgcgcactgatgccaacggtggatattcgatttcaacaagcaacgcgacctataccgttatagctgttgcagatgatagcactgttgatacttcatctggtacagtattttcaggcgtgactttgaaagccccgaaaggggcaacagtggtaactcccacaaccacattaatggaagaaggtaacctaactgctacacaagttgcgagtgttttaggacttccagacggtgttgatccgctgacattcaatccctttgccgctggagtgagtgcaagtgatgcactggctgtggagaaagcaagtcagcaggtcatgagcgttgtaaatgcttttgcgtctgcggcagaaggtgctggtgctaccgaggctgcagcttacaccgccgcccttaattcaattgttgaagttgtgaagacaaaagcagctactagcggctcgcttgatctgaccaatacagctgatttggcnctcattaanacgcaggccaaaacagagatggcttccacctctggagtgaacacaacggcttttgatgccttggctgatgacacagcaacagcnattaanaatgtgaacgacaagattgcgacagtgtccgatctgacctcagatgcatcaaagaatattttctctacaactcaagttctggcagatcaggtcaagactgcggctgcggctgaggccagcagtgcgggatcgggcagcagcagtatcactttcacagatagtagtgtggtgaatacagcagcgagtaacaaagctccaacaaacatcgcgctgagttcaagcgccataagtgaagctgcaagctctctggtgataggcacactgaccaccactgatagtgaccaaacggctggggttaaaccgatatatgcacttgctgaagtagcaggttcggatcacgcagcgttcagcatcaatcaagcaacgggcgagttgtccctgaaagcgcagcccgattttgagaccaaatcctcatacagcgtcactatcttatctactgatgagggtgggaaaacattctcaaagacttttagtattagcattggtgatgccaatgatgcaccgactttgacggttccnacgggnggttccgtaactgaggangcnnncacgnnnacgatnangggnagtcttaccagntcnganccngagaatgnnacacngncttacattttnnntgnnncnacttnnnntnatggnagntatnccnnnnntggnacntatggnacnttggnnctnaacgcntcnacnggtgcttanacttanacnntgnataatantncnncngctgttaatgcnntngatgcnagnnntnntnanactgagacnttntctgttaaagtnnntgatggnacnancacancngnngcccanancntnancttcacgatnaanggngcggnagatnagcctgnnatnactgtntctnntcttacatccattgctganaactcnnnnaatgctnttgcngcnacngtnagngctncngangcngangatggtantnnnacngttgngntnagtggcagtggncgtgacgatgcaaantttgaaatngtcganggnaaantnngnatcaaaacatctgctgatnatgaagcgcaaggcacgtatcaagtgcagctaaaagtcactgatagtgctaataacacagtattaaaaaatatcgaatttggtgtcactgatgttgctgaagccattagcggttctatcgttgacggttatgtcgctggcgcgactatcttccaagatttggataacga

SEQ ID NO: 1545 - DNA, 4000 bp, Escherichia coli
  misc_feature (1428)..(1428): n is a, c, g, or t
  misc_feature (1978)..(1978): n is a, c, g, or t
  misc_feature (1992)..(1992): n is a, c, g, or t
  misc_feature (1996)..(1996): n is a, c, g, or t
  misc_feature (2198)..(2198): n is a, c, g, or t
  misc_feature (2506)..(2506): n is a, c, g, or t
  misc_feature (2530)..(2530): n is a, c, g, or t
  misc_feature (2629)..(2629): n is a, c, g, or t
  misc_feature (2791)..(2791): n is a, c, g, or t
  misc_feature (2905)..(2905): n is a, c, g, or t
  misc_feature (3064)..(3064): n is a, c, g, or t
  misc_feature (3076)..(3076): n is a, c, g, or t
  misc_feature (3080)..(3080): n is a, c, g, or t
  misc_feature (3380)..(3380): n is a, c, g, or t
  misc_feature (3404)..(3404): n is a, c, g, or t
  misc_feature (3467)..(3467): n is a, c, g, or t
  misc_feature (3556)..(3556): n is a, c, g, or t
  misc_feature (3662)..(3662): n is a, c, g, or t
  misc_feature (3707)..(3707): n is a, c, g, or t
  misc_feature (3764)..(3764): n is a, c, g, or t
atgttttttactccaggatgatctctcttaagaaagaaacaggaaaaactttttacaaatacggctgaaacaaaaggtgttgaaaactgttaataaaattgttgaaaatgtttgtgatagtgacatataatctagccgatagcgacatgcagatactatcaggcttcggaaaggaggtatgaatgtttaagcgaagcggtgtctggtggacgtgtataaggcataatggtagaaagattcaaaaaagccttgagacctcagatcgaaaactggcaaaagcaatcgaagcaaagattcgaacagagattattgaaggaaagtattatgaaaaacctatctataatgaacgaactttcttgccgttgattgctaaattcatgaaggagtatgcaccaaagaagtccgttagtatgcagagaagctatactgcatcttcaaaacatcttattcctttttttggtaacataaacttgttgttaataacagccaaaaagatatcaaagtataaggtgttaagatatgaagagggtgtaagtcctgcaactattaatcgtgagacggcaatgttatccaggatgttcactatagcagttgaggagtgggagtggttagatcataagcctttcttgaggataaaaaaagagaaagaaaacaatgttcaggaaaaatacctgacatcggacgaagaaaagaggcttattgagaactgccctgaatggttaaaaggtttagtagttttttcgctaaacactggactgaggcagaatgaacagctttcattgacttgggagagagtgtctttgcaacgaagagacattcttattctggaaacaaaatctggcaggcctagaagtattccattgaacaaaactgctataggagtacttgaaagaaatgcaaagactcgaagcatcaaaaatgatctagtatttttcagcaattgtgggacaaagcttaacaactgtaatcttataagggcttttaaaagagcggtaaagaggacaggaatcagtgactttacatggcacggactgagaagaacatttgcgactcgtctggctcatagaggcttagatatctataaaatttcaagattgctcggtcatgaagatgttcagacaactcaaaggagatatgcccatcattgtactgaaagtctgagaattggagttgatattttagattctgactacaatttgactacaatcggtgaaaaagagggttttttgagtgcttctaggttgtcgtaagtctttgggggagaataaattggggtaccaggattcgaacccggacaaattgaaccagaatcaattgtgctaccattacacaataccccaatgaattactcattttatttcatatctctttaatatcaataaaaaaatttgtactcttgttaatttattgagaacttgcaggtttttnccctatatggactgtaactatacccagtgttctggtaaaaaatcttacatctttcaggccgcattgctccatctttttcttcaggcttaatctatccgggaaggccaatactgattgtggcagatatgaatatgcatcaaccttgcttttggctatcaaccgtcctatcattggtagtattctggtaaagtaaaaaaagtatatttttttaaaaagaaagtttgtcggttgcgaaaattccaatatgacaactttgccattcggcccgaccactcttctcatctcttttattccctcttccagattcgagacgtttcttataccaaaagcaacagtagaaacatcgaatgcgttgtcacgaaagggaagttgtagtgtatctgcttctacaagtttgatcttgctttccagatgcctcttcctgattttaggtaatccgtatttcagcatgccgtggcaatagtcacttccgaccacaagcccatttccatttaataatttagaatgagatatggcaagatctccggtgccggtacaaacatccagcacntttgtgtgtggctntatntcacttacttttacggcaaattttcgccatgacttatcgaagttaagactcaaaatcgcattcaggagatcatatactcctactatagagccaaacatgctctttatgctttctgctttcttttttaagagttcctcttgttgtatttcactatcagtattcattaacaatttggcaggtgcagggaaggtaacacttgccnacccttttgcactactttagtttattttttgctctatctcagaaagtatctcattcatgcttccgctacggtaaccttcaagatccagtgtaacataagtaaaaccgatatttttaaacttagctgataattcttctctgacaggtgaattagtaaggatgtgtatatcctccggcaaaacctcaatcctggcaatagtttcatggtgcctcactctaaactgtatcaggcctagagccctcaggtatttttctgcttctgaaaccatactgagcttctcttccgtgatagactgtccgtatggaaanctggaagacaaacaggcatacgcnggtttatcccagttaggcagatttaagaatttagagacttcacgtatgtctttctttgtcaaacctgtttcctttaaaggactcctgacattcagctcnctggatgcctgcaatccgggacggaattcctgtgtgtcgtctagattcgcaccgtcagcaacgttcagaaaaccctgttctcctgctatctctttcaactttccaaatagttcagttttgcaaaaatagcacctttcaggagggttatttgcaaatccttcnatagccagttcgctggtgtctattacaaggtgtttaatacctatctcatcggccaacttttgcgactccttaaactcaaaatcaggataggtttccgaccttgccgtaaccgcnatagatttgtcttttagggtgtcgtaacatacttttgcaacaagcgtactgtccacaccaccggaaaatgcaaccacaacactctcaagtttactgacaaccgcttttaatttagatagtttttcttctacttccaaagctacatcctcgtttaaattngttgtttgttcnttanatgtatgccctatgaggtgtccaaagcaacgagctggtaataaattttcaatttacgatgttaacacacacacatgatgaatgcaaatatcgatttagggcttttggtagggagtatagtggaaatatttctcatcaggtccaaacatttttttgagaaataatgctcaggcaggcatctacaacattgggatcgtatagtatatttctgttgttagatatttcctcttgcgctttttcaatgcctagcgccggtctataaggtctatgtggcactatagcatccacaacatcggctacnctcaggattctggcttcgatgagnatcttttcaccttgtagacctgacggatatccggaaccatccattctttcgtgatgttgaagnacgtattctgcaataggccattgaaattcaattgtctttaatatgtcataaccggcttgtgaatgtgtctttatcaggtcgaattccanttttgttaattttccgcatttactgagtatttcagtaggaacctgcatctttcctatatcatggatagcccctgccagatgaatactatcaatacgttctctgggnaaacccattttttcagctatggagcttgcaagactggcaacctgnctctggtgaccggcagtgtaggggtctctcatttctactgtcattgccatggcacgnatggttccttcaatatttgtctttattttgtctgtactttttttaagttcttcatagagggactcactgagtttaacgtttctaaggataattccataagattcgacagcactgactactgtatccatgagctgttcgggatctcctttttgtacataagcgtgtggcctaaattgtctccttatgtctcttctctcttccagcatgacagtagtacctgtgtggaaaatgatagg

SEQ ID NO: 1546 - DNA, 4000 bp, Escherichia coli
  misc_feature (1)..(1): n is a, c, g, or t
  misc_feature (3)..(3): n is a, c, g, or t
  misc_feature (5)..(6): n is a, c, g, or t
  misc_feature (8)..(9): n is a, c, g, or t
  misc_feature (11)..(11): n is a, c, g, or t
  misc_feature (13)..(14): n is a, c, g, or t
  misc_feature (16)..(17): n is a, c, g, or t
  misc_feature (20)..(21): n is a, c, g, or t
  misc_feature (24)..(24): n is a, c, g, or t
  misc_feature (26)..(28): n is a, c, g, or t
  misc_feature (31)..(31): n is a, c, g, or t
  misc_feature (33)..(45): n is a, c, g, or t
  misc_feature (48)..(49): n is a, c, g, or t
  misc_feature (51)..(51): n is a, c, g, or t
  misc_feature (53)..(63): n is a, c, g, or t
  misc_feature (65)..(66): n is a, c, g, or t
  misc_feature (68)..(68): n is a, c, g, or t
  misc_feature (70)..(71): n is a, c, g, or t
  misc_feature (73)..(73): n is a, c, g, or t
  misc_feature (76)..(77): n is a, c, g, or t
  misc_feature (79)..(80): n is a, c, g, or t
  misc_feature (83)..(87): n is a, c, g, or t
  misc_feature (90)..(90): n is a, c, g, or t
  misc_feature (92)..(92): n is a, c, g, or t
  misc_feature (95)..(96): n is a, c, g, or t
  misc_feature (99)..(105): n is a, c, g, or t
  misc_feature (107)..(107): n is a, c, g, or t
  misc_feature (110)..(110): n is a, c, g, or t
  misc_feature (113)..(114): n is a, c, g, or t
  misc_feature (117)..(117): n is a, c, g, or t
  misc_feature (119)..(122): n is a, c, g, or t
  misc_feature (124)..(126): n is a, c, g, or t
  misc_feature (128)..(132): n is a, c, g, or t
  misc_feature (134)..(135): n is a, c, g, or t
  misc_feature (137)..(137): n is a, c, g, or t
  misc_feature (140)..(140): n is a, c, g, or t
  misc_feature (143)..(144): n is a, c, g, or t
  misc_feature (146)..(147): n is a, c, g, or t
  misc_feature (149)..(150): n is a, c, g, or t
  misc_feature (152)..(153): n is a, c, g, or t
  misc_feature (155)..(156): n is a, c, g, or t
  misc_feature (158)..(158): n is a, c, g, or t
  misc_feature (160)..(161): n is a, c, g, or t
  misc_feature (164)..(164): n is a, c, g, or t
  misc_feature (166)..(166): n is a, c, g, or t
  misc_feature (169)..(169): n is a, c, g, or t
  misc_feature (174)..(174): n is a, c, g, or t
  misc_feature (176)..(180): n is a, c, g, or t
  misc_feature (182)..(183): n is a, c, g, or t
  misc_feature (185)..(188): n is a, c, g, or t
  misc_feature (191)..(193): n is a, c, g, or t
  misc_feature (196)..(196): n is a, c, g, or t
  misc_feature (199)..(199): n is a, c, g, or t
  misc_feature (201)..(201): n is a, c, g, or t
  misc_feature (203)..(213): n is a, c, g, or t
  misc_feature (216)..(216): n is a, c, g, or t
  misc_feature (219)..(227): n is a, c, g, or t
  misc_feature (230)..(230): n is a, c, g, or t
  misc_feature (233)..(233): n is a, c, g, or t
  misc_feature (235)..(239): n is a, c, g, or t
  misc_feature (241)..(245): n is a, c, g, or t
  misc_feature (248)..(256): n is a, c, g, or t
  misc_feature (258)..(264): n is a, c, g, or t
  misc_feature (267)..(267): n is a, c, g, or t
  misc_feature (270)..(270): n is a, c, g, or t
  misc_feature (272)..(276): n is a, c, g, or t
  misc_feature (278)..(280): n is a, c, g, or t
  misc_feature (282)..(282): n is a, c, g, or t
  misc_feature (284)..(284): n is a, c, g, or t
  misc_feature (287)..(288): n is a, c, g, or t
  misc_feature (290)..(290): n is a, c, g, or t
  misc_feature (292)..(292): n is a, c, g, or t
  misc_feature (294)..(295): n is a, c, g, or t
  misc_feature (297)..(312): n is a, c, g, or t
  misc_feature (314)..(315): n is a, c, g, or t
  misc_feature (318)..(327): n is a, c, g, or t
  misc_feature (329)..(333): n is a, c, g, or t
  misc_feature (335)..(339): n is a, c, g, or t
  misc_feature (341)..(342): n is a, c, g, or t
  misc_feature (344)..(348): n is a, c, g, or t
  misc_feature (353)..(353): n is a, c, g, or t
  misc_feature (356)..(363): n is a, c, g, or t
  misc_feature (365)..(369): n is a, c, g, or t
  misc_feature (371)..(371): n is a, c, g, or t
  misc_feature (373)..(374): n is a, c, g, or t
  misc_feature (376)..(381): n is a, c, g, or t
  misc_feature (386)..(386): n is a, c, g, or t
  misc_feature (390)..(391): n is a, c, g, or t
  misc_feature (393)..(395): n is a, c, g, or t
  misc_feature (397)..(398): n is a, c, g, or t
  misc_feature (400)..(400): n is a, c, g, or t
  misc_feature (404)..(409): n is a, c, g, or t
  misc_feature (411)..(411): n is a, c, g, or t
  misc_feature (414)..(414): n is a, c, g, or t
  misc_feature (416)..(416): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (440)..(440): n is a, c, g, or t
  misc_feature (442)..(443): n is a, c, g, or t
  misc_feature (446)..(450): n is a, c, g, or t
  misc_feature (453)..(453): n is a, c, g, or t
  misc_feature (455)..(456): n is a, c, g, or t
  misc_feature (458)..(459): n is a, c, g, or t
  misc_feature (461)..(462): n is a, c, g, or t
  misc_feature (464)..(465): n is a, c, g, or t
  misc_feature (468)..(468): n is a, c, g, or t
  misc_feature (471)..(472): n is a, c, g, or t
  misc_feature (474)..(474): n is a, c, g, or t
  misc_feature (478)..(479): n is a, c, g, or t
  misc_feature (482)..(483): n is a, c, g, or t
  misc_feature (485)..(485): n is a, c, g, or t
  misc_feature (490)..(490): n is a, c, g, or t
  misc_feature (493)..(497): n is a, c, g, or t
  misc_feature (499)..(499): n is a, c, g, or t
  misc_feature (501)..(502): n is a, c, g, or t
  misc_feature (505)..(507): n is a, c, g, or t
  misc_feature (509)..(512): n is a, c, g, or t
  misc_feature (514)..(514): n is a, c, g, or t
  misc_feature (516)..(516): n is a, c, g, or t
  misc_feature (518)..(520): n is a, c, g, or t
  misc_feature (522)..(522): n is a, c, g, or t
  misc_feature (524)..(525): n is a, c, g, or t
  misc_feature (527)..(528): n is a, c, g, or t
  misc_feature (530)..(531): n is a, c, g, or t
  misc_feature (533)..(534): n is a, c, g, or t
  misc_feature (536)..(536): n is a, c, g, or t
  misc_feature (538)..(538): n is a, c, g, or t
  misc_feature (540)..(540): n is a, c, g, or t
  misc_feature (542)..(547): n is a, c, g, or t
  misc_feature (549)..(549): n is a, c, g, or t
  misc_feature (551)..(555): n is a, c, g, or t
  misc_feature (557)..(563): n is a, c, g, or t
  misc_feature (566)..(566): n is a, c, g, or t
  misc_feature (569)..(570): n is a, c, g, or t
  misc_feature (572)..(572): n is a, c, g, or t
  misc_feature (574)..(575): n is a, c, g, or t
  misc_feature (577)..(577): n is a, c, g, or t
  misc_feature (579)..(581): n is a, c, g, or t
  misc_feature (584)..(585): n is a, c, g, or t
  misc_feature (587)..(593): n is a, c, g, or t
  misc_feature (595)..(608): n is a, c, g, or t
  misc_feature (611)..(611): n is a, c, g, or t
  misc_feature (614)..(615): n is a, c, g, or t
  misc_feature (617)..(621): n is a, c, g, or t
  misc_feature (623)..(623): n is a, c, g, or t
  misc_feature (626)..(626): n is a, c, g, or t
  misc_feature (629)..(633): n is a, c, g, or t
  misc_feature (635)..(636): n is a, c, g, or t
  misc_feature (638)..(644): n is a, c, g, or t
  misc_feature (646)..(646): n is a, c, g, or t
  misc_feature (649)..(649): n is a, c, g, or t
  misc_feature (656)..(657): n is a, c, g, or t
  misc_feature (659)..(663): n is a, c, g, or t
  misc_feature (665)..(671): n is a, c, g, or t
  misc_feature (673)..(674): n is a, c, g, or t
  misc_feature (676)..(678): n is a, c, g, or t
  misc_feature (680)..(680): n is a, c, g, or t
  misc_feature (682)..(683): n is a, c, g, or t
  misc_feature (686)..(688): n is a, c, g, or t
  misc_feature (690)..(690): n is a, c, g, or t
  misc_feature (693)..(693): n is a, c, g, or t
  misc_feature (696)..(696): n is a, c, g, or t
  misc_feature (698)..(699): n is a, c, g, or t
  misc_feature (701)..(701): n is a, c, g, or t
  misc_feature (703)..(704): n is a, c, g, or t
  misc_feature (706)..(708): n is a, c, g, or t
  misc_feature (710)..(711): n is a, c, g, or t
  misc_feature (715)..(721): n is a, c, g, or t
  misc_feature (723)..(725): n is a, c, g, or t
  misc_feature (727)..(730): n is a, c, g, or t
  misc_feature (732)..(732): n is a, c, g, or t
  misc_feature (735)..(736): n is a, c, g, or t
  misc_feature (738)..(740): n is a, c, g, or t
  misc_feature (743)..(743): n is a, c, g, or t
  misc_feature (745)..(745): n is a, c, g, or t
  misc_feature (748)..(751): n is a, c, g, or t
  misc_feature (753)..(753): n is a, c, g, or t
  misc_feature (755)..(755): n is a, c, g, or t
  misc_feature (757)..(757): n is a, c, g, or t
  misc_feature (760)..(760): n is a, c, g, or t
  misc_feature (763)..(765): n is a, c, g, or t
  misc_feature (768)..(769): n is a, c, g, or t
  misc_feature (771)..(772): n is a, c, g, or t
  misc_feature (774)..(777): n is a, c, g, or t
  misc_feature (779)..(783): n is a, c, g, or t
  misc_feature (786)..(787): n is a, c, g, or t
  misc_feature (789)..(790): n is a, c, g, or t
  misc_feature (792)..(792): n is a, c, g, or t
  misc_feature (795)..(805): n is a, c, g, or t
  misc_feature (807)..(807): n is a, c, g, or t
  misc_feature (810)..(810): n is a, c, g, or t
  misc_feature (812)..(812): n is a, c, g, or t
  misc_feature (818)..(818): n is a, c, g, or t
  misc_feature (826)..(826): n is a, c, g, or t
  misc_feature (1987)..(1987): n is a, c, g, or t
  misc_feature (1990)..(1990): n is a, c, g, or t
  misc_feature (1999)..(1999): n is a, c, g, or t
  misc_feature (2439)..(2439): n is a, c, g, or t
  misc_feature (3359)..(3359): n is a, c, g, or t
  misc_feature (3922)..(3922): n is a, c, g, or t
  misc_feature (3971)..(3971): n is a, c, g, or t
  misc_feature (3996)..(3997): n is a, c, g, or t
ngngnngnngncnncnnccnnctncnnntcntnnnnnnnnnnnnnctnnangnnnnnnnnnnngnngntnntnttnntnncgnnnnngcncnccnnccnnnnnnngnacnacnnggngnnnncnnncnnnnncnncngcnggnngnngnngnngnngncnnccncnagnagggngnnnnngnngnnnngcnnnccnccncncnnnnnnnnnnnctncannnnnnnnnccnccncnnnnncnnnnngcnnnnnnnnnannnnnnngtngtncnnnnngnnntncnccnncntntnntnnnnnnnnnnnnnnnncnncannnnnnnnnncnnnnncnnnnngnngnnnnncgcgncgnnnnnnnngnnnnncngnncnnnnnnctccnccgnngnnncnncnaccnnnnnngncgncngctnctnctncgncgncancancncnncgnnnnnggngnngnngnngnncgncgnngngccnnccnncnccgcngcnnnnncntnnttnnncnnnncnancnnncngnngnngnngnngntngncnnnnnntngnnnnngnnnnnnnccnccnncntnncncnnncgnncnnnnnnnannnnnnnnnnnnnncgncgnncnnnnncngangannnnncnncnnnnnnncnccnccgcggnngnnnnncnnnnnnncnncnnngncnnccnnngnggnggngnngngnncnnngnngggnnnnnnncnnncnnnngncgnngnnnggngncgnnnncngngnggncgnnnganngnngnnnngnnnnncgnngnncnccnnnnnnnnnnnanacncnccgccngatgacanactatggtttcccagactagatgctcatacgagcgggtcctccattttcgccgcgcgcgagaggcgtcacacggccccggaaacttttttttggaaactttttacacccaacacgacacgtagttcataccagactactacctttgtatttaccgcgccgcgcgcgtaaagcgtatctatatgtacataaagttagtgatgtcatcacgcgatccccgcgacggcgccggcggcgaaggcggcgccatacgctccgacggttttcgccatcttcgcgcgcgcgcggcgccttcgccgccgctcgatcagcgccacctcgtcgggcacgccgtcgccgtcctcgtccctccccaccttcagcttcccgaacaccttggcccgcatggcctccatctgcgccttgggcaggttcttcatccgcgccttgacgaagcccaggacgatgggcacgcacgctccggcgacggcgcccaggatgggcgccaccaccgtctggttcacgacgaacacgccgacgcccttcgccgcgccgcgcgcggcggtcttccagatgggccactccatgcgggagaagtacgtgcgcgcgaacccctcccactcgcgcgcgtcgagcttgccgtcgttgttgtcgtcgtacttgctcaagatggtctccgccttctccttgacgcgcgggagctttccgacgccgcccaacatcgcctccaaccgtcggtacagcgcgtcgatggcgagcgtgagctcggcgacatcgaggctgggctcggagtcgtcgccctcgcggtggttgatgcccgcgcacttctcgaacacgtccttcagaaccgcgtcgaactccttggacaagatcagatccatccactgctgcttctgcgcccgcgcgttgccggcgttctcggcggctctcttgagtttctcctccgtggacgccatcgcgtcgtcgtccgaccggtccaacttacgcgtcagcttgcgcaccaggaactgggtcttccgcgacgtgctgtctagcaggtgtttcgccttcttcaggaccatcgcgggagggcggtccgccggcccggtgagtgggggcgcggagcgaggcgatcggagccgatacaaaagtaacaatcatcatctggccagctcgttcactggaaaatcttcgggcccgcaacnctnagtgcgcantgcccagtcagcacactgcatcgcagctctcattggtttatctgcgtgtgaaaaacctctcggcgtggcggtgtttggcgcgtcccactcgggacgaccgcgcgaccgccgaacgcacaccggcgcgttcgacagggcatcagtcgccttcgcgcgtatcgcacgcgcgcggctcgaggcctcgaacctccgcgtctgcccgtcccaggaacgcgttcgctcgcgtcccggatagacacctcagcagcgactggctctgcatcgacgacgggcgcgatgaccgcggcgtgcgcctccggcgtcggctcgggaatcgcaggcgcgacgaggacgggcgtttccgcgtcgtttcgcgatgccgcgcgtcgcggcggcggcgtgtcccgtctgagacgcgggcgacgcgttcccgtcgccccgcgcgcgggcctcgccgactntggcgtgggggatctcggcctcgggacgtcggagaccgccgcggcggcggcggcccagaccgccgcggcggcggcgccgagcgcggcgaatcggtacgccgagctgttccccgacctgcccgccttcgtgttcggcgtgagcgtgcccgactccgcgcgcgcgctcgccgacgccgcctcgcccgtcacgggcgcggcgctggaggcgctgccggacgacgcgcgcgcgggcgtgctcggcttctggtcggacgaggcggcgagcggcttcacgctgctcaccggcaacgccgagtacgagctcgcgctcgccgtgcttttatttttgtgggccaccgggcgccccggcgtgttcgcgggtgcgttcgacgcgtacgtcgccgcgcctctggacaaggttctgagcgaccgcgcgttcgaccccgcgtcggtgcgcctgggcgggcggctgggcgacggctccttcgggcaggtgtttgcggcgacggcgctcgcgacggacgcggacgtggtggtcaagcaggccaagtccgtgcagggtgcggcgcagctgcagtgcgcggaggagtacatgaaccggcgcgtgcgccgcgcgccgctcgcggccatcgggtgcgcgaagtacctgggcagctacgacgtcgtcgagggcgcggcgtcgccgacgctcgtctgggcgcgcgagggggacgcgacgctggaggacctgatcaacgcgcgggactaccccggctgcctggaggaggcgctgtacggcgcggtctccgactcggacgacttcgcgcggcgcacgagccgagccgcgaagtgcgtgctccggcgattgctgttcacgctctcgcagctgcacgacatcggcgtcgtgcaccgggacgtgaagcccgccaacctggtgctggcggaggacgaagccgcgttcntgctggtggacttcggcgccgccgcggatctccgcacgggatataactacgagccggagcagggtttgctggaccccttctactccccccccgaaaacttcatcatgcccgagagaatacccgcgccgccgccgctgcggcccatcgccgcgtccttctcgccgctcatctgggcggcgttcttgcccgacctgttcgactcgttcagcgcggggctggtgttcctgcagatgtgcgtcccgcagctgcgcggccggaaggtgatggacccgaacggcgcgttccgccggaacctggaaaacgccaactacgacctgcgaaagtggcgccgcgtcgtcgagccgcagggctgggacttcgccgcgctggacgtcggcggcggcctcgggtgggacctggcgtgccgcctggtgtgcaagcggaactttttgcagaggggcaggctcgggtgcaacaccgcgctgttgcacccgttcttctggacgccatgagcgaacgcgctctttcggtggggtctctcggcacgagcgcgacggggttctcgcgaccacggtagggacatngtgagtacgcgcgcgcgtcgtcgacgcggcgggcgcggagatgacttgngtacaagttgtacttccggacggcnncgt

SEQ ID NO: 1547 - DNA, 4000 bp, Escherichia coli
  misc_feature (110)..(110): n is a, c, g, or t
  misc_feature (207)..(207): n is a, c, g, or t
  misc_feature (284)..(284): n is a, c, g, or t
  misc_feature (356)..(356): n is a, c, g, or t
  misc_feature (1720)..(1720): n is a, c, g, or t
  misc_feature (1942)..(1942): n is a, c, g, or t
gtggagagtccgatctgctacaaaagcatcggttcccgttgcgtgcctgtcttgaggaagccggcgaattggtgcgcatgtcgcatcgcggcaaagatattgatctcgcnatcgaatgcgcgaccggcgttgacatacagggtgatcgccagcgcatatcacaggtttttgtaaatattctgagcaacgcttatgacgccagcgacncgggggatctgataagaatcatcgcctcagcagcagctgatcacacagagattacggtccgcgattttggtcacggnatgagcgaagaaatcagcgagcgaatttttgaaccgttcatgaccacaaagcagccaggtgaaggcacaggnctgggtatggcattaacgtacgggatcattcgtgaccacggtggatcgatagaagttgagagcgctccaggtgccggcacggaagtacggatcacgtttccggtgtcggacaaataaattatggaacacatcttaatcatcgaggacgaagcggtcatccgcaaagccctcgcgaagttgctcaaacgatcgggttactcggtttcggaggcaggctcggtcctcgaaagcgagcaacagttcagtctggactcctttgatctgatcattgctgatcttcggttgcccggcggactcgggaccgaagtcatcgagaagtgtgcgggcacgcctgttttgatcatgacgagttacgcaagcatcagttcggcggttgatgccatgaaagcgggcgctgccgactacatctcaaaaccttttaaccacgatgagattctggtcgtgattgaccgactcatccgccaaaacctgctctttcgtcagaaccaggcgttgcgacgtgatattcaacgcgagtatccggccagcggtatggtgggctcctcacaggcaatgcagcaggtgctctcgattatccaaaaagtggctaaaacccggtccacggtgttgatctgtggcgaatccggaaccggcaaagaacttgttgcgagagccatacatgatcagggcgagcgcaagaatgcgccactcgtgattatgaactgcgccgcaatccccgatagcctcatcgaatcggagctgttcggcttcgagaaaggggcattcaccggggccgacaaatcaaccccgggcctcattgagagcgccgatggaggcaccctctttctggatgaggttgccgagctgtctccacccgcccaggcgggactgcttcgcgtcattcaagagggggaatcacgaaggctgggctcgagtcacacaaaaacagtcgacgtgcgcgtgctcgcagccacacatcgaaaccttgacgagcgtgtgcgcaaaggattattccgcgaagaccttatgtatcgcctaaaagtggttgaaatcgaccttccccccttacgggatcgtcaagaagatctacctgcacttgcggaccacctactggatcgaatcagcgccaaactcaatcgacggtctctggcgttctccgcggaggcgttgcagaagatcctaaaacatgactggcccggcaacgtacgggaactggaaaacgcgattgaacgagcggtaattctttctgatggtgataccttgtcagcggatcaactcacgctttcctccatgaaaaccacatcgcaagaggctgacgcgcccttgactccaaaaggatctctcgacgattactttgtggagtttgtcgtcaagaacgaatcaantctcaatgagaccgaactggctaagagtcttggcatcagccgcaagaccctttgggagcgaagacaaaaattcggcattccacggaacatttcctcttcgcaagccaagaaataagcgcttctcatcggcgttaccccacactagagtgttaccttacgtaacactcttttcgaatctgagaagaactagatctcagaatgtaaataaataatgctgttttnaagcgattttcaatcttcggataactggcacgtatcttgcttaaagagtagcaacgcgccaaaggatgggcgcggaggcttaaccaaaactgcagttggaggctaaaaatggatcaatcaacacgtgaatcccattgggccaagacaaaggggttgatgattacgaccctgattatctggttcatattttcgtaccttgttcactggtttgctgacagcctgaacaacgtgacgttcatcggattccccctcgggtattacatggcggcacagggttccctcatcgtttttgtggtgctgattttctggttcgccagacgacaacattcgatcgatgtggagcatggcgtggcagaagacgaatagccagcaaccatcagaactaaggagaaacttacatgtctgtaattaaaggtgactttatagacaacctacccaaagtctacgggctttatacgggcgggtttgttgtcttcatcctgctgatggcgattcttgagcaggctggagtcagcgccgatacgatcggcatcttgttcgtagcattcaccgttctcatttatgcgggtattggttggttatcccgtacgatgcaggtcgatgcgtattacgttgcaggacgtcaggtaccggccttatttaacggaatggcgacagcagccgactggatgtccggtgcgtcgttcgtggcgatggccggtggcatctactttggcggccacggttacgtggcgttcgtcgtcggttggaccggcggttatgtgctggtggcctcgctgatggcgccgtatctgcgcaagtttggctgttacaccgtgccggactttatcggtacacgttacggcggcaaccttgcacgctttctggccgttctggttctggtcatcgcatcgtttacgtatgtgacggcacagatcaatgcgacaggaacgatcgcttcgcgggcgcttcaaatcccgtttgaagtcggagtgtggttcggcctgctcggcattctgctttgctccatgcttggtggtatgcgcgcggtaacctggacccaggtggcccagtacatcgtgctcatcattgcctatgtggtcccggtaatctggatgtccaacaagcaaggcttcggtctgatcccgcagtttgtctacggtgatgccatcatgcgaattacggaactcgaaacccttcacggggtcggaaccgctcccgctgagaagatcgctgggctggccgtgctgacgaaggctcattcggtggcgggctcgacgtttgcagccaaatggcagttcgctaccctggtgctttgcatgatggccggtacggcttcactgccccacattctgatgcgctacttcactacgcctagcgtaaaagcggctcgtcagtcggtagcatggtctctgctcttcatcttcctcctgtacttcaccgccccggcgctggcgacatttaccaaactgcagctgcttgatcctaatcttgcaaccagcatcattggtaaatcgatcgctgaagtgaacgcgatggagtggatacagaaatggagcgcggtcaagttcctggccatttcggacgcaaacggcgatggtatcctgcaaatcaatgagttcttcatgcgtggcgacatcgtcgtgctggcgactccagaaattgcggggctgccctacgtcatctccggccttgtagccgcaggtggtatggcggctgccatgtcgaccgccgacggactgctgttggcgatcgccaatgcgctgtcgcatgatctgtactacaagatcatcgatccgaaagccgacaccaagcatcgcctgatcgtcgctcgagtgctgctcatcttcatcggtgccgcaggtgcctttgtggcaagcttgaagcttacgagcattctcggtgcagtggcgtgggcctttgactttgccatgtcaggcttgttcttcccgctggtgctcggcatctggtggaagcgagccaaccgagccggcgcgattgcaggtatgttcttcggcctattggctggaacgctatacctctacgcggtgcgctggggtggcatggagccatggctct

SEQ ID NO: 1548 - DNA, 4000 bp, Escherichia coli
tgacaaccgatgtcgggattgaaaccaccaacggattgccaagttgtttgacgtaaaattcagcgtcaccgtttgcaaaacagttcacaactttgccgtcctcatagacgattagaattttcgcgggcataaaaaagccgcacgtccagtcgtgccgagtgatgcagttacgccgtgaggcgcgaaagcgtcggacacttccaaacgtgcggacggggtttgttggttcttcggtttctgcatcacggctctactttagcagagaccgtgccaagtgtcaagcggtcacattccggcggttttccgccggtgattgtgcgagcgcgtcactatttgaggcacagaggccggtttttggacagacaaggggcttgccgtggccgctgcggggcgtttgactggtgccgcaacggttttagccggaagcaccggcggcacggcggcggggcttttaaccgctgccacgttgacgggcgaaaagacgtgtttgatcccggccacgatcttgcttgcgggcgcgggcggcgccgcgattgcggcttccgctttgcgggcttcggtgacttcgagcatggcgtcgtcgagccggtcgagtgccatttccaaacgtgaggctgtcatagattttttacgattgtgctgccctgtttctccaaaaacgccacgacttttttttcgaccgccgcgttttggatgatgtaagtgatcgccagcacgacaaggattgcggagatcacgattgcgaagtgcgcggaaaaccatactgcgaaaatcggcaggatgataccggcggcacacactttgacaccggccacgatctgcccgaaataaaacaatgcgccggacgcgagcaagcagagaatcccggcggcgatgaaaagtttttcctcaaatgaaaccatttgccggacgggtgacaacgcgggcgcgggcgcgggcgtgacggcgggctggactgtggcgtgcgggatcggcgggacttccgccgtggaaattttgaacagggagcaaccggacaggaacgcgacggccagaatcatgcacaaaattgacaaggatttttttttcataggcaatcgtcgtccagttttaattttcccattttcgggcagatttgcaccaaaattttcagcaaggtttcctgcttcgtcattcgatgctcgaatcgcaaccaaaacagtgtaagcccactaagtagtgtaagcaacattaaaatttcggtgatgctcatgggttgagtaaaggccgcgtccaaatgttttgccacacagtttgcagcacaaaggccccgattggcaaagtggcaggaacaccgcctgaccaattcggcaccatgtcataaacgacttgctgcccgccaaaggattgcttggtaacgccgacgccgtaaagagtttccccggcggtgttgaaagaataattgtgcgtgcatcggctgactccgacgacgccggtgcccgacccggcaacttgcgcccaagacaactgcgcggtgttgtcaacgtagctcgttgccgggacaacgcccgtcgcgccgacgtgcgcgttttgcgtgaaagcggcgtccgtgatcacacgcaagtaacccggattgaccccgtccaaaactgcattggtgctatcggatgcgccagttgaaaggactgtttgtgttgcccatttttcaagcgcgaaagacccggtgaaagtgccggtgcctttgtattggttccaaacttggtcgcccgccgcgctcaaaaccgggatcggcggcgcgagcgtgaaaatcagttgcaaggtgatcacgacataatctgaaacaccgatcacttccggcgcgcccaaaactacgcggcctttgatgttgggatttgccccgccggtgctgccccaaccgagttcgttgatcgtataggatgtaactttcgtattgatgatgaaagtgcgttgatgcgtgactgtggcaacgccgcccgcataaaccggcgtggtgctgcacgcgcccggcgaggtcacataggcatcgtaattgtaagagaacgcaaccagtttcgtttgctgcgtcaaccagacagttccggcgtcgccgacgggcacggcacgcgaaacgtccacaacggcggttgtgccgccgccgccgatgctttggatatacgcttcaagtccgccggtcccgtggccgaatttgaaaatcccgccgaccattgcgccggtgaaaaatggagcggacgcggtgatcgtggtgagggcttgcgtgaaagtgatcacgccgccggtgatataattggccgttgcatccgatccgacacaaaggtttgtaaaaatgtcagcggtgccggtcatgttcgccaacgcagtcagtccagcgtcaaggacgacattgtggccacgaatttcgcgcttcacccttcgcgtcacggcatcatgcacgcggagccggtaattgacttgaagttttgttttcatttaattagtcgaaactccccacccttttccttgtaacgaagccttgcttagtagcccggcagcagatggagcagaattcaaaccgccggaagcaatgaaattcccatcaagcatcccgttggcgtcacatgcagccagagccgcatcaactgctgcttgtgtcagcgcgcatgagttacaatcgaatatcactaactgtggacaatttgaaatagtcgccgaaacttgcgagttgtttcccgaacaatatagcaccgttaattgggtcaagccggtcaaatccaaatcaacgagtgccccgttatcttgggcggaaagaatctgtaattttacgcatgaactcacgtccaacgcggttaaattcaggtctccaatgtctccggacgaaacgtccaaatatgttaaatcgccgctgaaattagaatccacggcactaatacaaggccatactttgcaaaatgcatttgaaccagccacaaacgcgttgctgtcgttggcgtaaatgacaatcgttccgctggcgtcttgcacggcgaaatatccagtgcttgtttcggcggtgaaattgtaatccgtcgaaccgtcacctgttaaaatggctgtttgatctttcatgcgaaacagggagacgcacgaaatggcgtctccgacctcctctccggttgtgattggcacggcaatcgggtgaaccagcgtaacgcatgaaatgagcgtgtcgggagcgtcggaaatagcaatgtcaatttccggcgagtgataaagtgaaacgcatgaaatgagtgtgtcgggattttcgctgccggtgatcgggattgcgccgggcgtgtgcatatagaagcacgacaaatcgctgcccggattttcaccggcgacaagcgtttcttcaatcggagcaatgagcaaaaagcacgacaaatcgctgccgggattttcctgcatgagcagatcaaacgtgtcaggccgtttgatggtgagcaacggcgtcggagtggcattgatttgctgatatggatcgtatggcttgaacacattttatcaggccgggatcgcggcgtaaatttcggaaataattgcgttgatcgcggcggcttggatgattgagtaatcgccggacacgtcgaaacgaacgggcgtgagcggttgcaccgcgccgatacttccatcggcaaggccggtcgcgttctttttttgcaggaaatacttgtcagcgttcgagcagttgaaaacttcgattgcgatccggtagagcggcaaccattttttgccgttgatgtccaaaaacgacgatccggtgagatcgggaatttgaattgagacggcggcgtttgcgacgggataaaccgggttcgccacgttttgaatataagcgttggaaagaatgagttggttgttaacgaagtcggaaaaacccgtccagatcgaaaccacgaccggaacggtattcggattttgaatgtccactacgtcgaacgccacggtgttctcgccgggctgctgtcgtgtcccctgcccttgttgataaagtgaataagagtcggtgccgtagcgatgtccg

SEQ ID NO: 1549 - DNA, 4000 bp, Escherichia coli
  misc_feature (1676)..(1676): n is a, c, g, or t
  misc_feature (1718)..(1718): n is a, c, g, or t
  misc_feature (1844)..(1844): n is a, c, g, or t
  misc_feature (1985)..(1985): n is a, c, g, or t
  misc_feature (1992)..(1992): n is a, c, g, or t
  misc_feature (2006)..(2006): n is a, c, g, or t
  misc_feature (2063)..(2063): n is a, c, g, or t
ttgatgaaataagtaaaatagtagatcgtaagcaggtaatgcctttggttttagggatgttggatatgaaagttgctatgattcatcagcacttggaggagaagtataagcccaaaagggttcgttacgtttcattagccaaacactatcactcagaagaaagtttaaaagcactttttgatagcttgcaaaaagcaccaaaacaacttgctgtacttatggcaattttcactgattcaactggacacaaagagcttaaaaaagtgtcaattttgaagtctaaatcaggatcaggtagtagccaaataaaaacactaattgacaaaggggttttagaagagcaatatcaagatgagcaccgtttgttaattaaacaacaacaagatgttttaggaaataaaacactctctgatgctcagcaattgtctttagatgaaatcaaaaaacagtttgataataaaaaggttgttttatttgagggtgttacctcctcaggaaaaacggaggtatatatcaagttgattgaagagcaactagcccatggaaatcaagttctgtatttattgccagagatttctttgacctcacaaattgtaaatcgattggcagcaagatttggagaccaagtaacggtatatcattcaaaattttctattcacgaacgagccgaggtgtggcaaaaagtattaactgcctctccagaagcaagagtaatagtaggtgcacgctctgctgttctcttgccgtttgaaaatctaggattagttttgatcgatgaggaacatgaaaattcctacaaacaatttgatccagctccacgttatcaagcacgagacagcgctatatatttagcaaatctaatgcaatcaagagtattattaggttctgctacaccctctttggaatctgcagagaatgttcgaactggaaaatatggatgggttcgattaacagaacgctatggtggtgtttctttgccaaagattgaactcatagatttgaaagaagctaaccgaaagaaaatgatgaaagggatgttttcgtctcaattaattgatgcaattcaacatactttatctcaaggcaagcaagtgattttattccaaaaccgaagaggttatgctccaatatctgaatgtacaagttgcggccattcgcctcaatgtactcagtgtgacgtttcattaacctatcatcaaacacaacaacaattacgttgccattattgtggctataatattcctatgccaaatcaatgtcacgcttgtggaatgccaactctcacgactaaaggcgcaggaacgcaacaaatagaagaacagattaaagctttttttccagaagtagccgtaggtcgaatggactgggacagtacgcgaggcaaatggagttttgatgcaattattgagtcttttgttcaagaaagaattcaaatcttagttgggacacagatggttgttaaggggctggattttaaaaacgttttattggttggtgttatcaatgcagatcatgtattgaacttcccagattttagagctcatgagcggagttatcagatgttatgtcaagttgcaggtagggcagggcgctcggataggaagggtaatgtattgattcaaacttatcaaccagaacatccaatattaagacaggttttagatcatgattatganggtctctaccaaactcaaaaaaaggaacgccatgaatacaantaccctccttattacaggatgatccgtattaccttcaaaagtaggcagtatgacactgttaacttagcttctgaatggtttactaatgtgctcaggcaatcttatgaaggaacagtattgggtccngtatttccatctgttgctcgaataagaaatcagtatcacaaacaactagtcgttaaaattgatcataattttaccccccaagtgataaaaaaaaccttagaaagaactctacaaagttttcaggctattgccgcttttagnagtactngagtaaattttgangtagacccttattgaaatctgctcaataaaagacgaaattgttttttctgtgttcgncttaaagggaagtctttattttcaatatttacggaggatgaagaataattaataacctttttaaggttaatgatgtaggatttgtggattcgtgaaaactgttcttgtggtaagcgggttaaaaaatccttcattgttgagagtaccaagaatttttttttgtgagttataatttttatataatctcctacagcttcaatccattggatttgatcaatggctattttttcagtcttaaggttgtgtttgatttcaataaaatcatttgttttttttgtgatactaagacttagtttgattctttgttcaatacgagcaatagattgttcaatacgctccaatgaaaaaggaggtgagatacagtcggctagatttaaatcaaaagcacgaagagcatcctctgcctgttcggtcataagaatgatttctgtagggtcttttaacctttcaataaaatcaaacccattataaacagggagttttgcagagagaaatataagatctacagaggagtaatttagaaaattttgagcttcaacagcgttagaaaattcagcaataaagtttagtgttttaacttttttgaggatttgcgataggtaaaggcgcctaattggattaggatcaaccaaaatatagttaaggagcattgtttaaataatatagtgctacaaatataattaaaaaaactttattttaaagtgatctttatttggtatactgtatagtttaagttatttttgccaaccaaaataaagattatgaatcaatacgaaactgttttcattttaaatcccgttctctctgaaactcagattgaggaagcagttcaaaagtttgtagaatttattaagaccaaccaaggttcaatgacgagtcaggaaaattggggtcttaagaaacttgcttatcctatcgagaataagaaaagtggcttctatcatctttttgaatatgcagcaccaagcgaagccgtagcggctttagaggtagaatttcgccgtgacgagcgtatcatgcgttacttaacggttaaactcgacaagcattcactagcgtgggcagaaaaaagaagaaaaaagaacaaagcaaaagcataagcaatgtctaaaatagaagaacaaaattcaggaaaaaaagaaggtgaaattcgctatttaactccgttaaatatcgatacatctactcaaaaaaaatactgtcgttttaaaagaactggtatcaagtatgtggattataaagatccagactttttaatcaagtttgtaaacgagcaaggcaaaattttaccacgaaggttaacaggaacttcattgaagtaccaacgtaaagtttcagtggctgtaaaaagagcgcgtcatttggcattaatgccttatgttgccgatatgttaaaataataatcactcatcatggaattaatattaaaagaagacgttcaaaatcttggatttaaagatgaaatcgtgagtgttaaaaatggttacggtagaaattttttaatcccaacgggggttgctgttatggctactgtgtcagctcgaaaagtattagctgaaaatctaaaacaacgtgcattcaaagaaaaagcagttgttgatgaagcaaaagctagagctgagaaaatccaagcacttgaaattaaaatcgcttccaaagtaggaagtggagacaaactttttggatcaatttctaatgcagatcttgcgtctgcaataagctctaatggcgatgatcttgacaagaagtttattacactacctgggaaaacaatcaaacgtttaggtaaatacgaggcaactattcggttacatcgagaagtaagttttgaatttccgtttgagattgtgcctgaaacgaaagcttagtaaaatttaaacccgctttatgtgggttttttttattctaaaaagtaagaatgaaatatcacaggctca

SEQ ID NO: 1550 - DNA, 4000 bp, Escherichia coli
  misc_feature (1)..(5): n is a, c, g, or t
  misc_feature (7)..(8): n is a, c, g, or t
  misc_feature (10)..(12): n is a, c, g, or t
  misc_feature (14)..(18): n is a, c, g, or t
  misc_feature (20)..(20): n is a, c, g, or t
  misc_feature (23)..(31): n is a, c, g, or t
  misc_feature (33)..(34): n is a, c, g, or t
  misc_feature (36)..(37): n is a, c, g, or t
  misc_feature (39)..(40): n is a, c, g, or t
  misc_feature (44)..(45): n is a, c, g, or t
  misc_feature (47)..(47): n is a, c, g, or t
  misc_feature (49)..(49): n is a, c, g, or t
  misc_feature (51)..(52): n is a, c, g, or t
  misc_feature (55)..(63): n is a, c, g, or t
  misc_feature (65)..(67): n is a, c, g, or t
  misc_feature (69)..(70): n is a, c, g, or t
  misc_feature (72)..(73): n is a, c, g, or t
  misc_feature (77)..(78): n is a, c, g, or t
  misc_feature (80)..(80): n is a, c, g, or t
  misc_feature (82)..(85): n is a, c, g, or t
  misc_feature (87)..(90): n is a, c, g, or t
  misc_feature (94)..(96): n is a, c, g, or t
  misc_feature (99)..(105): n is a, c, g, or t
  misc_feature (107)..(108): n is a, c, g, or t
  misc_feature (110)..(115): n is a, c, g, or t
  misc_feature (122)..(125): n is a, c, g, or t
  misc_feature (128)..(128): n is a, c, g, or t
  misc_feature (130)..(130): n is a, c, g, or t
  misc_feature (133)..(135): n is a, c, g, or t
  misc_feature (137)..(138): n is a, c, g, or t
  misc_feature (140)..(141): n is a, c, g, or t
  misc_feature (143)..(145): n is a, c, g, or t
  misc_feature (147)..(148): n is a, c, g, or t
  misc_feature (151)..(151): n is a, c, g, or t
  misc_feature (154)..(163): n is a, c, g, or t
  misc_feature (165)..(168): n is a, c, g, or t
  misc_feature (170)..(170): n is a, c, g, or t
  misc_feature (172)..(175): n is a, c, g, or t
  misc_feature (177)..(179): n is a, c, g, or t
  misc_feature (181)..(182): n is a, c, g, or t
  misc_feature (184)..(188): n is a, c, g, or t
  misc_feature (191)..(192): n is a, c, g, or t
  misc_feature (194)..(200): n is a, c, g, or t
  misc_feature (202)..(202): n is a, c, g, or t
  misc_feature (204)..(204): n is a, c, g, or t
  misc_feature (206)..(206): n is a, c, g, or t
  misc_feature (208)..(217): n is a, c, g, or t
  misc_feature (220)..(226): n is a, c, g, or t
  misc_feature (229)..(230): n is a, c, g, or t
  misc_feature (232)..(232): n is a, c, g, or t
  misc_feature (234)..(234): n is a, c, g, or t
  misc_feature (236)..(236): n is a, c, g, or t
  misc_feature (240)..(240): n is a, c, g, or t
  misc_feature (243)..(243): n is a, c, g, or t
  misc_feature (245)..(255): n is a, c, g, or t
  misc_feature (257)..(258): n is a, c, g, or t
  misc_feature (260)..(263): n is a, c, g, or t
  misc_feature (267)..(267): n is a, c, g, or t
  misc_feature (269)..(278): n is a, c, g, or t
  misc_feature (281)..(284): n is a, c, g, or t
  misc_feature (286)..(287): n is a, c, g, or t
  misc_feature (289)..(292): n is a, c, g, or t
  misc_feature (296)..(298): n is a, c, g, or t
  misc_feature (300)..(300): n is a, c, g, or t
  misc_feature (305)..(306): n is a, c, g, or t
  misc_feature (308)..(311): n is a, c, g, or t
  misc_feature (313)..(313): n is a, c, g, or t
  misc_feature (315)..(315): n is a, c, g, or t
  misc_feature (317)..(318): n is a, c, g, or t
  misc_feature (320)..(322): n is a, c, g, or t
  misc_feature (325)..(325): n is a, c, g, or t
  misc_feature (327)..(329): n is a, c, g, or t
  misc_feature (331)..(339): n is a, c, g, or t
  misc_feature (343)..(350): n is a, c, g, or t
  misc_feature (352)..(354): n is a, c, g, or t
  misc_feature (356)..(367): n is a, c, g, or t
  misc_feature (369)..(376): n is a, c, g, or t
  misc_feature (379)..(380): n is a, c, g, or t
  misc_feature (382)..(386): n is a, c, g, or t
  misc_feature (389)..(390): n is a, c, g, or t
  misc_feature (394)..(395): n is a, c, g, or t
  misc_feature (398)..(400): n is a, c, g, or t
  misc_feature (402)..(403): n is a, c, g, or t
  misc_feature (407)..(408): n is a, c, g, or t
  misc_feature (411)..(414): n is a, c, g, or t
  misc_feature (416)..(416): n is a, c, g, or t
  misc_feature (418)..(422): n is a, c, g, or t
  misc_feature (424)..(427): n is a, c, g, or t
  misc_feature (429)..(433): n is a, c, g, or t
  misc_feature (436)..(436): n is a, c, g, or t
  misc_feature (438)..(442): n is a, c, g, or t
  misc_feature (444)..(444): n is a, c, g, or t
  misc_feature (447)..(449): n is a, c, g, or t
  misc_feature (452)..(453): n is a, c, g, or t
  misc_feature (455)..(456): n is a, c, g, or t
  misc_feature (458)..(467): n is a, c, g, or t
  misc_feature (469)..(472): n is a, c, g, or t
  misc_feature (475)..(478): n is a, c, g, or t
  misc_feature (480)..(481): n is a, c, g, or t
  misc_feature (483)..(483): n is a, c, g, or t
  misc_feature (488)..(491): n is a, c, g, or t
  misc_feature (494)..(495): n is a, c, g, or t
  misc_feature (497)..(497): n is a, c, g, or t
  misc_feature (499)..(499): n is a, c, g, or t
  misc_feature (501)..(503): n is a, c, g, or t
  misc_feature (505)..(507): n is a, c, g, or t
  misc_feature (509)..(510): n is a, c, g, or t
  misc_feature (512)..(512): n is a, c, g, or t
  misc_feature (516)..(521): n is a, c, g, or t
  misc_feature (523)..(523): n is a, c, g, or t
  misc_feature (525)..(529): n is a, c, g, or t
  misc_feature (531)..(532): n is a, c, g, or t
  misc_feature (534)..(535): n is a, c, g, or t
  misc_feature (538)..(550): n is a, c, g, or t
  misc_feature (554)..(554): n is a, c, g, or t
  misc_feature (556)..(558): n is a, c, g, or t
  misc_feature (560)..(566): n is a, c, g, or t
  misc_feature (568)..(571): n is a, c, g, or t
  misc_feature (575)..(576): n is a, c, g, or t
  misc_feature (578)..(578): n is a, c, g, or t
  misc_feature (580)..(583): n is a, c, g, or t
  misc_feature (585)..(587): n is a, c, g, or t
  misc_feature (589)..(591): n is a, c, g, or t
  misc_feature (593)..(600): n is a, c, g, or t
  misc_feature (602)..(602): n is a, c, g, or t
  misc_feature (604)..(605): n is a, c, g, or t
  misc_feature (607)..(609): n is a, c, g, or t
  misc_feature (611)..(611): n is a, c, g, or t
  misc_feature (614)..(617): n is a, c, g, or t
  misc_feature (619)..(619): n is a, c, g, or t
  misc_feature (621)..(629): n is a, c, g, or t
  misc_feature (631)..(631): n is a, c, g, or t
  misc_feature (633)..(640): n is a, c, g, or t
  misc_feature (642)..(645): n is a, c, g, or t
  misc_feature (648)..(650): n is a, c, g, or t
  misc_feature (652)..(654): n is a, c, g, or t
  misc_feature (661)..(662): n is a, c, g, or t
  misc_feature (664)..(666): n is a, c, g, or t
  misc_feature (668)..(676): n is a, c, g, or t
  misc_feature (678)..(678): n is a, c, g, or t
  misc_feature (681)..(682): n is a, c, g, or t
  misc_feature (684)..(685): n is a, c, g, or t
  misc_feature (687)..(697): n is a, c, g, or t
  misc_feature (699)..(702): n is a, c, g, or t
  misc_feature (705)..(705): n is a, c, g, or t
  misc_feature (707)..(707): n is a, c, g, or t
  misc_feature (709)..(710): n is a, c, g, or t
  misc_feature (713)..(713): n is a, c, g, or t
  misc_feature (717)..(722): n is a, c, g, or t
  misc_feature (725)..(728): n is a, c, g, or t
  misc_feature (730)..(739): n is a, c, g, or t
  misc_feature (741)..(742): n is a, c, g, or t
  misc_feature (744)..(748): n is a, c, g, or t
  misc_feature (750)..(751): n is a, c, g, or t
  misc_feature (753)..(764): n is a, c, g, or t
  misc_feature (766)..(771): n is a, c, g, or t
  misc_feature (773)..(774): n is a, c, g, or t
  misc_feature (776)..(781): n is a, c, g, or t
  misc_feature (783)..(783): n is a, c, g, or t
  misc_feature (785)..(786): n is a, c, g, or t
  misc_feature (793)..(793): n is a, c, g, or t
  misc_feature (795)..(800): n is a, c, g, or t
  misc_feature (802)..(806): n is a, c, g, or t
  misc_feature (808)..(808): n is a, c, g, or t
  misc_feature (810)..(810): n is a, c, g, or t
  misc_feature (812)..(817): n is a, c, g, or t
  misc_feature (821)..(821): n is a, c, g, or t
  misc_feature (823)..(837): n is a, c, g, or t
  misc_feature (839)..(842): n is a, c, g, or t
  misc_feature (844)..(847): n is a, c, g, or t
  misc_feature (850)..(851): n is a, c, g, or t
  misc_feature (853)..(857): n is a, c, g, or t
  misc_feature (859)..(861): n is a, c, g, or t
  misc_feature (863)..(874): n is a, c, g, or t
  misc_feature (876)..(881): n is a, c, g, or t
  misc_feature (883)..(883): n is a, c, g, or t
  misc_feature (885)..(886): n is a, c, g, or t
  misc_feature (888)..(902): n is a, c, g, or t
  misc_feature (904)..(907): n is a, c, g, or t
  misc_feature (909)..(909): n is a, c, g, or t
  misc_feature (911)..(914): n is a, c, g, or t
  misc_feature (916)..(922): n is a, c, g, or t
  misc_feature (924)..(928): n is a, c, g, or t
  misc_feature (930)..(937): n is a, c, g, or t
  misc_feature (939)..(946): n is a, c, g, or t
  misc_feature (948)..(948): n is a, c, g, or t
  misc_feature (950)..(950): n is a, c, g, or t
  misc_feature (954)..(955): n is a, c, g, or t
  misc_feature (957)..(957): n is a, c, g, or t
  misc_feature (959)..(963): n is a, c, g, or t
  misc_feature (965)..(969): n is a, c, g, or t
  misc_feature (971)..(971): n is a, c, g, or t
  misc_feature (973)..(973): n is a, c, g, or t
  misc_feature (976)..(976): n is a, c, g, or t
  misc_feature (978)..(993): n is a, c, g, or t
  misc_feature (996)..(1012): n is a, c, g, or t
  misc_feature (1016)..(1016): n is a, c, g, or t
  misc_feature (1018)..(1020): n is a, c, g, or t
  misc_feature (1023)..(1028): n is a, c, g, or t
  misc_feature (1030)..(1032): n is a, c, g, or t
  misc_feature (1034)..(1036): n is a, c, g, or t
  misc_feature (1038)..(1043): n is a, c, g, or t
  misc_feature (1045)..(1050): n is a, c, g, or t
  misc_feature (1052)..(1054): n is a, c, g, or t
  misc_feature (1058)..(1062): n is a, c, g, or t
  misc_feature (1065)..(1065): n is a, c, g, or t
  misc_feature (1067)..(1069): n is a, c, g, or t
  misc_feature (1071)..(1073): n is a, c, g, or t
  misc_feature (1075)..(1077): n is a, c, g, or t
  misc_feature (1079)..(1080): n is a, c, g, or t
  misc_feature (1084)..(1085): n is a, c, g, or t
  misc_feature (1090)..(1090): n is a, c, g, or t
  misc_feature (1094)..(1098): n is a, c, g, or t
  misc_feature (1100)..(1105): n is a, c, g, or t
  misc_feature (1107)..(1107): n is a, c, g, or t
  misc_feature (1109)..(1110): n is a, c, g, or t
  misc_feature (1112)..(1112): n is a, c, g, or t
  misc_feature (1114)..(1116): n is a, c, g, or t
  misc_feature (1119)..(1124): n is a, c, g, or t
  misc_feature (1126)..(1127): n is a, c, g, or t
  misc_feature (1129)..(1136): n is a, c, g, or t
  misc_feature (1138)..(1140): n is a, c, g, or t
  misc_feature (1142)..(1143): n is a, c, g, or t
  misc_feature (1145)..(1145): n is a, c, g, or t
  misc_feature (1147)..(1148): n is a, c, g, or t
  misc_feature (1150)..(1153): n is a, c, g, or t
  misc_feature (1155)..(1161): n is a, c, g, or t
  misc_feature (1163)..(1164): n is a, c, g, or t
  misc_feature (1167)..(1167): n is a, c, g, or t
  misc_feature (1170)..(1170): n is a, c, g, or t
  misc_feature (1172)..(1173): n is a, c, g, or t
  misc_feature (1176)..(1176): n is a, c, g, or t
  misc_feature (1179)..(1180): n is a, c, g, or t
  misc_feature (1183)..(1183): n is a, c, g, or t
  misc_feature (1185)..(1185): n is a, c, g, or t
  misc_feature (1187)..(1194): n is a, c, g, or t
  misc_feature (1198)..(1200): n is a, c, g, or t
  misc_feature (1202)..(1205): n is a, c, g, or t
  misc_feature (1207)..(1207): n is a, c, g, or t
  misc_feature (1209)..(1209): n is a, c, g, or t
  misc_feature (1211)..(1215): n is a, c, g, or t
  misc_feature (1218)..(1219): n is a, c, g, or t
  misc_feature (1221)..(1221): n is a, c, g, or t
  misc_feature (1224)..(1224): n is a, c, g, or t
  misc_feature (1226)..(1226): n is a, c, g, or t
  misc_feature (1228)..(1228): n is a, c, g, or t
  misc_feature (1230)..(1230): n is a, c, g, or t
  misc_feature (1232)..(1232): n is a, c, g, or t
  misc_feature (1235)..(1235): n is a, c, g, or t
  misc_feature (1237)..(1239): n is a, c, g, or t
  misc_feature (1242)..(1245): n is a, c, g, or t
  misc_feature (1248)..(1253): n is a, c, g, or t
  misc_feature (1255)..(1257): n is a, c, g, or t
  misc_feature (1260)..(1260): n is a, c, g, or t
  misc_feature (1262)..(1263): n is a, c, g, or t
  misc_feature (1265)..(1265): n is a, c, g, or t
  misc_feature (1267)..(1267): n is a, c, g, or t
  misc_feature (1271)..(1271): n is a, c, g, or t
  misc_feature (1273)..(1273): n is a, c, g, or t
  misc_feature (1275)..(1286): n is a, c, g, or t
  misc_feature (1289)..(1289): n is a, c, g, or t
  misc_feature (1292)..(1294): n is a, c, g, or t
  misc_feature (1296)..(1298): n is a, c, g, or t
  misc_feature (1304)..(1304): n is a, c, g, or t
  misc_feature (1306)..(1306): n is a, c, g, or t
  misc_feature (1308)..(1310): n is a, c, g, or t
  misc_feature (1312)..(1313): n is a, c, g, or t
  misc_feature (1316)..(1320): n is a, c, g, or t
  misc_feature (1322)..(1322): n is a, c, g, or t
  misc_feature (1324)..(1326): n is a, c, g, or t
  misc_feature (1333)..(1333): n is a, c, g, or t
  misc_feature (1335)..(1335): n is a, c, g, or t
  misc_feature (1337)..(1338): n is a, c, g, or t
  misc_feature (1340)..(1342): n is a, c, g, or t
  misc_feature (1347)..(1347): n is a, c, g, or t
  misc_feature (1350)..(1350): n is a, c, g, or t
  misc_feature (1354)..(1354): n is a, c, g, or t
  misc_feature (1356)..(1356): n is a, c, g, or t
  misc_feature (1361)..(1361): n is a, c, g, or t
  misc_feature (1364)..(1366): n is a, c, g, or t
  misc_feature (1368)..(1368): n is a, c, g, or t
  misc_feature (1371)..(1371): n is a, c, g, or t
  misc_feature (1373)..(1375): n is a, c, g, or t
  misc_feature (1378)..(1379): n is a, c, g, or t
  misc_feature (1381)..(1382): n is a, c, g, or t
  misc_feature (1385)..(1386): n is a, c, g, or t
  misc_feature (1388)..(1392): n is a, c, g, or t
  misc_feature (1394)..(1394): n is a, c, g, or t
  misc_feature (1396)..(1396): n is a, c, g, or t
  misc_feature (1399)..(1401): n is a, c, g, or t
  misc_feature (1474)..(1475): n is a, c, g, or t
nnnnngnngnnngnnnnngnaannnnnnnnncnncnngnngcgnngngngnnggnnnnnnnnntnnngnngnngggnngncnnnncnnnncaannnaannnnnnnanncnnnnnncacaccnnnnctntnctnnncnngnnannngnnagngcnnnnnnnnnnannnnanannnnannncnntnnnnnctnngnnnnnnngngntntnnnnnnnnnnccnnnnnnnganngnananaagnaangnnnnnnnnnnntnngnnnngttngnnnnnnnnnngtnnnntnnannnnatgnnntnatctnntnnnntntngnntnnnttncnnngnnnnnnnnnatgnnnnnnnncnnncnnnnnnnnnnnncnnnnnnnnttnntnnnnnccnncccnncannncnncccnnctnnnntncnnnnngnnnngnnnnntgntnnnnncnccnnnccnncnntnnnnnnnnnntnnnntcnnnntnncntcccnnnnctnncntncnnncnnncnncnctgnnnnnnancnnnnnanncnnccnnnnnnnnnnnnncatngnnntnnnnnnncnnnncctnncntnnnntnnngnnntnnnnnnnnanannannncngtnnnntngnnnnnnnnngncnnnnnnnngnnnnggnnngnnnagcgaanngnnngnnnnnnnnncntgnntnntnnnnnnnnnnncnnnnccngngnngtntagnnnnnnccnnnncnnnnnnnnnncnngnnnnncnngnnnnnnnnnnnngnnnnnncnngnnnnnntntnnttttttntnnnnnngnnnnncncncnnnnnncgtncnnnnnnnnnnnnnnncnnnncnnnnccnncnnnnnannntnnnnnnnnnnnnannnnnncncnncnnnnnnnnnnnnnnnannnnantnnnntnnnnnnncnnnnngnnnnnnnncnnnnnnnntntnctcnncncnnnnntnnnnntncnctncnnnnnnnnnnnnnnnntcnnnnnnnnnnnnnnnnncggntnnnttnnnnnngnnntnnngnnnnnncnnnnnntnnntttnnnnnagnannngnnngnnngnngggnnggggngggnnnnntnnnnnngngnngngnnncgnnnnnngnncnnnnnnnntnnntnncntnncnnnncnnnnnnntnnggntgngnngcntcnnttntntnnnnnnnntggnnngnnnncntnannnnnccnncnccncncncnangcnannntannnnggnnnnnngnnnagncnngngnggcncncnnnnnnnnnnnnaanaannnannntttttnantnnngnnttnnnnngnannngcaaacngncnngnnngaaanaangaananataantannngnagntnnncgnntnnaannannnnngncnggnnnggtccaaacgacagaaagagtccatgcatggctcccctcgcgcttgcggcaccgtggagggtatgggtgcganntacgtcgcacgcatccgaaaacagacgaagagttcgcgtcagggcgctcgagaacgtcgaggacgatgacgtcttatggttgacctcagggacagagcagttgcctcctctcgttgaagcaacgatgcgattgcagagtgaggcatcgatgcgtgtcgtcaagcctcccggtgttgacgagctttgggactggtacgaacaggtggggtctgacgacgcggacccatcttgggggcgggtgtggaagaccgcatccgatctatcgaacttagtgcaagcagatgcacttccttctttcagtctgagaggaggaaagaactcgaaggtagtcgtcgaggtggggtgcggactcggttacgttgggctttgtgcagccgtgacacaaggtgctcgggtgattttctgcgacagggaacctctggcgatacactgtgcgttatcttcagcccaactcaatggactggaggtgcacagcgtcaatgacatctcaatatcaagtcaaggtgtcgcaggatcggttctcgactgggcagctcctcttggtgctttggcgcagtcggcggatgtggtactgggggctgattgtttgtatgatccaacgactgctgcgatgcttgcgaaaacatgcaaacatttgttggatgaagacggggtggttgtgatttgtgaaccggagaaggagcgagctctggggacttactcaaagttcattgaatgcgcgcaatctttgggggcgacttcagcagaaatattgccgtaccctgacctggattcggacgaaccatctgttttacttcgcgtgtcgtggaaacgtctctgactttcaagccgatgcgcaattctagttgtgatgtcgactaccaaagtagactttctaaagctattcaatctgctctactggtttttcaaccctgctgtgtttcattggggacttccccttcatattccaaccttgtatcccatcgccattgggtcggacacaaaacattccgtcgtcgtcgccgtcatcatcgtcgccttctcccgccccgtcatccgatgagggctcctcagctgcgaaatcgacccagtgggctttgcggaattttcgacgagcacctcggtgcttgttagcgatcagcgcacttcctgcatcatcctctgctgaacgttcgtacaggcgggcaccaccgcgaagtgacgcagccgcacggagtgagacacgattcgacctaagatgctcagtttcgcgctccacggttttcgaatagccatcgcctgcagaaatttcaagagtcgcgccaagcttgccgctgctgcgatatactgcttgaagtgcgtcgtcaaatttgccacgcttcgaagcgtttggtttcactcccaaaggcatccacatgctggttgaagtaagggatgttagcgagatattgacggcacagatcatatctgtgacctccgcagccgagagatacgttagcctgagtgagcgcatcgcgtcagcctttcggcacatcctctttatcagcaacaaagcagcatccatcgcgtgtaccatcaactggcccgcacgcgataatctattgttcaccccagtgtcaattgtgccgacatcacgaaagttgatggtatcttcacgagattcacaaactgcatgacgcacgtgagctgaaagaagacacagagtcacagaaagagcagtggctgaagccgacgccggaaggctatcttttgtggatgagaccacatggatgacgtcagctatcaccgatatggcagcatcaggcccattgtgcgcaaatgcaagatgatgtgccacttggaggagttcagtgcgttgtgaccgttcaaaaggataagtttgtgttgccgccatagtgagcttgctttcacgttgaagcagatgcacgaaagcgctgaattgagtgccggtcttcatgccctttgagatttcttgagcaaacatcagtgcatctcccgaggaataatccgatgtacctttaagagattgcatgtcatcggcgtttgcgtcaacctgaccccacagagcaactgatgcatgcgcggtcacgatcatcggcgtgaacgcggatgcagattcaggcgacagtcccaagattaatgtggctcctaatcgtaatgctgccgcagcaggatgaagggcggtgcactcgttggctcgtgcgattacccattggagtatacttagacgtctgctctcgacgatgtcagcatcgtgaccaccaacaacaccgatggttccattttctgcgctccacgaatctaaatgaaacgcgggggcagccaacgagcacagcactgatgactcgagcgcaggagaggcagggacattggcggcaatcgtgcacaattgaaagcatgcagtcacaatagtcgcacgcactgcggaagaggtttctgcccattgaccatatctcttacctgcggagtagctcactgccccactgtttgcaaccagctccttttcaactcgtggtgcagacagacgttccgccagcatctgatagcgattcgtcaaatccccccct

SEQ ID NO: 1551 - DNA, 4000 bp, Escherichia coli
  misc_feature (1986)..(1986): n is a, c, g, or t
  misc_feature (1992)..(1992): n is a, c, g, or t
taagaaaattgatatagacaaatataagaagtgattatttacaatccaatcaaagtatgatataataatattatgtttaaaatatttaagaagaaaaaagaagaatttgaagaacttgactgggataaagtaacaaccctagaggatgtcagattattggtaaagctcacctttccggttattaaagtgagtaaaagcagaattgaaaaagtaagacatttattaaaggagaagtagtaatgagtttagatagaacgggtaatgggtacttagtagacccaacaacatggtcactagatgtgatgtatgagatggcaaaggaagatgatgttgcattgagtgagtcacaggtaatgcagattgaaaaggcgcgtgaatactttgatgagaattcaagtgttccaccgattagaacatttgctaagtatgtaggaattgataaaggtaaactattcaaagaatggttgaccggccctctcaagcctattactaagtatggtggtcttcctcaaccgacggggtgtgtctaatgattaaaagaatgataccactcggcgacagtattttagtattgcccgatgcagcggaaacggtgactgaatctggttttatcttaaccaacgctgaaatgactactactggtactgtacaggcgactggtcccggtaaattggtggatggagagatggtgcaaccacaactaaagccaggtgataaaattatgttcgccggcattaatgtaaatgaaagcttaagattagtaacactcaatgacgttcgatatctactaatgcttgagtctcaaatttttgggattatcgaagaagattaagtctggttcgactttcagggagtgggcagcatgtataaataatagatatatacctatataaggaatgtttatgtcttgtcactctaagtggtgtacttggataacggcagtatcgcaactagcgatagctacagttattgtatatgcaggattggttgttggctcccacatggaatcatggactaaatcgtttaaacaaggttctaatgatctacattctattagagagaatatgaatagtatgacttattctatggagtccatcaatagagacatggatataatgaataataatataatgattattaataagcagatgagttatatgaatggttcggtaagtaatatgtcgaataagtttagcccgcagggaatggcgagaagcttcatgcctttttaatataaataaattataatatagtaatacaatgaatgttgtgtagcaattccattaggagaaatatatggaattgaatagtttaggctatgcactaaatacattgtactttcttgtctccgcagtcttagtgatgtggatggcggcaggatttacaatgttagaagctggatcggttcgttcaaagaacgtaacagagatccttttaaaaaatgttgcactgtatagtgtagcatcactaaccttcttgtttgtgggttatgaattaatgtacggtggatggaacgctccagaagaccacgcattaatgagtgactttttctttcaagtagtgtttgttgcaacagcgatgtcagtagtttcgggcgcagttgcagaacgtaagaaactatggtcatttttaatctttgctggtatttttacagcagtgatttatccaatccaaggctcttggtcttggggtggaggatggttatctgaggcagggttctttgactttgcaggatcgggtatcgttcatatggcgggtgcagcggcggcattagcggctgtgctattaatcggcgctcgtaagggtaagtatgataagaatggtaacccagttgctattcacggttcaagttcaactcaggttgctcttggaacacttattctttggatgggctggtttggttttaatggtggttcgcagttaagtattttaggaattgacaacgctaacgcagttgctcaaattttcgtaaatacaaacactgcngccgcngcaggattattgagtgcaatgttgctctcaaagatttggttaaagaagaccgttttaaatgtaacactgaatggtgccttggctggactagtggtaattaccgctgatccattcacaccttcaccagagattgcagccttgtatggtgcaatcggtggattaattgtccctatctcaatggcgctgctagagaaatggggtatcgatgatccagttggtgcgatcagtgtacacggtgttgcgggtattgtgggactaatgttggttccgattttaaatactgatgcaacactgtatggccaagcgctaggtactactgcaatcttcggatttgtatttggtacaagcctagtagtttggtatatactcaaaaagaccgttggtctgagagtaggtgaagaggaagaacttgctggttctgatatgtgggaaacagggcaatccgcctacccagagttcatgaacagcaagaaataactttaactgaattgttatacaacatactaaccctcttaactgagggttttttaataaaagtatattaatatatcataatactgtttacaatcagagccttttatgttataatataactatatatgaaataatttgtatatacaacaaaaattaggagaaataaatgaaaaatttattcgcagcattaacagtgcttttaacagtaacatcggcaaatgctttctttaacggaaacaattcttggaacagtaaccactcaaatggttaccaagaagataatggtatctttgcatataacagttatgatttctgggatccacgttggtactctcaagagtttactaactttgtgactgaaatggatgatgagtttagtaatgatgactattcaaagcgttcatactacacggtacgtaataacaacttcccagcagtagatactactaaataaggatataataataatatcttaatttgaggagtccttcgggactcctttttcgcacaaggagaaagttatggcagatactacattagacgcaagtggattaaattgtccactaccaatattaaagactaagaaggcactaaacaaaatggagtctggacaaattttagaagttatctctacagatgcaggttcgattaaagacctcgaagcattttgtaatcaaactggtaataggttgatgaagacaattgaagttgcaggtaagtacacattcacaatcgagaaagtataatgaaagaactatataacaagtggaaaatgaattgtccaacaccaagagcatatagatgggttgcgactcattttaaaaatttagacacaaaataggagtaaagttatgtttgagtcattcttaatgggggcgatattattctttgccttctatataacacaggaagacagaaactttttctgtcgtaaattatggagtaaattgtggacacgaaaataggaaaattagtaggtgctggtatagcgattgtattatggatagggttattattactatctaactctgctaaggcagattatattacaatggacgtagattcatctgtgcgcagtggcacggttttgtgtgacagtgttcagagttgttatattaagacgttacaaatggagcaacgtggttctgctcaatactgtaactcagtaacaattaaaagagatggtagagtagtttggtttaagaattactttcgttaattatttggtcggccgaatatatagaagcttattcttaacttcgttcaacatatctttttgattatctagattgacttggatttctttgatgcccaccaagagctcttggtggtagaccggccaagctgatctaaattcagaattatcagcaacttcagatttaaggttattcatgttggtggtgatcttagatgcccaccaaacagaagtcataatttgagtgaacatagcacctaagactattacagccgattttttcaaccacttaggtagttgtggttctctatgttgtatcgcattaatatccgaacgcat

SEQ ID NO: 1552 - DNA, 4000 bp, Escherichia coli
  misc_feature (2)..(9): n is a, c, g, or t
  misc_feature (12)..(13): n is a, c, g, or t
  misc_feature (15)..(18): n is a, c, g, or t
  misc_feature (20)..(39): n is a, c, g, or t
  misc_feature (41)..(41): n is a, c, g, or t
  misc_feature (43)..(51): n is a, c, g, or t
  misc_feature (53)..(55): n is a, c, g, or t
  misc_feature (57)..(57): n is a, c, g, or t
  misc_feature (60)..(60): n is a, c, g, or t
  misc_feature (62)..(67): n is a, c, g, or t
  misc_feature (69)..(70): n is a, c, g, or t
  misc_feature (72)..(77): n is a, c, g, or t
  misc_feature (79)..(81): n is a, c, g, or t
  misc_feature (83)..(83): n is a, c, g, or t
  misc_feature (85)..(90): n is a, c, g, or t
  misc_feature (92)..(92): n is a, c, g, or t
  misc_feature (96)..(97): n is a, c, g, or t
  misc_feature (99)..(99): n is a, c, g, or t
  misc_feature (101)..(113): n is a, c, g, or t
  misc_feature (115)..(115): n is a, c, g, or t
  misc_feature (117)..(117): n is a, c, g, or t
  misc_feature (119)..(119): n is a, c, g, or t
  misc_feature (121)..(121): n is a, c, g, or t
  misc_feature (123)..(123): n is a, c, g, or t
  misc_feature (125)..(125): n is a, c, g, or t
  misc_feature (129)..(131): n is a, c, g, or t
  misc_feature (133)..(134): n is a, c, g, or t
  misc_feature (136)..(143): n is a, c, g, or t
  misc_feature (145)..(145): n is a, c, g, or t
  misc_feature (147)..(147): n is a, c, g, or t
  misc_feature (149)..(163): n is a, c, g, or t
  misc_feature (165)..(173): n is a, c, g, or t
  misc_feature (175)..(175): n is a, c, g, or t
  misc_feature (177)..(184): n is a, c, g, or t
  misc_feature (186)..(190): n is a, c, g, or t
  misc_feature (192)..(192): n is a, c, g, or t
  misc_feature (194)..(195): n is a, c, g, or t
  misc_feature (197)..(271): n is a, c, g, or t
  misc_feature (273)..(280): n is a, c, g, or t
  misc_feature (283)..(283): n is a, c, g, or t
  misc_feature (285)..(285): n is a, c, g, or t
  misc_feature (287)..(287): n is a, c, g, or t
  misc_feature (289)..(290): n is a, c, g, or t
  misc_feature (294)..(294): n is a, c, g, or t
  misc_feature (296)..(301): n is a, c, g, or t
  misc_feature (303)..(303): n is a, c, g, or t
  misc_feature (305)..(313): n is a, c, g, or t
  misc_feature (317)..(323): n is a, c, g, or t
  misc_feature (325)..(330): n is a, c, g, or t
  misc_feature (332)..(335): n is a, c, g, or t
  misc_feature (337)..(361): n is a, c, g, or t
  misc_feature (363)..(363): n is a, c, g, or t
  misc_feature (365)..(382): n is a, c, g, or t
  misc_feature (384)..(388): n is a, c, g, or t
  misc_feature (391)..(391): n is a, c, g, or t
  misc_feature (393)..(398): n is a, c, g, or t
  misc_feature (400)..(400): n is a, c, g, or t
  misc_feature (402)..(407): n is a, c, g, or t
  misc_feature (409)..(416): n is a, c, g, or t
  misc_feature (418)..(430): n is a, c, g, or t
  misc_feature (432)..(437): n is a, c, g, or t
  misc_feature (439)..(443): n is a, c, g, or t
  misc_feature (445)..(445): n is a, c, g, or t
  misc_feature (447)..(465): n is a, c, g, or t
  misc_feature (467)..(472): n is a, c, g, or t
  misc_feature (474)..(487): n is a, c, g, or t
  misc_feature (489)..(495): n is a, c, g, or t
  misc_feature (497)..(504): n is a, c, g, or t
  misc_feature (506)..(509): n is a, c, g, or t
  misc_feature (511)..(526): n is a, c, g, or t
  misc_feature (528)..(587): n is a, c, g, or t
  misc_feature (589)..(591): n is a, c, g, or t
  misc_feature (593)..(593): n is a, c, g, or t
  misc_feature (595)..(595): n is a, c, g, or t
  misc_feature (597)..(597): n is a, c, g, or t
  misc_feature (599)..(599): n is a, c, g, or t
  misc_feature (601)..(650): n is a, c, g, or t
  misc_feature (652)..(681): n is a, c, g, or t
  misc_feature (686)..(689): n is a, c, g, or t
  misc_feature (691)..(692): n is a, c, g, or t
  misc_feature (694)..(699): n is a, c, g, or t
  misc_feature (701)..(701): n is a, c, g, or t
  misc_feature (703)..(703): n is a, c, g, or t
  misc_feature (705)..(705): n is a, c, g, or t
  misc_feature (707)..(716): n is a, c, g, or t
  misc_feature (718)..(720): n is a, c, g, or t
  misc_feature (722)..(722): n is a, c, g, or t
  misc_feature (724)..(724): n is a, c, g, or t
  misc_feature (726)..(766): n is a, c, g, or t
  misc_feature (768)..(770): n is a, c, g, or t
  misc_feature (775)..(779): n is a, c, g, or t
  misc_feature (781)..(783): n is a, c, g, or t
  misc_feature (787)..(787): n is a, c, g, or t
  misc_feature (789)..(791): n is a, c, g, or t
  misc_feature (793)..(794): n is a, c, g, or t
  misc_feature (797)..(797): n is a, c, g, or t
  misc_feature (799)..(799): n is a, c, g, or t
  misc_feature (801)..(803): n is a, c, g, or t
  misc_feature (807)..(811): n is a, c, g, or t
  misc_feature (814)..(826): n is a, c, g, or t
  misc_feature (828)..(831): n is a, c, g, or t
  misc_feature (833)..(833): n is a, c, g, or t
  misc_feature (835)..(841): n is a, c, g, or t
  misc_feature (843)..(843): n is a, c, g, or t
  misc_feature (845)..(845): n is a, c, g, or t
  misc_feature (847)..(847): n is a, c, g, or t
  misc_feature (849)..(851): n is a, c, g, or t
  misc_feature (853)..(854): n is a, c, g, or t
  misc_feature (856)..(856): n is a, c, g, or t
  misc_feature (858)..(858): n is a, c, g, or t
  misc_feature (860)..(860): n is a, c, g, or t
  misc_feature (862)..(862): n is a, c, g, or t
  misc_feature (864)..(870): n is a, c, g, or t
  misc_feature (872)..(881): n is a, c, g, or t
  misc_feature (883)..(887): n is a, c, g, or t
  misc_feature (889)..(890): n is a, c, g, or t
  misc_feature (892)..(902): n is a, c, g, or t
  misc_feature (904)..(917): n is a, c, g, or t
  misc_feature (919)..(927): n is a, c, g, or t
  misc_feature (929)..(929): n is a, c, g, or t
  misc_feature (931)..(933): n is a, c, g, or t
  misc_feature (935)..(939): n is a, c, g, or t
  misc_feature (941)..(941): n is a, c, g, or t
  misc_feature (943)..(943): n is a, c, g, or t
  misc_feature (945)..(945): n is a, c, g, or t
  misc_feature (947)..(947): n is a, c, g, or t
  misc_feature (949)..(949): n is a, c, g, or t
  misc_feature (951)..(951): n is a, c, g, or t
  misc_feature (953)..(953): n is a, c, g, or t
  misc_feature (955)..(960): n is a, c, g, or t
  misc_feature (964)..(964): n is a, c, g, or t
  misc_feature (966)..(966): n is a, c, g, or t
  misc_feature (968)..(971): n is a, c, g, or t
  misc_feature (973)..(973): n is a, c, g, or t
  misc_feature (975)..(977): n is a, c, g, or t
  misc_feature (979)..(988): n is a, c, g, or t
  misc_feature (991)..(1000): n is a, c, g, or t
  misc_feature (1002)..(1002): n is a, c, g, or t
  misc_feature (1004)..(1004): n is a, c, g, or t
  misc_feature (1006)..(1006): n is a, c, g, or t
  misc_feature (1008)..(1028): n is a, c, g, or t
  misc_feature (1030)..(1035): n is a, c, g, or t
  misc_feature (1037)..(1037): n is a, c, g, or t
  misc_feature (1039)..(1040): n is a, c, g, or t
  misc_feature (1042)..(1043): n is a, c, g, or t
  misc_feature (1045)..(1050): n is a, c, g, or t
  misc_feature (1052)..(1052): n is a, c, g, or t
  misc_feature (1055)..(1061): n is a, c, g, or t
  misc_feature (1063)..(1063): n is a, c, g, or t
  misc_feature (1065)..(1065): n is a, c, g, or t
  misc_feature (1067)..(1087): n is a, c, g, or t
  misc_feature (1089)..(1093): n is a, c, g, or t
  misc_feature (1095)..(1103): n is a, c, g, or t
  misc_feature (1108)..(1108): n is a, c, g, or t
  misc_feature (1111)..(1113): n is a, c, g, or t
  misc_feature (1115)..(1115): n is a, c, g, or t
  misc_feature (1117)..(1117): n is a, c, g, or t
  misc_feature (1119)..(1123): n is a, c, g, or t
  misc_feature (1127)..(1131): n is a, c, g, or t
  misc_feature (1133)..(1136): n is a, c, g, or t
  misc_feature (1138)..(1138): n is a, c, g, or t
  misc_feature (1141)..(1150): n is a, c, g, or t
  misc_feature (1152)..(1152): n is a, c, g, or t
  misc_feature (1158)..(1158): n is a, c, g, or t
  misc_feature (1160)..(1173): n is a, c, g, or t
  misc_feature (1175)..(1175): n is a, c, g, or t
  misc_feature (1179)..(1179): n is a, c, g, or t
  misc_feature (1181)..(1183): n is a, c, g, or t
  misc_feature (1189)..(1196): n is a, c, g, or t
  misc_feature (1198)..(1198): n is a, c, g, or t
  misc_feature (1200)..(1208): n is a, c, g, or t
  misc_feature (1211)..(1211): n is a, c, g, or t
  misc_feature (1213)..(1213): n is a, c, g, or t
  misc_feature (1215)..(1217): n is a, c, g, or t
  misc_feature (1219)..(1219): n is a, c, g, or t
  misc_feature (1221)..(1222): n is a, c, g, or t
  misc_feature (1224)..(1228): n is a, c, g, or t
  misc_feature (1230)..(1230): n is a, c, g, or t
  misc_feature (1232)..(1232): n is a, c, g, or t
  misc_feature (1234)..(1237): n is a, c, g, or t
  misc_feature (1239)..(1239): n is a, c, g, or t
  misc_feature (1241)..(1241): n is a, c, g, or t
  misc_feature (1243)..(1249): n is a, c, g, or t
  misc_feature (1251)..(1254): n is a, c, g, or t
  misc_feature (1257)..(1261): n is a, c, g, or t
  misc_feature (1263)..(1263): n is a, c, g, or t
  misc_feature (1265)..(1274): n is a, c, g, or t
  misc_feature (1277)..(1280): n is a, c, g, or t
  misc_feature (1282)..(1289): n is a, c, g, or t
  misc_feature (1291)..(1297): n is a, c, g, or t
  misc_feature (1299)..(1323): n is a, c, g, or t
  misc_feature (1325)..(1325): n is a, c, g, or t
  misc_feature (1327)..(1327): n is a, c, g, or t
  misc_feature (1329)..(1339): n is a, c, g, or t
  misc_feature (1341)..(1341): n is a, c, g, or t
  misc_feature (1343)..(1344): n is a, c, g, or t
  misc_feature (1346)..(1362): n is a, c, g, or t
  misc_feature (1364)..(1370): n is a, c, g, or t
  misc_feature (1372)..(1379): n is a, c, g, or t
  misc_feature (1381)..(1392): n is a, c, g, or t
  misc_feature (1394)..(1397): n is a, c, g, or t
  misc_feature (1399)..(1401): n is a, c, g, or t
  misc_feature (1403)..(1403): n is a, c, g, or t
  misc_feature (1405)..(1405): n is a, c, g, or t
  misc_feature (1408)..(1408): n is a, c, g, or t
  misc_feature (1410)..(1412): n is a, c, g, or t
  misc_feature (1414)..(1414): n is a, c, g, or t
  misc_feature (1416)..(1418): n is a, c, g, or t
  misc_feature (1420)..(1430): n is a, c, g, or t
  misc_feature (1432)..(1452): n is a, c, g, or t
  misc_feature (1454)..(1466): n is a, c, g, or t
  misc_feature (1468)..(1468): n is a, c, g, or t
  misc_feature (1471)..(1481): n is a, c, g, or t
  misc_feature (1483)..(1490): n is a, c, g, or t
  misc_feature (1492)..(1508): n is a, c, g, or t
  misc_feature (1510)..(1515): n is a, c, g, or t
  misc_feature (1517)..(1524): n is a, c, g, or t
  misc_feature (1526)..(1531): n is a, c, g, or t
  misc_feature (1533)..(1534): n is a, c, g, or t
  misc_feature (1536)..(1536): n is a, c, g, or t
  misc_feature (1538)..(1544): n is a, c, g, or t
  misc_feature (1546)..(1554): n is a, c, g, or t
  misc_feature (1556)..(1556): n is a, c, g, or t
  misc_feature (1558)..(1564): n is a, c, g, or t
  misc_feature (1568)..(1570): n is a, c, g, or t
  misc_feature (1575)..(1575): n is a, c, g, or t
  misc_feature (1578)..(1578): n is a, c, g, or t
  misc_feature (1581)..(1581): n is a, c, g, or t
  misc_feature (1584)..(1584): n is a, c, g, or t
  misc_feature (1587)..(1589): n is a, c, g, or t
  misc_feature (1591)..(1591): n is a, c, g, or t
  misc_feature (1597)..(1598): n is a, c, g, or t
  misc_feature (1600)..(1617): n is a, c, g, or t
  misc_feature (1619)..(1623): n is a, c, g, or t
  misc_feature (1625)..(1631): n is a, c, g, or t
  misc_feature (1633)..(1633): n is a, c, g, or t
  misc_feature (1635)..(1643): n is a, c, g, or t
  misc_feature (1650)..(1658): n is a, c, g, or t
  misc_feature (1660)..(1660): n is a, c, g, or t
  misc_feature (1664)..(1665): n is a, c, g, or t
  misc_feature (1668)..(1668): n is a, c, g, or t
  misc_feature (1670)..(1670): n is a, c, g, or t
  misc_feature (1672)..(1676): n is a, c, g, or t
  misc_feature (1678)..(1678): n is a, c, g, or t
  misc_feature (1680)..(1680): n is a, c, g, or t
  misc_feature (1682)..(1684): n is a, c, g, or t
  misc_feature (1686)..(1686): n is a, c, g, or t
  misc_feature (1689)..(1689): n is a, c, g, or t
  misc_feature (1695)..(1695): n is a, c, g, or t
  misc_feature (1698)..(1698): n is a, c, g, or t
  misc_feature (1700)..(1700): n is a, c, g, or t
  misc_feature (1702)..(1703): n is a, c, g, or t
  misc_feature (1707)..(1707): n is a, c, g, or t
  misc_feature (1709)..(1712): n is a, c, g, or t
  misc_feature (1714)..(1714): n is a, c, g, or t
  misc_feature (1716)..(1716): n is a, c, g, or t
  misc_feature (1718)..(1718): n is a, c, g, or t
  misc_feature (1720)..(1721): n is a, c, g, or t
  misc_feature (1723)..(1723): n is a, c, g, or t
  misc_feature (1725)..(1725): n is a, c, g, or t
  misc_feature (1727)..(1727): n is a, c, g, or t
  misc_feature (1729)..(1729): n is a, c, g, or t
  misc_feature (1731)..(1732): n is a, c, g, or t
  misc_feature (1734)..(1737): n is a, c, g, or t
  misc_feature (1739)..(1741): n is a, c, g, or t
  misc_feature (1743)..(1743): n is a, c, g, or t
  misc_feature (1746)..(1748): n is a, c, g, or t
  misc_feature (1750)..(1750): n is a, c, g, or t
  misc_feature (1752)..(1753): n is a, c, g, or t
  misc_feature (1878)..(1878): n is a, c, g, or t
  misc_feature (1985)..(1985): n is a, c, g, or t
  misc_feature (1987)..(1987): n is a, c, g, or t
  misc_feature (1992)..(1992): n is a, c, g, or t
  misc_feature (2008)..(2008): n is a, c, g, or t
  misc_feature (2861)..(2861): n is a, c, g, or t
  misc_feature (2982)..(2982): n is a, c, g, or t
  misc_feature (3980)..(3980): n is a, c, g, or t
annnnnnnnaanngnnnnannnnnnnnnnnnnnnnnnnnanannnnnnnnnannnanaanannnnnnannannnnnnannnanannnnnnanagcnnanannnnnnnnnnnnnananananananaaannnannannnnnnnnananannnnnnnnnnnnnnnannnnnnnnnanannnnnnnnannnnncncnnannnnnnnnnnnnnnnnnnnnnnnnnnnnnnnnnnnnnnnnnnnnnnnnnnnnnnnnnnnnnnnnnnnnnnnnnnnannnnnnnnaanananannaaanannnnnnanannnnnnnnnaaannnnnnnannnnnntnnnnannnnnnnnnnnnnnnnnnnnnnnnnanannnnnnnnnnnnnnnnnnannnnnaanannnnnntntnnnnnnannnnnnnnannnnnnnnnnnnnannnnnnannnnngngnnnnnnnnnnnnnnnnnnngnnnnnngnnnnnnnnnnnnnnannnnnnngnnnnnnnngnnnnannnnnnnnnnnnnnnngnnnnnnnnnnnnnnnnnnnnnnnnnnnnnnnnnnnnnnnnnnnnnnnnnnnnnnnnnnnntnnnananananannnnnnnnnnnnnnnnnnnnnnnnnnnnnnnnnnnnnnnnnnnnnnnnnntnnnnnnnnnnnnnnnnnnnnnnnnnnnnnnaaaannnntnntnnnnnncncncncnnnnnnnnnnannnananannnnnnnnnnnnnnnnnnnnnnnnnnnnnnnnnnnnnnnnncnnnccccnnnnntnnntctntnnncnnttncncnnncgcnnnnnccnnnnnnnnnnnnncnnnntntnnnnnnnanancncnnncnncncncncncnnnnnnncnnnnnnnnnntnnnnnanncnnnnnnnnnnnannnnnnnnnnnnnntnnnnnnnnnanannntnnnnntntntntncncncncnnnnnnctcncntnnnncncnnncnnnnnnnnnntgnnnnnnnnnnanananannnnnnnnnnnnnnnnnnnnncnnnnnnananncnntnnnnnnanaannnnnnngngngnnnnnnnnnnnnnnnnnnnnncnnnnngnnnnnnnnnacacncannnananannnnncccnnnnngnnnnanatnnnnnnnnnnanatatanannnnnnnnnnnnnncncccncnnnctctcnnnnnnnncncnnnnnnnnnaananannngngnngnnnnnanancnnnntntntnnnnnnnannnnaannnnncncnnnnnnnnnnccnnnncnnnnnnnncnnnnnnnannnnnnnnnnnnnnnnnnnnnnnnnananannnnnnnnnnnanannannnnnnnnnnnnnnnnnannnnnnncnnnnnnnncnnnnnnnnnnnngnnnntnnntntntcncnnncncnnncnnnnnnnnnnnannnnnnnnnnnnnnnnnnnnnannnnnnnnnnnnntntgnnnnnnnnnnncnnnnnnnngnnnnnnnnnnnnnnnnncnnnnnngnnnnnnnncnnnnnngnncngnnnnnnncnnnnnnnnngngnnnnnnntttnnnttttnttnttnttnttnnntntttttnntnnnnnnnnnnnnnnnnnntnnnnncnnnnnnnanannnnnnnnnctctctnnnnnnnnntntttnnttntntnnnnnanantnnnanaanaaaaanaanananngaanannnnanancncnnantntntntnntnnnnannntnttnnnanannacacacacacacacacacacacacacacacacacacacacgtgataataataataataatactgatgatgacgagagtactaatgacgccgacaaggacgaggtttttggcgcttaaaacacatnatcatccttggataatgttgttctcattgttggtgttccaaaattgttctcttttttcttttccaataacatcagtcaatgcgttgggttgcgagtgcacgggagangngtttntcgtctcgggcgtttncttgggcagccgatgcgccgagtggggggataaaaacgcaatctgcgcggatcaaacgacggtcacggacgagtgctgcaaaccgtggtgttgggtgtcacaaacagattgtccttctgcgaggtataacaaacaggcggataaatatttttcgtacgacgcgtgcggggcgacgtgcgcgaacgaccattgcggagaggagaagacgtatgtagataccagaggagcaatcgtgtgcgaatcggaatatcaaaacacgtgggttcgatatcgaatgtcgtcgtggatattcattattcccttgttttgtttgttttcttcgttacggtaccagcaatcacggaggcggatgttgctttgtcaaaaccagttacaaggcggcggttcgccatatggtcaagcgtcagcgggggtgtggagaggacagaattttggtctgcagaataactttacgacgccgcaagggcaggcggtatacatcgtcggcgcgaacgggcgattaacgccgctacagaattcgaacgcggctaatcaaccgcaattttatcaagggggaaacccagcgcaagaggtgaggagacaacagaatcagccgagaagcggcggcatgttagacgcgttgtttggtagagccaacagaggtggtggtggtggtggcgtgcaatcgcaacaacaaccacgcgcggcggcggcaacatctgttgttccggaaatgtcgcccgtgagtagagaaccggcgtacgcacctccgtcgaattattacggcaacgaaaaccaagcgagacgaaatcaagcggtgaccgataattctccgcaacaagcgtatccgactgtttaaaagtaaatatcaatnaccatgatgcttgaagtaggaagaaacttgattaacgatgatgtttttatatgtaataagatttgtatatgagatatttaaagtacgcgtacaacggcagcagtatctagatgaaatttanaatcgctcttttcttttccttccggtatatttagaatcgtttgccacctggacgcctcgattcctcatctgttttttcttcttcatcacccacgctttccctttcccttccgggtgtgattttgagcccacatatatcgttctcgcgtgcttatctcctttcctcttcttcttcacacctaatccgaattcgctattattgttattgttatgtttgaacttgttcttcccgcctcctctcccgacgacgtcttgtttcgcgttggcgtagtcattcgcctcgtccgtctttgccgtcggcatcgagtccggcggtccagccgccaagaccaaaaaatatttcttcgctctcgtcgagtttggataatctacgactaaaccaccgctaaaaccaactctcaacgcactactcgcaatcatctccgcctgcctcgcgttctccggataaaactgaaacgcgcacttcgcgcctcgtttcaagcacctatacgtttgcgaaaagaacgctttcaatcgtttcctcgggtcgtgttcgctcttatccgcgttgcacaaccactgaatcgcggatatagagacgcacccgtcgaacactcccggacgaaacggtaccccgtggccgatatctgactcgaaaacgtctccttccacttctcgctccaccgcgtgattcaacatccctctggagatgtctaccccgacccaatgatgcccgagctcggttaaccgatccccggataagccggacccgcacccgacgtctaacaaaaatctcggcacatcgtccctcgggaagtttaataactccaacgctctctccgtcaatctttcttggatttcaatcaccctcgacgaggcggtgtacttctttgcctcggcggcgtcgtagaaatactccgccggggcggtcagttctggtcgagacattactaatttgcgtttgttgaacaaagagtgaacaaagacaaatgatgatgatgatgcgggtacaaatagtanagaagtatatatatacgcga

SEQ ID NO: 1553 - DNA, 4000 bp, Escherichia coli
  misc_feature (214)..(214): n is a, c, g, or t
  misc_feature (396)..(396): n is a, c, g, or t
  misc_feature (439)..(439): n is a, c, g, or t
  misc_feature (459)..(459): n is a, c, g, or t
  misc_feature (483)..(483): n is a, c, g, or t
  misc_feature (501)..(502): n is a, c, g, or t
  misc_feature (1331)..(1331): n is a, c, g, or t
  misc_feature (1412)..(1412): n is a, c, g, or t
  misc_feature (1438)..(1438): n is a, c, g, or t
  misc_feature (2028)..(2028): n is a, c, g, or t
  misc_feature (2890)..(2890): n is a, c, g, or t
  misc_feature (3054)..(3054): n is a, c, g, or t
  misc_feature (3240)..(3240): n is a, c, g, or t
tcctgcatcaacgacttctcccacaaaaatggaatggtctccttcctccacagttgttacaagtctgcattcaacgaaagcaggtgtgttctccaaaactggtgctccggtacttcctgcatgaaatggctcgccgcttattttttgtccgtctctttcagccggtttgaaaaacgcataggccgcaccctgttgtcccttgcccaaaacattnagtgcaaaatttccggctgttttaataatgtcatgtatctgggaatcagctttaacaccgacagcaaccaggggcggtttgaacgaagcctgtgtgacccagttcacagtagcagccgaaattcgaccatctttgtcttcggctgtcataacgtaaagtccataaggaatcatccgcaatgnggtttttttagcattctcatccataaagcctccttttgagaanaatagaaaaaagttgaaacngcagtgtttcagaaatgagttagntttgtcaagttaagttgnngagacacttggattttgcacatattcacttcggcagtttagcaggaaatattccgcagcgaacaatactttttgatcggtgtcaatcagcaggcttaagtaaaatttttccaatgtgggcactgctttccatcaggcgatgtgcttctgacgcttgtttgagcggaaatgtttgatggatgatcggtcggatagctccggattccagcaatggccaaacgtttttttgcagggcctgagcgattttagttttttcttcaacgctgcggggacgcaaggtggagccggtcaaggttacacgtttgagcagtaaggagcgaaaatcaacttctgctttgctgccctgcatcagagcgatttgcactaaccgaccttcgtcggccagcaaccggatgttttttggaaagtatgggccgccaaccatgtcaaggatcacatttacgccttttccttcagtcaagcgtttgatttcttcggagaaatcctgttctctgtaattgatggcagcatcggcaccaagattattacaaaactcacatttatccgaagttcctgcagtggtgtaaacagttgccccaaaggcttttccgagttgaatggcagttgttcctattccactgctaccgccgtgtaccaacagactttctccggctttgagttgtccgcgtttaaagacatttgtccagacggtgaaaaaggtttccggaattcccgcggcatttactagcgaaattttttccggaaccggcaagcaaatcgaggctgccgccagacaatattccgcataaccgccgcaggtcacgagggcacaaacttcagaattgatgggnggctcgctgacgttttgacccacactcactacagttccggaaacctccagtccgggaacatcggttgcgccgggaggcggnggataaagccctttgcgctgcatcangtccggacggttgactcccgccgccgcgaccttaatcagtacttcaccggggcctggttccggaaccggcatcgaatgcagttttaatacttcaggatccccatgtttttcgatctgaatgtagttcattgattgtggtatgttgttcatgaaaactccgaaaataaagtaaacttagtcaactgtatcaatatgaccttatttctttttaaaattatttagtgccagattgagttgtgatttgctccaactttaacaatcgttttttaatcggcagtccgccggcatatccgacaagctctccattacttccaattatacgatgacagggaattatgattgccatcgagtttgcgccattagcagcggcaactgctctgaccgctttttcattctttatatttttggccaactgcaaataagttgacgtagttccaaaaggaactctcagtaaagcttcccagacacttttttgaaaatccgttcctaccatttgtagagggacatcaaactcttttctgttgccatgaaaatattcatcaagctctgcccgggttttttctataatttccgtgttattttctacaaanttggcatttagtccttttttaattctttcatcaacggattttctcatttttctgtatctaaaatcaagcagacaaagtttgccttcgaaggagcctaaaatcagttcaccaatttttgttttacaatattgtatgttgataaatttcatagtttcagaagagtccaaacgtttgagagttttcagtcaatcctatgtatattcaccggaatgactattcgaaatgataaaaaccaataacagcagtgccagtgtactcaacaaataaagtggtattacttcaagtccaaagattcttgccagcacacctgcaattgaaggaaccacagccacccccaaacctgctgcggcaatctgcattccaattgtattggcctgatgccggaaccctacacgacttgttgtgctggaaaccagtccgggaaatattggtgcgatcgcaaaaccggctaaagtgactccaagaattgttattataagactggaatctgccagcagcagagctactccgaaaagtgccagtgagatactcaagtaaattagtttgcgaatgtctatcattttagcgtaccatcccgcaaaaatacggccgacagtaaacattgcccagtaacctccggttacaattccagcaacttccggagcaactccacgggattctgtcaaaagtgagtaaatccaaagccctaaacccaattctacacctgtataaagaaaaaacaatgccacacttaagagtacctgaattgattttatagtttcactgagggaagcattattctcatcgtgatcttcttctctactactggctgaaataccttcccacatgtctttagtaaaaagaaaaattacggaaagaattnccattgccactgaaacaacaaaatatccgctttgccaatgggatgttgcgtttattcccattgtcattatgaatggaccggaggtaattcccacgccaaaacttgcgtgtaaccactgcatcattctggtactgtggtatttggcgatataggtatttattccngcatcaattgcaccggcaccaagtcctccaactgcagaaaaaataacgaaaacccaccagagaggagtaactgcataaactagtaatgtaccagccatggcagcacaactcagactcagcagcccaccgattcctaaatgtcgaatcagtagtccactcaaaaagcttgaaagcatgtatcctgcngttccgcagacaagaataattcctaaagcatcaactggcagttggaattggtgacgaatcccaggccatgccacgcccatgagtccgtctggtaagcccagggaaacaaaggcaaaaaaagagataataattaatcccatagattttagtgagagtttgactgtggttgaagcgagttttgtagctaattaaaaggataataaccgttaagatacttttgtatctattatattgtcattctgggcgaagtgccttccggtaactgaatcagacttgaaaagcgtgacgcctccggaagataaagcacacccttggcttgatagtcagctgggccgattgtgcgccgaccgctgccggctccctcgagttccttggctgccgccaggaacttgtggtcggcatagcgcaaaaataccaaacccaataccgggacagagtattcattggatgttaactcagaatttgcgcgcagttcatcggctgcttcccaaagtcgtgattcgatgttatttccgttttggttcatctgttctactaagtggttctacttattttaaaattcctccgtttcagtcactccgggaaaaaacttattatccggtaaatcagaaatatttgtctgcaatacaagatatcaagtcaacttgatctgacgggtttgaattgaatgtacggaattatggcgaaattagaccaatcttattgtagtgaaatctaatacatttcagcgggaatttcaatctaaaaggctagtgaagat

SEQ ID NO: 1554 - DNA, 4000 bp, Escherichia coli
  misc_feature (1976)..(1976): n is a, c, g, or t
  misc_feature (1988)..(1988): n is a, c, g, or t
tccaataaattttcaattgttggataaatatgataagtacaattattcataatttcaatatagcaattgcaaatttcttcaacaatgttttcatcattttgacagagatctaaaattctcactaatatagagtggtaattattatataattctattattggatgattttcactaatatcaatttcttcatttaattttatagtaaaaaagagagaaatatatgatataatatctatatatttttaaatattaatgtttatataataaaaatcaaataaattaataaatatatatatatatataataaataaatataaagaattatttatgaattattgataatttaccttgaatatcataagcaatattattaatattattatttggattattaatatattcatcactagttaacaattgtaatttttcaattaatggtaaatttaatttattaagatagtaatatagatcattttttgaaacatagattaaaatattacaaattgatttcaataaatcataaatatcctgatagttataaacattgattactttaatatagaaattgcaaaattcatcaagtaaatttgttaaatactttaatattaattataataataataaataaataaataaaataattaatatatatatatttcattaatttagttttaattttatttctaaataatataactattgtttaaatttttaccattccacaatatttagtaaattctaacaatgacgcaaatccttgatatctattactttcattttcaagaaatgatattaaataatttaattgttcattgatttcaatattattattaaatgaatattctgataaatcaccaattattctaataataacattatttattttttcattatttggaaagtagggtatcatttttacaatttctcttataatgttttgatggtcattgtttatattaaatataattgagtatagataaaataaatgaacttctatattgtttgaagtatcctcactgatttcattttgattagttttattgcaaagttcattttttaatgattcataaagggaatttaatatatcatattcatttagcattaaaaagcaattctgaaacataacttcaaaaacttctaatgaaatttcatcatcattattcattgatgtcaatttatataaatttaatgttttttcttgaaggacgctgtatgcctctacaaattgtggtttataattctgatatcctatgttatttaattgttcttgtaatatagtaaaaaatctatatgatatttcaatactatttggataaattgaatataattctattaatgaagctataataaatttaaaatcgttataatttttgattatggtataaatattatattcagcatatgtttcaaacattaaattatatattaataaaacttctttagatgatatatatttaatatgatttgataattcaaatattgtaggtgttatatagttcaataattctttattagtttctgatgaagtagatgaagaaattattaattcatttataatacttccaatgacttcatcaatttcatcattaattgcttcttttattatataattcattaatggagattttattatttttaatggttttatagccttatatcttatccaattgtatatacaattatttatatttgatttaagcctagagttattatctatatttattttatagaagttatgttaaaatttaaaaaacttattactttttactaatcatttaaatttcttttatttcttttttcaatttatatataaaaattcatacttgcttccattgaataataagataatatttcaacaatgttatttacgatattacttattaagacttcttcctttatttttgcttttctttcctatgtaatataataatagtaatataatattaatattaataataataataaaaaaaaaaaanaaaaaaaaaaangaagaaaaattaaaattttcaaacaaaataataaatatttaataaaaatattacaatatttacacttaattttaattgtttattatttagttcttcaggaatatatgctaaaaattgaaataatatacttgtcatttctgtatttttttcaaataattcacaaatttcttcaattggattattccaatcatcacataatattgccaaatcagataacgccaaacataattgcgttaaaattggatttgacttatctttattaatatataaaagataagtaattgaattcttcaattcgattgcatcttgttttaaatattgtaactcataaattatctagcattatttattattaattaatttatttatttacttatatatatattaaattttaaatttttaaattatttattatataataaaataatcattcaaataaaccttttgtcttaaagtttgagaagaaaatagttttaaatctagattttcctcattactttttaatatctcaagagacataaaccaagcattatcctttttaaaataattataaattaaattaatttataaatttattaattagtttttaaaattaatttaatttaagattaataaaaaatattattattattattattattattattattattattattattattattattattattattattattattattattattattattattattattattattattattattattattacgataatcttccagccattttaaatttgtttggtaagtatcataattatttgaattattcaaagaattaaaaataaaaagtagatgattataattttcatccatatccattattccagtagtcatagcgataaattgtacaaatatcaatgcttataaatatataatattaattattaaataaagaactgcaaatttatgtataaattctaaagaaaaaaacaatacttattaaatataactataaaaatgaattaatatcattgtttattattactttatttatattaaatctaaaataaaaatttaaataatatttattttcaaatttatattcttcatttattaatattattacataagttataataacattgttaatatgattgaaatattcatttaataaataaaatagaaaaactttttttctgaaaaatgttattactttatgtcctatcctatactaataataaataaatataaaataaaaataaaaatatttatacatattttttttattgataaggttcataaatatacggatcatttaatagatcattttaaaaataaattaattaatatatatatattatatattagaatataataaaatatattataaaatattattaattttagtataaatatttaatatctttagcaattatttaaaagaggagagcaatccaccataaaaaataaggtttttaataattactaataatttaataatttttttataaaaaaaattatatatatttaactgattttatactattaataattttctttaaatacaacaatattttaaattagtcaaaaagtaaagttggatcaaatagtaataaaaatggatgaagaatatgcccttgatgacatgggggataaagaagttttaattccaagaaaaaaaaaaggagaaaaagaaataaaagaattgcaacccaatttaaagaaagtaagagtacaatatatatatataaatatttatttttcatttgtttattattattttttttatcaaaggaatataaaaaattattttattttgtcttattttatattattaattttttttaatttattttgttttatttttattttgctttattttattttattttattttattcactatgtacttaaatttatatttttaatatttattttctttcattatattatattctctattatattatatattttattttattttattttattttattttattttattttattttattttattttattttattttattttattt

SEQ ID NO: 1555 - DNA, 4000 bp, Escherichia coli
  misc_feature (983)..(983): n is a, c, g, or t
  misc_feature (1008)..(1008): n is a, c, g, or t
  misc_feature (1154)..(1154): n is a, c, g, or t
  misc_feature (1181)..(1181): n is a, c, g, or t
  misc_feature (1185)..(1186): n is a, c, g, or t
  misc_feature (1190)..(1190): n is a, c, g, or t
  misc_feature (3834)..(3834): n is a, c, g, or t
  misc_feature (3891)..(3891): n is a, c, g, or t
  misc_feature (3942)..(3942): n is a, c, g, or t
  misc_feature (3960)..(3960): n is a, c, g, or t
aaggcataaaagggaaaaacccggttcgtgttattcttgattccagagcaacgatccgtgcaagctccaaaatcttaagaacatgttcaaaaattccaacaattatcgcagtgtcaaaaatggcaaagaaaaaaaacttagaaaaactaaaaaaatttccagtggtggtaaaagtttgtggaaataataaaataaacataaaaaaattacttaaatttctcaaagaaaaaaagataaaaaatcttttagttgagggaggcggaattacaaattggacatttgtaaaagaaaacctagttgacgaggcaataatcacaataactccttacattataggaggaaattcatctacaacattagtggatggtaacggtttttctattattgcaaaatcatcaagattgaggctaaaaaacgttacaagaatgaaaaacgaggttgtattacactatgagaattaagatggcatatctttttttatttcatcaattttcttcgcaaatgccttttttgccttctcatttttcttgtgatccaagatcttaccacatgaaggacatttgaaagactcttcaagtgcattttcaaatgtcagtctttcgcagtcttcatttccacaatgataaaactgcgatgaattttcataatctaatctttgctgaagtctctcagcaatcttctttttctgattctcaataaaattttcaacctcatctcttctagagcgccagcggtagacaaaccaaccttttctctcatcttttaccctaactcctgtaattagtgccttaccaaaaagatcatagagtacttttctaaccatgtttattcttaaaccagtatagcttgcaatttcctcatcagttgcatcttgtgcttttatcagtgatctagcaactttaagatattcatcaccaccaatcatttgtgagatttttacaaatggatcctcgtatttatcaatcaacgacgtccacactcanattctattattaatagttgttttantcatcctgacattttttccctgttcctgagggattatcactctttctgaattttcaaacttggattcaaactgatttccacactgaattcgatctaacaatactccgagagcgcttatttccgaatgtggttgattgcctattgcnacattataatctgccatctcaaaaatntccnntggnaccttctcagccccaactattattaagattttatcttcatttcgtaatttattttcaacgtcgttaatgcttagaccatacattgtaagatgaacaatttttacagactcctttttctttttcctgattatttttttccattccgtaatattttcaattgcaaaatttccaccccaggttttattaatcttggaaatcgtgtcattaatttcaggatttatttcattcatgtaaattcgtttagcaccaaatgatcttgcaaccagggcaacatgtgttgtaactctatcatctcttacaattcgttggccgattcttagcacctcaatttccatacgtttttacaccaacactcttattattttgcaatttattattttggaaaattttcccaattatttttttaagttcatccatgtttttacctgtaagagcagaaatggctatccattttttattttcttttagcattagataatctaccctatctaaaacctcatcatcagtcagtaattctgatttgtttaaaacgtaaatcatcttctccggctctacaccaatttcaattaaagttctataacaacttttgaattttttttgtaactcgtacaaaccgtcactcgcatcaattataactagtataatgtctgcatacaacagctcttctaatgtcgaattaaatgcctcaatcatatatgcggggatcttagtgataaatccaacagtgtctgaaatcagtgcaacttcgtgatttaccttaactcttctaacagtagttgaaagtgtagtaaaaagttcatcactttcttctttttgctctcctgttagaagattaaataatgttgtcttacctgctgaggtatatcctgctagtgatattattttaaaaccaagacgctttctgccttctctgtgcagtttacgttgtttgcctacctttactaattttgattttatatttatcatcctttttttaatttcgttatagtatacatcaacctcaaacgttcctagacccataaatccaggttgttcaccaccttttgataacttgactttttcttttgctcttgacatttcatatcgaagctgtgctaattctacctgaaactttgattctgcgttggcagctctactctcaaatatttttaaaatcaaagcctctctgtcaagtatttcaattttgagctctgaagctaggttataattctgtcttggttttaacatctcatcaaagattatgacatctggttttgcagcagcagtaatgtccttaagctcttgaatttttccagtgcttacaccaaattttggtttctgtaaaaaatcctgttttataatgtgctcaactttgtaacctgccgagtcacagagagctagcgcctcttttattacatcatcttggtcatatgttattaaaactgctgaattcatcgcaaaattttatgccttttgttttttgataatcttctctatattcatgtttaagacaatctcgccaacgtcacttgcatattcagcaattctttttacgttttcagaaattcttctaatcctaaaaacttcttcttcgttcttgtttattctaagaccctcaattatctttttttcatatttttctatatcgtttgcccttttaattgcattttcagcttcttcatagtcttttttgaataaggctaagcacgcatcatccattacagatatagcaaaatcactcatttctcgtatcatatcaaataacttgcctgtgataggttttttataatccaaaacatcttttgatattctgactgcatgatctgctagtctttcaatgttttttgtaataaccctatagccaaggcaatcgcgggcattttgaaatcccatttcctttaacatatggtcattttcaattgcaatcacaagctgtctagtaatataaaatgcaaatctgtctacatcatcatcactgttgataacctcttttgcaagttctacatttccttcttttattgcaatgagggcatcatcttgcattgatttagctagtagcatcatccttttgaaagcaccatcaactgagagctctaccaaatttattagaacttgaatggttatgccatctgaagaatcagcagtaatttcagaacccattaaaattttctttacagcatctctaattccaactctttgtgatggtgtgattcttcctatctttggtttaatattgattatcttaaaacgaaaaaagtatagtgacacaagctttcttacgacagaagacttatcctcctccggctcaatttctattgtagcaacttcagattcttctttttttctcgtacgatgcggcattatttgcaaacttgtagttccacttcgttcaactgatacctgatcaccctgttttagacccagttcattaacccattgttttggaagagaaataatgtaagtagatttgcccgtaaactggattttccgagtttcctcactatttgccataactatattcatcttatctgtctatatagattatttgatttctatacaaaatttaaactaatatttagatatcaggtatctgtttttgatggatcctattgtaaagcttaggcttagtattgatgcattatttgggcagggagtttcaaaacanctcccaaagaatattgagattttcttttcaaagagaactggacgaattcgtcaagtntaccataaacagaaacttctttgtacattgaaaattgacggtggactggcnatttcaccatattttgcncaaattcttatgaaaagtaaaaaattcagagaaaactgtg

SEQ ID NO: 1556 - DNA, 4000 bp, Escherichia coli
  misc_feature (418)..(418): n is a, c, g, or t
  misc_feature (420)..(444): n is a, c, g, or t
  misc_feature (447)..(447): n is a, c, g, or t
  misc_feature (450)..(451): n is a, c, g, or t
  misc_feature (454)..(454): n is a, c, g, or t
  misc_feature (456)..(458): n is a, c, g, or t
  misc_feature (460)..(462): n is a, c, g, or t
  misc_feature (465)..(468): n is a, c, g, or t
  misc_feature (470)..(487): n is a, c, g, or t
  misc_feature (490)..(490): n is a, c, g, or t
  misc_feature (492)..(494): n is a, c, g, or t
  misc_feature (496)..(496): n is a, c, g, or t
  misc_feature (499)..(499): n is a, c, g, or t
  misc_feature (501)..(502): n is a, c, g, or t
  misc_feature (504)..(511): n is a, c, g, or t
  misc_feature (513)..(514): n is a, c, g, or t
  misc_feature (516)..(517): n is a, c, g, or t
  misc_feature (519)..(523): n is a, c, g, or t
  misc_feature (525)..(530): n is a, c, g, or t
  misc_feature (532)..(535): n is a, c, g, or t
  misc_feature (537)..(537): n is a, c, g, or t
  misc_feature (539)..(544): n is a, c, g, or t
  misc_feature (546)..(547): n is a, c, g, or t
  misc_feature (549)..(554): n is a, c, g, or t
  misc_feature (556)..(558): n is a, c, g, or t
  misc_feature (560)..(560): n is a, c, g, or t
  misc_feature (562)..(563): n is a, c, g, or t
  misc_feature (565)..(567): n is a, c, g, or t
  misc_feature (569)..(570): n is a, c, g, or t
  misc_feature (572)..(576): n is a, c, g, or t
  misc_feature (578)..(580): n is a, c, g, or t
  misc_feature (582)..(586): n is a, c, g, or t
  misc_feature (588)..(589): n is a, c, g, or t
  misc_feature (592)..(593): n is a, c, g, or t
  misc_feature (595)..(595): n is a, c, g, or t
  misc_feature (600)..(608): n is a, c, g, or t
  misc_feature (610)..(611): n is a, c, g, or t
  misc_feature (614)..(619): n is a, c, g, or t
  misc_feature (621)..(629): n is a, c, g, or t
  misc_feature (631)..(631): n is a, c, g, or t
  misc_feature (637)..(639): n is a, c, g, or t
  misc_feature (642)..(645): n is a, c, g, or t
  misc_feature (647)..(650): n is a, c, g, or t
  misc_feature (652)..(653): n is a, c, g, or t
  misc_feature (656)..(656): n is a, c, g, or t
  misc_feature (659)..(659): n is a, c, g, or t
  misc_feature (661)..(663): n is a, c, g, or t
  misc_feature (665)..(671): n is a, c, g, or t
  misc_feature (674)..(675): n is a, c, g, or t
  misc_feature (678)..(678): n is a, c, g, or t
  misc_feature (682)..(682): n is a, c, g, or t
  misc_feature (684)..(684): n is a, c, g, or t
  misc_feature (686)..(686): n is a, c, g, or t
  misc_feature (688)..(706): n is a, c, g, or t
  misc_feature (708)..(711): n is a, c, g, or t
  misc_feature (714)..(715): n is a, c, g, or t
  misc_feature (721)..(727): n is a, c, g, or t
  misc_feature (733)..(733): n is a, c, g, or t
  misc_feature (735)..(736): n is a, c, g, or t
  misc_feature (739)..(741): n is a, c, g, or t
  misc_feature (743)..(745): n is a, c, g, or t
  misc_feature (747)..(747): n is a, c, g, or t
  misc_feature (749)..(749): n is a, c, g, or t
  misc_feature (754)..(758): n is a, c, g, or t
  misc_feature (760)..(760): n is a, c, g, or t
  misc_feature (762)..(762): n is a, c, g, or t
  misc_feature (765)..(765): n is a, c, g, or t
  misc_feature (770)..(770): n is a, c, g, or t
  misc_feature (773)..(773): n is a, c, g, or t
  misc_feature (775)..(775): n is a, c, g, or t
  misc_feature (777)..(777): n is a, c, g, or t
  misc_feature (779)..(779): n is a, c, g, or t
  misc_feature (781)..(782): n is a, c, g, or t
  misc_feature (785)..(786): n is a, c, g, or t
  misc_feature (790)..(791): n is a, c, g, or t
  misc_feature (796)..(800): n is a, c, g, or t
  misc_feature (802)..(802): n is a, c, g, or t
  misc_feature (805)..(805): n is a, c, g, or t
  misc_feature (807)..(808): n is a, c, g, or t
  misc_feature (812)..(812): n is a, c, g, or t
  misc_feature (816)..(816): n is a, c, g, or t
  misc_feature (818)..(818): n is a, c, g, or t
  misc_feature (822)..(822): n is a, c, g, or t
  misc_feature (824)..(825): n is a, c, g, or t
  misc_feature (828)..(828): n is a, c, g, or t
  misc_feature (832)..(832): n is a, c, g, or t
  misc_feature (835)..(835): n is a, c, g, or t
  misc_feature (837)..(838): n is a, c, g, or t
  misc_feature (840)..(843): n is a, c, g, or t
  misc_feature (845)..(850): n is a, c, g, or t
  misc_feature (853)..(861): n is a, c, g, or t
  misc_feature (863)..(863): n is a, c, g, or t
  misc_feature (865)..(892): n is a, c, g, or t
  misc_feature (894)..(894): n is a, c, g, or t
  misc_feature (896)..(897): n is a, c, g, or t
  misc_feature (901)..(906): n is a, c, g, or t
  misc_feature (908)..(910): n is a, c, g, or t
  misc_feature (912)..(915): n is a, c, g, or t
  misc_feature (917)..(919): n is a, c, g, or t
  misc_feature (922)..(931): n is a, c, g, or t
  misc_feature (933)..(939): n is a, c, g, or t
  misc_feature (941)..(948): n is a, c, g, or t
  misc_feature (950)..(951): n is a, c, g, or t
  misc_feature (953)..(953): n is a, c, g, or t
  misc_feature (957)..(960): n is a, c, g, or t
  misc_feature (962)..(962): n is a, c, g, or t
  misc_feature (964)..(976): n is a, c, g, or t
  misc_feature (978)..(984): n is a, c, g, or t
  misc_feature (986)..(988): n is a, c, g, or t
  misc_feature (990)..(993): n is a, c, g, or t
  misc_feature (995)..(1003): n is a, c, g, or t
  misc_feature (1005)..(1010): n is a, c, g, or t
  misc_feature (1012)..(1013): n is a, c, g, or t
  misc_feature (1015)..(1018): n is a, c, g, or t
  misc_feature (1020)..(1029): n is a, c, g, or t
  misc_feature (1032)..(1033): n is a, c, g, or t
  misc_feature (1035)..(1037): n is a, c, g, or t
  misc_feature (1039)..(1046): n is a, c, g, or t
  misc_feature (1049)..(1049): n is a, c, g, or t
  misc_feature (1052)..(1053): n is a, c, g, or t
  misc_feature (1055)..(1055): n is a, c, g, or t
  misc_feature (1057)..(1060): n is a, c, g, or t
  misc_feature (1062)..(1067): n is a, c, g, or t
  misc_feature (1069)..(1075): n is a, c, g, or t
  misc_feature (1077)..(1077): n is a, c, g, or t
  misc_feature (1079)..(1102): n is a, c, g, or t
  misc_feature (1104)..(1107): n is a, c, g, or t
  misc_feature (1109)..(1116): n is a, c, g, or t
  misc_feature (1118)..(1119): n is a, c, g, or t
  misc_feature (1121)..(1123): n is a, c, g, or t
  misc_feature (1125)..(1125): n is a, c, g, or t
  misc_feature (1127)..(1127): n is a, c, g, or t
  misc_feature (1129)..(1129): n is a, c, g, or t
  misc_feature (1131)..(1131): n is a, c, g, or t
  misc_feature (1133)..(1133): n is a, c, g, or t
  misc_feature (1135)..(1135): n is a, c, g, or t
  misc_feature (1137)..(1140): n is a, c, g, or t
  misc_feature (1142)..(1149): n is a, c, g, or t
  misc_feature (1151)..(1157): n is a, c, g, or t
  misc_feature (1159)..(1163): n is a, c, g, or t
  misc_feature (1165)..(1167): n is a, c, g, or t
  misc_feature (1169)..(1178): n is a, c, g, or t
  misc_feature (1180)..(1180): n is a, c, g, or t
  misc_feature (1182)..(1183): n is a, c, g, or t
  misc_feature (1185)..(1186): n is a, c, g, or t
  misc_feature (1188)..(1188): n is a, c, g, or t
  misc_feature (1190)..(1210): n is a, c, g, or t
  misc_feature (1213)..(1213): n is a, c, g, or t
  misc_feature (1216)..(1219): n is a, c, g, or t
  misc_feature (1221)..(1224): n is a, c, g, or t
  misc_feature (1227)..(1234): n is a, c, g, or t
  misc_feature (1238)..(1239): n is a, c, g, or t
  misc_feature (1241)..(1249): n is a, c, g, or t
  misc_feature (1251)..(1252): n is a, c, g, or t
  misc_feature (1255)..(1255): n is a, c, g, or t
  misc_feature (1257)..(1257): n is a, c, g, or t
  misc_feature (1259)..(1259): n is a, c, g, or t
  misc_feature (1261)..(1261): n is a, c, g, or t
  misc_feature (1263)..(1265): n is a, c, g, or t
  misc_feature (1269)..(1271): n is a, c, g, or t
  misc_feature (1273)..(1274): n is a, c, g, or t
  misc_feature (1276)..(1277): n is a, c, g, or t
  misc_feature (1279)..(1279): n is a, c, g, or t
  misc_feature (1281)..(1282): n is a, c, g, or t
  misc_feature (1284)..(1284): n is a, c, g, or t
  misc_feature (1286)..(1286): n is a, c, g, or t
  misc_feature (1288)..(1289): n is a, c, g, or t
  misc_feature (1291)..(1297): n is a, c, g, or t
  misc_feature (1299)..(1301): n is a, c, g, or t
  misc_feature (1303)..(1304): n is a, c, g, or t
  misc_feature (1306)..(1308): n is a, c, g, or t
  misc_feature (1310)..(1318): n is a, c, g, or t
  misc_feature (1320)..(1321): n is a, c, g, or t
  misc_feature (1324)..(1329): n is a, c, g, or t
  misc_feature (1331)..(1333): n is a, c, g, or t
  misc_feature (1335)..(1335): n is a, c, g, or t
  misc_feature (1337)..(1338): n is a, c, g, or t
  misc_feature (1341)..(1350): n is a, c, g, or t
  misc_feature (1352)..(1357): n is a, c, g, or t
  misc_feature (1359)..(1359): n is a, c, g, or t
  misc_feature (1361)..(1364): n is a, c, g, or t
  misc_feature (1366)..(1373): n is a, c, g, or t
  misc_feature (1376)..(1376): n is a, c, g, or t
  misc_feature (1378)..(1381): n is a, c, g, or t
  misc_feature (1383)..(1388): n is a, c, g, or t
  misc_feature (1390)..(1392): n is a, c, g, or t
  misc_feature (1394)..(1396): n is a, c, g, or t
  misc_feature (1398)..(1403): n is a, c, g, or t
  misc_feature (1405)..(1409): n is a, c, g, or t
  misc_feature (1411)..(1412): n is a, c, g, or t
  misc_feature (1414)..(1436): n is a, c, g, or t
  misc_feature (1438)..(1505): n is a, c, g, or t
  misc_feature (1507)..(1522): n is a, c, g, or t
  misc_feature (1524)..(1524): n is a, c, g, or t
  misc_feature (1526)..(1537): n is a, c, g, or t
  misc_feature (1539)..(1543): n is a, c, g, or t
  misc_feature (1545)..(1545): n is a, c, g, or t
  misc_feature (1548)..(1548): n is a, c, g, or t
  misc_feature (1550)..(1562): n is a, c, g, or t
  misc_feature (1567)..(1568): n is a, c, g, or t
  misc_feature (1571)..(1571): n is a, c, g, or t
  misc_feature (1573)..(1575): n is a, c, g, or t
  misc_feature (1577)..(1579): n is a, c, g, or t
  misc_feature (1582)..(1583): n is a, c, g, or t
  misc_feature (1586)..(1586): n is a, c, g, or t
  misc_feature (1588)..(1588): n is a, c, g, or t
  misc_feature (1591)..(1593): n is a, c, g, or t
  misc_feature (1597)..(1599): n is a, c, g, or t
  misc_feature (1601)..(1604): n is a, c, g, or t
  misc_feature (1606)..(1607): n is a, c, g, or t
  misc_feature (1609)..(1611): n is a, c, g, or t
  misc_feature (1613)..(1613): n is a, c, g, or t
  misc_feature (1616)..(1616): n is a, c, g, or t
  misc_feature (1618)..(1618): n is a, c, g, or t
  misc_feature (1621)..(1623): n is a, c, g, or t
  misc_feature (1626)..(1626): n is a, c, g, or t
  misc_feature (1628)..(1629): n is a, c, g, or t
  misc_feature (1631)..(1632): n is a, c, g, or t
  misc_feature (1637)..(1638): n is a, c, g, or t
  misc_feature (1640)..(1640): n is a, c, g, or t
  misc_feature (1642)..(1642): n is a, c, g, or t
  misc_feature (1644)..(1646): n is a, c, g, or t
  misc_feature (1648)..(1648): n is a, c, g, or t
  misc_feature (1650)..(1651): n is a, c, g, or t
  misc_feature (1654)..(1654): n is a, c, g, or t
  misc_feature (1657)..(1657): n is a, c, g, or t
  misc_feature (1660)..(1661): n is a, c, g, or t
  misc_feature (1663)..(1664): n is a, c, g, or t
  misc_feature (1666)..(1666): n is a, c, g, or t
  misc_feature (1668)..(1669): n is a, c, g, or t
  misc_feature (1671)..(1671): n is a, c, g, or t
  misc_feature (1676)..(1682): n is a, c, g, or t
  misc_feature (1684)..(1684): n is a, c, g, or t
  misc_feature (1687)..(1688): n is a, c, g, or t
  misc_feature (1691)..(1693): n is a, c, g, or t
  misc_feature (1695)..(1700): n is a, c, g, or t
  misc_feature (1702)..(1705): n is a, c, g, or t
  misc_feature (1708)..(1708): n is a, c, g, or t
  misc_feature (1712)..(1712): n is a, c, g, or t
  misc_feature (1714)..(1714): n is a, c, g, or t
  misc_feature (1716)..(1717): n is a, c, g, or t
  misc_feature (1719)..(1719): n is a, c, g, or t
  misc_feature (1721)..(1728): n is a, c, g, or t
  misc_feature (1730)..(1730): n is a, c, g, or t
  misc_feature (1732)..(1734): n is a, c, g, or t
  misc_feature (1736)..(1737): n is a, c, g, or t
  misc_feature (1739)..(1750): n is a, c, g, or t
  misc_feature (1752)..(1754): n is a, c, g, or t
  misc_feature (1756)..(1758): n is a, c, g, or t
  misc_feature (1795)..(1795): n is a, c, g, or t
  misc_feature (1860)..(1860): n is a, c, g, or t
  misc_feature (1863)..(1863): n is a, c, g, or t
  misc_feature (1979)..(1979): n is a, c, g, or t
  misc_feature (1988)..(1988): n is a, c, g, or t
  misc_feature (3024)..(3024): n is a, c, g, or t
  misc_feature (3129)..(3129): n is a, c, g, or t
  misc_feature (3135)..(3135): n is a, c, g, or t
  misc_feature (3138)..(3138): n is a, c, g, or t
  misc_feature (3141)..(3141): n is a, c, g, or t
  misc_feature (3195)..(3196): n is a, c, g, or t
  misc_feature (3219)..(3219): n is a, c, g, or t
  misc_feature (3222)..(3222): n is a, c, g, or t
  misc_feature (3306)..(3306): n is a, c, g, or t
  misc_feature (3816)..(3816): n is a, c, g, or t
  misc_feature (3957)..(3957): n is a, c, g, or t
ccaaatcagagcgcaaccctcggggcggttccgcgagataaactgggagccgcttcaggcatgtcagtgacgaccggccgaattggggtatcctgcggcgtggcgctttccacagcagtctttacttatgcgctgactcttacgggtctaacccgcagccagattgaatttcccgaggactggggtttgtttcccgatgaatttatgcgcgcgttcaaccatacagtccatgtcattaattctttcacgctgctctcgattgttttctccgcgtcgcgagggggccgcaaggattgacgtctattaaaacgctgatgccggatgataacgaacgatttcctcacttctccacggccgagtttgccttctcgaatttttcgacaaatgaattgtcgaaaaattcctttggattggtgcntnnnnnnnnnnnnnnnnnnnnnnnnntgngannctncnnntnnnccnnnntnnnnnnnnnnnnnnnnnncanannngnctngnnannnnnnnngnngnngnnnnncnnnnnntnnnntntnnnnnnannannnnnntnnntntnntnnncnntnnnnntnnngnnnnncnngcnntnttttnnnnnnnnngnnacnnnnnngnnnnnnnnntngctaannncgnnnntnnnntnnggnttntnnntnnnnnnnttnnccntcgntncntnnnnnnnnnnnnnnnnnnngnnnntcnnctttgnnnnnnncatgcntnnagnnngnnngnantcgannnnntncnggntgaanggngncntntnngtnnagcnngaagnnnnncntgnanngatngatnanagantnnctngacntcngnnannnnannnnnnccnnnnnnnnngngnnnnnnnnnnnnnnnnnnnnnnnnnnnncncnnccgnnnnnntnnngnnnncnnnttnnnnnnnnnntnnnnnnncnnnnnnnncnntntttnnnncnannnnnnnnnnnnncnnnnnnncnnntnnnngnnnnnnnnntnnnnnngnncnnnngnnnnnnnnnntgnnannngnnnnnnnncgnctnncngnnnntnnnnnncnnnnnnnanannnnnnnnnnnnnnnnnnnnnnnncnnnngnnnnnnnncnntnnntntngncntnantnnnnannnnnnnncnnnnnnntnnnnngnnnannnnnnnnnngngnngnncncnnnnnnnnnnnnnnnnnnnnnggnagnnnncnnnnagnnnnnnnnaggnncnnnnnnnnngnnttncnangngnnntctnnngnntnngnannangncnngnnnnnnntnnnannannnannnnnnnnngnnggnnnnnngnnngntnnaannnnnnnnnntnnnnnnantnnnnannnnnnnncancnnnntnnnnnngnnntnnngnnnnnnannnnngnncnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnngnnnnnnnnnnnnnnnnanannnnnnnnnnnnannnnntnttngnnnnnnnnnnnnngaacnnagncnnncnnnaannaancncgnnnccannngnnnntnngnnncnagngngcnnnctngnnanngcganncngncnnncnanngcngtnttnngnngncnntntccgnnnnnnngntcnnatnnnannnnnngnnnngantttnananngncnnnnnnnncnannncnntnnnnnnnnnnnnannncnnntgatagagaatcgggctcccatcctcagtccgatctntgctcgggcagatcctttagcccatcaacgggcaacttccatattcccttctgccctacctatcnaantcatatagacgagggagagtcttaaaaattcggcaggcgatccagtggccgtaaacttgacgcatccaatgccgaaagctattgtcgatttgatgaaaaaaacgatcaacgtgacnattaacggncgcctgtacgaagaagacgtcgagccgcgtctgctgctttctcattttctccgcgagaatatcggcctcacgggaacgcatgtcggttgtgtcgtcggcgaatgcggtgcctgcacgattcttttggatggcaaactcgttaaatcatgccttcatttcgcggtccaggcggacggacgggaagtcacgaccgttgaaggattggctaaagatggcgagttgagcgtcgttcaagaagccttcgtcaagcactacgcgtttcaatgcggttactgcacccccggaatgatcatggcgagttacgcgctcttgcgcgatcatccgaatcccagcgagggagaaattcgcaaagcgctctccggcaatctttgcatgtgcacaggctacgtgcagatcgtcgaagccgtcaaagatgcagcacaaggactgaagaatggctaaattcgtaggcagccgcagtcgcagcaaggaaggtccccggcacgtcaccggtcgaggtctttatacggatgacttcatgctgccgggcatgcttcaggcgatgattttgcggagcccccacgctcacgcgaaaattgtttccatcgatccttcagaggcgctgaaaaatcccaacgtcatcacggtaatcactccggacgacgtcaagcaaagcacacgaccgttcaggcccggccggtatgccgctggactgaagcggcccatcgatgaatacgcgggcgccgtcgataaagtgcgctatgttggcgagcctgtaggggcggttgcggctcgagatcgcgggacggcggaagatgcgttggaattgatttcggttgagtacgagcctctccgttccgtggtggacgtgcgcgaagctattaagccttcctccgctgtcctgttcgatgaattgggcaccaacctggcatggcacggcgctttgaagtatggcgagatcgacggcgcattcaaatccgcggatcgaatcgtcaaggagaatttgaagattcaccgctacagctcgactcctctggagcctttcgccgtcatcgcntcctacgatgcagcgagcaaaagattgacggtttgggtcacggctcaggttcctgaggttatttacgatggactgcgcgaggcgctcggattgcaagacgttcgngtcatnatnccngacgtcggcggcgggtttggccaaaaaattcatttgattcgtaaatacgtcgtnntgatctctcttcttgcgatgaanagnggccggccggtcaaatggatcgaagaccgcagcgagcacatgatggccggcggccacgcctgcgctcaggaatttgaggccgangccgccgtgaaaaatgatggcacggttttgggtcttcgcttcaaggaatacgatgacgtgggcggctccatcagcaccctcacgatccacttcaccaacaaactgaacaacctttctaacacctaccgcacgccgaatatttcaatggaaggtttcgccgtcgtgacgaacaaatgcccggttattcccaatcgtggcatcggcaaaccgggcatgtgctttgtttgggaacgaatgatggatcgtgttgctcaggagctgaatctaagtcccatcgaagtacgccggaaaaacctgattcagcccaacgagatgccctacagcactgtgagcggcaacgtctatgatagcggcgactatccggggctgctgcaaggtctcttggaaaaaatagattacgataaactcagagaggaacaaaagcgtgaacgggaaaaagggcgtctcatcggcatcggcgtggttatcggcgtcgaacctggcggccgaaacgccgcccgtgacatggcnatctttcccgagatgaaggagccaccgggctccggcggcatcaatggcgcaaccatcaagcttgagaaaaacggcaccctcgcgcttcacctcggctcgcccaactgcggtcaggcccacgaaaccaccaccgcgcaagtngcggcggaagttctcgggacgactcccgaccgcatcagtacca

SEQ ID NO: 1557 - DNA, 4000 bp, Escherichia coli
  misc_feature (2)..(4): n is a, c, g, or t
  misc_feature (6)..(6): n is a, c, g, or t
  misc_feature (8)..(11): n is a, c, g, or t
  misc_feature (14)..(16): n is a, c, g, or t
  misc_feature (22)..(24): n is a, c, g, or t
  misc_feature (26)..(27): n is a, c, g, or t
  misc_feature (29)..(35): n is a, c, g, or t
  misc_feature (38)..(38): n is a, c, g, or t
  misc_feature (43)..(49): n is a, c, g, or t
  misc_feature (53)..(54): n is a, c, g, or t
  misc_feature (56)..(61): n is a, c, g, or t
  misc_feature (64)..(66): n is a, c, g, or t
  misc_feature (70)..(70): n is a, c, g, or t
  misc_feature (74)..(75): n is a, c, g, or t
  misc_feature (77)..(77): n is a, c, g, or t
  misc_feature (79)..(80): n is a, c, g, or t
  misc_feature (82)..(86): n is a, c, g, or t
  misc_feature (88)..(90): n is a, c, g, or t
  misc_feature (92)..(92): n is a, c, g, or t
  misc_feature (96)..(98): n is a, c, g, or t
  misc_feature (100)..(106): n is a, c, g, or t
  misc_feature (109)..(109): n is a, c, g, or t
  misc_feature (111)..(114): n is a, c, g, or t
  misc_feature (116)..(117): n is a, c, g, or t
  misc_feature (119)..(127): n is a, c, g, or t
  misc_feature (129)..(131): n is a, c, g, or t
  misc_feature (133)..(146): n is a, c, g, or t
  misc_feature (148)..(149): n is a, c, g, or t
  misc_feature (152)..(153): n is a, c, g, or t
  misc_feature (155)..(155): n is a, c, g, or t
  misc_feature (157)..(157): n is a, c, g, or t
  misc_feature (159)..(159): n is a, c, g, or t
  misc_feature (161)..(167): n is a, c, g, or t
  misc_feature (169)..(170): n is a, c, g, or t
  misc_feature (173)..(173): n is a, c, g, or t
  misc_feature (176)..(177): n is a, c, g, or t
  misc_feature (180)..(182): n is a, c, g, or t
  misc_feature (184)..(185): n is a, c, g, or t
  misc_feature (187)..(191): n is a, c, g, or t
  misc_feature (196)..(202): n is a, c, g, or t
  misc_feature (204)..(206): n is a, c, g, or t
  misc_feature (208)..(216): n is a, c, g, or t
  misc_feature (218)..(221): n is a, c, g, or t
  misc_feature (223)..(225): n is a, c, g, or t
  misc_feature (228)..(229): n is a, c, g, or t
  misc_feature (232)..(233): n is a, c, g, or t
  misc_feature (235)..(235): n is a, c, g, or t
  misc_feature (237)..(240): n is a, c, g, or t
  misc_feature (282)..(282): n is a, c, g, or t
  misc_feature (969)..(969): n is a, c, g, or t
  misc_feature (1014)..(1014): n is a, c, g, or t
  misc_feature (1209)..(1209): n is a, c, g, or t
  misc_feature (1230)..(1230): n is a, c, g, or t
  misc_feature (1976)..(1976): n is a, c, g, or t
  misc_feature (1983)..(1983): n is a, c, g, or t
  misc_feature (1991)..(1991): n is a, c, g, or t
  misc_feature (1997)..(1997): n is a, c, g, or t
  misc_feature (2408)..(2409): n is a, c, g, or t
  misc_feature (2411)..(2413): n is a, c, g, or t
  misc_feature (2415)..(2416): n is a, c, g, or t
  misc_feature (2418)..(2419): n is a, c, g, or t
  misc_feature (2424)..(2425): n is a, c, g, or t
  misc_feature (2427)..(2429): n is a, c, g, or t
  misc_feature (2432)..(2432): n is a, c, g, or t
  misc_feature (2437)..(2437): n is a, c, g, or t
  misc_feature (2439)..(2439): n is a, c, g, or t
  misc_feature (2443)..(2445): n is a, c, g, or t
  misc_feature (2447)..(2449): n is a, c, g, or t
  misc_feature (2451)..(2452): n is a, c, g, or t
  misc_feature (2454)..(2457): n is a, c, g, or t
  misc_feature (2459)..(2461): n is a, c, g, or t
  misc_feature (2463)..(2466): n is a, c, g, or t
  misc_feature (2468)..(2470): n is a, c, g, or t
  misc_feature (2473)..(2473): n is a, c, g, or t
  misc_feature (2475)..(2478): n is a, c, g, or t
  misc_feature (2480)..(2481): n is a, c, g, or t
  misc_feature (2484)..(2484): n is a, c, g, or t
  misc_feature (2487)..(2492): n is a, c, g, or t
  misc_feature (2494)..(2494): n is a, c, g, or t
  misc_feature (2496)..(2496): n is a, c, g, or t
  misc_feature (2498)..(2500): n is a, c, g, or t
  misc_feature (2505)..(2506): n is a, c, g, or t
  misc_feature (2509)..(2511): n is a, c, g, or t
  misc_feature (2513)..(2515): n is a, c, g, or t
  misc_feature (2518)..(2522): n is a, c, g, or t
  misc_feature (2524)..(2524): n is a, c, g, or t
  misc_feature (2526)..(2528): n is a, c, g, or t
  misc_feature (2530)..(2531): n is a, c, g, or t
  misc_feature (2536)..(2536): n is a, c, g, or t
  misc_feature (2538)..(2538): n is a, c, g, or t
  misc_feature (2540)..(2544): n is a, c, g, or t
  misc_feature (2546)..(2564): n is a, c, g, or t
  misc_feature (2566)..(2567): n is a, c, g, or t
  misc_feature (2570)..(2582): n is a, c, g, or t
  misc_feature (2584)..(2596): n is a, c, g, or t
  misc_feature (2598)..(2601): n is a, c, g, or t
  misc_feature (2603)..(2603): n is a, c, g, or t
  misc_feature (2605)..(2606): n is a, c, g, or t
  misc_feature (2609)..(2609): n is a, c, g, or t
  misc_feature (2612)..(2612): n is a, c, g, or t
  misc_feature (2616)..(2616): n is a, c, g, or t
  misc_feature (2618)..(2619): n is a, c, g, or t
  misc_feature (2621)..(2625): n is a, c, g, or t
  misc_feature (2628)..(2630): n is a, c, g, or t
  misc_feature (2632)..(2634): n is a, c, g, or t
  misc_feature (2637)..(2637): n is a, c, g, or t
  misc_feature (2639)..(2643): n is a, c, g, or t
  misc_feature (2645)..(2647): n is a, c, g, or t
  misc_feature (2649)..(2650): n is a, c, g, or t
  misc_feature (2655)..(2657): n is a, c, g, or t
  misc_feature (2659)..(2659): n is a, c, g, or t
  misc_feature (2661)..(2662): n is a, c, g, or t
  misc_feature (2665)..(2665): n is a, c, g, or t
  misc_feature (2667)..(2670): n is a, c, g, or t
  misc_feature (2672)..(2673): n is a, c, g, or t
  misc_feature (2675)..(2676): n is a, c, g, or t
  misc_feature (2678)..(2680): n is a, c, g, or t
  misc_feature (2682)..(2682): n is a, c, g, or t
  misc_feature (2685)..(2685): n is a, c, g, or t
  misc_feature (2687)..(2691): n is a, c, g, or t
  misc_feature (2693)..(2693): n is a, c, g, or t
  misc_feature (2695)..(2695): n is a, c, g, or t
  misc_feature (2698)..(2702): n is a, c, g, or t
  misc_feature (2706)..(2708): n is a, c, g, or t
  misc_feature (2710)..(2711): n is a, c, g, or t
  misc_feature (2715)..(2721): n is a, c, g, or t
  misc_feature (2723)..(2723): n is a, c, g, or t
  misc_feature (2725)..(2725): n is a, c, g, or t
  misc_feature (2728)..(2731): n is a, c, g, or t
  misc_feature (2735)..(2737): n is a, c, g, or t
  misc_feature (2740)..(2741): n is a, c, g, or t
  misc_feature (2743)..(2746): n is a, c, g, or t
  misc_feature (2750)..(2755): n is a, c, g, or t
  misc_feature (2759)..(2759): n is a, c, g, or t
  misc_feature (2761)..(2772): n is a, c, g, or t
  misc_feature (2774)..(2782): n is a, c, g, or t
  misc_feature (2784)..(2785): n is a, c, g, or t
  misc_feature (2787)..(2787): n is a, c, g, or t
  misc_feature (2789)..(2790): n is a, c, g, or t
  misc_feature (2792)..(2793): n is a, c, g, or t
  misc_feature (2796)..(2796): n is a, c, g, or t
  misc_feature (2798)..(2802): n is a, c, g, or t
  misc_feature (2804)..(2813): n is a, c, g, or t
  misc_feature (2815)..(2815): n is a, c, g, or t
  misc_feature (2817)..(2830): n is a, c, g, or t
  misc_feature (2832)..(2832): n is a, c, g, or t
  misc_feature (2834)..(2836): n is a, c, g, or t
  misc_feature (2839)..(2839): n is a, c, g, or t
  misc_feature (2842)..(2842): n is a, c, g, or t
  misc_feature (2844)..(2844): n is a, c, g, or t
  misc_feature (2846)..(2847): n is a, c, g, or t
  misc_feature (2849)..(2849): n is a, c, g, or t
  misc_feature (2852)..(2855): n is a, c, g, or t
  misc_feature (2857)..(2859): n is a, c, g, or t
  misc_feature (2861)..(2861): n is a, c, g, or t
  misc_feature (2865)..(2870): n is a, c, g, or t
  misc_feature (2872)..(2873): n is a, c, g, or t
  misc_feature (2875)..(2875): n is a, c, g, or t
  misc_feature (2877)..(2880): n is a, c, g, or t
  misc_feature (2882)..(2884): n is a, c, g, or t
  misc_feature (2886)..(2887): n is a, c, g, or t
  misc_feature (2889)..(2890): n is a, c, g, or t
  misc_feature (2892)..(2895): n is a, c, g, or t
  misc_feature (2900)..(2902): n is a, c, g, or t
  misc_feature (2904)..(2904): n is a, c, g, or t
  misc_feature (2906)..(2906): n is a, c, g, or t
  misc_feature (2908)..(2910): n is a, c, g, or t
  misc_feature (2912)..(2912): n is a, c, g, or t
  misc_feature (2915)..(2915): n is a, c, g, or t
  misc_feature (2917)..(2918): n is a, c, g, or t
  misc_feature (2920)..(2923): n is a, c, g, or t
  misc_feature (2925)..(2927): n is a, c, g, or t
  misc_feature (2931)..(2936): n is a, c, g, or t
  misc_feature (2938)..(2939): n is a, c, g, or t
  misc_feature (2941)..(2942): n is a, c, g, or t
  misc_feature (2944)..(2948): n is a, c, g, or t
  misc_feature (2951)..(2956): n is a, c, g, or t
  misc_feature (2959)..(2960): n is a, c, g, or t
  misc_feature (2962)..(2962): n is a, c, g, or t
  misc_feature (2964)..(2966): n is a, c, g, or t
  misc_feature (2969)..(2969): n is a, c, g, or t
  misc_feature (2971)..(2976): n is a, c, g, or t
  misc_feature (2978)..(2978): n is a, c, g, or t
  misc_feature (2980)..(2985): n is a, c, g, or t
  misc_feature (2987)..(2988): n is a, c, g, or t
  misc_feature (2990)..(2992): n is a, c, g, or t
  misc_feature (2994)..(2996): n is a, c, g, or t
  misc_feature (2998)..(3001): n is a, c, g, or t
  misc_feature (3005)..(3007): n is a, c, g, or t
  misc_feature (3009)..(3009): n is a, c, g, or t
  misc_feature (3011)..(3012): n is a, c, g, or t
  misc_feature (3014)..(3015): n is a, c, g, or t
  misc_feature (3018)..(3018): n is a, c, g, or t
  misc_feature (3020)..(3020): n is a, c, g, or t
  misc_feature (3022)..(3031): n is a, c, g, or t
  misc_feature (3034)..(3034): n is a, c, g, or t
  misc_feature (3036)..(3039): n is a, c, g, or t
  misc_feature (3041)..(3046): n is a, c, g, or t
  misc_feature (3048)..(3048): n is a, c, g, or t
  misc_feature (3050)..(3052): n is a, c, g, or t
  misc_feature (3055)..(3057): n is a, c, g, or t
  misc_feature (3060)..(3060): n is a, c, g, or t
  misc_feature (3062)..(3064): n is a, c, g, or t
  misc_feature (3066)..(3066): n is a, c, g, or t
  misc_feature (3068)..(3068): n is a, c, g, or t
  misc_feature (3070)..(3077): n is a, c, g, or t
  misc_feature (3079)..(3080): n is a, c, g, or t
  misc_feature (3084)..(3090): n is a, c, g, or t
  misc_feature (3092)..(3093): n is a, c, g, or t
  misc_feature (3095)..(3097): n is a, c, g, or t
  misc_feature (3100)..(3100): n is a, c, g, or t
  misc_feature (3102)..(3107): n is a, c, g, or t
  misc_feature (3110)..(3110): n is a, c, g, or t
  misc_feature (3112)..(3113): n is a, c, g, or t
  misc_feature (3115)..(3122): n is a, c, g, or t
  misc_feature (3124)..(3124): n is a, c, g, or t
  misc_feature (3126)..(3131): n is a, c, g, or t
  misc_feature (3133)..(3133): n is a, c, g, or t
  misc_feature (3135)..(3135): n is a, c, g, or t
  misc_feature (3139)..(3139): n is a, c, g, or t
  misc_feature (3141)..(3143): n is a, c, g, or t
  misc_feature (3145)..(3145): n is a, c, g, or t
  misc_feature (3147)..(3153): n is a, c, g, or t
  misc_feature (3155)..(3156): n is a, c, g, or t
  misc_feature (3158)..(3159): n is a, c, g, or t
  misc_feature (3161)..(3161): n is a, c, g, or t
  misc_feature (3163)..(3164): n is a, c, g, or t
  misc_feature (3167)..(3167): n is a, c, g, or t
  misc_feature (3169)..(3169): n is a, c, g, or t
  misc_feature (3172)..(3173): n is a, c, g, or t
  misc_feature (3177)..(3181): n is a, c, g, or t
  misc_feature (3183)..(3185): n is a, c, g, or t
  misc_feature (3187)..(3192): n is a, c, g, or t
  misc_feature (3194)..(3194): n is a, c, g, or t
  misc_feature (3197)..(3206): n is a, c, g, or t
  misc_feature (3208)..(3213): n is a, c, g, or t
  misc_feature (3215)..(3215): n is a, c, g, or t
  misc_feature (3217)..(3217): n is a, c, g, or t
  misc_feature (3219)..(3222): n is a, c, g, or t
  misc_feature (3224)..(3228): n is a, c, g, or t
  misc_feature (3230)..(3236): n is a, c, g, or t
  misc_feature (3238)..(3241): n is a, c, g, or t
  misc_feature (3243)..(3243): n is a, c, g, or t
  misc_feature (3245)..(3245): n is a, c, g, or t
  misc_feature (3248)..(3250): n is a, c, g, or t
  misc_feature (3252)..(3266): n is a, c, g, or t
  misc_feature (3268)..(3278): n is a, c, g, or t
  misc_feature (3280)..(3281): n is a, c, g, or t
  misc_feature (3283)..(3285): n is a, c, g, or t
  misc_feature (3287)..(3288): n is a, c, g, or t
  misc_feature (3290)..(3292): n is a, c, g, or t
  misc_feature (3295)..(3297): n is a, c, g, or t
  misc_feature (3300)..(3302): n is a, c, g, or t
  misc_feature (3304)..(3307): n is a, c, g, or t
  misc_feature (3311)..(3313): n is a, c, g, or t
  misc_feature (3315)..(3316): n is a, c, g, or t
  misc_feature (3318)..(3325): n is a, c, g, or t
  misc_feature (3327)..(3327): n is a, c, g, or t
  misc_feature (3329)..(3331): n is a, c, g, or t
  misc_feature (3333)..(3333): n is a, c, g, or t
  misc_feature (3336)..(3341): n is a, c, g, or t
  misc_feature (3343)..(3344): n is a, c, g, or t
  misc_feature (3346)..(3347): n is a, c, g, or t
  misc_feature (3349)..(3349): n is a, c, g, or t
  misc_feature (3351)..(3351): n is a, c, g, or t
  misc_feature (3353)..(3357): n is a, c, g, or t
  misc_feature (3359)..(3366): n is a, c, g, or t
  misc_feature (3368)..(3368): n is a, c, g, or t
  misc_feature (3370)..(3371): n is a, c, g, or t
  misc_feature (3374)..(3379): n is a, c, g, or t
  misc_feature (3381)..(3384): n is a, c, g, or t
  misc_feature (3386)..(3387): n is a, c, g, or t
  misc_feature (3390)..(3391): n is a, c, g, or t
  misc_feature (3393)..(3393): n is a, c, g, or t
  misc_feature (3395)..(3396): n is a, c, g, or t
  misc_feature (3398)..(3399): n is a, c, g, or t
  misc_feature (3401)..(3402): n is a, c, g, or t
  misc_feature (3407)..(3412): n is a, c, g, or t
  misc_feature (3414)..(3414): n is a, c, g, or t
  misc_feature (3416)..(3420): n is a, c, g, or t
  misc_feature (3425)..(3425): n is a, c, g, or t
  misc_feature (3427)..(3433): n is a, c, g, or t
  misc_feature (3436)..(3436): n is a, c, g, or t
  misc_feature (3438)..(3438): n is a, c, g, or t
  misc_feature (3441)..(3443): n is a, c, g, or t
  misc_feature (3445)..(3446): n is a, c, g, or t
  misc_feature (3448)..(3455): n is a, c, g, or t
  misc_feature (3458)..(3471): n is a, c, g, or t
  misc_feature (3473)..(3473): n is a, c, g, or t
  misc_feature (3475)..(3475): n is a, c, g, or t
  misc_feature (3478)..(3480): n is a, c, g, or t
  misc_feature (3482)..(3484): n is a, c, g, or t
  misc_feature (3486)..(3488): n is a, c, g, or t
  misc_feature (3492)..(3497): n is a, c, g, or t
  misc_feature (3500)..(3504): n is a, c, g, or t
  misc_feature (3506)..(3508): n is a, c, g, or t
  misc_feature (3510)..(3511): n is a, c, g, or t
  misc_feature (3513)..(3514): n is a, c, g, or t
  misc_feature (3516)..(3519): n is a, c, g, or t
  misc_feature (3521)..(3526): n is a, c, g, or t
  misc_feature (3528)..(3529): n is a, c, g, or t
  misc_feature (3531)..(3534): n is a, c, g, or t
  misc_feature (3536)..(3536): n is a, c, g, or t
  misc_feature (3538)..(3538): n is a, c, g, or t
  misc_feature (3541)..(3543): n is a, c, g, or t
  misc_feature (3545)..(3546): n is a, c, g, or t
  misc_feature (3548)..(3549): n is a, c, g, or t
  misc_feature (3551)..(3551): n is a, c, g, or t
  misc_feature (3553)..(3553): n is a, c, g, or t
  misc_feature (3555)..(3555): n is a, c, g, or t
  misc_feature (3557)..(3559): n is a, c, g, or t
  misc_feature (3561)..(3563): n is a, c, g, or t
  misc_feature (3565)..(3565): n is a, c, g, or t
  misc_feature (3568)..(3570): n is a, c, g, or t
  misc_feature (3575)..(3576): n is a, c, g, or t
  misc_feature (3578)..(3579): n is a, c, g, or t
  misc_feature (3581)..(3581): n is a, c, g, or t
  misc_feature (3583)..(3584): n is a, c, g, or t
  misc_feature (3586)..(3588): n is a, c, g, or t
  misc_feature (3591)..(3591): n is a, c, g, or t
  misc_feature (3593)..(3595): n is a, c, g, or t
  misc_feature (3597)..(3600): n is a, c, g, or t
  misc_feature (3602)..(3604): n is a, c, g, or t
  misc_feature (3607)..(3608): n is a, c, g, or t
  misc_feature (3610)..(3610): n is a, c, g, or t
  misc_feature (3613)..(3615): n is a, c, g, or t
  misc_feature (3617)..(3619): n is a, c, g, or t
  misc_feature (3621)..(3622): n is a, c, g, or t
  misc_feature (3625)..(3627): n is a, c, g, or t
  misc_feature (3630)..(3634): n is a, c, g, or t
  misc_feature (3637)..(3639): n is a, c, g, or t
  misc_feature (3641)..(3643): n is a, c, g, or t
  misc_feature (3645)..(3647): n is a, c, g, or t
  misc_feature (3649)..(3650): n is a, c, g, or t
  misc_feature (3652)..(3655): n is a, c, g, or t
  misc_feature (3658)..(3658): n is a, c, g, or t
  misc_feature (3660)..(3663): n is a, c, g, or t
  misc_feature (3665)..(3665): n is a, c, g, or t
  misc_feature (3667)..(3669): n is a, c, g, or t
  misc_feature (3671)..(3687): n is a, c, g, or t
  misc_feature (3689)..(3689): n is a, c, g, or t
  misc_feature (3691)..(3697): n is a, c, g, or t
  misc_feature (3699)..(3699): n is a, c, g, or t
  misc_feature (3701)..(3704): n is a, c, g, or t
  misc_feature (3706)..(3710): n is a, c, g, or t
  misc_feature (3714)..(3718): n is a, c, g, or t
  misc_feature (3721)..(3722): n is a, c, g, or t
  misc_feature (3724)..(3734): n is a, c, g, or t
  misc_feature (3737)..(3744): n is a, c, g, or t
  misc_feature (3746)..(3746): n is a, c, g, or t
  misc_feature (3748)..(3748): n is a, c, g, or t
  misc_feature (3751)..(3752): n is a, c, g, or t
  misc_feature (3754)..(3754): n is a, c, g, or t
  misc_feature (3757)..(3758): n is a, c, g, or t
  misc_feature (3760)..(3760): n is a, c, g, or t
  misc_feature (3762)..(3772): n is a, c, g, or t
  misc_feature (3774)..(3785): n is a, c, g, or t
  misc_feature (3787)..(3787): n is a, c, g, or t
  misc_feature (3789)..(3790): n is a, c, g, or t
  misc_feature (3793)..(3795): n is a, c, g, or t
  misc_feature (3798)..(3804): n is a, c, g, or t
  misc_feature (3806)..(3806): n is a, c, g, or t
  misc_feature (3808)..(3810): n is a, c, g, or t
  misc_feature (3812)..(3812): n is a, c, g, or t
  misc_feature (3814)..(3819): n is a, c, g, or t
  misc_feature (3821)..(3833): n is a, c, g, or t
  misc_feature (3837)..(3838): n is a, c, g, or t
  misc_feature (3840)..(3841): n is a, c, g, or t
  misc_feature (3843)..(3844): n is a, c, g, or t
  misc_feature (3846)..(3848): n is a, c, g, or t
  misc_feature (3850)..(3850): n is a, c, g, or t
  misc_feature (3854)..(3860): n is a, c, g, or t
  misc_feature (3862)..(3864): n is a, c, g, or t
  misc_feature (3866)..(3867): n is a, c, g, or t
  misc_feature (3869)..(3870): n is a, c, g, or t
  misc_feature (3872)..(3876): n is a, c, g, or t
  misc_feature (3878)..(3878): n is a, c, g, or t
  misc_feature (3880)..(3881): n is a, c, g, or t
  misc_feature (3883)..(3884): n is a, c, g, or t
  misc_feature (3886)..(3889): n is a, c, g, or t
  misc_feature (3891)..(3893): n is a, c, g, or t
  misc_feature (3895)..(3895): n is a, c, g, or t
  misc_feature (3897)..(3898): n is a, c, g, or t
  misc_feature (3900)..(3904): n is a, c, g, or t
  misc_feature (3907)..(3915): n is a, c, g, or t
  misc_feature (3917)..(3920): n is a, c, g, or t
  misc_feature (3922)..(3922): n is a, c, g, or t
  misc_feature (3925)..(3925): n is a, c, g, or t
  misc_feature (3927)..(3935): n is a, c, g, or t
  misc_feature (3937)..(3943): n is a, c, g, or t
  misc_feature (3946)..(3946): n is a, c, g, or t
  misc_feature (3948)..(3952): n is a, c, g, or t
  misc_feature (3954)..(3956): n is a, c, g, or t
  misc_feature (3958)..(3962): n is a, c, g, or t
  misc_feature (3964)..(3968): n is a, c, g, or t
  misc_feature (3970)..(3970): n is a, c, g, or t
  misc_feature (3972)..(3975): n is a, c, g, or t
  misc_feature (3978)..(3978): n is a, c, g, or t
  misc_feature (3981)..(3983): n is a, c, g, or t
  misc_feature (3986)..(3988): n is a, c, g, or t
  misc_feature (3990)..(3993): n is a, c, g, or t
  misc_feature (3997)..(3997): n is a, c, g, or t
  misc_feature (4000)..(4000): n is a, c, g, or t
tnnntncnnnnggnnnaaaaannntnntnnnnnnnaanttttnnnnnnntttnntnnnnnnggnnntttngggnnantnngnnnnntnnncnaaannntnnnnnnnaancnnnngnnannnnnnnnnannngnnnnnnnnnnnnnntnnttnncngntncnnnnnnntnnttnaannttnnntnnannnnnttttnnnnnnntnnngnnnnnnnnngnnnngnnnttnnttnngnannnntaagatgttgtaaatttacagaattaaaattatcctccaagngttcgtattgatttatttgaagatagaggcatgaaatctttattttgcctgtcgttatctcgctgtttcatattttatctttatctttgtctgcgaaaactattaaaatagcgaagacttaaaatgagagcaaaaacgatttttcttttattgataacgctccttctgacatcggcggtcaatgccaggtcacgttatcctaagcgtgaatttcggggtgcatggattcaatgtgtaaatgggcagtttcaaggaatgcctgcagagaagatgcagcagttattaatcagacaactgaacagcttacaagaagctggtattaatgctattatttttcaggtgcgtgctgaagcagatgccttgtataaatcatcttacgagccgtggagccgcttccttaccggggtgcagggcagggtaccgtcaccttattgggaccctatgcagtttatgatagatgaatgtcataagcgtggaatggagtttcatgcctggataaatccttatcgtgccaaaacaaagggaacggtagccttgtcgcccattcatccttacaacaggaaccctgaacgttttgtgacttatgccggacaattgtattttgatccggcattacctgagaatcgtaaatatatttgtaagattgtacgcgatattgttacccgttatgatgtggatgccattcanatggatgattatttttatccttatcctaatccgggagaggatttncccgacaatatcagttttgcacagtatggtcgcggatacagtaataaagccgattggcgacgtgacaacgtgaatgtgttgataaaggaaatccatgagacggtgcgcgagtgcaagccgtgggtgaagtttggaatttctccttttggaatttatcgtaatgtgaagagtgaccccaatggcagcaacacacgnggtttgcaaaattatgacganttgtatgctgatgtgttgatgtgggtgaacaatggttgggtggactataatattcctcaagtttattgggaaatcggtcatccggctgccgattatgatacattgatccgttggtgggcgaagaatgcttccgcccgtcctttgtatattggtcaggatgtgatgcgtacggtgaataagcccgacctccataatccgcttatcaatcagatgccggctaagatgaaactccaacgtgctttgcctactgtgcagggaagttgtcagtggtatgcttcggctgtggtggataatgcaggaaactatcgcaccatgcttgtaaaagattaccaccgttatccggctttgccgcctacatcgccatttatggatgataaggctcctgataaagtaaagaaagtgaaagatgtttggacacaggatggattgttgcttttctggcaggcaccaaaggcgaaaacggaaatggataaggctgtgcaatatgtggtttatcgttttgataaaaaagaaaaagtgaatctggaggacccttctcatattgttgctatcacgcgtgatacttattataaattgccttatgaaaacggcaagacaaaatacaactatgttgtgacggctctcgatcgtttgcataacgaatctaaaggggcaaagaagaaagtaaaactgtagacaaacagcataatagtactgagatattagtaagtaagaaccacgtttcacacgtgttatggggttaattngttgttntacaggtntttaangtgaaaggtttaactcaagccgccgagagcaacggattatgttcatgacaggtatgatgcgtggttttgtattttgggggaatagtttgaacacttaacatatcatatcaccaacaaagggaagaataagccgtttcttagggttggctaaggtcttttaaacggaagattattacagtctccgacagtggaccgtacagtccgttgcggtggactgtatagtccgttaccgtagactgtatagtccattgccgtagactgtagtaatccgactgacagacaggcataatagaaaggatgaaaacgcttagcccggctaatgaaacgacttagggagtttaaaacgtatgcagaggttgaaaaccggaggagacaacacacggtgacagaatcaagttctttttttgaagnncnnntnngnnttttnnannnaantcctncntttnnncnnntnntnnnntnnnannnntnnnaantnnnnannaanttnnnnnntnantnnnttttnnttnnntnnnttnnnnncngnnnannaaaangnannnnnannnnnnnnnnnnnnnnnnnannggnnnnnnnnnnnnngnnnnnnnnnnnnnannnntnannggnaantttncnntnnnnnttnnngnnnttncnnnnnannntnnttttnnngntnnttngnnnntnntnntnnngnaantnnnnnangnaannnnnaaannngnntttnnnnnnntncnttnnnncccnnnaannannnntttnnnnnntttncnnnnnnnnnnnngnnnnnnnnntnntngnntnnttncnnnnntnnnnnnnnnngnannnnnnnnnnnnnncngnnnttnggncntnntnggnnnntnnnantttnnnnnntnntngnnnntnnntnncnntnnnnttttnnntntnannnanttngnnannnntnnntttnnnnnntnntnncnnnnnaannnnnnccnntngnnnttncnnnnnnancnnnnnngnntnnngnnngnnnntttnnncngnntnnttngnannnnnnnnnnccngnnnntnnnnnntncnnnttnnnaangnnnancngnnnnnnnngnntttnnnnnnnanngnnnttncnnnnnnttngnntnnnnnnnngnannnnnntncntttncnnngnannnnnnncnnanngnannccntnccnntttnnnnncnnngnnnnnntnggnnnnnnnnnngnnnnnntngnannnnannnnncnnnnnnntnnnngntnggnnnannnnnnnnnnnnnnnannnnnnnnnnngnnannngnnannnaannnaannntnnnntttnnnanntnnnnnnnnancnnngnaannnnnnanngnngncngnnnnntnnnnnnnntngnnggnnnnnntnnnntnnttnntnanngnncnnaaaannnnnntnannnnnaaaangnnnnnnnaantnggnnnanntnnnnnnnnttnnnnnnnnnnnnnntngnttnnngnnngnnngggnnnnnnttnnnnntnnntnntnnannnngnnnnnnanngnnnntngnttnnncnntnncngnantnnngnnntnggnnnttttnntnncngnntnnnggnannncnnnnannnccnncnttnnngnnnannggnnnaannnnnttnnngnnntnnntnntnnnnggnannnncngnnntnnnnnnnnnnnnnnnnngnannnnnnntngnnnntnnnnntttnnnnnttnntnnnnnnnnnnnttnnnnnnnntnanttnntnaanncngnnnnnnnnnnncnnnnnnnnnnnncngnnttnnnaannnnnnngntnnntncnnnnnntnnnnnnnnnnnnntttnntnntnngnnntngggnnnnnnntnnntnntnncnnnnncngnntnntnnnncnnnangnngnnnnnttnnnnnnnnncnnnnanttngnnnnnnnnngnnnnnnnttncnnnnnannngnnnnntnnnnngntnnnnttnggnnnaannngnnnngggnaan

SEQ ID NO: 1558 - DNA, 4000 bp, Escherichia coli
  misc_feature (159)..(159): n is a, c, g, or t
  misc_feature (2146)..(2146): n is a, c, g, or t
  misc_feature (2929)..(2929): n is a, c, g, or t
ttctcctttttggattggcccatattctctccggccaggataaaggaagtactccgggaaactgaagttgaatttttacctccattcctttcaatcaattctttatattcatcacgactgtatttctggaaaacacctgatataacaattattttaccntcgaggacgtttcctttcagtatggttttattctcattgctgaatcttatgccggttgatttgagccgtttaatcatttcaaggttatctccatcagaaaaatatgtaacaatgcttgcagcaattttaggtccgatctcatagacacttgtcaattgctccgcattcgcattcatgaggtcatcaatagtcttgaatcttccggcgatggtttttgcaactgtctcacctacatgtcggataccaagggcaaaaagtactctgacataaggagtatcaatcgatttcctgatgctttttaaaatattggctgcagatttttcaccaagacgctccaatggtaccagctgttctaattttaaatcgtaaagatcggatatatttcttatcaggttattgttgaacaggagatcgatagtctcttctcccaatccgtcgatatccattgcctttctgctgataaaatgctcaattctgcctttaatctgaggaggacaatggaggtaatcaggacaaaaatgatttgcttcaccttcatttttaataagtgctgttccgcattctgggcagttcgaaataaagacaatcttcttattgttctcatttctgtatgagtgatcaactcccacaattttaggaattatttcgcctcccttttcaacataaaccatatcattaagatgaagatcaagcattgtgatctgatcggcattatgaagggttgcccgtttaacggttgatccggaaagaagcaccggttccaggtttgctaccggagttactgctcctgttctgcccacctggaatgtaactgataacaaccttgtagaggcctcttccgctttatatttataggcaattgcccagcggggtgactttgctgtaaacccaagttcctgctgctgactcactgagttgactttaacaacaacaccgtcggtatcgtagggaagatttttccgttctgattcccaataagaaataaattgaagcacctcatcaatactcctgcagagtcgtatactaccggcaactctgaatccccatcctgccgcctccataagattatcataatggttgttatgaggtagatcttcagccagaagaaagtaaaccatacaatcgagagatcttgaggctacaatcctggaatccagaagctttaaagtacctgcagcagcatttctggggttggcaaatggagctatttctgctttttgtctttcctcatttaacctgttgaatactgcccttggcataagtatttcgcctctaatcacaaaatccgaaggtgtaaccttaccagtaattttcaacggaatgcttctgatcgtttttacatttaaagtaacatcatcacctttattgccatcaccacgtgtcaccgcccttagtagggagccgtttttataaattatactgattgacgctccatcgaatttcgattcgcatacatactcaacaggttgtgagattgtcttatgtatcctgctgtcaaattctctgagctctccttcactgtacgtgtttccgagagacatcatagggtatgtatgttcgtattgttcaaattcctttgtaatgtcactgccaacgtgaagtgtaggtgaattctcgcttatgaattccgggaattttttctcaagagtatcaagttcatttaataatatatcgtactcaaaatcagaaattgaaggctgatttaaaacataatatctattattatgttcttcaattttcttcctgagaatatctatccttccctttgcttcagattttttcatcttcatagataatttttgattttctccgttcaccccgccccagggggaacgaaaaagaatttcatttccagaccccttcgattgtacttccacatttattacacttcccggcagttatggtatttgcagagatccggtaaccctgccggacaataatagtggagttgcatgacgggcatttggtattcgagatttcatttccnggtacatttccggtatatacatatttcagaccttcttctgttgcaatcctgaaggcgctatttaatatttcaacaggtgttggaggcaattgttcaagtttatgaagagggtagaacctgctgaaatgtaatggtgtgtttttaaacccattatcacttaaccacttgcacatattccttatatcatccagattatcagtccagtcgggaataacgagattagttatttcaagccatatccccatgtcctttaaaactttaagcgaatcgagtaccggttgcaattttcctccggttaacttcaggtaagtgctttcactgaatgctttgagatcgatattagctgcatcaataacgctgcagagctttttaagaggttcgttatttatatagccattcgatttgaagatgttttttaaaccggcacttcttgcaagagtagctgtttcgaaaacatattcataaaaagaggtcggttcagaataagtatatgctattgaactgcagttgtttttaatacattcttcaactactttttccggcatcatatcataatttcttgttttatcaggactggtctgtgatatcgtccagttctgacaattcagacaaaccaggttacatccggctgttgcaatagagaatgcttttgaaccaggaagaaaatgataaagcggttttttttcgacaggatcgacattgactgagcaaggattgccaaatgcaagcgtatataactttgagtcatgaacttttcgattattgcatttgctcagttctccntctttcagaacacattcattaggacagatcctgcacattattccccttgctgtttcttcctggaacattgcaattctcttgtaaatgctctgttcatcagatgacgtttctgaaaacattgactggcaggggaaacacatcaaaccggctgagagagccagtgattttttaagaaaatcacgtttgctgagatcacattctttcttactcattatacttttaagaattatgccaattaataataaacctacgatttgttccttattgtgccaaatagaattccaccaaaaatcattagggataataaaaaaacagaaccctgaatcccaaatacgggtacagcaaatcctgaaataaagataaagccaaaagcagaacctgcaaggtcagcgctgtatattgaaggtgaatcagagatcccttctgttttaagtgtaagttggcgaaagatgcgacctgtaattaatgcgggtaaaaaacctgaaaggataatcacgagtactgacatcaaaccgctttttagttctatcatataattatagctcaagccaaaaattatataaaatactatctggaagataacttggtttcttaatgaaatagtattcaggaatctgatattaattcctgaaccgacagcaagacccgtcatcaaccctgcaattatcaatccggtaagctggtacatatttcctaccataagctgaagagaaataagaatgattatttcaaatcctgcaagagctgaagagctgaaatacataagcatatttcttctttttattgctgtcactggcaatgcgaagacaataaacattaagattattgctggtatcttctcattgaggtttttgctgaactgatacgactggaaatggaaactggcaacaggaaaggctgatctgttttgttttattccgcgatcaataagcgcatttacttcctctgacttcttatttattgtttcatcatccaggaaatcggaatttacataaacatttttaatatttttcttatcggccagctggcagaatgataatgagattgtcttgtcagtggcaatgaaatata

SEQ ID NO: 1559 - DNA, 4000 bp, Escherichia coli
  misc_feature (48)..(48): n is a, c, g, or t
  misc_feature (228)..(228): n is a, c, g, or t
  misc_feature (279)..(279): n is a, c, g, or t
  misc_feature (303)..(303): n is a, c, g, or t
  misc_feature (327)..(327): n is a, c, g, or t
  misc_feature (415)..(415): n is a, c, g, or t
  misc_feature (423)..(423): n is a, c, g, or t
  misc_feature (492)..(492): n is a, c, g, or t
  misc_feature (540)..(540): n is a, c, g, or t
  misc_feature (727)..(727): n is a, c, g, or t
  misc_feature (1609)..(1609): n is a, c, g, or t
  misc_feature (1706)..(1706): n is a, c, g, or t
  misc_feature (2248)..(2248): n is a, c, g, or t
  misc_feature (2266)..(2266): n is a, c, g, or t
  misc_feature (2975)..(2975): n is a, c, g, or t
ggacagtatgacagtcgccttattttcgacacggcttatcatgtgcgncttctcgacagctttacggaagatacgcgtcgttggcggactgcctatgacaagacgtatgaaacatggaaaaaactgtgtcgtgaaagagattctttggaacatgacgaaagtgagaaaatacgtcttctcggtattttagattttcaaatacaggaaattgaagaagccaagttaacnaaaggagaggacgaaaagctggaagccgatattcgcacggcttctcatgcngaacacattacggaaggactacanaccgccatggccgctatggacggnagtgaacgtcgtcagggaatgacggacggtattgcggaaattcgccgcagtttgctgaaaaacgcatcgtatgacccgcgttttgagnccatggcngctaaggcggaggcgctttcttacgagttggaagagttgcgagacgaaatatcttcttatgcagacggnatgagttttgacggcccggcattagaccgaatgcagtctcgcttggcnacgattgaaaagttaaaacgtaaatacggattttccgtagaagatatattggcctttgctgaaaaagccaaggcggatcgggagaaactgagcgattcggaaaacgctctggctgacttaaataaacaaatctccagctgtgaaaagcaattacggcaagaaggcgatgatttatttcaggcacgcntggaagcggcagacttgtttaaagaaaagacggaagatattttacatcggttgggacttgaaaatagccgcatctcttttcgcatcgagcctatggaggctataagtctttccggagccgcatcggtggagctgtggttttcagctaatcggggcgagacggaacaacccttggcagaagtggcatccggcggcgaagtatctagaatcgccttggcattaaaatctattttccgagaaaaatatacggacaggaccgtagtttttgacgaaatagatgtaggcatcagcggggaaacagggttgcaagtagcggctcaaatgggacgattgggacggatgggtcaggttttttgtattactcacctgccgcagacggcagccattgcggacagtcactactttttgtataaagaagaaaaagaggggcggacggttactcaggtccgcaatttagataaagaagcccatgttaaagacattgcccgcatattttccggagacgataccagtgaggccggtatgcaggcagctgaggaaattattcgcaaggtcaaagggcgtgcctaggcacgctttttgtatacatgggcatatttcttgacgagcgttcttgagaagtttatcataaatagatacataatattccgatttatacggaggaaaaggcatgattcgagtattggtaagcggcgcagacggtcgcatgggaagcgaaacggttaaggccgttttggcagataatgaattggaattcgtaggcggcacaagtcttatgaatgtgggtaaagatgcgggagaagtcatcggtatttcttctttggggttacccttgtacgggagtttgaatgaagcgttaaaaatggcaaaacccgacgtagtngtcgattttacgacaccggcggctatttacggaaatgtaaagacttgtattgaaaacgggacgaatattgttgtcggtacgacaggtttgacggcanaacagcgtaatgaattggatgaagcggcaaaaaaagcggacgtagccgtatttattgcaccgaacttttctgtcggagccgtactgatgatgaagtatagtgcggaaatcgctaaatacttgcctgatgtagaaatcattgagctacaccacaataataaattagacgctccgtccggtacggccaaaatgacggctgaaaaaatagcccgtgctcgtcgtgaagccggtgcggaaccggctccggacaaaacacacgaaagtcttaccggagccagaggcactacggtggagggcatacccgtacatagcgtacggctgcccgggtatgtggcacatcaggaagtgcttttcggcggctacggggaaatccttacggtccgtcacgactcgttggacagaaaatcctttatgcccggcgttgtcttagccgtgaagaaggtggattcccgcaagggtgtgaccttcggcttggaacactatttataaactgtacaggaggctttacatatgagtacgaagaatccgtctgtagccattttnggggctaccggtgctgtnggacaggaatttatcagattaatagaagaacgcaacttcccgtacagttccttgaagttgttggcatccaaacgttcggaaggtaagaagctgacggttaacggtaaggagtatacggtagaagaagcgaaacccgaatcgtttgaaggcgttgacatcggcttgtttgccggcgggtccatcagtaaagaattagcccccgaagcggtaaaacgagggtgtgttgtcattgataactccagtgcctttcgcatggatcccgatgtaccgttggttgttcccgaagtgaatcctgaagacattcgtaagcataaggggattattgccaatccgaactgttcgaccattattatgctaatggccttaaagcctatttacgacttgtctaaaattactaaaattgtggtcagcacataccaggctgtatccggcgccggtaaggaaggcattgatgaactgcgtaaacaagtggaagatgttatggcgggaaaagaaccggtagcggaaatcttgcctacaaagagcttggataaacactatcccattgcttttaatctattgccgcaaattgatgtttttatggacaacgattactctaaggaagaaatgaagatggtcaatgagacacataaaatcttccatgacgatactattgccgttacaccgacaacggttcgcgtgcccgtattccgcagtcatgccgaatcgntttatgtggaaacggaaaaagaactgaccgttgaagaaattcgtcgtgctatcgatgcttttccgggggcacaggttcaggataatccggctaaaatggaatatcccatgcccttgtatacttcggaaaagtatgatgtgtatgtaggtcgcatccgtaaggatttatttaatcccaaagccgtcaatctttgggtatcgggggatcaaatccgcaaaggggccgctttaaatgcgttgcaaattgcggaatatatgataaaacacgatatataaggaggagtacgggttatgttgaagttcggaaacgttattacggctatggtcacgcccttttatgaaaacgggaatattgactttgacgagtttgattcattggcaagatatttgcttgaaaacggttcggacgggttactcgttgccggtacgaccggtgaaggtgctacactgacggaagaagaaagattgcgtcttttccggtttgccgccgatgaatacggcgatcgtactatgattatggcgaatgtaggttctaacaatacggcggctactgttgaatttgccaaaaaagctgagaaaaccggcgttgactgtctgctcgtaatagtaccctattacaataagccgaatcaggacgggtgttacgcacactttgcggcagtggcaaaggccgtatcattacctgttattatctataatgtaccggggcggacgggtggtaaaatcttgcctgaaacggtagtgcgactggctgcggacttccccaatattgtaggcataaaagaagccagcggtgacttggtggcggctacgaagattgctcgcgacactaaagacgacttccgcgtatatagcggtgaagacgcattgacattgcctattacagctgtcggaggcacaggggttatcagtgtggcatcacatattatcggcaaagaaatgaatgccatcgtacagtgctgcaaggacggagacatggaagcggctgcatctatcaatcaaaaataccttgatgtcatgacggga

SEQ ID NO: 1560 - DNA, 4000 bp, Escherichia coli
  misc_feature (629)..(629): n is a, c, g, or t
  misc_feature (3188)..(3190): n is a, c, g, or t
  misc_feature (3192)..(3192): n is a, c, g, or t
  misc_feature (3212)..(3220): n is a, c, g, or t
  misc_feature (3226)..(3227): n is a, c, g, or t
  misc_feature (3229)..(3231): n is a, c, g, or t
  misc_feature (3233)..(3237): n is a, c, g, or t
  misc_feature (3239)..(3246): n is a, c, g, or t
  misc_feature (3248)..(3248): n is a, c, g, or t
  misc_feature (3250)..(3250): n is a, c, g, or t
  misc_feature (3252)..(3252): n is a, c, g, or t
  misc_feature (3254)..(3255): n is a, c, g, or t
  misc_feature (3257)..(3258): n is a, c, g, or t
  misc_feature (3260)..(3260): n is a, c, g, or t
  misc_feature (3262)..(3267): n is a, c, g, or t
  misc_feature (3269)..(3270): n is a, c, g, or t
  misc_feature (3273)..(3276): n is a, c, g, or t
  misc_feature (3278)..(3278): n is a, c, g, or t
  misc_feature (3280)..(3281): n is a, c, g, or t
  misc_feature (3283)..(3283): n is a, c, g, or t
  misc_feature (3287)..(3288): n is a, c, g, or t
  misc_feature (3290)..(3293): n is a, c, g, or t
  misc_feature (3296)..(3296): n is a, c, g, or t
  misc_feature (3298)..(3309): n is a, c, g, or t
  misc_feature (3312)..(3313): n is a, c, g, or t
  misc_feature (3319)..(3319): n is a, c, g, or t
  misc_feature (3323)..(3323): n is a, c, g, or t
  misc_feature (3325)..(3329): n is a, c, g, or t
  misc_feature (3331)..(3331): n is a, c, g, or t
  misc_feature (3333)..(3336): n is a, c, g, or t
  misc_feature (3340)..(3340): n is a, c, g, or t
  misc_feature (3342)..(3342): n is a, c, g, or t
  misc_feature (3344)..(3344): n is a, c, g, or t
  misc_feature (3348)..(3350): n is a, c, g, or t
  misc_feature (3353)..(3353): n is a, c, g, or t
  misc_feature (3359)..(3359): n is a, c, g, or t
  misc_feature (3363)..(3363): n is a, c, g, or t
  misc_feature (3366)..(3366): n is a, c, g, or t
  misc_feature (3371)..(3372): n is a, c, g, or t
  misc_feature (3375)..(3375): n is a, c, g, or t
  misc_feature (3377)..(3377): n is a, c, g, or t
  misc_feature (3379)..(3380): n is a, c, g, or t
  misc_feature (3385)..(3386): n is a, c, g, or t
  misc_feature (3388)..(3391): n is a, c, g, or t
  misc_feature (3393)..(3396): n is a, c, g, or t
  misc_feature (3399)..(3405): n is a, c, g, or t
  misc_feature (3407)..(3410): n is a, c, g, or t
  misc_feature (3412)..(3417): n is a, c, g, or t
  misc_feature (3420)..(3420): n is a, c, g, or t
  misc_feature (3423)..(3424): n is a, c, g, or t
  misc_feature (3428)..(3428): n is a, c, g, or t
  misc_feature (3431)..(3437): n is a, c, g, or t
  misc_feature (3441)..(3444): n is a, c, g, or t
  misc_feature (3446)..(3447): n is a, c, g, or t
  misc_feature (3449)..(3449): n is a, c, g, or t
  misc_feature (3451)..(3459): n is a, c, g, or t
  misc_feature (3462)..(3464): n is a, c, g, or t
  misc_feature (3466)..(3466): n is a, c, g, or t
  misc_feature (3468)..(3468): n is a, c, g, or t
  misc_feature (3471)..(3472): n is a, c, g, or t
  misc_feature (3474)..(3474): n is a, c, g, or t
  misc_feature (3476)..(3477): n is a, c, g, or t
  misc_feature (3479)..(3480): n is a, c, g, or t
  misc_feature (3482)..(3483): n is a, c, g, or t
  misc_feature (3485)..(3485): n is a, c, g, or t
  misc_feature (3490)..(3493): n is a, c, g, or t
  misc_feature (3497)..(3497): n is a, c, g, or t
  misc_feature (3501)..(3501): n is a, c, g, or t
  misc_feature (3504)..(3504): n is a, c, g, or t
  misc_feature (3514)..(3516): n is a, c, g, or t
  misc_feature (3518)..(3519): n is a, c, g, or t
  misc_feature (3524)..(3524): n is a, c, g, or t
  misc_feature (3528)..(3528): n is a, c, g, or t
  misc_feature (3530)..(3530): n is a, c, g, or t
  misc_feature (3532)..(3538): n is a, c, g, or t
  misc_feature (3541)..(3545): n is a, c, g, or t
  misc_feature (3547)..(3552): n is a, c, g, or t
  misc_feature (3554)..(3555): n is a, c, g, or t
  misc_feature (3558)..(3558): n is a, c, g, or t
  misc_feature (3561)..(3561): n is a, c, g, or t
  misc_feature (3563)..(3565): n is a, c, g, or t
  misc_feature (3568)..(3568): n is a, c, g, or t
  misc_feature (3570)..(3577): n is a, c, g, or t
  misc_feature (3579)..(3588): n is a, c, g, or t
  misc_feature (3592)..(3592): n is a, c, g, or t
  misc_feature (3596)..(3597): n is a, c, g, or t
  misc_feature (3599)..(3606): n is a, c, g, or t
  misc_feature (3609)..(3609): n is a, c, g, or t
  misc_feature (3611)..(3617): n is a, c, g, or t
  misc_feature (3623)..(3623): n is a, c, g, or t
  misc_feature (3625)..(3626): n is a, c, g, or t
  misc_feature (3628)..(3628): n is a, c, g, or t
  misc_feature (3630)..(3631): n is a, c, g, or t
  misc_feature (3633)..(3641): n is a, c, g, or t
  misc_feature (3643)..(3650): n is a, c, g, or t
  misc_feature (3652)..(3652): n is a, c, g, or t
  misc_feature (3657)..(3661): n is a, c, g, or t
  misc_feature (3663)..(3663): n is a, c, g, or t
  misc_feature (3665)..(3665): n is a, c, g, or t
  misc_feature (3667)..(3667): n is a, c, g, or t
  misc_feature (3669)..(3669): n is a, c, g, or t
  misc_feature (3674)..(3674): n is a, c, g, or t
  misc_feature (3678)..(3678): n is a, c, g, or t
  misc_feature (3680)..(3681): n is a, c, g, or t
  misc_feature (3684)..(3684): n is a, c, g, or t
  misc_feature (3686)..(3691): n is a, c, g, or t
  misc_feature (3693)..(3693): n is a, c, g, or t
  misc_feature (3695)..(3697): n is a, c, g, or t
  misc_feature (3703)..(3703): n is a, c, g, or t
  misc_feature (3705)..(3705): n is a, c, g, or t
  misc_feature (3709)..(3710): n is a, c, g, or t
  misc_feature (3713)..(3713): n is a, c, g, or t
  misc_feature (3720)..(3721): n is a, c, g, or t
  misc_feature (3723)..(3725): n is a, c, g, or t
  misc_feature (3730)..(3731): n is a, c, g, or t
  misc_feature (3734)..(3734): n is a, c, g, or t
  misc_feature (3736)..(3738): n is a, c, g, or t
  misc_feature (3740)..(3744): n is a, c, g, or t
  misc_feature (3746)..(3747): n is a, c, g, or t
  misc_feature (3750)..(3751): n is a, c, g, or t
  misc_feature (3753)..(3753): n is a, c, g, or t
  misc_feature (3755)..(3760): n is a, c, g, or t
  misc_feature (3762)..(3764): n is a, c, g, or t
  misc_feature (3766)..(3770): n is a, c, g, or t
  misc_feature (3772)..(3774): n is a, c, g, or t
  misc_feature (3776)..(3782): n is a, c, g, or t
  misc_feature (3784)..(3784): n is a, c, g, or t
  misc_feature (3786)..(3787): n is a, c, g, or t
  misc_feature (3790)..(3792): n is a, c, g, or t
  misc_feature (3794)..(3799): n is a, c, g, or t
  misc_feature (3801)..(3805): n is a, c, g, or t
  misc_feature (3807)..(3810): n is a, c, g, or t
  misc_feature (3814)..(3814): n is a, c, g, or t
  misc_feature (3817)..(3821): n is a, c, g, or t
  misc_feature (3823)..(3823): n is a, c, g, or t
  misc_feature (3828)..(3830): n is a, c, g, or t
  misc_feature (3833)..(3833): n is a, c, g, or t
  misc_feature (3838)..(3838): n is a, c, g, or t
  misc_feature (3840)..(3842): n is a, c, g, or t
  misc_feature (3844)..(3844): n is a, c, g, or t
  misc_feature (3846)..(3847): n is a, c, g, or t
  misc_feature (3849)..(3852): n is a, c, g, or t
  misc_feature (3854)..(3855): n is a, c, g, or t
  misc_feature (3857)..(3860): n is a, c, g, or t
  misc_feature (3862)..(3865): n is a, c, g, or t
  misc_feature (3869)..(3872): n is a, c, g, or t
  misc_feature (3875)..(3875): n is a, c, g, or t
  misc_feature (3877)..(3878): n is a, c, g, or t
  misc_feature (3880)..(3880): n is a, c, g, or t
  misc_feature (3882)..(3884): n is a, c, g, or t
  misc_feature (3886)..(3886): n is a, c, g, or t
  misc_feature (3888)..(3891): n is a, c, g, or t
  misc_feature (3898)..(3902): n is a, c, g, or t
  misc_feature (3906)..(3906): n is a, c, g, or t
  misc_feature (3908)..(3909): n is a, c, g, or t
  misc_feature (3915)..(3915): n is a, c, g, or t
  misc_feature (3917)..(3917): n is a, c, g, or t
  misc_feature (3922)..(3923): n is a, c, g, or t
  misc_feature (3925)..(3925): n is a, c, g, or t
  misc_feature (3929)..(3929): n is a, c, g, or t
  misc_feature (3932)..(3934): n is a, c, g, or t
  misc_feature (3936)..(3937): n is a, c, g, or t
  misc_feature (3939)..(3940): n is a, c, g, or t
  misc_feature (3945)..(3945): n is a, c, g, or t
  misc_feature (3947)..(3947): n is a, c, g, or t
  misc_feature (3949)..(3950): n is a, c, g, or t
  misc_feature (3952)..(3955): n is a, c, g, or t
  misc_feature (3957)..(3958): n is a, c, g, or t
  misc_feature (3960)..(3961): n is a, c, g, or t
  misc_feature (3963)..(3967): n is a, c, g, or t
  misc_feature (3969)..(3969): n is a, c, g, or t
  misc_feature (3971)..(3972): n is a, c, g, or t
  misc_feature (3975)..(3978): n is a, c, g, or t
  misc_feature (3980)..(3980): n is a, c, g, or t
  misc_feature (3982)..(3984): n is a, c, g, or t
  misc_feature (3986)..(3987): n is a, c, g, or t
  misc_feature (3989)..(3989): n is a, c, g, or t
  misc_feature (3991)..(3991): n is a, c, g, or t
  misc_feature (3993)..(3995): n is a, c, g, or t
  misc_feature (3997)..(4000): n is a, c, g, or t
ataacctgctgcaccaataataattaatttatttgcagttcgcagcgttcccataaataaattactgatggcatcatttaatctataggtattcttctttattgctattccatataccaattctattaaaagagctaataagaaaaagggaactgcataggtaatataatccatgatttatattaacttatttaaagagaatttttaatacagcaggtttgaaatctttcaaacctgcatgaaatttaagttatataagctttagtttttaatcagcgaagtctaatccttttgctaattgaacttcccttttgtttgggttcacagactctctaaatggaacatctacaatttcaccgtcaactggaactccaggtgattcagaaaactcatcaggcaacctgactaataattttgttccaacctctgatgaggtccacggtacccatgcaagagcaatatttgtacccagttcaggagaccaccaaggagaagtaacataacccatgtcatttccatcggtatctgctattagccaaaaatcaggagcatagtctgttatttcttttcctccaagagttattccaaccattctcattttaaatggtggcgttccctggtcgatcatngtgcgttgtttttcaagcgcctctttaccaatataatctgcagatttattacgaggcacttggtaggccaggttaacctgaaagggtgaagtttcatgatctaagtcttgcccccaagataaaataccggcagcaattcttcgatggtgagctggagcaattaccattaaaccaaattcctcacccccctcaagaactgcattccatactttttctgcattctgatgagcatcgcggacataaatttcatatcccttctctccagtgaaccctgtttggctaataacaacatctgcaccaccaatttgagtttccataattccataataaggaacatctctaagctcttcaccagctaatttagccataagatcttctgaaagaggcccttgaatctggacagggcatacatcaatctcatcaataattacatcatattttttagtaacattgacgccttgcaaccatagcaataaatcactatctgaaattgaaaaccaaaattcatcatctgttaatcttaataaaacagggtcattaagaactccgcctttgtcgttacacaaaattgcatatttaccatttcctggttcaatcttcgttgcatcacgagtaataacgtaatcagtaaaagcttctgcatcaggtccttttactcttatctgtctttcaacagcaacattccacatagttactcgattcactaatgcctcatactcaaccatagcaccaccatcttcaggttttacatagcctcttgggtgataaatacgattgtaaacagttgctctccagcaaccagcttcatgagaaagatgccaaaaaggtgacttcctaactcgagttgaaatcaacatctgaacaggcgttcggccgctctgtctaaggttataaggtactacgcgatcgctttgatcaacactagggtgatttggattggtcatattaagttccccccgaaatttaaagttatgactacttaatgtatataatttacataagcgtttttaataaatttacgccttttttttaattttgtaaatcaaaatttatggggtttaaataatattttagaaagtatttatccgagtaaaaaaatgaggttaaaaattagttatttaatggttatctaaataatcttttactgcaattttgtcagctttcatgtctgatctaaaggcattaaaaagtttctgtttatgattaggcattaatccctgagacatatttttaatctgctgataaaaccatgccattgcaccaaatgcattaattaccttaattatagtaaacggactggaaggagaaaggattgaaggtcccagtgaaagagttttttcaagacttggtaattctttcagctcacctgctatcatttttttgacacagtaagggtctgcacataatggtcttcctattccaactatttggcaaatattactttttaaagcgtcttcgataccatccttagttctaaatcctcctgtaaccattaatggcaaagaaactgcctttctgatgtcctgggcgtattcaagaaaataagcttccctagcaacagtgctttcttttcttttttcatttcttttagggttaatacttagatcatcaacacctattagtttgggttgttcgtatgtacctcctgaaatttctataatatccacgccttcattttcaagcatctgtgcaacttgaatagattcactagctgtaaacccacctttttgaaaatctgcagaatttagttttactgaaatagggaaatctgttcccacctcttctctgcatctcttaataatttctaaatgaattctagctctattttgaatatttccaccccatgcatcagttctattattgatatcaggtgataaaaactctgataaaagataaccatgtgcagagtgaaattgaacgccagtaaagcctgcttctctagcaatttttgcagtgaaaacaaacctttctataacatctaaaatatcctcttcagtcataggggttgggatgccgtaattctttccaggaatttttaaaccaatatctgagggcgctaaaggtgaggaatttatttcaccaggagtttgtctgccagcatgtgagatttgcatccatagctgagtattattttttgttccagctgcagaccatgcctttaaatcatctaattgttctttatagttatttgaatctataactacatttgctggcccttctatatttcgacgatcaatttgaacattgccggttaataagatgccaatatcaccatctgcccatctctcatataaattgacatgtccttgatgcgccaaattgttgcctttagcaattcgttcagtcatcgctgctttgcaaatacgatttttaattacttgcccacatggcaatacaaaggattcgttaattatattagacattgattactccctaaagataaggagtatagcttaacagaagaagatggtgggcccggtaggactcgaacctacgaccaatggattatgagtccactgctctaaccaactgagctacaggccccttgttaaatcaacnnntncaagcatttctctaaaaaannnnnnnnnaaaaanntnnnannnnncnnnnnnnntncntnannannantnnnnnnannaannnnanannantttnnannnnttnannnnnnnnnnnnaannaaaaantaanannnnntnannnnaaantntntaannnaanaaaaancaanaantaagnnttngnannaaagnnannnntnnnnaannnnnnntnnnnannnnnnacnaannaagntgnnnnnnnaaannnnannantnnnnnnnnnaannntntnttnntnannannanncntatannnnaaanaaanttntttaaaaaannnannaaatnaaanangnnnnnnnttnnnnntnnnnnntnntanctncnnntcntnnnnnnnntnnnnnnnnnnaaanaaanntnnnnnnnnatnannnnnnnaattgnanntnanngnnnnnnnnncnnnnnnnncnaaaannnnntnangntntttanaaancnngantnnnnnntnannnatttantnaaanngtnatagttnntnnnataanntanannnannnnnannttnngntnnnnnnannncnnnnncnnnannnnnnnanannttnnncnnnnnnannnnntnnnnaaanaannnnntnttttnnnatntattntnnntnannannnntnnannnnannnnaatnnnncancnntntnnnanannnntaaaatnnnnntatncnntttttntnatatnntnaaanttnnntnntnntcaanananncnnnnanntnntnnnnnantnnatnnnnantnnncnnantngnnngnnnn

SEQ ID NO: 1561 - DNA, 4000 bp, Escherichia coli
  misc_feature (133)..(133): n is a, c, g, or t
  misc_feature (331)..(331): n is a, c, g, or t
  misc_feature (481)..(481): n is a, c, g, or t
  misc_feature (553)..(553): n is a, c, g, or t
  misc_feature (712)..(712): n is a, c, g, or t
  misc_feature (1748)..(1748): n is a, c, g, or t
  misc_feature (1985)..(1985): n is a, c, g, or t
  misc_feature (1992)..(1992): n is a, c, g, or t
  misc_feature (2054)..(2054): n is a, c, g, or t
  misc_feature (2066)..(2066): n is a, c, g, or t
  misc_feature (2080)..(2080): n is a, c, g, or t
  misc_feature (2225)..(2225): n is a, c, g, or t
  misc_feature (3066)..(3066): n is a, c, g, or t
  misc_feature (3516)..(3516): n is a, c, g, or t
acaaaagttgcttacaaaagaaactttcagtctagacacggaaacaacaggaaccgatcccatcaccgcaaaactggtaggaatgagtttcagctacaccgaaaaccaagctttctatgtccccgttcccgcngaacaaaacgaagcacaaaaaattgttaatgagttccgaccggtatttgaaaaagcaggagtactgaaagtgggacaaaatatcaagtacgatatgctggtgctaggcaactacggagtagaggtttgcggtccgctgttcgacactatggtagcacactatgtgctgcaacccgaactgcgccataacatggactancttgccgaaatctacctgcattaccagacgattcatatagaagaacttatcggacctaaaggcaaaggacagaaaaatatgcgcgacctccctcccgaagctatatataagtacgcgtgcgaggatgccgatgtcaccttaaagctaaancatgcactggaaaaggaactgaaagagcaaggagccgaaaaactcttttacgaaatagagatgcccctagtncccgtcctcgtctatatggaaagaaatggcgtgcgtgtagacacggaagcactgaaacaaacctcggaacatttcacagcccgcatgaatcaaatagaagaagaagtacatcaattggcagggacagagttcaacattgcatcgcccaaacaagtgggngaagtcttgtttgacaagctacgcatcgtagaaaaagccaaaaagacaaagaccggccaatacgtgaccagcgaagaagtattggaaagcttgcgcggaaagcatgaaatagtgggcaagattcttgaacatcgagggctgaagaaactactcggaacttatatcgatgccctaccccttcttattaatccggcaacgggcaagatacacacgtccttcaaccagaccgtgaccgccacaggacgcctcagttcgagcaatccgaacctgcaaaacatccctatccgcaacgaagacggcaaagaaatccgcaaggcatttatcccggaagacggatgcgagttcttctctgccgactattctcagatagagctccgcatcatggcccacttaagcggtgacaaaaacatgatagaagctttccgcgaaggagacgacatccatgccgctacagccgccaaagtatataaaatagccatcgaggatgtgacacgcgagcaacgcagcaaggccaaaaccgccaacttcggtattatctatggcatatcggtattcggattggcagaacgcatgaatgtcccccgtcaggaagccaaagaactgatagacggctatttcgatacctatccgcagatcaaggaatatatggacaagagcatcgaacgcgcacgtgccaacggttacatcgaaactattttcggccgtaaacgcttcctgccggacatcaattcacgcaatgccgtagtacgcggatatgctgaacggaatgccataaatgctcccattcagggaagtgcagccgacattatcaaagtagccatggttaaaatattccaacgctttcaatctgaaagtatacgctctaaaatgatacttcaggtgcacgatgaattaaacttcagtgttgtgcccgaagagaaggaaaaagtacagcaaatcgtaatggaagaaatggaaaaagcctatctgatgcaagtgcctctaaaagcagactgtggctggggaaacaattggttggaagcacattaaaaagaanatataatcactaacacactatatataaatatattaaaggagacctgcagttggtctcctttctttatctgcctattctgattgtatactcaaaaatctatttatcctctttccctaaagaatctccggtctgccagtccaaagataaacaaccgccattcacccactattcctctgttattcaagataaatacataaactcctttctctctctttaaatacattctgttacatattnaaagtanctaattcttaatatttgtttatttagtgacatattgcaaaaatatcatctttttattgcagntttgttaggtanttcaatttcttttngtacatttgcaccgcttttgaaaacaatatgaaagtaacaatctaatatactgatatcatgaagaaaattatttttttgaaaggaatgctctctgtagtaatgttgtttattgccagccttacaatttccgcagcaaagccgggngacaacctggttcacaacactgaagaagtaaacggagtaatcatttcggaaactgttttcaagatggacggtaatatgctgaccaattatatgaagcacaattataagtacgatacaaaccaacaacgtaccgaagatgaaagtcaaaaatggaacagcaacaaaaactgttgggaaaataacctctgcatccgttatattcacggaaataagagcattactaccgaatattataaatggaattctaagaagaaagaatatatactagtacctgaaatgaccgtaactatggataaataaaatgttcatttaactaacaatctaacacttttcataaaattttaaacaaaaaggcagtcgcgatgactgccttttttcgtagctccaagccaattctatctttaatatgaagcacgataaaaaaagaatggttatctttgcaggcaaattaatggataataatcaaaaaaacagatagataatggctttacaatgtggcattgtcggccttccgaacgtaggaaagtcgacactttttaattgcttatcaaatgcaaaggctcaagcagccaacttccctttttgtacaatcgaaccaaatgtcggcgtaatcactgttcccgatgaacgtttgaccaagcttgccgagctggttcatccgggacgcatcgttcctaccactgtcgaaattgtggatattgccggtctggtgaaaggcgccagcaaaggcgaagggttaggaaacaaattcttagccaatattcgtgagacagacgctatcttacacgtactccgctgctttgacgatgagaatgtaactcacgtggacggaagtgtagancctgtacgcgataaagaaatcatcgataccgaacttcagctgaaagatttggaaaccattgaaagccgtatccaaaaagtgcagaaacaggcacagaccggaggtgacaaggcggctaaacaaacatacgaagtgcttgtcagatacaaagaagcattggagcagggcaagtctgcccgcaccgtacaatttgaaagcaaagacgaacaaaaaattgccaaagaattgttcctgctgacttccaagccggtgatgtatgtgtgcaatgtggacgaagcaagcgcagtcaacggtaacaaatatgttgaaatggtgcgcgaggccgtcaaagaagagaacgcggaaatcctagtggtagctgccaaaacagaagccgacattgcagaactggaaacatacgaagaccgtcagatgttccttcaggaagcaggtttggaagaatcgggtgtnaaccgtttgattaaagcagcttacaaactgttggatctggaaacattcatcacagccggagaaatggaagtaaaagcatggacttaccgcaaaggctggaaagctccccaatgtgccggagtcatccataccgactttgaaaaaggctttatccgtgccgaagtcatcaaatacgaagactatattcaatatggttcggaagcggccgtcaaggaagccggaaagatgggcattgaaggcaaggaatatgtggtacaggatggcgacatcatgcacttccgcttcaatgtataaaacaaacgattaatatgaataaatttcttatcataggaaccggcggcgtgggaggtagcatcgccggttttcttgctttagcaggaaaggacgtaacgtgcattgcccgtggcaaacacctggaagccatccgcgaaaaaggacttcacctgaagtcggatttaaaaggcgaacattatcttcccgtaaa

SEQ ID NO: 1562 - DNA, 4000 bp, Escherichia coli
  misc_feature (46)..(46): n is a, c, g, or t
  misc_feature (81)..(81): n is a, c, g, or t
  misc_feature (84)..(84): n is a, c, g, or t
  misc_feature (111)..(111): n is a, c, g, or t
  misc_feature (168)..(168): n is a, c, g, or t
  misc_feature (183)..(183): n is a, c, g, or t
  misc_feature (261)..(261): n is a, c, g, or t
  misc_feature (267)..(267): n is a, c, g, or t
  misc_feature (321)..(321): n is a, c, g, or t
  misc_feature (345)..(345): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (369)..(369): n is a, c, g, or t
  misc_feature (378)..(379): n is a, c, g, or t
  misc_feature (429)..(429): n is a, c, g, or t
  misc_feature (450)..(450): n is a, c, g, or t
  misc_feature (570)..(570): n is a, c, g, or t
  misc_feature (615)..(615): n is a, c, g, or t
  misc_feature (663)..(663): n is a, c, g, or t
  misc_feature (679)..(679): n is a, c, g, or t
  misc_feature (684)..(684): n is a, c, g, or t
  misc_feature (789)..(789): n is a, c, g, or t
  misc_feature (837)..(837): n is a, c, g, or t
  misc_feature (855)..(855): n is a, c, g, or t
  misc_feature (948)..(948): n is a, c, g, or t
  misc_feature (954)..(954): n is a, c, g, or t
  misc_feature (966)..(966): n is a, c, g, or t
  misc_feature (1259)..(1259): n is a, c, g, or t
  misc_feature (1508)..(1508): n is a, c, g, or t
  misc_feature (1676)..(1676): n is a, c, g, or t
  misc_feature (1988)..(1988): n is a, c, g, or t
  misc_feature (1991)..(1991): n is a, c, g, or t
  misc_feature (2010)..(2010): n is a, c, g, or t
  misc_feature (2255)..(2255): n is a, c, g, or t
  misc_feature (2968)..(2968): n is a, c, g, or t
  misc_feature (3697)..(3697): n is a, c, g, or t
  misc_feature (3700)..(3700): n is a, c, g, or t
  misc_feature (3856)..(3856): n is a, c, g, or t
  misc_feature (3925)..(3925): n is a, c, g, or t
  misc_feature (3952)..(3952): n is a, c, g, or t
acctacgaaaagaagaacgagtttaacatcggcgtggacgccggcntgtggaacaaccgcatcaacgccaccgtcgacgtntanacgcgcaacaactacgacgaaatcggnccgatggtgacgcagggcatgagcggacagatcgtaaattggggcaacgtggccganatgaaatcgaacggngtggaagtgagcctcacctcgaccaacctcaagcagaaagacttcagctggacaacgagcttcgtcttctcttacacnaacacngagatcaccaagctgttcaacaacggacgtgtgatcgatctcgtgtcgggtaanggtttcgccatgaagggtttcccngcccgcgccctnttntcngtgccnttcctgggnntgaacgacgccggcatccccctcttccgcaacgagaagggcgaagtgacnaccgacgacatcaatttccangaacgcaaccacaccggcttcctcaaatatgagggcccgacggatcccaagtacgtgggttcgctcggcaacgtgttctcttacaaaggactccacctgaatgtgttcctcacctactcntttggcggcgtggtgcgcctggatccgaaattccgcacgcgctanaccgacatgacctccatgacgcagacgttcctcaaccgctggatggcncccggcgacgagaaantgacnaatgtgcccggcatcttgagcaaacgccagtacacgcaaaaccgccaactgcgttatgcctacaatgcctacaacttctcgtcggtgcgcacggccaaatccganttcatccgcctcaaagagatctccctcacctacgatctgccggcatcnctcttcaaagacaaggcnatccacgacgtttccgtcaaacttcaggccaccaacctcttcttgctctactctgacaagaaactccacggacaggatcccgaattcctcaangccggnggtgtggcttcncccatgcccaagcagtttaccctcacactcaaattcggactctgatcaattcgacagttagcatgaaacattatattgcttctctcctcttgggtgccgccacactgggcacttccggcacgttgacctcgtgcaatgactatttggacaagtatcccgacaagcgcatggagcttcgcacgcccgatcacttggcacagctcctcacctcggcctaccctcaggtgcacccggcctacttgctcgaaatgtattcggacaacacggatcgccatctctcgccttcgtgggcngaagtggatcgcttccaacgcgaagcctaccaatgggacgacatcaccgacgtgggcgaaaacgaatcgccgcaaatgatttggaactcccactatctcgcggtcaacacggccaatgaggtgctgagcttcatcggcaaacaaaaggaccaatcggctttccgcgcccaaagcggcgaggccaagctgtgccgcgcctatgccatgctctgcctggccaacgtgttctgcgaagcctacgatcccgcnacggcagcttcgcacttgggcctgccttaccccacggaaccggaagaccgcccgggcattacttatcaacgtggcacgctggccgagctttatgcccacatcgacaaggacatcaccgaaggtttggccgaagtgggtagcacttacaccacaccgaagttccacttnacgcccgaagccgcgcacgctttcgccgcccgcttctacctttacaaacaagactggcagaaagccgtggatcacgccacgaaagccctcggcaaccagcccggcaaccaactgcgcaactgggcactctggaacaaacaggggctcaacggcgaggccatgcccaacgaatatgtgcgttcgagcgcgaaaaccaacctcttgctccaagtggtgatttcggcttgggggctctacagcggcccttacggcacaggcggtcgctactgccacggtcgcagcatttccgacaaggaaacgttcaactccacnggnccttggggcgaaagcgagngcgctttcaactacaccgtgggctccaactccggccaaccgcagatcacgctcaagaagttgcccatcaacttcaaattcatcgaccgcgaagccggcatcggtagctactattcggaatattcggtgttcaatgccgacgaaacgctgctggttcgcgccgaagcctacgcacgcctcaaacaatatgcgcaggccacggccgacatcaacacggaaatgacggctttcgcccgcaaacccaanacgttcaccacgacgcagctcgcggacttctacaaaaaggtgaaatactaccgtccggacagcgccacggtgcgcaaagcgttccacatcagcgagccgctcgacaccaccacgcaagaaccgctgctgcaatgcattcttcatctgcgccgcatccttacggtgcacgaaggtctccgcatgcaagacgtgaaacgctacggcatcacgatctatcgccgcgatttcgacgccaacgacaagtttgtcaccgtcaccgactccatgcccgccggcgatccgcgccgcgccatccaacttccgcaggatgtgatctcggccggcctcacacccaatccgcgtaaaaccctcactgccaaatgaaactccggatgaacaagatactcctcgccacgctgctgctcctttcgtgcttggggctcagcaattgctcggacgacgctccgaaaggcgccagcattttccccaccacccccgtccggcgcaacgccttcgacacctggctgctcaaaaactacacgaacccttataatattgagttcaaataccggctcgaagacgcagaaacggactacaactaccaccttgtgcccgccgactcggcgaaaacggccaaattggccattctgaccaaatatctctggtttgatgcctatgccgaagtggccggcgtgaactttgtcaaggccaatgttccgcgcaccatcgtggcngtcggcattccgggctacacacgtcagcgcacaatggtgctgggtagcgcagaaggtggctacaaagtgacgctcaacaacatcaattcgctcgatagcgtcacgctgaccaactacggcgcgatgacggaattctatttccacacgatgcaccacgagttcacgcacattctcaatcagaagaagccctacaacacggccttcaacctgatttcgaagtccgactacgtgagcagcaactggtcgcaccagaaagaaagcgacgcccaccgcgccggtttcgtttcgccctacgccatgagcgacggcttcgaggatttcgccgagaccctggccttctacgtcaccctcacccccgcacagtggaacgacatcctcaaagatgccggcaactcgggcgcaccgatcatcaaccagaagctcgaaatcatcaaagactacatgctcacgtcgtggaatgtcgacctcgatcggctgcgggcctccgtgcttggccgcggcgacaacgtgcgtcatctcgatctccaacacctcaagtaacttctccccatgcgcatccttcataccctcgtcatcgcacttgccgccctcggggccgccagctgcgccaacgacgaaaaagaacttttcagcctccccgcggctgaacgcatcgaccaagtggtcaaaaacgaccgcaccgctctcgaatctgcgcccaacggctggaaattcgactactttctcggncgngactactcaggtccgggcgtttcgatgatggttaccttccgaaacggcaaggccacgatggcttccgacgcgtcggacaccgcactcttccgcactgccgactacgatgtggtgaaagatcaaggcccggtgctgactttcaacaccttcctcgancccatccacagtttggcgggcggcatggccagcttccccgaaggtcgtcagggcgactacgagttttcnatcctctccacctcggccgacaccatncgcctgcgcggtaagaagtggggcaacgacatgttgctcacccgcaac

SEQ ID NO: 1563 - DNA, 4000 bp, Escherichia coli
  misc_feature (2)..(2): n is a, c, g, or t
  misc_feature (6)..(7): n is a, c, g, or t
  misc_feature (59)..(59): n is a, c, g, or t
  misc_feature (68)..(68): n is a, c, g, or t
  misc_feature (70)..(70): n is a, c, g, or t
  misc_feature (76)..(76): n is a, c, g, or t
  misc_feature (79)..(79): n is a, c, g, or t
  misc_feature (84)..(84): n is a, c, g, or t
  misc_feature (87)..(88): n is a, c, g, or t
  misc_feature (96)..(96): n is a, c, g, or t
  misc_feature (98)..(98): n is a, c, g, or t
  misc_feature (106)..(106): n is a, c, g, or t
  misc_feature (121)..(122): n is a, c, g, or t
  misc_feature (125)..(125): n is a, c, g, or t
  misc_feature (132)..(132): n is a, c, g, or t
  misc_feature (137)..(137): n is a, c, g, or t
  misc_feature (159)..(160): n is a, c, g, or t
  misc_feature (176)..(176): n is a, c, g, or t
  misc_feature (182)..(182): n is a, c, g, or t
  misc_feature (190)..(190): n is a, c, g, or t
  misc_feature (196)..(197): n is a, c, g, or t
  misc_feature (205)..(205): n is a, c, g, or t
  misc_feature (212)..(212): n is a, c, g, or t
  misc_feature (214)..(215): n is a, c, g, or t
  misc_feature (220)..(220): n is a, c, g, or t
  misc_feature (259)..(259): n is a, c, g, or t
  misc_feature (373)..(373): n is a, c, g, or t
  misc_feature (377)..(377): n is a, c, g, or t
  misc_feature (382)..(382): n is a, c, g, or t
  misc_feature (387)..(387): n is a, c, g, or t
  misc_feature (393)..(393): n is a, c, g, or t
  misc_feature (541)..(541): n is a, c, g, or t
  misc_feature (874)..(874): n is a, c, g, or t
  misc_feature (907)..(907): n is a, c, g, or t
  misc_feature (1145)..(1145): n is a, c, g, or t
  misc_feature (1536)..(1536): n is a, c, g, or t
  misc_feature (1704)..(1704): n is a, c, g, or t
  misc_feature (1707)..(1707): n is a, c, g, or t
  misc_feature (2834)..(2834): n is a, c, g, or t
  misc_feature (3215)..(3215): n is a, c, g, or t
  misc_feature (3233)..(3233): n is a, c, g, or t
  misc_feature (3979)..(3979): n is a, c, g, or t
gncctnngcgccagcagcctcaaaagcagccttagctttatcagcggttgccttatcanccttctccntnatggtngcnggtgnggnntcaactanancctttgcntcttttaggccaagnntgnagttaantgcangtacctctttgataactgcaannttctgagaaccagcancctcanggatgatngtgaanncatcttgngcagcancnnctgcnccgccagctgcgccaccggctgctgctgcagcaactggngctgctgctgttacatcaaactctgtctcaaatgctttcacaaactctgttagttcaaccaaagtcatatctttgaactgacctaatagatctggggtatttagctttgccatnttcntttcnttttnttctantcccgactccaactcttggtatgagtacgggggttgggggtcggtttagttttctgtgctttcagcagcaggtgccgcttcggctacaacttcaggtgttgcatcttgtgcaacgactgcttctgcaacaacttcaggagctgcttcngcaacgactgcctctgctacaacttcaggagctgcttgcgcaactggtggagcaactggtgctggtgcacctgcctccatcttgatgcgaagaccatcaaatgttctagcagccttagacattgatgctttaagtgcaccggcaatcttggcaagtagaacttcgcgagattcaagattagcaagttgcataatctcagcagttgttactgccttaccatcaaaaattccacccttaataattagaagtggattttccttagcaaaatcacgtaatgctttagcagcatcaattgggtcacctttaataaatgcaacagcagatggaccagcnagcattgctggatctagatcaacaccggcttcntttgctgcaattttagttaaagtgttcttaactacggagtacttgttttttacaccaagtgatcgacgtagttgctttaataatgtagcggatagaccacggtactcagtaagtacagttgcatttgcggtgcggaaatcttctgcgatctctgcaacagcagcgctcttatctggggttgccatttggcatcctttctaaataagaaaaacctcggcgcataaatgcactcgaggtnatcgattacacctatgcgggctgtttttcaacaattaccttttaaagatttactttaaaagacctgcagtctttggttttctgtctttctaattattttattaattagcctgactgaataagccaagggtaggcggtaaggcctacccaagtcaaaattacttatttattggatctgggctccaccatcacgagcaactgaggtatcaagttggattcctgggctcatagttgatgaaacagtagctgacttaataaagcggcctttagatgatgcaggctttgctctcattacctcttcaattgctgcagcataattttcagcaagttgttcagcagtaaatgaaactttaccaattacaaagtgcaggtttgagttcttatcaactctnaactcaatctttccacctttaatatcagtaacagctttagcaacattggttgtaacagttccagtctttgggtttggcattaggccacgaggtccaagaacttttccaagtcggccaacctttcccattaattcaggtgttgatacaactgcgtcgtaatcaagacgnccntttgaaacttcatcgattaattcatctgcgccaacaatgtcagcaccagcagcacgtgcctcttcagctcgctcaccaccggcaaaaactaaaactctggcagtcttaccagttccgtgtggcaagttaacggtggaacgaatagcttgatctgctttctttggatccacacctaaaaacaatgcgatatcaacagttgcatcgtatttaacagttgaagtctctttaactaacttcatcgcctcacctggcatataaagattttctaactttatcttctcggcggcggccttatatttcttactgcgcttcatttcttctcctcttaattaatcttgaaagggttttcaagattggggttgtggtgtttgcgaaccagcgaggttctcccacattatttatttttaactagagacggtaatacccatcgaacgagcggtaccggcaataattcgtgaagccatctctaagtcattagcatttagatcaaccatcttttgcttggctatatcttcaacctgtgccttagttagatttgcaactttatctttatggggaactgctgatcccttttcaattccggcagccttaagaattaatcgtgaagctggtggagttttagtaataaaagtaaatgagcgatcctcaaacacagtaatttcaactggaatgatgtttcctttttggctttcagtcgcagcgttatacgccttaacgaagtccatgatgttcacaccatgctggcctaatgctggtcctactggtggcgccggtgtggctgctccagcctgaatctgcagcttaataagtgcggttacttttttctttggtgccatggttttttccttttctcttctcgttaaatcttttgtacctgatgaaatgaaagttcaactggagtctcgcggccaaagatagagactaatacctttaactttgcttgctctggcatgatctcagagatagttgctggcaaggttgcaaacggaccatccataacagtgatggattcaccaattgcataatcaatatccttcatctcaatcttgccgcccttcttaagtgggcgtggagctaagatgttttcaacttcagaaagcgtaagtggtgatggatgatgagcgttnccaacaaagccggtaacacctggtgtgtttctaacgcatgaccatgactcatcagataattccatacgaactaatacataacctggaaatacgttgcgctttactactttaattgcgccattcttaagctcgcgaacctcttcttcaggaacttcaatctggaagataaagtcctccatatttaaagattgaatacggtttactaaatttcctttaaccttcttttcatatccggcgtatgagtgaacaacaaaccactcacctggtgcgttgcgaagggcggcgcgaaactcagcgttctcatcattttcttcactaacactctcatcagttacatcttcaataactggcgcaattacctcttcaacaactggtgctacntcggtaacagctagtgcngcttcaaatgcatccactggtggattagctggggtatcaattgacatcatattttcctagatcccttagccgaatacccagaaggtaatttttgttaaaactaaatcaaatattgaaactactaaaataataaatccaacgaatactaaaaccacagctgtgtaggtggttaattgatttcgagttggccaaacaacttttactaattcagaaataatttggcggtagaacaggccgatgcgaccaaagagccctttggcttcttcagttgagacaatctcttcgctcatctacctattccttttcttttcagttcttacttacttcttactaattaccgaactacttgcagggcaggagggactcgaacccccaaccggccgctttggagacggcaactctagccaattgagctactgccctttgtcccgaattaaggcatgaaaaatcatgacctaatacaagcgccgggggcgaaagtgtagaggaggtagtagtcgaaggtaaaactgagataaatatgaagcctcttttaagcgtagatggcacacttaagccccatgagcgcatctgaaaaacctagagtttcaaaacgaattgcagctatcgcagagtcagcaactcttgcagttgatagcaaagctaaagcgctaaaggcagccggtcggccagtaattggttttggcgccggtgaaccagattttccaactcctgattacattgttaactctgcaattgaagctgtnaaagttgtagctaatcaccgc

SEQ ID NO: 1564 - DNA, 4000 bp, Escherichia coli
  misc_feature (184)..(184): n is a, c, g, or t
  misc_feature (226)..(226): n is a, c, g, or t
  misc_feature (295)..(295): n is a, c, g, or t
  misc_feature (959)..(959): n is a, c, g, or t
  misc_feature (1619)..(1619): n is a, c, g, or t
  misc_feature (1964)..(1964): n is a, c, g, or t
  misc_feature (2015)..(2015): n is a, c, g, or t
  misc_feature (2613)..(2613): n is a, c, g, or t
tggacgctcatcttttgtgtcatacactgcaaatacaatatttttaaagtggtacatccacttttcttcgacaagaacttgatacatatcattggccacatcctttggaggattgccaaatgctccacatccccacgcaccaagaattaaggtgtcatagtgctcctttgcggccacctgaatncccaaacgaaatttatgtcttctctcttcgcccaactcttcngagtttaattttcctgcctttacacgagtatttggtgccggcaaggacataacagaaacttgatagggntcaggcaaaaaacttccatctgcccttcgaaagacttcgacatccttagagagcaataaatagtcaaggtctgtgttgcttgccacattctccttattggcctcatacatttctaaggcttggctgccactaatggactgatacaaactgctctgacggcaaagtacctcttcttgtgcattagctccacgcagatatccaccacctggattatatgcattggcaaaactaaggactaaaatcttcctgccgctctccctcatttgccaagctgcatcaaaactatttaggtcattgacaatgacattggtcgaatcatacatcatttgattgccaacatgcaaattggcaagtagatctggtgtgtaaacttccacggcctgccgcctgctctttggaatggtaagctctatttttttgtcattcagtgtataaaaacctagcctcagaacatccatattttctgtcgctattttttttctggattctctactcatattcccacactcttttgctttattttttcttatatggaactttagctgctggcactacctttgaagctgcacgcaaatgagcactctgatcatcaaagaaaatatgtgcaccaaatgcagacaaaacctcactcttttttattccgccaagaaaaaaggcctcatcnatgcgaacattccacgcccgcaatgtccggatcactctctcatgtgcaggtgcatttcttgctgtcacaagtgctgttcgtatcggaactgcatctggtggaaattgctgctgcacataggaaatggtctttattaacttggcaaagggtccctcaggcaatggcttttttgcattctcttgttcatacaaagtaaatgcttctaagcccttctcctgatagattttttctgcttcatctgaaaaaagtacggcgtcgccatcgaaggcaattcgaatttgtggaatttctgcttttggattgatcttgacttctggataagaataaattagacctgctgccacccctgcatcgacagcttcttgcacatctgacccatttgctgataaaaagagatcggtatgaaatgcatttaaatactttacaatcggtgcaccgccaaccaatgcggctcgggtaatatctaaaccatagtgttcaatagaattgaaaatacgcagactggtgtctgctgtattccttgacataataataatctctgtcaacttttttccgcctgcattcagctggtgcaatgcccgtaccaaagaaaaagccgttcccggctttagtacatcattttcgtgctccctttgatactttgcatagatctctattccntcggtttcaaaaattgcattttccctctctaaatcaaacaatgccctcgaagagatccccacaaccagctttccatctaattgaaatgccattgctcacctcaatgtatcctacaatattactccactattgtataatcttttcagataattaacaatacctttattaattttattcactgaaaagagtatatcataatttctatagctagaaaagagctagaaaaattctcataccaattgtaagatttttgttatatatttagacaactcattcaatatgtatcattacgcaaaaatgctggtcttcaaaacaaaaaccagcatctaattctatattctctangctttctgaattttctgaatactttccatttcttctactatttttctattntttagaaattttgaacctatagcaatgagtaaaaagagaatggctgctacaggatagaaccaaactaaacgattggttgttccataaatttctaaaattccctgaaaaatacttccaatggtcaaagtcaccacgaccgcattccatgcacttacggtaatattccttggctctttttttgccctcttgctcgccaaaagataggcaaagcttcccagacaaagtggaatcataaaggcatagatcatataataggaatacacttcatggctaaacttttcatagattgcaccaaaaatagcaataaaaattgcaaaaatcatatgtccaaaaatattatctcgataaatcttatccaatgtagacaatatcgctcaccttcctctctcgaatatctcttcccgatgttgttggcttattgattaaacttccctgaaataccatcgtggatgagccaccgccatctaagttgtaggctgtctttgcccccaagctcttcataaattgtgccagctgatacagcgaaagtccttcgctctcctgtgttcttccatcggagaccacaaaaagatagtgattgttatcgatcagcccaatngctgttcttggattgctcgccatggctcttccaacctctgcatcggttgacacactcacctttccctcactcacaagtcctgggccaaatgaaaatgcctgccaaaccccttgattaactaattcctgtgcggtcacggttgacggatcaaccaccttcatactgccatcggcatagatacaaagtacatcttcacttcctgcctcatctcggtagactacaccatttcgaatcacatagccatcctctcttgccccatagtaatccccattaatagataaaatggcatttttttcactggcaatctgtgaagttgtctctgtgacattttttccataggtatcactggcaaaggccgtctttagtgattgtgcagaatcaagcgtaatgtcagcgacatagaccttcgtgttttcataggtgtattcctttaagctgatgttctttccatcttggctgtagcttttgatctcctttccaccatctgtgctcgtcttcgtctggttgctcgctactgtcgtctcacttttacttttattggcacttgatgtgctgttttttgcactggatgactttgttgtctttgtagccgatgtcgctgcctttgttgtcgtattggcaaatgcagaggtattcacgcttgttgtatttacctgatatgctcttgaaataacaaaagtatccattgaaatatacactgtaaatgccaatattgatgtcaaaaatagaatattccacttatgctttttcatataaatctccctcccgagttccttttttaaaaacgaattgtctctgtacactccagctgatgacaaacatcataatctctgtgataatctttgccaaataggcgttgatgccaaaagaaacaattcctctgagcaatatcacatttcccaacaaaatgcatagagcaagtgtgatatatttgggcaaagattcgatggctgcctcttggcttttaaatacaaacttccgattgaggctgtaatttaggcttgcactgaccattctagccaaaatacttgaaactaccattgcccccgaaatcataaataacagacaatacaatccataatctaccaaaaaactagtgagtgacgacgaagcaaagcgaataatctctttatagattcgataagagtccttgattgtagaaaaatgagatgatcgattgtcattgagatacaccgttgcaatctccacctctttgatatcttcctttctcgctaattccaagagtacattcatctcatattcatatcgttcacctcgaacggaaagcatttcttccaccattctgtcagaaaatgcccgaagtcctgtctgtgtgtcaaagacatctagtccgctactgaccttatataccatccgagtgatactg

SEQ ID NO: 1565 - DNA, 4000 bp, Escherichia coli
  misc_feature (3629)..(3629): n is a, c, g, or t
  misc_feature (3736)..(3736): n is a, c, g, or t
ttccatccaatactgtcgtaccgccaaagtcaggcaaatagtagacggaactgttgccgtgttccagcgctccgaaccctttaccggcaagtgttcggatggctttaatgattgttccaattttaatttcttggccggtaaacagtccttcgaattctgtatggtctttgatataaaaaatgaagacataattatctacgggaagatcgccctccaaaaaggcttcaatggccttcatactggtcgctacctgcgcatatatctcctctgatagttcacgtccattttcagtaaagacacctatggttactttggctccgccgagctgaaatgaagtggtatcaggccggctgaccattactgggcagtctagaaattcatggtaattgcgtgcatagaaattctgagtattaccgtaactgtagctttccatagcgcttaggccgaagaggctggggcttttagtaatctcgagcgatacggggaggtcttcctgtccttcgaaaaagccgaagtaacctgcggcatttaaaaggaagttcgtgcgttcttgattgttcgttcccgccggttcaaatactttattcttgcgaatttgcgcatcaaatgtgtcgtcggcccaatattcaaggcgctcaggttttccgtagatggtaaaagtattgtcctttcgtttaaccttcagtaatgctccatcgctgccgtaagcttgaaaatcttgaataaatcgaccgtagtctagcgtggcataggtgcccggaatggttgcagggaaatgaaagttgtacgtacgctgttttgtggtcaattgaagcgatctagcatctacggaaactttaactcgatcgtctatcacttgcgtgaggtcaatggtgtaggaatgcatacccgcatgttgccctaaagagggcaatgtgaggatgaggaatagggaaaggagtttgattttcatcttttaaagatactatgctattcagtaagacaacgaaaaacagatcgagggttgcctcggcatagaatgatttaaaaaaagaaagccccacgactttcgtcgtggggctcactaacactctgaaacgtatgattaagccgcctctgtcttagactcgatagccaaagagtagattacaagaccaaatccaattttgttgattgcatcagcaaggttgtagcacaagttcagtacttcctcgtttgcttcgatacctaggtccattccgaagaatccacctgctgtacctaagatgtaaccgatagggtagataccccaaccgatgattacaaatttagccaaagcactgtttgcttttgctactgcaccaccagcgttgtttgccaatttcgcaacgtctcctttccataccatccatacgatgtagaagtaagcagcaccagaaatagcaccccatacccaagaaacagcgtcatttgcgtagaatgcctcaccgatgtaaccggtaactaacattgcaactgaagctaggatcagtttgtacaagattgactttgtacctccagctttctttgtgatcaagtagaactcaacacacataagtggaacggttaacgtccagtctacataacgtagaacaactggacttccattaccggcagcgtagaaatcacgcatgtagtagtagtgcactgctgcaataccagtaataagcccactaacgagcattgaagttttccactcgtctgcaactctacttctttcgaagaagaagaatactgaagcggccaacatcgccatgtaaccggcgaagaatgtgaacgatacgtaatcgttcggatcgaatcccatagatccgtctaaaaataatgacatggtgttaaaaattaaaggttataactaccacttaacttacgaagaatacttttgttcacgacagactaaaaataagttaaaacactcatatttatagccatatttatcgatttcagctatttatacagctatttagcaacatgtatagaacaaaatatatatgaaaatgttgtgctaaatataaagggtctaatcgacatttaatcaatggagcgttacgatataggttttttgggaatgggtgccgcaaatggtttgcttttgcttgaattggagcgtagaaatatcttgcaccagttcaaaatactcattcttgaacccgatgcgaaacttaaaaacgataagacctattgtttttgggcggattccaaacatgaaatccgcacgcgacttaaagatgtattgttccaccagtgggatacgctcgatacggtggatggtctggaggcgttagaagatcaacattattatatggttgaaagtagcgcactatataataaggttaaatcggttgcgcaatcgtacgaaaacatcgtttggattagaggagctgttgatggtttaaggacagaacaagaaggcgttttagtttcaagcggagactattcgtgggaagttcagcaagtgttcgatagcaggcccccaaacattaaagagcccatggggccgcttgtcttgcaaagttttgtgggttggcgcgttgagctcaaggaagcgtactggaccccgaatgaaatgacgttgatggattttagtattcctcaaaacggctttacgcagttcatgtacgtgcttccaaccggaactaaggaagctttagtggaaatgacgcgcttcggcagtgaacaattgccgcatgaattggccagtaatcatcttcgaaattatcttctttctagaggcttgtcttttgaaattcaacacgaggaacgtggagttattcccatgacgcaatatgccgaggtcaaagatcaggatgcacgtattgtttctacaggtgcccgtgcaggaagggttaaggccactacaggctatgcttttaagagcatgtttgagcatgcgagagaattggcagaaagtattgcgcaggagcgtaaagaatcgtcgtggttgcgtttgcctaagagcactatggatcgattcaatttttacgatcatctgctgctgcacatcttgaagcataaaccacactggggtaaagaaatatttgaaaccttattcgagactcagaaggccaacaaggtctttcaattcttagatgaaaaatcttcctttaagtgggagttaagcatgtttgctcgtttgcccatcatgaaatttttatgggcattagcggcttcttttgtggctataattgtggctaagcccgcgcgctgggctccagtagtattcacggttttagcgctcgtagcggatgcttttttgccgctatccgtgacttatggcctgcaagccgtgctcgttttcctgttgtttctttatggcataccccatggcgcattagacggttacagccacgccaaccaggaccgattaccgaaattcattttgcgctactgcttcatcatgctgatggtcattttgttttgggctgcaagtccagtcataggattatccgccttcttaatttacagcgcgtggcatttcggggaaacggacctgcgcgagtggggctttcctagtattggtctttcgtttttatgggggactttactattgacgctgatacttatacctcattcgatggaagtgaacacagtgcttgaagtcatgggtattagtaaagtaacatggtctacgnaattcatggatatggtttacagaatggcgctgacgctgggactttttatgggcctttggtttcgctcgatcccctgggtggttgccgtggtgacactcggtttgacngcgacaataccgttggctactgcattcggtatttactttgtcttgcaacacagtctgtcgggttggaaccacctaaagttgtcgcacaaatggacgaacacggaaatgtggatgaaagccttgccgtttaccattggtgcagtggcgctcttcttattggtgtttagattcgataaaaactccctgttggcgtggtcgagttactttttagtattccttagcgccataagcttaccacacatttacttcatgtcgaagctttac

SEQ ID NO: 1566 - DNA, 4000 bp, Escherichia coli
  misc_feature (14)..(14): n is a, c, g, or t
  misc_feature (108)..(108): n is a, c, g, or t
  misc_feature (111)..(111): n is a, c, g, or t
  misc_feature (568)..(568): n is a, c, g, or t
  misc_feature (942)..(942): n is a, c, g, or t
  misc_feature (1767)..(1767): n is a, c, g, or t
  misc_feature (1991)..(1991): n is a, c, g, or t
  misc_feature (3051)..(3051): n is a, c, g, or t
  misc_feature (3069)..(3069): n is a, c, g, or t
  misc_feature (3094)..(3094): n is a, c, g, or t
  misc_feature (3430)..(3430): n is a, c, g, or t
  misc_feature (3432)..(3432): n is a, c, g, or t
gcgactccatcggncgtccgttcttccgccatgagcctcgacaagcccacccctgacgccatcgatggcgccgaactccgcttcgccctcgtggccgcgggttacaanggngagctggtccaggccctgaagaagaacgccatcaaaggcctgcgcgccgccggcgtgcccgccgcctcgatcgtcgaagtcgccgtccccggctccggcgagatcccttacgccgcctacatgtcggccatgaccggtgattatgactgcgtcatcgccctcggcgtcgtcgtcgccggcgacaccccgcaccacgagatcatcgcgcactcgacggcccaggccctccaggacgcggccatccgctccgaagtcccgatgatcaacggcatcgtcgtgacgaacacccgcgagcaggccgtcgcccgctgccagggttcgctggaccgcggcacggaattcgcccacgccgccctcaccatggcccgccaccgcgtcacgctcggcgcccgcctcgaccaggtcgaggacgaggaacgcaagcgcggcggccaggaacctttcgcccagaactgancgatggacaacgactcgcctatctccgcctccgcgcgcgccaagatccgcatccggatcaaaggcgtcgactaccgcatggcggaccagaccgcggccgacatcatcgccagcgtcgtcggctccggcgcccgcatctccggacccttcccgctgccctcccaggtcgaggaaccgcgcacggccctccgtgaggagatccgcagccatcgccgcctgatcgagatcatcggctccaaccagaagaccgtcgacgcgttccgccgccacaacgtccccgccggcgtcgagatcgccatcgtcgccccggaagaaccggtcgtcccggaccccgccgcgccgcccgccaagcgcaaccgccgccacgacagccgngtcgtcgcgatgcagttcctctgctcgtgggaagtccagcgccacgccgacatggtcacggccctcttcgacttcttctccgaacgcccccagccccgcgaatattacgccttcgccgaggagctcatccagggcgtcatccgcgacctcgccctcatcgacgagatcatcggcaagtacgccaagaactgggccttcggccgcatcgcccgcgtcgacctcgccatcctgcgcgtcgccatcttcgaactcatgcgccgcacggacatcccgccggtcgtgagcatcaacgaggccgtcgacatcgccaaggagttctcgaccgaggaatccaagcgcttcgtcaacggcatcctcgacagctacaaggaagagctcgggcgcgacccgcgcaaggccgagggcggctgagccatggcgggcttcttcgagcgactgaagtccggcctgagccgcacggccgaggccgtggccaacctgctggcgcgaccgatggacgccgcgtccgccgagcagctgcgcgagcggctgatcgccgccgacttcgggccggccaccgccgacgaggtcgtcgaagccgcccgcgccgcctggaagaccgaagcctcgctccgcaagacctcgcccgccgaagccgcggccgaaagcatcgtccgcgcgctgggcggcgagaccgccgcggcgcccgcccttacgaagccgcacgtgatcatgctcctcggcgtcaacggggccggcaagacgaccaccgccgcgaagctcgcctggcgctggcgcgaggaaggcaagacctgcctgctcggcgcgtgtgacaccttccgggcngcggccggagaacagctttccgcctgggccggccggctcggcgtcgaagtcgtcggcggcgccgccggcgcggaccccgccgcggtggcgttcgatgccgtcaaggcgggcgtcgcgcgcggcgccgacctcgtcatcctcgacaccgccggccgcctgcacaccaaggcgcacctcctcgaagagctgcgcaaggtcgtccgcgtcacgacgaaggcccacgncggcgcgccgcacgagaagtggctcgtcctcgacggctcgctcggcgccaactccatcgagcaggcccgcatcttccacgaagccgtcggcctcaccggcctgatcgtgaccaagctcgacggcaccgcccgcggcggcgcgctcgtggcggtggtccgcgagctcggcgtgccggtccgcttcatcggcgtcggcgagcagccggccgacctccagcccttcgacgcgcgtgcttacgcccgttcgatcgtcggcctggccgagtgaggttgtcttgccagcgggggtggctcgccccagcgtgacctcatgtcggccgagaccgtcaccgtcgaactaggctcacgctcctaccccgtccgcatcggggccgggatgcgccgcgaggccttggccgccgccgaacgtcgtctggccgccggccagaagtgcgtcgcgatcacctcgcccggcgtcgccgccgcgcagtccggcttcgcggccgaactcgcgcgcctgatgcccgtgctggccaccgctgcggacggcgagacggccaagtcggccgccgaactggcccgcgtctgggacttcctcgccgccaacggcgtggcccgcgacggcgcggtcttcgcgctcggcggcggcgtcgtcggcgacctcgccggcttcgcggccgcttcctatcagcgcggcgtcgatttctaccagctcccgaccacgctgctcgcgatggtcgacagttccgtcggcggcaagacgggcatcaacctttccgccggcaagaacctcgtcgggaacttccaccagcccacggcggtcttcgccgacaccgacctgctggccaccctgccgccgcgcgaattcgccgccggcatggccgaggtgatcaagcacggcatcatcgccgacgccgacctcttcggtctcctcgaacagaattcgccgctcgcctggaaccatccgctcctcccgcgcgtcatccgccgctgcgtggagatcaaggccgccgtcgtcgccggcgacgaacgcgagaccagcgcccaaggcggacgcgcgctgctcaacctcggacacacnttcggccatgcgatcgangcgaccgccggctacggcgcctacntgcacggcgaagcggtcgccatcggcctcgtgatggccgcccggctttccgccgagctgaagcactgcaccggcgcccaggccgaacaggtcgaggccgtgctgaaatcccacgccctgccgaccgccctgcgcgcgccgctcaggctcgacccgatgctcgccgcgatgcgccgcgacaagaaggtccgcggcggcaagctgcgcttcgtcctgcaggacggcgtcggcgcggccagcaccgcggacgacgtgcctgaagaggccgcggtccgcgccttgctcgccggcggcgccgtccgctgaggccgtccgcttgacccgggccgtcagagcntnttggatacgccatgccccgcctcctctgcgcctgcctgctggcagcctccgtcatcctgcgtgccgcggagacgccggaaccaggcaagacctacttcggtcgcaatcagtacgtcgaatacatcgccggcagcctgcccttcgtcctgtcggccccgcacggcggacgcgacaagcccgccgaacttccggaccgcgagaagggcaccttcgctttcgacaccaacacccaggaactcgcccgcgccatcgacgacgagttcgtcgcccgcaccggccagcacccgcatgtggtcatctgccgcgtcacgcgtcgcaagatcgactgcaaccgcgagatcgtcgaaggcgcggcggggaacccgctgaccgaacagtcctggaaggacttccaaggcttcatccggaccgcccagcaggcggtcgtcgcgaagcatggccaaggattctacatcgacctgcatggacacggtcacgccgatgcccgcctcgagctgggctatgcgcacgatcgccgggagttcggcctgccggacgccgagttggccaagccggagttcatcaggaa

SEQ ID NO: 1567 - DNA, 4000 bp, Escherichia coli
  misc_feature (64)..(64): n is a, c, g, or t
  misc_feature (70)..(70): n is a, c, g, or t
  misc_feature (190)..(190): n is a, c, g, or t
  misc_feature (391)..(391): n is a, c, g, or t
  misc_feature (1985)..(1985): n is a, c, g, or t
  misc_feature (2463)..(2463): n is a, c, g, or t
  misc_feature (2511)..(2511): n is a, c, g, or t
ataatattgagatttaaagattaaagaagtaccaataacaacaaaaattcctaaaaaaatttcntatggnattatttttcgtttataaaataaaggttccaaaaatgaagttaaaaatgcccctaatgaaagcacactaagggtaattgagacattagaaactttaatcgcttgaaaaaaagtaatccantgtaaagaaattaatactccgcaaaaaagcaatttaattagaatcttattagaaacttttatgtttattttaaaaattattgcaaaaagtattaaaataacaaaagcaattaacattctataccaaactaaacttaaagagcttacagatattaatgaacctagtattgcagtaaatccaaaaatgaaaactataaaatgnaaatgtaaaaaactattaagtttatttttttgcatttttcaaaaaataaatagctaataataaaaaagcaaaatttggtatccatgcacctaaaaaaggagataaatttgatttacttaccatcactgcaaaaaacttatcaaaaaaaacaaatgtaaaagcagtaatgataccaaatgctaaattaattcccattccttcccttcttttgaatgatgaaacagagacagcaagcaatgttaatacaaatgtagaaaaaggtatactccatcttttatgtctaactaataaatgattatttattaatggagatccactttctatttctttatcaataaaatcattaagctgaaaaaaattttgtgtttctgccatataatttagactagaaagttcatcgattttaaaagaaaatattgtgtctttaattcttttagattcaattaactgactgtcgttcttgaaagttcttttaaaataatcgttcaaacgatatatactatcttctgaaacccatctgatgtttcgggcagttattttataacttaaagaattatcgataaatttttcataagaaaaatcataagccatttctcttgtaggattataactactcacataaataaaatcgttttcattaacctgtttgtaaatcttagaagtttctcttgattttttattttttttcaaatatttatattgaaattcattatattttttattcttttctggaactataaacatgcctgaaaaaagggcaaaaacagctataattgaagctgcaatcataaatggctttaaatatctattaaaagaaatacctgaacttagaatggcaataacttctgaattattggctatttttgatgtaaaccatattacagctaaaaaaacaaaaattggataaagagtatttccgaaataccaaacaaaatttaaataataatctacaatttcattaaacggcacgtcgaattcttttaatttatctattttttcagataaatcaactaatattccaattggaataaataataataacattgcagtaaatgttatcaaatattttttaattatatagttatctaaaattttcaaaaaattataatttattatccatttgtctaaccattagttttttccaagttaaaaaagtaccatttaaaatttgatttctagcttctctaaccagccataaatagaaggctaagttatgaattgttgcaatttgtcttcctacagcctcttttacagtaaataagtgtcttaaatatgcttttgaatagtacgtgtcaacatatgaataattatcattatccaaaggactgaaatcattttcccattttttatttttaatattaattcttccctgagctgtaaatagcataccatttcttgcatttcttgttggcattacacaatcaaacatatctacaccaagtgcaatattttctaataaattaataggagtacccactcccattaaatatctaggtttttcttcaggaagtacattacatacaacttcagtcatagcatacatttcttcagcaggttcaccaacagataaacctccaatagcatttccaaaagnattggtctcagatataaattctgcagactgtaatcttaaatctttatatacactaccctgcacaataggaaacaaagtttgagaatagccatgttttggatcggttttcttaaactcattgatgcatctaatcaaccatctatgtgtcatatgcatagattttttagcataattatattcacatggataaggagtgcattcatcaaaggccattattatatcggctccaattgatttctgaatgtttattgctctttcaggtgtgaaaaaatgaaaagagccatcaatatgagatttaaacttaaccccttcttcattaatttttctatttgcagataaagaataaacttgatatcctccactgtctgtaagaattggagatttccaattcataaacttatggattcctcctgcttctgaaataatttcaggtcctggtcttaaatataaatgataattatttgctaaaattacatcnggattaatttcattttttaaaaccatttgatctactcctttaacagangcagctgtaccaacgggcataaaaattggagtttgtataactccatgatcagtttcaattttacaagctcgagctttagtttcagaatccttatgttctaatttaaatttcatataataaaagaccaaatataatcatctatagttattaaaattatctatttacaattgttaattaattatgtatttaattatcaaaataagtttgctatggatgtctatataattaaatttataattatataaataatctatgcaaaacaatttaaatgagttaactactcaagtaagaagagacattcttagaatggttcataaagttaattctggacatcctggaggatctttaggatgtgctgaatttttagttgtgctttataatgaaatcatgattagaaaagaagattttgatatggatggaattaatgaagatatatttttcttgtctaatggtcatatttcacctgttttttacagtgttttagctagaactggatattttcccgttgaagaattaaatacatttagattactggattctagattacaaggccatcctacaactcatgaaggtctaccaggtattagaattgcttccggatctcttggtcaaggattatcagttgctattggagctgctgaagccaaaaaactaaacaacgattcaaatttagtttatgtacttatgggtgatggggaattacaagaaggccaaaattgggaagcaattatgtatgcttcagctaagaaaattgataatctgattgctactgttgatttgaacggaaaacaaattgacggagcaactgatgatgtacttccaatgggaagtatcaaagaaaaatttgaagcttttggatgggatgtgttagaaattaaaaaagggaataatattgaagatatttcaaaaggattgttaactgcgaaatcactttgcggtaatgaaaaacctatttgtatattacttaatacaatgatgggtaatggtgtggattttatgatgcatactcacgcatggcatggaaaagcaccaaatgatgaacaactggcttctgccctttctcaaaacaaagaaacttttggagattattaattaaaaaccacttaacaatgaaagaatatacttacacagaaaaaaaagatacaagaagtggttttggagccggattagcggaacttggaagaaaaaatccaaatgttgttgcgctttgtgcagatcttatcggatcattaaaaatgaataaatttattgaagaaaatcctaatagattttttcagatcggaattgctgaagcaaacatgatgggtatagcagcaggattaacaattggcggtaagattccttttactggtacttttgctaatttttctactggaagagtttatgaccaaataagacaatcaatcgcttactctggaaaaaatgttaagatttgtgcttctcacgctggggtaacacttggtgaagatggagcaacacatcaaatact

SEQ ID NO: 1568 - DNA, 4000 bp, Escherichia coli
  misc_feature (12)..(12): n is a, c, g, or t
  misc_feature (26)..(26): n is a, c, g, or t
  misc_feature (36)..(36): n is a, c, g, or t
  misc_feature (57)..(57): n is a, c, g, or t
  misc_feature (60)..(60): n is a, c, g, or t
  misc_feature (90)..(90): n is a, c, g, or t
  misc_feature (102)..(102): n is a, c, g, or t
  misc_feature (105)..(105): n is a, c, g, or t
  misc_feature (120)..(120): n is a, c, g, or t
  misc_feature (122)..(122): n is a, c, g, or t
  misc_feature (126)..(127): n is a, c, g, or t
  misc_feature (144)..(144): n is a, c, g, or t
  misc_feature (349)..(349): n is a, c, g, or t
  misc_feature (962)..(962): n is a, c, g, or t
  misc_feature (1151)..(1151): n is a, c, g, or t
  misc_feature (2350)..(2350): n is a, c, g, or t
  misc_feature (2692)..(2692): n is a, c, g, or t
  misc_feature (2695)..(2695): n is a, c, g, or t
  misc_feature (2710)..(2710): n is a, c, g, or t
  misc_feature (2758)..(2758): n is a, c, g, or t
  misc_feature (2799)..(2799): n is a, c, g, or t
  misc_feature (2830)..(2830): n is a, c, g, or t
  misc_feature (2833)..(2833): n is a, c, g, or t
  misc_feature (2869)..(2869): n is a, c, g, or t
  misc_feature (2881)..(2881): n is a, c, g, or t
  misc_feature (2884)..(2884): n is a, c, g, or t
  misc_feature (2886)..(2886): n is a, c, g, or t
  misc_feature (2899)..(2899): n is a, c, g, or t
  misc_feature (2992)..(2992): n is a, c, g, or t
  misc_feature (3094)..(3094): n is a, c, g, or t
  misc_feature (3300)..(3300): n is a, c, g, or t
  misc_feature (3757)..(3757): n is a, c, g, or t
  misc_feature (3767)..(3768): n is a, c, g, or t
agcgtctgcgtngtgccgcgctcgangtcgagcacncgaagatcgatcgcattgccntcntacgacgagaacaccacgtaccgcccgtcnggcgaccagtcnggntgatagtcgtagcgngntccnntggtgagctggcgcgcntcggtcgtgccgagtcgctggcgccacagggagccctgcatggagtagatgacgtcctttccatcgggcgaccacgtcacggcgctcgggccgctcgtggcctgtgggacgtacatctcgcgccagtagtacgcgtgcgggaccttgacctgtggcagcacttgctcgcgctgtggcgcctgagcgctcgcggctgcggtcaccnccagcgtcaggagcagggcgctcgttgtcatcccgagcggagcgagggatcgcggtcgtcccgacagagggccctctacctggagactcgcgatccctcgcctggcggctcgggatgacatcacgtgcgcagctcgccgagcagctcgtccatcatcccgagcgccgtatcgacgtcgtaggtatcgataacgagcggcggcgccaggcgcagcgcgctcttgccagcccccagcagcaggaggccgcggcggaacgcccgctgcaccagctcgtgcacgagctcggacgccggctcccgcgttgcgcgatccttcacgaactccacaccgatcatgaggccgacgccacgcacgtcgccgatcgcttcgtgacgctcggcaagccggcgcagaccggccacgagacgctcgcccatcgctcgcgcgttcgtcgttaggccgccctccacgaggtccagcgtggccagcgcggccgcgcaacacaccgggttcccgccaaacgtcgagccgtgcgccccctgcccccacttcatcacgtcatcgcgcgcgatgatcgcgccgatcggcatcccggagcccagtcccttcgccgtgagtagcacgtcgggctcnacgccttcgtgttcgcaggcgaacatcttccccgtgcgtccaatgccgctctgcacttcgtccatcacgagcaggatcccgtggcggtcgcacagctcacgcagggcggtcagaaacccgcgcggcggtacgacgtatccaccctcaccctgaatcggctcgacgaagatcgccgcgacgtctttcggntgcagtcggcgagcgaacagctcagtctcgatcgagcgcacacagtcgagcgtgcactccgaccggtcgcggcaatgctggcagcgatagcgattcgcgtacgggacgtggtaaacctccgggagcattggcccgaaccctgcgcgctgcgtcaccttgctcgatgtcaggctcatcgcgccataggtgcgcccatgaaacgcgccgtcgaacgcgatgagcgccggccgtcgtgtcgagtttcgggccaacttgatggcgccttccaccgcctcggcccccgagttcgtgagaaacacgcgctttttgctcggccccggcgcgatccgcgcgagtcgctcgcagagcgcagtcatgtcctcgtagtagaagtccgtgccgcagatgtgcaggaaccgcgacgccgccgcctgaatcgcggcgaccacctgcgggtgcgcgtgccccgttgccgcgaccgcgatgcccgccatgaagtcgagatagcggttcccgtccacgtcttcgatcatcgcgcctttaccatgcgagacgacgagcggatactccttgatgtacgacgtggaagcggccgctacgtcccgatcgatcaccgcctgcccgttaggccccggtggcgggacgacgatgcgagggtagtcacgcttggtggtagcggtagccggtgtctgcagaatctcggtagccataggaggagctctgttgatagtccgtagtcgttagtctttagtctttagctaacgactatcgactatcgactaacgactggtagaatgatccgcgacggatgtcgcgcgtcgtgatgaatcgttatgcgggccgagcgcgtgcgggcagattgggtctccgacgcgccggtctggaggttgcgtgcgtagttcggcgcgaacgaggacatgacgtgaacgcgaatgcggtggccttgcttgaacgtgttccctgtcaacagtcccggcagtcgcagtagatacacgcggcgcggctcgagcagcgaacgacgtgccgtgcggtcgcggtagctcgcgcggatcacgtcggatcccggggccatgaggttgtacgccgttccgtccggcgcgacgtcgagcaccttgacccacaggtccgcgtcgggtgcgtccgccgcgaggtacacttccgccgcgattgcacccaccacttccacgtcgttggcgagcggaggtgtctcgaaggtgagnacgtcggaacgcgaggcgagctcgcggtagtcgtgcgcgccgctccgatcggcgtatgggtcggtaacaggctttgccggattggcgacgtaggcgctcgtcggtcggcgcgagtctggtcggcgcgcggacagttcgccgatgcgcgacccttcggcgggcgccgacaagtaaagcgtgtccgagcgcgtcccgggaatcggccagcggtcggcttcgcgccagcgattgtctcccatgacgaacacgcgcaccggtggctcgcggtccactccgttgtccagatcgcgcacgtagcgatccatccaacgaagcacggtctcgtcgtagtcgatggtcgcntcnggaccgttctcgcgntcgcccgctttcgtccgccccgtgccgccgacgccatgtggccacggnccgatcacgaaggcggcccgcgactggccgcctgctcgcgnagtcgttaggcccatgaagttcgtcgtcgcnccntcggggccgtacgcctcgtcgtaccatccggacatncccagcaccgcngcncnggtgcgtccatancgcgggcgaagatccgcccaatcccaccatgaatcccacggcgggtggcgcatccactcgtagtaccacggcgcgatcggcttgaagtccggnacggcggcgagcggcagctgccagagaatccgctggcgcgcctcatcccaggttcgctcggcctcttcatcggtcgtcggtccggccacgccatggcggcgntgcagctctccgccgacgtcttcccacacccagccggcccacgagttgtcccacacgccgccggcgtagaagaacatgttcgcggtcgcgaacgtcatggccgggaccatcgccttgaggtgcggcgggccctccacggccgcgagccactgaaccgcaccgggataggacagaccgaacgttccgacggagccgctcgaccacgnctgacgcgccgcccattcgatggtgtcgtagccgtcgagcccttcgtgacgatagggctcgaactcgccgtccgacgcgaaccgcccgcggacgtcctgcataacgacagcatatccgcgcgcgaccgccttcccgaacgtggtgtagtccgactgcgcggcggatttgccgtatggggtgcgatacagcagtaccggaaacggccccgagccctgtggccgccagacatccgcacggagtacgacgccgtcgcgcatcggcaccgcgacatcgtgctcgcggacccaggtggtttccgcggtcgccgccggggtctgcgccggtgcgcccgtcgcaatccaggcgatcacgaagaccacacccgacgctctgccgatcatcgcgccgcgaggcccccgctcgacgcggtcttcgtcgttaggcccgatgcgacgatggccgcctcgagccggtccncgatcatcgnnatctcgtcctccgtgatgatgaacggcggcgccaccatcacgaggtcgccgcgcgtgccgtcggcgtggcccacgttaggccacacgacgagcccgagatcgagcgccgccgccgtcagtcgctcggcgacgcgggcctcgcgcgcgaacggcgctcgtgtgtccttgtcctcgaccagctcgacgccggccagcaggccgcgcccgcgcacatcacccacgtgcggcagct

SEQ ID NO: 1569 - DNA, 4000 bp, Escherichia coli
  misc_feature (2170)..(2170): n is a, c, g, or t
  misc_feature (3507)..(3507): n is a, c, g, or t
  misc_feature (3577)..(3577): n is a, c, g, or t
  misc_feature (3794)..(3794): n is a, c, g, or t
ttgccttttttcaaaaagattttttgcattaaactgcagcaggttagcactatttctaattggttgttcccacaggcgggttactcggtcggcaagcaggttaatgtcttcaagaatgtcagaattgggggccgcgacattcaacgtcttactttccttaaaggtttttgaaactgcaggatcggtaaaaagacaaccaaaaaaatcacttctaagcattaaaattttattgaaagtattttccaatgatccaagtaaatccaattcgtttggcaaattacatttgttgattataatcctaggtctgtaacgaatccaactctgttcggctttttgtgctacattcctgtcaattgtagaaatttcatccaacagaccccgtacggtcaggacttcatccatcacagtgcggttgtaagagtccctcaacttttcgtcaaggaaagtgttttttggcatagaacgctcaattactctaaaagcaaaaagtttgaggaaagtaagcatgtttactgttgaagcatgctctgcagtagtgataatcatccccaattgtgtcattccaaaataatccaaggtattgtaagtacttccgcttccaaggtccaatataagatattcacattccaattgtctcagattgttaatgagtcgcattttttgtgagtgatgcatgtttgccagaaacggacttctaacatcaccagcaagaaacttgagattctcattttctgtttctacgagcaaatctttcagtttgctgtatcgtgcgcgtaaaaaatctccgatgccaggattagtattgtgtattcccagacaggtatgaagatttgatcctccgaaatcaaggtctgcaacaataacctgtttgccaagtttcgccaatgcaattgccaagttagctgctataaagcttttaccaactccaccttttccacttgcaattggtataatagttctattcatagctgatccaagtttagttattaaaagtataaatcaaatacgtcagttccattggagacaggataaccaagaaaaaacataaaagcaaataaaagaattttctgcaatattaagctactgtcaattaatccagagtaagctcaaaaaacactacttccggatgtggattgttgtaatactgatctgtctcaacaaacccaagagacttatagagtccaactgcggactgcatgctgtttaaggtgtccaactgcattctggtatattttttatcaataccgagttgcacaattttttcagccagcaatcgccctaaaccagtaccacggtataatggtttaacgtaaagacgtttcatctcgcatacatcatcacttaaaggccgcaaacctgcgcaacctacacaatccaactcatcccatgcaaggaggatacagccttcaggtgcagcgtattttccgggaagatgttccagttcgtcctcaaagccttgaaaagacagactgaatcccaatgattcagcataatctatgaacagctttcgagcattgtcaaaatcagctggactatgagcaaagtcgatccgaacagacattttataaattatacatgaagactagttcaaaatgagttgtcatttcagtacatgcagcaatacgggatttgtaagaatatgaaaaatttgtcctcagcctgcatcaaacactgtcatgagttcccaaatttaaaatgaattaaaataatagtcaaaatttttgtttgtctgaactcaatatagtctattttacgtaatccaaatatgattcttaaacccaccaaataaaaaaacgaacacaatcaacaaatagggatgccatccaaagtaatggtaaattcggttgcggtgagtaaagagtactgaaggctgacacagttatcagcaaaagaatatttaaagaactgttattaatgaaaaaataaagctaactgtgtgttgaatattattaaatgacttttcattttgcaagtttttaagtagcattgaaggtgaataaaataattacagcaacatttgtcatcaaggaaaaactttatgagtaaaaaagcaaagccaaaaccagaagtccatgaatatcaggctgagatgcagaagcttctcgaaattctggtacattcattatacacggaacgagaaatctttctccgtgaacttgtctcaaatgcntctgacgcactgagcaaggttcaattgactacattgacagaagaaaaagttctggacaaagacacagaactccagatcacaatttccttggatgaagagcagcgaaagattgttatagaagactccggttgtggaatgacaaaggaagaattggttgaaaatttgggaacaattgcaaattccggaacgctaaaatatttagagcagttacaaactgagaacaaatctgcagaaaatctgattggacagtttggagttggtttctattcagttttcatggtagcagatcgtgtggaattaaccacccgttcctggcaagaagatgctaaagcctggcaatggtcttccgaaggaggaggtcaatatgaaattattcctgttgattttaagcagcgcggcacgcgtgttactgtgtttctaaaggaagatgccaaggaattttgcagtgagtggcgtcttgaatcaattataaaaaaatactctaactatcttccttttccggtaaaagttaaggataaaacgatcaaccaggtaaaagcgatttggacgcagtcaaaatctgaagtgaaagatgatgaatataaagagttttacaagcagatttctcatggtcagcaggatccgtttcatcatttgcattttaatattgacgccccaattcagtattatgccctgttgtatttccctgaatcagtaggaaatgaagtgctttatgcacgagagagcaaagatattgcgctttatgcgcagaaagttttgattcagaccggcaacacagacctccttccatcatatttacgttttgtgaatggggttgtggattcagaggatttgccgctgaatgtgtcccgggaaaacgtacaaaaaaatgtgctgattgaaaaaattaaaaatagtttaactttgcgtgtgttgaaagagttgcagacactggcagaacaaaatgttgaaaagtacggaaaattttggcaaacatacggaactttgcttaaagaaggagtttcttctgactttaagaacaaagacagattgaaggacctgttgcgctttaactcttccatatcagaagattcttcaacggacgtgactcttaaagattatgtcagcaggatgcgtgaaggacaaaaagacattttctatgttaccggaggttcgcgtgaggcaatattacacaatcccaatctggaatattttcgcagacagggcttggaagttttgtttctaacagatcaaattgatgattttatggttgttgatctaagggattatgatgggaaaactttaaaaaatatatcccagggagatatagaaggaattaatgacagtgacatgtctgnagcagaatcttcactttccaaggaagaaaaaagtgatattcttgcatttttcaaaaaacagcttaaggancgtgtcagtgaggtctctgactcaaaacgcctggtggacagcccctgttctctggtgactccaaaggatggaatgactgcacaaatggaaaagatgatgaaaatgatggaccagaaatttcagggggaaaagcgtaacctggaagtcaatatgggacacccgataattcaaaatctttctgagattctacagaaaaataaaaaacacccttttctcnaagaaactgtggagcaactctacgaaaattcattgttggttgaaggtttactcgaaaatccagtgcagattttgtcccgttatcagatgtttatggagtcggcaagtgcgtatgaattggagaaactcaacagagtagagtgagaaaggatttttggggagatccgataaactgttggaagaaaaatgatggtgggcagtcgtttg

SEQ ID NO: 1570 - DNA, 4000 bp, Escherichia coli
  misc_feature (1196)..(1196): n is a, c, g, or t
  misc_feature (1199)..(1199): n is a, c, g, or t
  misc_feature (1202)..(1202): n is a, c, g, or t
  misc_feature (1949)..(1949): n is a, c, g, or t
  misc_feature (1952)..(1952): n is a, c, g, or t
  misc_feature (1964)..(1964): n is a, c, g, or t
  misc_feature (1967)..(1967): n is a, c, g, or t
  misc_feature (1979)..(1979): n is a, c, g, or t
  misc_feature (1985)..(1985): n is a, c, g, or t
  misc_feature (2674)..(2674): n is a, c, g, or t
  misc_feature (2887)..(2887): n is a, c, g, or t
  misc_feature (3607)..(3607): n is a, c, g, or t
  misc_feature (3730)..(3730): n is a, c, g, or t
tggagagtatcaattatcaacattagaacctcatttctatattaaactaaaacaatcaatgaaagaattgaatcgagatgattttgatcatgttgaaagtatattgttagaattatttagaatgagaagaggtaaaattgtaaagcttgcagattctatcaaactaaattctgatatttataatcaattaacagttgaagaaaatattttttacaaaactatctatgataatagtaaagaatttgaaaatcaagtgaggggagaaaaaaatgagtagttctcaaactagtacatttacagattctgcattatctgataaagtaaaagaatttcttactagattcaaagataaacaaggcaattacaagtacgttgatgcaattgatgcaatgatgccaaaaaatgcaaaatacattgtagttgattataatgatcttgtaactgaacctcacatagaaattatattttctgaaaatccagatagaatttttgatgcttttgcaagagcaataaaagaagcattacaaacaagatttccagaatatgctgaaaaaattaaggaagaagttcgtgtaagaatagctaattttccacttgaaagaagtttaagacaaatcaatgctgaaacaattggaaacattaccagtgtttctggaatggttgttagagcatctgaagttaaaccccttgcaaaagaattaatttttgtttgtcctgatgaacatactaccaaaataattcaactaaaaggaatggatgcaaaaattccaatagtttgtgataaccctagctgtaaacaaagagattttgaattaaaaccagaatctagcaagtttattgattttcaaattcttagattacaagaattacctgaggatttacctccaggacaattacctcattacattgatgtcactattaggcaggatttagttgataattcaagacctggcgatagaattattcttacaggtgtagttagagtagaacaagaatctgttgctggcgttcaaaggggtcatagtggcttgtatagattacgaattgaaggaaataatatcgaatttttaagtggtcgaggttctaaaactgatagaaaaattggtagagaagaaatctctcctgaagaagaaaaacgaattaaatctcttggtcaaagttctgatgtttatcaaagattaattgattcatttgcnccncanattcaaggtcagtcattaatcaaagaagctattttgttgttgattgttggttctaaccaaagattgttaggtgatggtagcaagattagaggtgacattaatgtatttttagttggagatcctggtactgcaaaaagtgaaatgttaaaattttgtgcaagaattgctccacgaggtttgtatacttctggtagaggttcaactgctgcaggacttacagcagctgtagttcgtgataaaacaggaataatgatgttagaagcaggtgcagttgtacttggtgatcaaggtttagttagtatagatgaatttgataaaatgaaacctgaagatagaagtgctctacacgaagttatggaacaacaatccgcaagtattgcaaaaggtggtattgtagctacactaaatgctagaacgtctatcttagctgctgcaaaccccatgtatggaaaatatgatccttttaaaaatatcacagaaaatgtaaatttacctattccgttattgacaagatttgatttgatttttgtagttagagatattcctactaaagaaagagatacacaaattgcaaaacatatcattagaagaaatacaactttgggaactgataaaaaatctgtaattgaagttgatttgttaacaaaatatctttcatatgcaaaacgtggtactcctgaattaacaaaagaggctgaagcaaagattcttgattattatttacaaatgagaaatgtagagtctganganatgattactgtnacncctagacaattngagggnattatcagactttcaactgctcgagcaagattactcatgaaagataaggttgaagaggaagatgctgagcgtgcaatatttttaattcaaagtatgcttcaagatgcaggtgtagatgttaatactggtaaagtagatcttggtgttttacaaggaaaaccaagaagtgaagtttcaaaaatgcaattatttatggatattttgaaaagtttagaaggtgataacaaagtggcagttgaagaaagaacatttgttcaagaacttgaaaaaagtgaaaaatttactgaagaagaagcaagaaattacattagaagaatgcttagagaagcatctatttatgaatcaaaacccggtcattataaccgagtatgaaaatagaaaaattaaaacttccagactctgcaattgattttttaaaatcacaaggatttgaaaaattatatcctccacaagctgattgcattaaatctggattattggatggaaaaagtattttagtttctgcacccactgcaagtggaaaaactttgattgcaatgcttgcaatacttaattatctttcaaaaaataatggtaagattatttatcttagtccattacgtgcattggctgctgaaaaatttgcagaatttaaaaagttagaaaaaatttcaattggcaaaaaaattaaaacaagtatttctactggngattttgaacacattgaaaaaaatttagaaaatagtaacgtgttaattttaacaaatgaaaaaatggattccattattcgacatggtgctgaatgggttgatgaaattggtttagtaatatctgatgaagttcatctaattggagatgaaagtagaggccctacacttgaaatgattttaactcatctcaaactattggatttaaaacctcanattgtaggtcttagtgcaacaataactaattctgatgaaattgcaaaatggcttgattgtaaattagttaaaaatgattggcgtcctgttcctttatctgaaggggtctatgatggaggaaaagtaatgatgagtgatggtgaaatatttgaagtaaagcccagtttacgaggaattcctatcgatttaggcgttcaatgtgttcaacaaggtggccaatctctggtatttgctgaaactagagtacgttcaaaatctcttgcaacaaaagctgcagacatagtttccgaaatgctagaaaaaaaagaattaacatcattagagaaaacatcaaaacaaattctggcagaaaatgaacacacagaaattgtaaaaactttagcaattcttgttaaaaaaggagttgcatttcatcatgctggattaaatcaaaaatgtagagaaatagtggaaaaagaatttcgtaaaggaacaatcaaacttttatcttctacaccaacgttggcagcaggtgttaatcttcctgcaagaagagttgtgatttcaaatattaatcgatacaatgcaaaagttggtgcaaatagacccattagtattttagaatacaaacaactttgtggaagggctggaagaccacagtatgatgattatggagaatccataattgttggaaatggaaatgctgaagatttaactgaatattacattcacggtgaaccngaaccaattatttcaaaaattactgatgataaatctcttagaactcatattctaagtgtaattgttacacatcctggaataaaaaaagaagaacttcttaaattctttttacaaacattaggnggattacaatcatctaaagcaactctaagttttgcaattaacatcgctttacgttttctttctagtcaacaattaataattaaaaaagatgaaagatttgctgctactccatttggaaaaaagacatctatgctttacattgatcctttaactgcaacatcttttagagataccatagataatgtatcacaacaacgaaaacatacatttggatttttacatttaataacaacttgtgaagaattttttcctaaattctcacttcgaaac

SEQ ID NO: 1571 - DNA, 4000 bp, Escherichia coli
  misc_feature (416)..(416): n is a, c, g, or t
  misc_feature (486)..(486): n is a, c, g, or t
  misc_feature (512)..(512): n is a, c, g, or t
  misc_feature (527)..(527): n is a, c, g, or t
  misc_feature (716)..(716): n is a, c, g, or t
  misc_feature (731)..(731): n is a, c, g, or t
  misc_feature (797)..(797): n is a, c, g, or t
  misc_feature (806)..(806): n is a, c, g, or t
  misc_feature (1241)..(1241): n is a, c, g, or t
  misc_feature (1334)..(1334): n is a, c, g, or t
  misc_feature (1440)..(1440): n is a, c, g, or t
  misc_feature (1574)..(1574): n is a, c, g, or t
  misc_feature (1805)..(1805): n is a, c, g, or t
  misc_feature (1985)..(1985): n is a, c, g, or t
  misc_feature (1992)..(1992): n is a, c, g, or t
  misc_feature (1994)..(1994): n is a, c, g, or t
  misc_feature (2123)..(2123): n is a, c, g, or t
  misc_feature (2429)..(2429): n is a, c, g, or t
ttctcagggaaattcctgcttcagcacaccctatggcggtcatggcaacaggatgttcaatgctaggaaatattgagcctgaaaagtctatagactctcaaatggactcaatcaatcgtatggttgcaacgatgccttcaattgttacttattggtataagttttcacatgagaacgaagatattagcttgattaatgatgaagatacaatggctggccatttcttgcgcatcttgcatggcaaaactccatctgatcttcatagaagagttatggatgcatcgctggttttatacgctgagcatgaatttaatgcatcaacttttactgctagagtttgcgcttcaacaatgtcagatatttactcatgtgttgtcgctgcaataggttccttaaaaggaccattgcatggtggngccaatgaagctgcaatggaaatgattgagaactggaaaactcgagatgaagcaagagaaaatattctanacatgcttgcaaacaagggaaaaatnatgggttttggtcangctatatactccgagcgtgatcctagaaatgcagtaattaaagaattttcaaaagagttatcacaagaatatggagatgactctttgtatcaagtttctgaagaagtagaaaaagttatgtgggatgagaaaaaattatttcctaatgctgatttttttcatgcttcagcatatttttacttgggcatnccaacaaaattattnacacctatttttgttatgtctcgagttactggctggacagctcactgcatggagcaaagagcaaanaatagaatnatcagaccaagtgcagaatatactggcccagaaacctctgtctggattgatttagaagatagggagtaaattatgtcgaataatgtagaactgaatataaggtcaggtcccgactctttgcttgttgaaattgcagaatatgtcacgaagcaaaatatagattctgagcttgctctttcgaccgcaagaaattgtttgattgataccgttggttgcgggttgcttgcgctgacctttccagcttgcacaaaaatgcttggaccaatcgtgccaggtacttcggtgccaaatggcgtcagagttccaggcactaattttttgctagacccggtaaagggagcatttgatattggatgtatcatccgatggcttgattataatgatacttggttagctgctgaatggggccatccatcagacaatctaggagcaatnctatcaatagctgattatgtatctcaagaaaatgtagcaataggcaaggatcctctaacaatgagagatgttttagagtgcatgattatggcncatgaaatccaaggcgttttagcactaacaaatagttttaatagggttgggcttgatcacgttgttttggtgaaagttgcatccacagctgttgtaacaaagctantgggtggaaactcagatcaaattatggatgctgtaagccaagcttgggttgatggacagagcttaagaacataccgtcatgcaccaaatgctggttcaagaaaaagctgggctgctggtgatgcaactagcagngccgttagacttgccttgataacactttcaggggaaatgggctatccaagcgtgctatcagcaccaacttggggctttgaagatgtttctttcaaaggagagaaactgtcattgagccaaccgtttgatacttacgtcatggaaaatgtattgtttaaaattagtttccccgctgagttccacgctcaaacagctgttgaggctgcagtgacactgcaccctgaaatagtnaatagacttgatgaaatttctaatattgaagtcactacacacgaatcagcaattaggattatttctaaatcaggcgtgttaaataaccctgctgaccgagatcattgcttgcaatacatgattgcaattggattaatccatggagatcttattgctgagcattatgaagatgacgttgcnagtgatncnagggttgatgcgcttagagagaaaatgactattaaagaagataagcgttatacagcagagtacttagaagctgacaaaagatcgatcgcaaataaaatacaaatcttttttaaagatggctcatccacnaatgctgttgaagtagagtatcctattggccacaagcgaagaagggaagagggtattccagttttagaaaagaaatttgaaaaaaatcttggaaaaatatttgatcaagatcaagtcgatagtattttatctcaatgtctcgaccaagcagcgctcgaatctatgagcgtattagactttcaaaaattattttttgtagaaaagaattctttctaaaggttttcaggaatataccgcaaagcttcctggctaaagagaaaggtttgatctgaataatgtgctgatgcagggtctctggatgacccntaattatgcatcccataaataatttttccctcatcttgttctgcaataataaaaaatagcccatctccacctgacatatccaaacttttggtttgagagttaggtgttccgtatacagctcttaatgtatcgactgagccctgaattgggtaggatcttccgccacgtgaaattgtatttagcttgccccagggatctgaataatttctgcccattgtcgaagatattttttcacactcttttctggaagattcataagaaggggtaggcttgctattcatttctgatatccattcttgagccatgatgcacattcccagcccagcatcagtattttcaaaagtagttttaccatcccaggcctcaaccgtctttttaacatcttggtaagatgcggccattgattttaggtattgatattgtcttgagttttttgaataagagttatcaaacttaatctcaataaaccgatctaagtctattaaatcatcagtagaaaaaagttcatttgcaacatgagaacgattcgtcaatcttttttcaaaatctacatgctcatttattttttgttgctttagcgagtgcttgcccattactgaaaagggattttgatttgtgctttgaatccagccgttcaaaggattaataaatgttgggagattgtcaacaagtattccggcatcccaattttcttttgaagcagacaccttaatgatttgccttgcttccaatgcattaattcgcattggtattcttccgttatagaaatagcctatatttctttgagaatccatagttacaaagttaaagctgggtatttttctgctttttagcttctcaccaaaatcgtatacatcttttgcattattaatttcataccaaccatccatttcatcaaaagaatattccttagaatgtttaagagcaaaagactttccatttatttctagtactggaccaaattttgaatatttaaattcttgttttgtcttaagtgtaaggatgcccaaaattttaaaagataaataatcttcctcaattttgaagggtgcccactcttcatctaagagatattgatttgagttatctgggttgatggtaagttcaaaaatatccataacatctgggcgatttactgttgcgccccagccaatattttcattgaatccaacattaacaagaaaagaacctggaaagtttcctccatgagccctccacccagaatcactctcaatattcagctcataccaacccacaggtcctgccaatggttgatgagagttaattagaagaaacgaagatcctgaatcagttttaattgaatttacagctatggcatttgatccagtaggaatagattgagtttcttgttttgtcatttgcgctaaatctctatccaagccagcaaaaaataaatgctgtatatacgaccccgctaaaacatcctcctgagaaataggatgaagggaaagattaactttatctggattactttttgcatattcatttaccccatcagcatatgcttgggccatagccagaacatttgatgaaagctgtttttttgcaag

SEQ ID NO: 1572 - DNA, 4000 bp, Escherichia coli
  misc_feature (3348)..(3348): n is a, c, g, or t
  misc_feature (3579)..(4000): n is a, c, g, or t
agcaggctctgccatatttcgtgctgaaggaaatgccactcagacttcctcttctcaatggagtggaatacgccacagccatgacaagacagttccccaatgtcagtgaactccttagcgaacattccctcagacaagccgtcgggaaactggctggaacagaaacacagctgttggagaaagataacaagaagcaattgtgtcggtacatcgaaagcgatgcgaaccagaagttactcgaatagcttcgcaacgacataggtaagattatctgacacaaagccatttggaggcgccaaactgtcaaatatatgttaatttttcatggctaatgagtatatttctgaacaatcagactacaattagaaataaatgtagtaactttgtacacaaaataaagtataaaggcatggaaggcaagagatacagcaacagttttacctcctcaggaatggtaaaagaagaaggaagggcagcatactacaaactgctggacagcgtgcgtgatggtgatactgtacgcattaagcgcggggtgtatgccactgccgaacagttggccgacactatgattgatgttgaagccattgttccgggtggagtgctatgccttttctccgcatggaatgtgcatggacttaccacctcgctgccacaagcctaccacattgccgtgaagagaggcaggaaagtcacgctcccggtcttcccaaaaatcgaactgcaccacatcactaacacgatgtttgacataggtgtcgaagaacagataatcagcagctatcgcatccatatatacaataaggaacgatgcgtatgtgatgccgtgaaataccgcaacaaggtcggtatggacgtttgtgccgaagtggtaaacagctatctggcactacccggcagaaacctttccctgctttttgactatgccgacaaactgagagtaagaagaatccttgaacagtatattgcactaaaactatgagtgaaatcaaaaactatggaaaatccatcagggcaaggctgctcaatgtagccaagcaggaggaagtgttctatcagaccatcctgaccagatactttcaggagcgtctgctgtaccgtatttcccagacacgttatcgtaataacttctacctgaaaggcggtgcgttgatgtacgcctacgagagatttgccgcccgtcccacattggacatagactttcttggcactcacatcagcaatgatggcgaacgcatagtcgaagcattccgtgaaatatgtgcggttgattgcaaagaggatggtgtacagtttgcttgcgacaagattgaaccccagaacatcaccgagttcaaggattatcatggtatccgtctgagtattccagtgacaatggactctatcgcgcaagtgctcacgatggacattggatttggggatgtagtgacaccgcatcctgtttcattggactaccccctgttgttagagggactgcccgaagcaagtatccttgcctattccacagaaaccgtgatagcggagaagatgcacgccatcatagatttggcagaccaaagtagccgtatgaaagactattatgacatataccacctgctcacatcattccaatatgacactgccattttgcaggatgccatcaaccatacctttgagaatcgtcacacaccctataatgctgacacaatgtttttcagggaagacttccccaatcatcctcagatgcaggttcgatggacggctttcctgaggaaggctactatcaatagtgccctgtcatttcccgaggtggcgcgttggcttcaagacacattaagaccatattggacagcatacggacgtatgcaacactgaccgaacttgcttactaagatactcttctatgcggacttggttactctacattgattcaaatgtaactaagtctgcattttattttgcgcaaattcaaagcgaaatcgctattttattgcaattttcccttgtcataaaggaggtgtgtcaaaatgcgcaccttcttttttttaagcacaaagccccgactttcacaagctggggctttgttattacctaaagattttgtatctttaggcataagattttcactatgacaaagatacattttcgtccttataattccaaccaaacagtgctttttcctcaaagaattgacgaggatattgcagagcatgatccagttcggatggttgacgctctggttgagagcctgaaccttgaaagtttcaggaagttgtataaggaatgcggccgcagcccttaccatcccaggatgatgctcaaggtcattctctatgcctatatgaacaacgtctattcctgccggaaaattgaaaagctccttcatcgtgacatccattatatctggcttgccggatatgagaaacctgatttcattaccatcaaccgtttccgcaaccgggtgaaaaaggaaatcaacgaggtatttacccaaaccgtactccttctctcttccaaaggcttcatcaggctgaatgtggaatacattgacgggacaaagattgagtccaaagccaataagtatactttcgtctggcgaaaaacggttgagcggaactgtgaacgcctgatgaagaagatacatgtcctgttagggcagatagacgatgtcatcgcccaggagaactcatcggaaagcaatgaggagattgagttcactccggccatgctgactgagatggctggagaattgcggaaagcacttgaacaggttcctgagccctccacgaaagaggaaaagactgcgttgaaaaagaaacgcaaacagctgaaggaactggaagaacacagggacaagctgcaggaatacgacaaccgtctgaacacgctacaggacaggaactcctattccaaaacggacaaggacgctactttcatgagaatgaaggaggatgccatgcgtaacggccagacaaagcccggttacaacctccagatcggcaccgagaaccagttcattaccgattttgcactctttccgaaccctacggatacactgaccatgatacctttcctgcaatccttctcaagcagatatgacaggttggcccatacggtggtggccgattccggctacggttctgaggagaattaccgcttcatgtcagaaaacggtatggcgggctacgtcaaatacaactacttccacatggaacagcggccgagattcaaaccggacccgttcagggcggaaaacttctactacaatgaagaacaagacttttgtatctgccccatgggacagaagatgcaaaggatagggactagacatgtgaaaacagcatccggatatgtcagcgaaaatgccangtacagagccatcagatgtgaaggctgtccgctaagatgccgatgttttaaagcaaaggggaacagaacgatagagttgaatcacagactcagaaaatacaagcaaaaagccaaagagttgctctgctcagaggaaggactgaaacacagaggacagagatgcatagaaccggaagccgtgttcggacaaatgaaaaacaatatgaattacaaacgtttccaccattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1573 - DNA, 4000 bp, Escherichia coli
  misc_feature (804)..(804): n is a, c, g, or t
  misc_feature (1008)..(1008): n is a, c, g, or t
  misc_feature (1035)..(1035): n is a, c, g, or t
  misc_feature (1039)..(1039): n is a, c, g, or t
  misc_feature (1302)..(1302): n is a, c, g, or t
  misc_feature (1404)..(1404): n is a, c, g, or t
  misc_feature (1407)..(1407): n is a, c, g, or t
  misc_feature (2126)..(2126): n is a, c, g, or t
  misc_feature (2171)..(2171): n is a, c, g, or t
  misc_feature (2174)..(2174): n is a, c, g, or t
  misc_feature (2276)..(2276): n is a, c, g, or t
  misc_feature (2297)..(2297): n is a, c, g, or t
  misc_feature (2330)..(2330): n is a, c, g, or t
  misc_feature (2402)..(2402): n is a, c, g, or t
  misc_feature (2459)..(2459): n is a, c, g, or t
  misc_feature (2685)..(2685): n is a, c, g, or t
  misc_feature (2819)..(2819): n is a, c, g, or t
  misc_feature (2833)..(2833): n is a, c, g, or t
  misc_feature (2848)..(2848): n is a, c, g, or t
  misc_feature (2855)..(2855): n is a, c, g, or t
  misc_feature (2858)..(2858): n is a, c, g, or t
  misc_feature (2867)..(2867): n is a, c, g, or t
  misc_feature (2906)..(2906): n is a, c, g, or t
  misc_feature (2909)..(2909): n is a, c, g, or t
  misc_feature (2924)..(2926): n is a, c, g, or t
  misc_feature (2928)..(2928): n is a, c, g, or t
  misc_feature (3011)..(3011): n is a, c, g, or t
  misc_feature (3065)..(3065): n is a, c, g, or t
  misc_feature (3080)..(3080): n is a, c, g, or t
  misc_feature (3920)..(3920): n is a, c, g, or t
cgcgtggctaccgcgcggcgttgggcactcgtgacggtttcggcaagctcttggcggcgggcctttccacggttatggtgcttcagctcttcgtggtggttggcggtgtaacccggttaattccgctgaccggtttgaccacaccgtttatgtctgccggtggttcatccctggtggctaactggattatcgtggcgttgtggctttcgatttcgcataccgcgcgagcgcctcacgtcgtggtcgggttcgacgttcccgaaagtatcgaccacgaagactacagctatgaatctgagggcgcaaccagcgttctcgcccgtatttcaactcaacaagcaggaggtgaccgcaatggatagggcaattcgccgcatgtggatggccgcaggttgcgtttttatcctgctcatgggtacgttgagctatatccaattcttcgacaccgaatctctcaaagataacccgtggaactcgcgttctctgtacgataactacggtgccaaccgtggctctatcgtggtcgatggaaccgaaatcgcctcgtcggtgaaatcggatgatgagtataactatcagcgcgtgtactctgagccggaaaagtatgcggcgctgacgggttatttctcgtcagtgtacggttctaccggtgtcgagtccgctatggacaaggagctttcgggtacttccgacagccagttctacgatcgtgttgctcagctcttctcgggttcttcggcacgcggtgcgagcgtcgagctcaccgtggattccaagcttcaggagcttgctaacaacctgctncagggccgtaagggttctattgtggcgattaaccccaagactggcgaaatcttggcgatggcctcgtctccctcatatgacccgaatacgctcgcatcccacgatgggtctacggtagtcagcaactatgaggaactgaactcgaatccgaataacccgctttacaaccgtgctattgcgggtaacacctattcgcccggctcnaccttcaagattattgatgccgtcgcngctntggagtccggcaaatatgatgcgaactccacgatcgataaccccgcacagcttccccttccgggaaccaatgtgtcgcttccgaactatgcgggcggtcagtgtggaggacgcaccaaggctacgattgaatgggctatggcgcagtcctgcaacactccttttgcgcagatcgcaatggatttgggtgaagataggatctctaggactgccgaaaactttggttatggtcaggatttgaagattccgctggcggtggctaantcgagcttcccgaagggtatgtcgcagagccagctggcgcaggcatccgtgggtcagtacgatgtacgcaccaccccgctgcaggtggcgatgacttctgcngcnatcgctaacggcggtgtgcagatgaagcccaatatgattcgttctgtcaaaaccagtaacttgagcgtgctctacgagttctcacccgagaagttgcgcacctcaacttctactaaagtcgccgatcaggtgaaacaatggatggtgaactctgtggataacggtattgcccgtaacgcaggcgtgcccgggtataaggttgctggtaagaccggtaccgcagaaactacgggtggtttgaataactcttggtttaccgggtttgcacccgccgatgatcctcagatcgccattgcggtggtctatgaggatatggatgcaacaaccggttcccagctttcgacaaatgcaggtaaacaactttttgaggcggtgttgaacaagtgaggccttcggctgatatcaccttgggcgggcgctacaccctaaccgaacgtatcgctatcggcggtatgggtgaggtctggaaagctcgcgacaaggttctcggacgcaccgtcgccgttaaaatcctgaaagaggagtatacgggtgaccccgggttcttggagcgtttccgtgcggaggcgcgccatactgcgctcctgaaccaccccggtgttgccaatatgttcgattacggtgaagaggataactctgcatacctggtgatggagctggttccgggtgagccgctgtcgagcatcatcgagcgcgacggcacgctgccgccggatcgnatcctgaactttattgcgcagacggctcgcgcgttggctgctgcncangctcagggcctcgtgcaccgcgatgtgaagcccggtaacctaatgatcaccccggatgaccgggtgaaggttaccgacttcggtattgctaggcttgcgaancaggttccgctgaccgctacnggtcaggtgatgggtacagcccagtatttggcncccgaacaggcaaccggtcaacctgcaaccccgtcctccgatatgtactcgctgggtattatcgggtacgantgcctggtcggtcaccgcccgttcacgggtgaatcacagatcgcgattgctctagcncaggtgaacgatccgccaccgccgctgccggagagcatcccggcgcccgcccgcgccttgattatgtgcctgcttgctaaggatcctgcggagcgtcctaaggatgctaccgcgctggcatccgctattgatgctattcgccgtcgcgatattcctgcggcgattaaggccgtgcccacgctggaggcgttcttgccggagaatctggatactgcccagacctccntgatcgccgagcctatttcggcatccgccgctccgaagttcggatctgggtcgcacttcacgcccggtccttcgaccgctccgattcctgagcccgggtcaaaggctgcggccgcacgtacggcacaacagggnccgaagaaacgcanctgggtatggatcgncgctatngtngcggcactngtgcttattctcggtatcctctgggctgtctgggcggcnaanagccgtgcaaccccnnntncgaataccaccagctcggcaacacccagctctgcggaaggtaccgtcacggtagccaccccgagcgaggagtcctcggctgcnagcagtactcagaagcagaaaattaacctgcaggcacgcagctacgagggtcgnccccttcaggatgtngtcaatgacctgaagaacctgggtctttcgcccaggactgaaagtgttgagtctgaagagccagccaacaccgttctgtcgatttcaccggctggttcggtagacgaaggcagcaccattaccgtgcgttattcaagcggttccaggggcgcgaccctacctaatgttgatgggaagaactacgaagaggcttctcggacgattacctcgcttggtgttgacgtgaaccttcacttcgagcattcggacaccgcacagcccggtacggtgctgcgcaccagcccttcttctggcactaaagtgtcagttcctagtaaggtagagatgtatgtagctaatgagtcttcaggtacgaggacggattctgactcgtcgccatccgcagctacgccttcaggcgcgtcgacttcttctagtcctcgtactgggcgttagtgtctgagtccactcacatcaaaaactatttttaccccaggagaacgtatggacctgttggttcctgaaacggtagatggccgttataaggtactcgatgttatcggtaccggtgcgatggctaccgtatacgcggcggaggatactcgtctcggtcgtaaggtcgcgatgaagatcctgcgcccggagcaggcccaagacaaaaccttccgttcacggtttaaacgtgaggcggaggctgtcgcatccctgaacaaccccggtatcgttgcggtgtacgacacgggcgcttattccccgtcagatcccaacagcggatacggtgttgatgatgccgccgacgatgacgaggctaagatcccgtacatcgttatggaatacgttgatggcaggacgctgcgcagngtcctttcgtcgggcgggtacattcccgtgcgtgatgcggtggggtacgcagagcagcttttgagcgctctgaaatacag

SEQ ID NO: 1574 - DNA, 4000 bp, Escherichia coli
  misc_feature (354)..(354): n is a, c, g, or t
  misc_feature (373)..(373): n is a, c, g, or t
  misc_feature (869)..(869): n is a, c, g, or t
  misc_feature (931)..(931): n is a, c, g, or t
  misc_feature (1991)..(1991): n is a, c, g, or t
  misc_feature (2315)..(2315): n is a, c, g, or t
  misc_feature (2517)..(2517): n is a, c, g, or t
  misc_feature (2525)..(2525): n is a, c, g, or t
  misc_feature (2643)..(2643): n is a, c, g, or t
  misc_feature (2933)..(2933): n is a, c, g, or t
  misc_feature (3095)..(3095): n is a, c, g, or t
  misc_feature (3712)..(3712): n is a, c, g, or t
cgcagaaacccttgattatggatccattttgtgtgaatcttatggcatgcccgaaattattgccttgcacccggaagcttcctggtcccaaatttcgccaatcgatgcagattgggacgccgcagacccagtaatgctcggcgccatgtttagtcacatggtgttaatccgcacttttgaagagtgtgtgttgcagttagccggtgaagggctgattcacggaccagctcactccagcatcggccaagaaggcggtgcggttggttcggccttagcccttattgccggggatactgtgaacgggtcccaccgcggtcaccatcaatttcttgccaaagtgctggcgcatttggncccagagggcattgatccntccggagaacttgagcaaccaattcgtgaagtgctgttgaaaacgctggcggaaatctgcggcctggatcgtgggtttagccacggtcgtggcggttcaatgcatttgcagtgggaggaggccggtgcaatcggcaccaacgccattgtcggcggtggcgtcccgttagcggcgggttcgggttgggcccatcagcacgccggaactaacaacgttgccgtcacttactttggtgatggagccgcaaacatcggatctacacttgaatccttcaatctcgccgctgcgtggaaagttccagtgtgcttctttattgaaaataatctgtacgcagtgtcaacgacggtatttgaagctacgggtgaaccgcgactttctgcccgtggtcctggattcggaatcacgagtttcaaagtcgatggcatgaatccactcgcggtctttctcactatgcaagcagcgaatgaacacatgagatcaggcaatggcccaacgntcgttgaggccgacgtgtaccggtacttccaccaaaacggcccgttccccgggagcgcattnaaataccgcactaaagaggaagaagcgtcatggcgcgcccgtgatccaatcgatcaagttgcctttcacctcgtacgtcgcgagattcacacccaaaacacacttgattcattcattgagcaagccaacgcactcatggtcgagatcacctccgtgcttctggagcccgtcgagggtggcaagcccaatgaacgccgcattaagccttccgagtggccagatcctgcttttgtcaatgtcggggtccgcggcgacctttccgaactgcaagggtctcactacaaggatcgtgaagactttgagggtgaaatcgccgaagtcaaattcatcgatgcggtttccggggtcatgttcaatcgcatggaaaaggatccacgtgttgtgatcatgggcgaggacattcaccggctcaatggcgggaccaatggcgccacccgaggattaaaggacaccttccctgatcgggtacttggtaccccgattagtgagaatgcatttaccgggctagccggtggtatggcgctcgatggaagattccggccggtgattgagttcatgtacgccgactttatgtgggttgccgcggaccaactcttcaatcagatcggtaaggcccgtcacatgttcggtggaaaaagccccgtcccgctagtacttcgcagcaaggttgccatgggcacaggttacggctcccagcactccatggatccagccggaatattcgtcaccaacccgggttggcgagttgtcgcaccctctaatccatttgactacgtcggtttaatgaatacggctctaagttgtgacgaccccgttgttgttctcgagcacgtggacctctacacctccagtggccccggtgttcccgatacatacgactatttcctccccgttggaaaagccgcggtcaaaaaatctggttcagaggtcacagtgatctcttatctagccatgaccaattacgtcatggccgctgtggaaggtcaaagtgcgattgatgctgaagtcatagaccttcgctggcttgatcgggccagcatagactgggataccattggtnccagcattaaaaagaccaacaaggtgatcattgcagagcaaggcgcattgggtacttcttatggaggctggctctccgacgagattcaacgtcgttacttcgattggcttgatcacccggtcctgcgagtgaccgggacgcaaagttctcccagcatcagcaaagtcctcgaacgggccgcgattgctcgcaccgaggaaatggaagcagcactgagtgcgttggcgaaggattaccatggctgaattactcctcatgccagaagttgcaacgggcacaacatcagcggtcctatctgcctggccgatgccggaaggttccacnttcaaagcgggagacattcttgcgatccttgaaacagataaagccgtcgttgacgttgaagctgaagctgacggaattatgcacacccacttagtttctgccggaacggacgtcaatattggcgtccccattgctctgaccgccgcggtgggcgagcagattacagataaatcagcggcactacaggaattgggttatcaanccgacccngtcacgcatccggtcgaactaagcgatgtcccagctgcgacaccaaccccggcgagcccctccaacagcggtcgaatttttgcaagcccactcgcccgcagggtcgcccgcgaacgcnacgtagacctcaccagcgtggttggcaccggaccttccgggcggattcgacgcaaggatcttgaactcgctgcgctcactcctgcgctatcacccgcattttctatgccaactattgcatctactccgatcgcagaaaccgctcaatccggcacctcgatccagatcccacatacgaaattgcggaaagtgatcgccaaccgtttaactgaaagtaaaaccacggtccctcatttctatcttcgcgcgagcatgaaggttgaccgtttaatggcgatgcgggcagaactnaatgacgactcgaaagttcgtatctcagtaaatgatcttctcatcaaggcaatcgctgccactcacattcgggttcctgaactcaatgtgatttggactcccgatgctgttgtgcaatttgcatcggtcgacatttccatggccgtagcaacagaccagggncttttcacccccacacttcgttcggtggaaaatatgagcatcacgcaagttgcattgacgacaaaagacttcgctcagcgtgcccgaaccggatcgcttcgccaaaatgaactcgaaggtggaagcatctcaatttcaaatctaggcatgttcggggtggaagatttcgctgcaataattaatccgccacaagccagcatcttggcggtcggggggatctccactgagccagttgttgtcaacgaccaactcaccaccggtcaactaatgcgcgctaccctctcagttgaccaccgccccgttgatggtgcgaacggtgcccgctggctacaagagttcgtgactcttattgagtcaccgagcaaaattcttgcttaggctgtccacaaaaaatatactgcgcaagttactccaagccagtaagcgcgtcaggttttttgggctggatggtattaacgatgacggccatgaacgccaagataactccaagaataagtggcgcatccagatagccgttgacaactaggtcgagcacgagtgaaccaactagttgtcccgaaattgccaataaactcaagcgcagtactccaacttttcccaccacccatgacgtggtngcaatgaaaatcacgccgacgacaccaccaaagtagagccagaggggcccggatggaagggccctgggcgccacggttcccaccaataccatgaccccaaataccaggatcaaaattgacgcacccaccacaaagttcaaccatgcagccaccagcggttcacccgagacatcacgcaccctaccgtttattgcttgttgaactgacacaccaataccggcgacaaaacatagtgccacaagccagatcggaatctcagcgctatccagccgtccagataccgctacg

SEQ ID NO: 1575 - DNA, 4000 bp, Escherichia coli
  misc_feature (29)..(29): n is a, c, g, or t
  misc_feature (73)..(73): n is a, c, g, or t
  misc_feature (83)..(83): n is a, c, g, or t
  misc_feature (134)..(134): n is a, c, g, or t
  misc_feature (173)..(173): n is a, c, g, or t
  misc_feature (188)..(188): n is a, c, g, or t
  misc_feature (203)..(203): n is a, c, g, or t
  misc_feature (212)..(212): n is a, c, g, or t
  misc_feature (224)..(224): n is a, c, g, or t
  misc_feature (251)..(251): n is a, c, g, or t
  misc_feature (296)..(296): n is a, c, g, or t
  misc_feature (359)..(359): n is a, c, g, or t
  misc_feature (362)..(362): n is a, c, g, or t
  misc_feature (365)..(365): n is a, c, g, or t
  misc_feature (391)..(391): n is a, c, g, or t
  misc_feature (428)..(428): n is a, c, g, or t
  misc_feature (438)..(438): n is a, c, g, or t
  misc_feature (440)..(440): n is a, c, g, or t
  misc_feature (442)..(443): n is a, c, g, or t
  misc_feature (452)..(452): n is a, c, g, or t
  misc_feature (467)..(467): n is a, c, g, or t
  misc_feature (515)..(515): n is a, c, g, or t
  misc_feature (529)..(529): n is a, c, g, or t
  misc_feature (543)..(543): n is a, c, g, or t
  misc_feature (554)..(554): n is a, c, g, or t
  misc_feature (575)..(575): n is a, c, g, or t
  misc_feature (606)..(606): n is a, c, g, or t
  misc_feature (614)..(615): n is a, c, g, or t
  misc_feature (639)..(639): n is a, c, g, or t
  misc_feature (747)..(747): n is a, c, g, or t
  misc_feature (749)..(749): n is a, c, g, or t
  misc_feature (782)..(782): n is a, c, g, or t
  misc_feature (791)..(791): n is a, c, g, or t
  misc_feature (899)..(899): n is a, c, g, or t
  misc_feature (908)..(908): n is a, c, g, or t
  misc_feature (941)..(941): n is a, c, g, or t
  misc_feature (947)..(947): n is a, c, g, or t
  misc_feature (1067)..(1067): n is a, c, g, or t
  misc_feature (1073)..(1073): n is a, c, g, or t
  misc_feature (1109)..(1109): n is a, c, g, or t
  misc_feature (1151)..(1151): n is a, c, g, or t
  misc_feature (1235)..(1235): n is a, c, g, or t
  misc_feature (1241)..(1241): n is a, c, g, or t
  misc_feature (1304)..(1304): n is a, c, g, or t
  misc_feature (1512)..(1512): n is a, c, g, or t
  misc_feature (1539)..(1539): n is a, c, g, or t
  misc_feature (1616)..(1616): n is a, c, g, or t
  misc_feature (1675)..(1675): n is a, c, g, or t
  misc_feature (1719)..(1719): n is a, c, g, or t
  misc_feature (1965)..(1965): n is a, c, g, or t
  misc_feature (2004)..(2004): n is a, c, g, or t
  misc_feature (2061)..(2061): n is a, c, g, or t
  misc_feature (2068)..(2068): n is a, c, g, or t
  misc_feature (2124)..(2124): n is a, c, g, or t
  misc_feature (2169)..(2169): n is a, c, g, or t
  misc_feature (2187)..(2187): n is a, c, g, or t
  misc_feature (2193)..(2193): n is a, c, g, or t
  misc_feature (2208)..(2208): n is a, c, g, or t
  misc_feature (2295)..(2295): n is a, c, g, or t
  misc_feature (2301)..(2301): n is a, c, g, or t
  misc_feature (2304)..(2304): n is a, c, g, or t
  misc_feature (2307)..(2308): n is a, c, g, or t
  misc_feature (2310)..(2310): n is a, c, g, or t
  misc_feature (2313)..(2313): n is a, c, g, or t
  misc_feature (2325)..(2325): n is a, c, g, or t
  misc_feature (2355)..(2355): n is a, c, g, or t
  misc_feature (2373)..(2373): n is a, c, g, or t
  misc_feature (2379)..(2379): n is a, c, g, or t
gcgatttagtatgcgatgagaccaacctngcctataaggcttataaggctttggcgcctttttgtgaagtgcngcgccctgtncatatccgtctggaaaaacggcttcccgtggcagcggggctggccggtggnagtgccgactgtgccgctgttttgcgcggcttgaatcgnttttgggaccttaanctgaaagcttccganttggaacgnatcggggcggcnttgggggcggatgttcccttttgtgtnaccggcggcacggtccgcggtagcggtatcggtgatattctcacncctttgccgtcattgccggcatgggaagttcttatactgcatccccatgtctgcgtcgagacnggnaangcttatgatctctttgataaggccgngtcggtatcttttgtcgatgtaggtgaaatggttgantccgtgcgtngngnntcttttganggtatttgcagggcnatgggaaatacctttgagtccttcatagtgccgctcgttcccgaagtnagtgagtgtaaagnggctttaagtcgtntcgggctcaancctcttatgtcgggaagcggncctaccgtttttgcccttgtaccgcctgagngagacggnnctttttttgcgaaacggttggaanaagaaatgaaaaatacggatgtaatgttaacgtccttaatataggaagggattaaagtgaacaaagaacataaattggaacccatacgcttggacacgtataagcccntncgtgacgttgtcagtgaagctctaagacaagcnattaaaganggcatattaaaacccggagaacgcttgatggaaattcaactggccgatgagttgggcgtaagccgtacgcctattcgggaagctattcgcaagcttgaattggaaggntttgtcgtnatgataccgcgtcgcgggacgtatgtagccganatttcnttaaaagatgtagttcaggtatttgaaattcgcagtgctttggaagagttggccgccggccttgcggcagaacgcatcacccccgacgaattggaagaactggaacgtattttagtaganattaangaatatatagaccgtgacgaatttgataaaatcgtngatacggatattcgttttcacggcgttctctatcgtgccagncgtaataacagactggtcgatattttacataatttacgggaacaaatgcttcgttttcgttccatatcgatgcattatcccggncgtttngccgcaacgtgggaagaacacagacagttggtggaaagcattgctaaccataacagtgttcangctcgaaaaatagcaaaaaaacatatggaaaattcggaaaaaacccttataatgggtattaagcgggataaggattcagcccgattggtacaagaattatttccgcactaagaaaaggagtaatacatggaagcaaatatgaaggtagataaataccacgagcatgaagattcatttgaagcattcttaggatacttggctaaggganccttcgtactcatgttcggccgactgnttattgcctgggctatgggtaccttataatcttataataagagtacaagaggctgtcatgcgaaagggaagcgaagntcgtttttgtatgtatgtacaaaaacgaaacgcttctctttttatttctcgttaaaggntggtatagatgaaatataatgcggttactgaagaattgttgcangaattgcgacaggttgtgggagaaaaatacgtaaagacggatccgtccgtcttggatatatataaggccgatgaaagcctggctccgtcttattgggttatgcccgaagcggtggtgttgccggcggatgcacgggaaacggcggaaattgtgaaacttgccaatcggtataaagtgcccttaacgcctcgcggtgccggaaccagtgtcagttgcggagccgtaccggcacaaggcggtattgtngttcttacggagcggatgaaccacattcttgaatgcagngaagagggaatgtatatggtcgtcgaagccggcgtaagaacggcggatattcaggcnttggccnagtcgaagggacttatgtatgccggcgacccgtgtagtgccgacagctgtcttatnggcggaaacttggcaaccaatgcgggcggtaacaaagcggttcgntacggcacgacgagaaancaggtntattccgttgaagtngtattgcctaacggaaaaatcgcaactttcggcagcactttgaaaaaatgctctaccggattttgtttagatcaactgattatcggnagtganggnacnntnggnattattacaaangccacgttgaaactcgtgcctttaagcccntttcatgtagacgttctngcagtntttacaaaattaagcgacgctgccgaagcggtacccaaaatcgttaaagccggtattaacccgacgtccgttgaatttatggacgtatccttcgtgcgcagtgcttgtgagtactgcaaactggatttgccgcacaaggaagacggctattatgacatcattactattgaggcttttaacgaagcggaactggatgaaaaaacggaaaaattgatgaagatttgcgaagaatgtcatgctacagacgttgtagaggctgacgatcgcgtttggagcgtacgccgtaattgcctggaaagtacgcgaacctattcgaaagtgggcacatcggaagacttggtcgttcctgttacgaaaattgcagattgcataaaaacgctgatggaagaaagcaagaaatatgattttcgtcccttctgtctggcccatgccggtgacggaaatattcactttcaaatcctgaaatgtgatatgagcgatgaggattgggaaacacagttggaacaattccgggctgttgcctatccgtatgtatactctttaggcggtaggctttcgggagaacacggcatcgggctgaaacgcttgaagtatatggaaaaatacacggatccggtagaactggaatttatgaaaactataaagcaggccgtggaccccaactggattatgaatcccggcaaagtgatagagccttaaaaccggtataattagactaactattaaaagtcaattggaaaataagattttttgaataagacatcaccagatgttttagatagcccggaggcaggcttaagcctcaatcagtaccttgaaaatcgcatgacaaatagaacatctaaacaggtgctctcagaaaaggatgtgaagttaatgaattatcttcggtaggcttcgcctgtaagttccattcggtatatggtgcgtaccagttttttcgttgcatgaccgatagcaacattatagtgcttgccttcgcctatcttctttgagaggtaagctccgaaattctcatcccacttgcagacaaatttcgcggcattgaacaaagcatatcttagataacgagaacctcgtttctccatatgagaatagctagaatccagttgacctgattggtaggtagaaggtgacaaccctgcaaatgccagtatctgatcagcatagttgaatcgagtgaagtcaccaatctctgcaaggatcatagctcccatacgatagctaatcccagggattgtcataatcggagagttacaagtgtccatgatggatttgatggaatcttcaatttcatcaatctcttccgtcatcaccttaatcaaatggatggtgtgctttagttccattgattttgccggtatcacagagccgatagagtccctggcggtgtttcttaaagtaatcgccatatctcgtccgtaatggcctttagaggctgtttctaggagatttttgagatgggtaagatgacattcggtaatgtaagaggctccgggaagtttggacagcaaggaatacaccgaagccatatgaaggctggggacgagtttttccagctccggaaaaaggatgtttacaagacgagctacggaagatttgagttttgcccgctcctgaa

SEQ ID NO: 1576 - DNA, 4000 bp, Escherichia coli
  misc_feature (127)..(127): n is a, c, g, or t
  misc_feature (451)..(451): n is a, c, g, or t
  misc_feature (606)..(606): n is a, c, g, or t
  misc_feature (730)..(730): n is a, c, g, or t
  misc_feature (751)..(751): n is a, c, g, or t
  misc_feature (841)..(841): n is a, c, g, or t
  misc_feature (1315)..(1315): n is a, c, g, or t
  misc_feature (1426)..(1426): n is a, c, g, or t
  misc_feature (2926)..(2926): n is a, c, g, or t
atcccacagcgtgagaggatcaatacttaacccgaagctgaagaaaaagatagctccaaagaaatcacgaaacggtacgacaagatgttcaatacgatcgcgatgttccgtttcagaaaatacaagnccaagcaataacgcaccaattgcttctgccacgtgaattgtttctgagaagcctgccacaaaaaacaataccgcaaaaacgacgattataaagatttcgtttgatgaaatatttaaaagtttatttagtagcggcgtggcttttcgagcaatgataaagaacagcatcatatagccaaacgcaattaaaatagatgttaaagatccagcaagcgatccgtggtctccaagcaccaaccctgaaacgacagaaagataaacggctaagaaaatatcttcaaacatgatgatccctaatatcagttccgtttctggattcgctgtncgttttaaatcaaccaatacttttgcgacaattgcgctggacgaaatcgtaataattccagcgataatcagcacttcaagaagaggatttcctgtcaggtatccatacaataatcctaaagtgaagttaattaaaatataaatagatcctcccancgcgatggacctgcctgatttaattagctttccaactgaaaattctaatcctaaataaaagagtaaaaagagaactccaattctccccatgaattcaataatctcttggctttcaataaacttnaaactgaatgagccaaactcnggagcatggggaccgaccgccatgcccagcagaatgaggaatggaataatcgtaaatttaaatttatgtgctagtatagccgctaaagcnactagtaacaaagctgtcccaacttcaaatactaaatgatccaattatgaactacctccttgtgaaagcaattctttaatgagcgtttttaaatttcctctttcaccagagatgacaagcgtatctccttcttcaattaacgtatctggtcctggggtggataattttttttgcgtgtttttaatgacggcgatgatagtgacatcatagttgctgcgaacgtcaatttcaccaattgttttactgtgagctttcgcttgtttttcaactttgtaccattcaatcactaagtcattgaatgccacttcaatggtttccattgcttttggcttgtaaatcatgccgcctaaaattgcagctagctgtcttgattccgtatctgttaacgtaatgtcaaaaatgctttcttctaaatctttttgatcgaagtggtagatttcacgtcgtccatcatcatgaatgataacgactacncggtttcctccgcttgtctcaatttcaaatttacggccgattcctggtaactccgtttctttaatcatcattgaatgatcactcctataaagtttttaaaaagaatttttnaattttgccgcgttatttgcatagaaaatccgcatagcaaataagcctaagaatagttggtaattttaggtttgaagaaaaggctgtggaaatttcaaccttttttatttaattgaggtaacttgattgaaagatttttggataaaaaagtgttttcttgaggataaaatacgcaatttgatgcgtcggaatgatgagtttggcactcgtccatactaaagcaaaagttactatcacgctttgtatgagggatcctatttgtttaacgctgtgcttagctcctggagacatgtgcacaatatccgtgtaatgctgaaccgaactttttgtgaccttcactttttcaaagtcgttatcaataaatttatctggcaaactcgcaaaaggcaaacagaatatcatgcataacaataagctcatccatacatttttcatcatctcacctctctttcttctgaactagtatctccttacttaaaagtatacgtactctgaaattcaatttcaagcaataagttttttttataaagatttaccttttttataatattttcttaacgtcattctttttagatatgtatgcgacacttaaaaaaatatacaaaaagctggctttctaagaagaaagccagctcatgttatagttcaagttctcccattcgaaggagttctacgactgcttgagaacgccccttgactccaagcttttgcatcgcattagaaatatgatttcgaactgttttttcgctaatgaatagttcactcgcgatttcttttgttgttttgtcctgtactaaaagctcgaatacttctcgttcacgctttgtaagtagcggtttaggttgaaactctttttctttcaatgtaaccctccttgcctgatcctgagttgaactatcggatgggtgtaaatttagtcaacatatcttatgtgcggtatgcctacgcggttactagttttagaaaaaatatgcaaaaaactcttttttacctttaaaaaagaaaaaagcctgaagaaagagccttcaagccattttcatatatttgataaacaccttttcatctcttcattccaaggcacgctttttcccgtttctttagaaatttgcaccattgttcctctcccggtgagtacaacctctctttgctcattttgaatcatatagtgtaaatcaaccgacgaacgtccaattctatgagcttttacaaaaacagatagcacgttgccaaaatacacttgtttgacataatcgcactgcaaatcagccaccaccggtatcgttccctcatgctcactcgtccacttttgcataaagccaatatggtgaaagaattccgtacgtatttgttcaaaataaacaaaaggaaccgtattatttaaatgcccaaacatatctgtttccgaaaatcttaccttgatctcctgcttaaacgaaaatgactctttccaatgatccatgtcttcaatatacgaaatattattcatctgtatttcctccnttcgtcatagacaaaataaaacctctccgcgtggagaggttttgagtgattatacttgatcgctaccaaagaaacttctgaatgcttgaattgttgtatcgcggttcaaagctgcgattgaagtagtcaatggaattccttttggacatgattgaacgcagttttgagagttcccgcagttcgctagtcctccatcacccataatcgtctctaaacgttctcctttatttaacgcaccggttggatgggcattaaacaagcgaacttgagaaagcggtgctggaccgatgaagtttgacttgtcgtttacgtttggacaagcttctaagcaaacgccacatgtcatacacttggataactcatacgcccactgacgtttcttttcaggcatacgcggtcctggacctaaatcgtatgtgccatcgattggaacccaggcttttactttttttagtgaatcaaacatacggctgcggtctacttgcaagtcacgaaccacaggaaatgttttcattggctgtaagcgaattggctgttctagtttatcaacaagagccgtacatgactgacgaggtttaccgttgatgaccattgaacaggctccgcatacttcctctaaacagttcatttcccagtttatcggagcaacctctttacctgaagcatcaacagggttacgtctgatttccatcagtgctgaaataacgttcatattcggacgatacggaatttcaaactcctgattgtaaggagcagattcagctgaatcttgacgtgtaataatgaagcgcactgtcttttggactgtttgttgttcactcattgattaacgaaccccctcttgttgtttttttggtttttcatcttttttctttgtgtagtcgcgcttacgcggtttgattaacgatacgtctacctcttcataatggaaagaaggagccgttttcttatccacaaaagatgccattgttgtttttaagaattcttcatcgttacgatctgggaaatctggcttataatgagcaccgcgactttcgttacggttgtaagctcctagcgttacaacacgtgaaa

SEQ ID NO: 1577 - DNA, 4000 bp, Escherichia coli
  misc_feature (1991)..(1992): n is a, c, g, or t
  misc_feature (2073)..(2073): n is a, c, g, or t
  misc_feature (2304)..(2304): n is a, c, g, or t
  misc_feature (2318)..(2320): n is a, c, g, or t
  misc_feature (2324)..(2324): n is a, c, g, or t
tcctggggtgggccgatcttgacgagcggtgccgctgccagcgacggcatgacctcccgctcggagagcaggtcgtcgaccttgacgtcagtcgtcatggcgtcacttcgcagagtgggcaggattcaccggccagctggtcacagtcgcaagggcagatgtcctcttcgacgattcggagaactcgctcagtcactcttgtccttcttctcggccgaggccttggcgatcttggtggcggaatcctcgggagattcctcacatccctcgcaggggagcccggccctgatcccagcctggacgagaccgagcccgatgccgacgagcaggccgccggcgatgatcagcccgagtgacttgcccttcactttccgatcccccagaggtacttctcgatcttgcggctggtcgtattcggaggcgtctcggcgagcgaggattgcttcgtaggctcggagggcgtcacttgcttcaacttctccacctccgcccggaccagctcctccatcgagcgctcctcctcccgtggcgtcggcggcttcgtctccgttttggtcgagctgggcgaggtatcggtcgagtcctccaccgtcaccgacccggagtccaggagggaccccaggacctcccgcaccgctgtcttgatctcgtcggcgaggctctcctttttcggtgatggctcctccttcacttctgtttcagtcattccgaccctttccgtaggtgccaggattccggcaggtcgcagccgagctccagcgctcgcttggtgatgtggcgacggacacgctcacggtcacccgccgcggtgcgcccgaggtcgcggatggcgttctcgacatcggtgcagtcattgatcgggtagcgcggctcttcgccctcagtgaggggagggagggccttgccttccgataatgcggcgcggcgtcgagccgctgaccatcttgccaacgatcccacctcccaggcgttcgagcagcggcgcgaagcgctcgtagatcgagagcaggcggtcgagcttcgcttcgatccgcgccaggtgctcggcaagctcctcgcccataccctttaatggtataccattggaggcgtgaccgaggtactgatcggagccgaggatcgggcgacggcgcagttggcccgcctggagatcgtggcgacgatcctcgcccagctggtggcctgctacctggcgctctccgccctcgacgacgggacgacctggccgacgattgtctggcactggaagcgttggcgtcacagcctccgcaaccggatcgagttccgggtgccgtcgtggccggtgatcgccgaggcggaacggatcgtgagagagggagccttccatggctgaagcggaagcaggcgtagagttctcgatcggcgacttcctcctcggagccaaggtcgacctcgaggccaagcttgactcgatcgagaaacacctgggggacatcctcgcccgcgaggagcgctacgagcgggagggaccggtcttcgtcgccctccaggcctccggcgtcgtcgacgcctcctccgaccccttgtacctcgacctcggcggccccacctacgggcgggcctgggaggtccgccagctcgtcatcggcgggatcacctgggcgacggcggtcgccggcaacgccgtggtcttcgcccagccggtcgccccctccacccttaccggcgtcggcctcggcaacgtccaggatcacgccgccagcctcccctccgtggccttctactccggcggccagttccacgtccgccacccgaaccgcatctacgtcgccatcctctccggcaccgcctcgacgcagtaccaggccgtcggcgacgccttccacgtccccgacgtgggcacccgcgggctcttctcggtatgagcggcttcccgcaggcggcatcggccgctcagcctccgctggcgtacagcgacctgttgggctggtccttcgacccgactggctacggcggcgggctggctctanntaatgcggcgacggtctacgtctcccgcatcccgctcccctcgcagatcctcgtcacgaacatcctcgcttacatcaccgncatcggtggcaccctgacccacagttacctggcgctgttcaattcgctgggcacgatcctcggccagaccgccgaccaatcgaccggcggcacgggttggggcacgggcggggccaccgggctgcacaccgtcccccttaccactcccgtccaatgcgcgccactgacagccaacgatttcctctacgccggggtctacagtgggacggatgtctccttgccctcgctccnagcggccgacaccnnnctcnccgcgtttgccaacgctgggacggctgccaaccggctccgtgccgggaggatcgcccaggcggacacggcgaccctggcctcgatcgtcgtcgccagcctcagcgccacggcgatttactggttcggcctcagctaaggagagacatggagatcctgaaaggcgccgactccgcagtcccccagcccggcctctaccctggccacgacgtctggggcgtctacatcgccggcgccacgcctcacgcctggacccacgccgaggtcgccgccctcagaagcggtggcgtgcgcggcgtgctgcccatcgtcgttccgtcacagaaagaggagtggtggctggagaacgaggggtacggagtcctcgaagggctggtccgggaagccgtcgcctggggcctgccgcacggggcgccgctggtcttggacgtggaggaagctcagagcgtcaagatcggctccgggacctgccactgttgggcgatcgcctgcctcgcccacggctacatcccctggctctacggcccggcggggttcctcgcccgcgaccactggtgccaccactggctcgcctcctgggtcgttgccagcggcgtcgaccatgaccccccggagaagttgctcgccaactacctcggctggcagtacgccggcaacgtcgaaggcggtcggatcgaccgtgacatcttcgccgcccgtcacacttacctgacacctgaaaggaccatcgtgacagagcaatatatgaaccccgcagaggcggccttcgggacgcccgtcccagtaccagaagcgccgacatcaggcctgccgacggccgaggaggtcgccaaggtcgaggacatcccggccgacgccgagcccgtagcccaggaagaggccaagccggccgtccagaccgtcgaggccgcagaagagctccccgacctcaccgccgcggccaaggccaagctccacgcctgggtcgactcttttttttagatgagactcctcaccctcccctggcggctggccttagtgctcgtcgaagtgatagcgttcctgctcttcctctcagcgggggcagcggccctcgtctggcaactcctaccggaaaggacacaacgatgggcacaccgactagcccgactgtttcagtagcgggggtcgtctcggttccgaagaagctcgccacctacatccacgagatcgtcgacgccgtccacaaggaggcggcgttggtgatgggtatcctcgtcgccctcggcgtcacgccgaccccggcggcagactccaaggtcacctcgggcatcctcgtcggctacgctgccgtggcgcaattggccgagaagttcttcgccaagagctgatggctcaccagcaagtctctggcaaaggtggcaggaccgctgaaaaacgtgtagcgaaaagggcacggagaacccttctcgccatcgaaataccgcccgcactacgcgacagcgcgagccgagccacacacgcccacggcacgaccgtttccgaggtcgttaggcaatccctctatgcctacgtcgagcgcgccgaaaacgcggcacctgagagagaggggcactaatggcaacgggccgcgggctacttcgggatcaagaaagctgacccgaaaatgaggcatcacaacaagggtcggatggaccgagagggtattaccggagccgtt

SEQ ID NO: 1578 - DNA, 4000 bp, Escherichia coli
  misc_feature (73)..(73): n is a, c, g, or t
  misc_feature (478)..(478): n is a, c, g, or t
  misc_feature (535)..(535): n is a, c, g, or t
  misc_feature (1326)..(1326): n is a, c, g, or t
  misc_feature (1404)..(1404): n is a, c, g, or t
  misc_feature (1434)..(1434): n is a, c, g, or t
  misc_feature (2276)..(2276): n is a, c, g, or t
  misc_feature (2552)..(2552): n is a, c, g, or t
  misc_feature (2558)..(2558): n is a, c, g, or t
  misc_feature (2969)..(2969): n is a, c, g, or t
  misc_feature (3071)..(3071): n is a, c, g, or t
  misc_feature (3086)..(3086): n is a, c, g, or t
  misc_feature (3167)..(3167): n is a, c, g, or t
  misc_feature (3275)..(3275): n is a, c, g, or t
  misc_feature (3447)..(3447): n is a, c, g, or t
  misc_feature (3500)..(3500): n is a, c, g, or t
  misc_feature (3539)..(3539): n is a, c, g, or t
  misc_feature (3740)..(3740): n is a, c, g, or t
  misc_feature (3788)..(3788): n is a, c, g, or t
  misc_feature (3818)..(3818): n is a, c, g, or t
  misc_feature (3821)..(3821): n is a, c, g, or t
  misc_feature (3824)..(3824): n is a, c, g, or t
  misc_feature (3833)..(3833): n is a, c, g, or t
  misc_feature (3917)..(3917): n is a, c, g, or t
aaacactaacaaccatggtcacgtccccgtgctgcgcgaacgagtcaccgaactcctcgccccagccctctgnaacaccaccacaaacccacccatcatcctcgacgccactttaggcgccggtgggcacagcgaatacttcctcaccacattcccgcaggtacacataataggactcgaccgcgacaccaccgcactggcccaagccgccacccgcctggccgacttcggcgaccggatcaccacactccacacgcgcttcgacgattttcccacagccatccaagccgccgccgacgccggcaatgcaacatgccaagctgcactcacagaaggtatatccggggcactcttcgacctgggtgtgtcatcaatgcagcttgaccaggtgaaccgcggttttgcctatcgggttgatgcaccgctcgacatgcggatgaacaactccgaaggcattaccgcggcggaaatcctcaanacctacccccacggcgacctcacccgcatcctcaaaacctacggggacgaacgattngccagcaaaatcgccaccgccatcatccgcgaacgcgaacacgcccccttcaccacctccgcgcggctcgtcgaactgctctataacaccatccccgccgccacccgacgcaccggcggccaccccgccaaacgcacattccaggcactccgaatcgaggtcaaccaagaactcgccgccatcaccaatgtgctaccccgcatcgccgacgccctcatccccggtggccgggccgtcttcatggcctaccaatctttagaagacaaaatcattaaaaaatacttcgccgaaatcaccacctccaaaaccccccggggacttcccatggaactccccgaatacgcggccaaattccggctggttacccggggcgccgaaaaggccacccccgcagaaatcgccgacaattcccgagccgcccccgtccgggttcgcgcaatcgaaaaacttgccaccagcaccaatagaaaggagacttcaaaatgacaaccaattaccgaatccgtgacacccgtatccgcagcggccgccccatcaacacctacaccccttaccggccgacccgtccggcacggtcgcttgcgcgcacccaacaatcccaagaccacagccgaaacgacaccgccctcctcgtcgaagaccggcccagccgcaccggcacatcaggccgggcaatccccaccgtccccacccaggcgccaccccgacggcgcatgcagcgcaaagccggatcccaacaggtattttccaaccggggcaaacggatcgtgcgccaacgcgtcgacccgagncgcatccgcttcgtgctagcactcacactcctgctcggcgccggcgtgtttatagccatgatgctctccaaaatatcnaccgaacaaagtttcgagatgcaggagttncagcaccacgaatccaccctgcaaaaccaggtggaaaccctcaaccgtgacctgcaaaacgcctctgccaccgcggagatcgcccgccaagccaaagacctaggcatggtgatcccggaccagcccggcattctggcaaaaaatgaatcgggcgacatacacgagcaacgcgcgccaggcaccgtgacgcgtcctatagttgatgtcaatggtcagcaagttcggccacaggtggcatccagtgatcccaaggccacaaacgaagtctcccaacggctgaatgaggctccccggattacaccccggacctccaatgttgcaccatacatttctaatcgaaattaatttcgaacggtagaaccgtatctgtcaacattccacaatattccaaggtgtcatttgtgaatcagtcgaactcacgcgcgtctcgcatgcgtcgaaaagctagcagtaacacgcaattccacaacgataccgcggacccgaagaatgggctcaaccggatagccgacaaacccgcaaccggacctgccggcggacccaccaccggaccaggtggcggacaacgccgaatcatgctcggccggctacgaatcctcagcgccggcgtattcctgctctgcctcatggtcattgcccgcatggcctgggtacaactcgtgtggggacccgacctcagcagcctggcggcggaacaacgcacccgcatctacaccgacccggcgcgccggggggcgatcaccgaccgctccggccaacagttggcctacaccatgcaggccagatcactgactgtgtcaccgaatgtgctgcggcgcgaattgccgtatgtggcgaaacancagctggcgtcggacgagaattacgttcaagggtccgaagaaacccgcaaccaaatgattgaggcgaaggttgcggacatcatgacggagtattcggaagaaatccccaagattattgagaaggctcggacggaaaaacaggccgccaaggccacgaaaaccgtgacgggcagcacgaaggggctcaaggatgcggccaagaagagtgaggtgaagccggaagatattgtggcgaagctgaaggccgattcgaattatgaggtgttggtgcgcaangttganccggatgtggcggccggtatttcggagaaatattatggtattgccgcggatttgcaggatgtgcgccagtatcccaatggggcggtggcgtcgaatgtgatcggcaagatcagccaggatgggcagggccagtttgggtttgagtcggcgaatgattcattgctgtcggggattaatggccggaagtcgattgaggtgtcgaccgatgggcaggcgatcccgggcaccgtgacggacgatgtgccggcgacgaatggggcgaatgtgacgctcaccctggatttggatttgcaaacatatgtgcagcagcagttggagcaggcgaaggcgaattcgggggcgaagagcgcgtcggcggtggtgctggatgcgaagacggcgcaggtgatggccatggcgacgagtgattcnattgatccgatgggggatattaaaaagcagctggagcaggggaaagagtttggtaatagcacgatttcggcaccgtttgagccggggtcggtggcgaagatnattacggcggcgggngcgattgaaaacggggtgaccagcccggacgaggtacatacggtgccgggcagtatcgacatggcgggggtgaatgtgaangatgcgtgggatcatggtccggcgcagtacaccacgacggggatttttggtaagtcctccaatgtggggacgctcatgctggcggagaagctgggggaggacaagttngaccagctcttgactggttttggggtgggtcgggccacggggatcgagttgccgagcgagtcggaggggctgttgccgcagcgggcgcagtggtctgggggcacgtttgcgaatctgccgattgggcagggcatgagtgtgacattgttgcagatggcggggatttatcagnctatagcgaatgggggggagcggattgcgccgcggattatttccgaggtgcgngatggtcatggtgcggtggtggcccagccggagccggancgcacccgggtggtgagtgaggagacggcccggacggtggtgaatatgttccgggcggtcacccagtcggattcgagtgggttgcagcagggtaccgggtcgcaggcggcggtaaaggggtaccagattgcagggaagaccggcacggcgcagcaggtggatgcggcgacgggggcgtattcccattcgaaatattggatnacgtttgcgggtattgcgccggcggatgatccccggtttgtggtggcnttgatgttggataatccccaacggggggtncanggngaggggggncagtcggcggcgccgctgtttcatgatattgcgtcgtggctgttgaatcgggataatgtgccgccgtcgccgccgatggagggncagttggtgctgcaggtgcagtgatgacggagtggtgattcggccatggggtgtgatgtccgggttaccctcgatcggttacc

SEQ ID NO: 1579 - DNA, 4000 bp, Escherichia coli
  misc_feature (1)..(2): n is a, c, g, or t
  misc_feature (4)..(7): n is a, c, g, or t
  misc_feature (9)..(17): n is a, c, g, or t
  misc_feature (19)..(25): n is a, c, g, or t
  misc_feature (27)..(43): n is a, c, g, or t
  misc_feature (45)..(54): n is a, c, g, or t
  misc_feature (56)..(56): n is a, c, g, or t
  misc_feature (58)..(59): n is a, c, g, or t
  misc_feature (61)..(63): n is a, c, g, or t
  misc_feature (65)..(72): n is a, c, g, or t
  misc_feature (74)..(79): n is a, c, g, or t
  misc_feature (81)..(90): n is a, c, g, or t
  misc_feature (92)..(93): n is a, c, g, or t
  misc_feature (96)..(101): n is a, c, g, or t
  misc_feature (103)..(104): n is a, c, g, or t
  misc_feature (106)..(110): n is a, c, g, or t
  misc_feature (112)..(112): n is a, c, g, or t
  misc_feature (114)..(126): n is a, c, g, or t
  misc_feature (129)..(129): n is a, c, g, or t
  misc_feature (131)..(137): n is a, c, g, or t
  misc_feature (139)..(140): n is a, c, g, or t
  misc_feature (142)..(143): n is a, c, g, or t
  misc_feature (145)..(154): n is a, c, g, or t
  misc_feature (156)..(158): n is a, c, g, or t
  misc_feature (160)..(165): n is a, c, g, or t
  misc_feature (168)..(186): n is a, c, g, or t
  misc_feature (188)..(188): n is a, c, g, or t
  misc_feature (190)..(194): n is a, c, g, or t
  misc_feature (197)..(204): n is a, c, g, or t
  misc_feature (207)..(217): n is a, c, g, or t
  misc_feature (219)..(219): n is a, c, g, or t
  misc_feature (221)..(224): n is a, c, g, or t
  misc_feature (227)..(231): n is a, c, g, or t
  misc_feature (233)..(241): n is a, c, g, or t
  misc_feature (243)..(246): n is a, c, g, or t
  misc_feature (249)..(250): n is a, c, g, or t
  misc_feature (252)..(252): n is a, c, g, or t
  misc_feature (254)..(257): n is a, c, g, or t
  misc_feature (260)..(260): n is a, c, g, or t
  misc_feature (262)..(262): n is a, c, g, or t
  misc_feature (265)..(265): n is a, c, g, or t
  misc_feature (267)..(270): n is a, c, g, or t
  misc_feature (272)..(272): n is a, c, g, or t
  misc_feature (274)..(275): n is a, c, g, or t
  misc_feature (280)..(286): n is a, c, g, or t
  misc_feature (288)..(296): n is a, c, g, or t
  misc_feature (298)..(305): n is a, c, g, or t
  misc_feature (308)..(317): n is a, c, g, or t
  misc_feature (322)..(329): n is a, c, g, or t
  misc_feature (331)..(331): n is a, c, g, or t
  misc_feature (334)..(336): n is a, c, g, or t
  misc_feature (339)..(342): n is a, c, g, or t
  misc_feature (344)..(353): n is a, c, g, or t
  misc_feature (356)..(356): n is a, c, g, or t
  misc_feature (361)..(362): n is a, c, g, or t
  misc_feature (373)..(373): n is a, c, g, or t
  misc_feature (427)..(427): n is a, c, g, or t
  misc_feature (445)..(456): n is a, c, g, or t
  misc_feature (460)..(466): n is a, c, g, or t
  misc_feature (468)..(469): n is a, c, g, or t
  misc_feature (471)..(471): n is a, c, g, or t
  misc_feature (475)..(476): n is a, c, g, or t
  misc_feature (478)..(480): n is a, c, g, or t
  misc_feature (483)..(485): n is a, c, g, or t
  misc_feature (487)..(491): n is a, c, g, or t
  misc_feature (494)..(495): n is a, c, g, or t
  misc_feature (497)..(497): n is a, c, g, or t
  misc_feature (499)..(499): n is a, c, g, or t
  misc_feature (501)..(501): n is a, c, g, or t
  misc_feature (504)..(504): n is a, c, g, or t
  misc_feature (506)..(506): n is a, c, g, or t
  misc_feature (509)..(510): n is a, c, g, or t
  misc_feature (515)..(518): n is a, c, g, or t
  misc_feature (520)..(522): n is a, c, g, or t
  misc_feature (524)..(526): n is a, c, g, or t
  misc_feature (529)..(531): n is a, c, g, or t
  misc_feature (534)..(537): n is a, c, g, or t
  misc_feature (539)..(541): n is a, c, g, or t
  misc_feature (543)..(543): n is a, c, g, or t
  misc_feature (546)..(548): n is a, c, g, or t
  misc_feature (552)..(555): n is a, c, g, or t
  misc_feature (557)..(557): n is a, c, g, or t
  misc_feature (559)..(562): n is a, c, g, or t
  misc_feature (565)..(567): n is a, c, g, or t
  misc_feature (569)..(570): n is a, c, g, or t
  misc_feature (572)..(572): n is a, c, g, or t
  misc_feature (574)..(577): n is a, c, g, or t
  misc_feature (579)..(579): n is a, c, g, or t
  misc_feature (581)..(583): n is a, c, g, or t
  misc_feature (587)..(588): n is a, c, g, or t
  misc_feature (590)..(593): n is a, c, g, or t
  misc_feature (595)..(596): n is a, c, g, or t
  misc_feature (598)..(602): n is a, c, g, or t
  misc_feature (604)..(604): n is a, c, g, or t
  misc_feature (607)..(612): n is a, c, g, or t
  misc_feature (615)..(616): n is a, c, g, or t
  misc_feature (618)..(622): n is a, c, g, or t
  misc_feature (624)..(626): n is a, c, g, or t
  misc_feature (628)..(636): n is a, c, g, or t
  misc_feature (638)..(638): n is a, c, g, or t
  misc_feature (641)..(645): n is a, c, g, or t
  misc_feature (648)..(658): n is a, c, g, or t
  misc_feature (660)..(666): n is a, c, g, or t
  misc_feature (668)..(673): n is a, c, g, or t
  misc_feature (675)..(675): n is a, c, g, or t
  misc_feature (677)..(678): n is a, c, g, or t
  misc_feature (680)..(681): n is a, c, g, or t
  misc_feature (683)..(687): n is a, c, g, or t
  misc_feature (689)..(691): n is a, c, g, or t
  misc_feature (693)..(695): n is a, c, g, or t
  misc_feature (697)..(698): n is a, c, g, or t
  misc_feature (701)..(704): n is a, c, g, or t
  misc_feature (706)..(707): n is a, c, g, or t
  misc_feature (710)..(717): n is a, c, g, or t
  misc_feature (719)..(719): n is a, c, g, or t
  misc_feature (722)..(722): n is a, c, g, or t
  misc_feature (724)..(726): n is a, c, g, or t
  misc_feature (729)..(734): n is a, c, g, or t
  misc_feature (736)..(754): n is a, c, g, or t
  misc_feature (756)..(757): n is a, c, g, or t
  misc_feature (759)..(762): n is a, c, g, or t
  misc_feature (764)..(766): n is a, c, g, or t
  misc_feature (768)..(774): n is a, c, g, or t
  misc_feature (776)..(777): n is a, c, g, or t
  misc_feature (779)..(785): n is a, c, g, or t
  misc_feature (787)..(789): n is a, c, g, or t
  misc_feature (791)..(792): n is a, c, g, or t
  misc_feature (796)..(800): n is a, c, g, or t
  misc_feature (802)..(804): n is a, c, g, or t
  misc_feature (806)..(816): n is a, c, g, or t
  misc_feature (818)..(819): n is a, c, g, or t
  misc_feature (821)..(824): n is a, c, g, or t
  misc_feature (826)..(829): n is a, c, g, or t
  misc_feature (831)..(834): n is a, c, g, or t
  misc_feature (836)..(841): n is a, c, g, or t
  misc_feature (846)..(848): n is a, c, g, or t
  misc_feature (850)..(851): n is a, c, g, or t
  misc_feature (853)..(854): n is a, c, g, or t
  misc_feature (856)..(858): n is a, c, g, or t
  misc_feature (861)..(861): n is a, c, g, or t
  misc_feature (863)..(867): n is a, c, g, or t
  misc_feature (869)..(871): n is a, c, g, or t
  misc_feature (873)..(876): n is a, c, g, or t
  misc_feature (879)..(889): n is a, c, g, or t
  misc_feature (892)..(893): n is a, c, g, or t
  misc_feature (899)..(901): n is a, c, g, or t
  misc_feature (904)..(905): n is a, c, g, or t
  misc_feature (908)..(917): n is a, c, g, or t
  misc_feature (920)..(920): n is a, c, g, or t
  misc_feature (924)..(927): n is a, c, g, or t
  misc_feature (929)..(932): n is a, c, g, or t
  misc_feature (934)..(937): n is a, c, g, or t
  misc_feature (940)..(940): n is a, c, g, or t
  misc_feature (942)..(944): n is a, c, g, or t
  misc_feature (946)..(952): n is a, c, g, or t
  misc_feature (954)..(963): n is a, c, g, or t
  misc_feature (965)..(970): n is a, c, g, or t
  misc_feature (972)..(972): n is a, c, g, or t
  misc_feature (975)..(979): n is a, c, g, or t
  misc_feature (981)..(984): n is a, c, g, or t
  misc_feature (986)..(988): n is a, c, g, or t
  misc_feature (990)..(1000): n is a, c, g, or t
  misc_feature (1002)..(1005): n is a, c, g, or t
  misc_feature (1007)..(1016): n is a, c, g, or t
  misc_feature (1019)..(1020): n is a, c, g, or t
  misc_feature (1025)..(1025): n is a, c, g, or t
  misc_feature (1027)..(1032): n is a, c, g, or t
  misc_feature (1035)..(1036): n is a, c, g, or t
  misc_feature (1040)..(1044): n is a, c, g, or t
  misc_feature (1046)..(1049): n is a, c, g, or t
  misc_feature (1053)..(1057): n is a, c, g, or t
  misc_feature (1059)..(1061): n is a, c, g, or t
  misc_feature (1063)..(1066): n is a, c, g, or t
  misc_feature (1068)..(1068): n is a, c, g, or t
  misc_feature (1070)..(1071): n is a, c, g, or t
  misc_feature (1074)..(1079): n is a, c, g, or t
  misc_feature (1083)..(1084): n is a, c, g, or t
  misc_feature (1086)..(1086): n is a, c, g, or t
  misc_feature (1088)..(1091): n is a, c, g, or t
  misc_feature (1094)..(1095): n is a, c, g, or t
  misc_feature (1097)..(1097): n is a, c, g, or t
  misc_feature (1101)..(1101): n is a, c, g, or t
  misc_feature (1104)..(1107): n is a, c, g, or t
  misc_feature (1112)..(1112): n is a, c, g, or t
  misc_feature (1114)..(1121): n is a, c, g, or t
  misc_feature (1123)..(1131): n is a, c, g, or t
  misc_feature (1133)..(1135): n is a, c, g, or t
  misc_feature (1137)..(1142): n is a, c, g, or t
  misc_feature (1144)..(1144): n is a, c, g, or t
  misc_feature (1148)..(1151): n is a, c, g, or t
  misc_feature (1154)..(1155): n is a, c, g, or t
  misc_feature (1158)..(1159): n is a, c, g, or t
  misc_feature (1161)..(1164): n is a, c, g, or t
  misc_feature (1166)..(1168): n is a, c, g, or t
  misc_feature (1170)..(1172): n is a, c, g, or t
  misc_feature (1174)..(1174): n is a, c, g, or t
  misc_feature (1179)..(1179): n is a, c, g, or t
  misc_feature (1181)..(1183): n is a, c, g, or t
  misc_feature (1186)..(1189): n is a, c, g, or t
  misc_feature (1191)..(1192): n is a, c, g, or t
  misc_feature (1194)..(1194): n is a, c, g, or t
  misc_feature (1196)..(1196): n is a, c, g, or t
  misc_feature (1198)..(1198): n is a, c, g, or t
  misc_feature (1200)..(1200): n is a, c, g, or t
  misc_feature (1202)..(1207): n is a, c, g, or t
  misc_feature (1210)..(1213): n is a, c, g, or t
  misc_feature (1216)..(1218): n is a, c, g, or t
  misc_feature (1221)..(1221): n is a, c, g, or t
  misc_feature (1223)..(1225): n is a, c, g, or t
  misc_feature (1227)..(1228): n is a, c, g, or t
  misc_feature (1230)..(1238): n is a, c, g, or t
  misc_feature (1240)..(1240): n is a, c, g, or t
  misc_feature (1242)..(1243): n is a, c, g, or t
  misc_feature (1246)..(1246): n is a, c, g, or t
  misc_feature (1252)..(1260): n is a, c, g, or t
  misc_feature (1262)..(1266): n is a, c, g, or t
  misc_feature (1268)..(1272): n is a, c, g, or t
  misc_feature (1274)..(1279): n is a, c, g, or t
  misc_feature (1281)..(1290): n is a, c, g, or t
  misc_feature (1292)..(1293): n is a, c, g, or t
  misc_feature (1296)..(1296): n is a, c, g, or t
  misc_feature (1299)..(1300): n is a, c, g, or t
  misc_feature (1303)..(1305): n is a, c, g, or t
  misc_feature (1307)..(1308): n is a, c, g, or t
  misc_feature (1313)..(1315): n is a, c, g, or t
  misc_feature (1317)..(1320): n is a, c, g, or t
  misc_feature (1322)..(1323): n is a, c, g, or t
  misc_feature (1325)..(1326): n is a, c, g, or t
  misc_feature (1328)..(1331): n is a, c, g, or t
  misc_feature (1333)..(1336): n is a, c, g, or t
  misc_feature (1338)..(1340): n is a, c, g, or t
  misc_feature (1343)..(1343): n is a, c, g, or t
  misc_feature (1346)..(1346): n is a, c, g, or t
  misc_feature (1348)..(1362): n is a, c, g, or t
  misc_feature (1365)..(1375): n is a, c, g, or t
  misc_feature (1377)..(1384): n is a, c, g, or t
  misc_feature (1386)..(1386): n is a, c, g, or t
  misc_feature (1388)..(1388): n is a, c, g, or t
  misc_feature (1390)..(1394): n is a, c, g, or t
  misc_feature (1396)..(1399): n is a, c, g, or t
  misc_feature (1404)..(1405): n is a, c, g, or t
  misc_feature (1407)..(1407): n is a, c, g, or t
  misc_feature (1409)..(1409): n is a, c, g, or t
  misc_feature (1412)..(1412): n is a, c, g, or t
  misc_feature (1414)..(1415): n is a, c, g, or t
  misc_feature (1418)..(1421): n is a, c, g, or t
  misc_feature (1424)..(1424): n is a, c, g, or t
  misc_feature (1426)..(1427): n is a, c, g, or t
  misc_feature (1430)..(1436): n is a, c, g, or t
  misc_feature (1438)..(1438): n is a, c, g, or t
  misc_feature (1442)..(1442): n is a, c, g, or t
  misc_feature (1444)..(1444): n is a, c, g, or t
  misc_feature (1446)..(1451): n is a, c, g, or t
  misc_feature (1453)..(1454): n is a, c, g, or t
  misc_feature (1456)..(1462): n is a, c, g, or t
  misc_feature (1464)..(1465): n is a, c, g, or t
  misc_feature (1468)..(1469): n is a, c, g, or t
  misc_feature (1471)..(1472): n is a, c, g, or t
  misc_feature (1475)..(1475): n is a, c, g, or t
  misc_feature (1478)..(1481): n is a, c, g, or t
  misc_feature (1483)..(1485): n is a, c, g, or t
  misc_feature (1488)..(1498): n is a, c, g, or t
  misc_feature (1501)..(1504): n is a, c, g, or t
  misc_feature (1506)..(1508): n is a, c, g, or t
  misc_feature (1511)..(1514): n is a, c, g, or t
  misc_feature (1516)..(1518): n is a, c, g, or t
  misc_feature (1520)..(1520): n is a, c, g, or t
  misc_feature (1523)..(1523): n is a, c, g, or t
  misc_feature (1989)..(1989): n is a, c, g, or t
  misc_feature (1992)..(1992): n is a, c, g, or t
  misc_feature (2190)..(2190): n is a, c, g, or t
  misc_feature (2534)..(2534): n is a, c, g, or t
  misc_feature (3906)..(3906): n is a, c, g, or t
  misc_feature (3908)..(3908): n is a, c, g, or t
  misc_feature (3910)..(3910): n is a, c, g, or t
  misc_feature (3915)..(3921): n is a, c, g, or t
  misc_feature (3923)..(3927): n is a, c, g, or t
  misc_feature (3931)..(3933): n is a, c, g, or t
  misc_feature (3935)..(3936): n is a, c, g, or t
  misc_feature (3938)..(3939): n is a, c, g, or t
  misc_feature (3942)..(3946): n is a, c, g, or t
  misc_feature (3950)..(3952): n is a, c, g, or t
  misc_feature (3956)..(3968): n is a, c, g, or t
  misc_feature (3970)..(3973): n is a, c, g, or t
  misc_feature (3977)..(3977): n is a, c, g, or t
  misc_feature (3979)..(3983): n is a, c, g, or t
  misc_feature (3985)..(3986): n is a, c, g, or t
  misc_feature (3988)..(3995): n is a, c, g, or t
  misc_feature (3997)..(4000): n is a, c, g, or t
nnannnncnnnnnnnnncnnnnnnngnnnnnnnnnnnnnnnnncnnnnnnnnnncnanngnnntnnnnnnnnannnnnncnnnnnnnnnnanngcnnnnnngnngnnnnngnannnnnnnnnnnnnccncnnnnnnngnngnnannnnnnnnnncnnnannnnnnccnnnnnnnnnnnnnnnnnnngncnnnnnccnnnnnnnntcnnnnnnnnnnntntnnnnggnnnnntnnnnnnnnntnnnnttnncntnnnnttncnggntnnnntncnnccggnnnnnnnannnnnnnnngnnnnnnnnccnnnnnnnnnnatccnnnnnnnngnccnnnaannnntnnnnnnnnnnggnctccnngcacataccancccgacagccttttgatacaggcgcgccgcaggaaatgaaaaatgtgcagaatngtgcagcctgtatttaannnnnnnnnnnntttnnnnnnntnntnaaanngnnnaannntnnnnnaanncntnanttnanggnnttttnnnntnnngnnnccnnnggnnnngnnntnccnnngggnnnntncnnnnttnnngnngnannnncngnnnaaannannnnanntnnnnnanccnnnnnnggnngnnnnngnnncnnnnnnnnncnggnnnnnccnnnnnnnnnnngnnnnnnnannnnnncngnnanncnnnnngnnntnnncnnaannnnannccnnnnnnnngncgnannnccnnnnnnannnnnnnnnnnnnnnnnnnannannnntnnngnnnnnnntnncnnnnnnngnnncnnaaannnnntnnngnnnnnnnnnnngnncnnnntnnnngnnnncnnnnnnggggnnngnngnnannnttncnnnnngnnncnnnnggnnnnnnnnnnnaannaaaaannnaannagnnnnnnnnnnacnaaannnnannnncnnnnagncnnntnnnnnnngnnnnnnnnnncnnnnnnanggnnnnngnnnncnnngnnnnnnnnnnngnnnncnnnnnnnnnnggnnggggnannnnnnggnncccnnnnngnnnngggnnnnnannntnnnncntnnccnnnnnntttnnancnnnnttnncnaaanggnnnnggggnannnnnnnntnnnnnnnnncnnncnnnnnncngggnnnnccnncgnngnnnngnnntnnncnggggngnnnggnnnngnngnancngncnnnnnnggnnnnttnnnggnannngnngnnnnnnnnncngnnccntttttnnnnnnnnntnnnnncnnnnngnnnnnncnnnnnnnnnncnnccnggnnaannncnnggggnnngnnnncnngnnannnntnnnngnnnaanccngnnnnnnnnnnnnnnnggnnnnnnnnnnntnnnnnnnntncntnnnnntnnnnaaaanngnanccntnnttnnnnccntnnttnnnnnnnanttantnannnnnntnntnnnnnnntnnttnncnnttnttnnnnannnttnnnnnnnnnnnaannnntnnnaannnntnnnantanatggaaccattgtaagcagcggagatcttccgcaggaggcagtaatgaatacattaaaactcagagattacactggaaaagcacttagcgagtgcacgattctggaactttacaacgcggcgctggccctgacgcaggacgcctgcaggaacaggggatacaacagcggaaagaagaaagtttactatatttcggcagaattcctgatcggtaaacttctttccaacaacctgatcaacctcggcatctacgatgatgtgaaagcggaactggctgaggctgggaaagacattacggagctggaggaatttgaatacgagccctccctcggaaacggcggccttggcagacttgcagcctgcttcatcgacagccttgcgacactgggccttcccgctgacggcgtaggcctggcctaccactgcggtctgttcaaacagtccttcgaggaccgcaagcagcacanganacctgactactggcgcaagtggggcatggccaactggatgaagcgcaccgacaagcactataaggtgcagtgcggcgatctggagcttctttccaccatgtatgagatcgatgtcacaggttacggaagcaagtgcggacgccttcgtctctttgacctggacacggtcaatgagggactgatcggctcgggtatcgnttttgacaaaaaagagatcgagaaaaacctgaccctcttcctgtatcccgatgacagcgatgaggacggaaagcttctccgcgtctatcaggagtatttcatggtcagcaatgccgcccagctgatcctcgacgagtgcgtggagcgcggcagcaacctgcatgaccttgccgactacgcggcgatccagatcaacgatacgcacccttctctggtcattccggaactggtgcgccttctgaccgaaaagggcattgaggagaaagaagcatatcagattgtgactgatgtctgtgcttacacgaaccacacgatccttgctgaggcactggagacatggcccnagcacttcttcaaggctgtcgtgccgcaccttatgccgatcatcaagaggatgaatgacgctgttaaggcaaaatatgaagaaccttccgttcagatcatcgacgagtacggcaacgtgcatatggcccacatggacattcactacagccactccgtgaacggcgtcgcgagacttcacactgacattctcaaggagacagagctcaacaatttctacaagctctatcccgagaagttcaacaacaagaccaacggcatcactttccgcagatgggtcatcgagtgcaaccctgagctgacagagctgatcaccgagaagatcggcgagggctggaagacggacgccagacagcttgagcagcttattccttacgcggaggatgagactttcctgcagtgcatcctgaacaggaagaacacgaaaaaacacaagttctccgcatggcttgaacaatatcagggcgacaaggttgaccccgagtccgtctatgacgtgcagatcaagcgcctgcacgagtacaagagacagcagctcaacctcctgtgggccatcgaccgttacctgcacatcaaggacggttacaggccgagaagaccggtcacggtattttttggcgcaaaggcagctcctgcctatgtgatcgccaaggatataatccatgcgatcctcgccttcagcagcatcgtgaacaacgaccctgaagtgagtccttacctcaaggtcgtcatgcttcgcaactacaacgtgtccatggcggagaaactgatccccgcatcggacatttccgagcagatctcactggcctccaaggaagccagcgggaccggcaatatgaagttcatgctcaacggcgctgtgacgctgggaaccatggacggagcgaacgtcgagatcgcggaacttgtcggggaagacaatattttcaccttcggacagtcctccgaggaggtcatcgagcactataagaacgcggattacgtcgcaaagaactggtataagaaggacaagagacttgccgcggctgtggacttcctggtcagtgaagagatgctcgaagccggcgacaggaagcttctcaagcagctctatgacgagctgctgggcaaagactggttcatgacattccctgacttcgagagttactgcaagaccaaggacaaggctctggcagcttatgaggacagaatgggctgggcgaagaagatggcagtcaatatcgccaaggcgggctacttctcctccgacagaacgatcgaccagtacaacaatgatatctggcatttggagaaagactgctgaccgcagggaacagaatatcgtgcagagaaaacccccggagatccgatttccgggggttttaacttgccccntnanggccnnnnnnnannnnnaaannngnngnnttnnnnnaaannngggnnnnnnnnnnnnngnnnntttnannnnncnncnnnnnnnngnnnn

SEQ ID NO: 1580 - DNA, 4000 bp, Escherichia coli
  misc_feature (17)..(17): n is a, c, g, or t
  misc_feature (21)..(21): n is a, c, g, or t
  misc_feature (107)..(107): n is a, c, g, or t
  misc_feature (167)..(167): n is a, c, g, or t
  misc_feature (179)..(179): n is a, c, g, or t
  misc_feature (212)..(212): n is a, c, g, or t
  misc_feature (224)..(224): n is a, c, g, or t
  misc_feature (689)..(689): n is a, c, g, or t
  misc_feature (719)..(719): n is a, c, g, or t
  misc_feature (734)..(734): n is a, c, g, or t
  misc_feature (1196)..(1196): n is a, c, g, or t
  misc_feature (1402)..(1402): n is a, c, g, or t
  misc_feature (1423)..(1423): n is a, c, g, or t
  misc_feature (1483)..(1483): n is a, c, g, or t
  misc_feature (1985)..(1985): n is a, c, g, or t
  misc_feature (1988)..(1988): n is a, c, g, or t
  misc_feature (2043)..(2043): n is a, c, g, or t
atacatagttatgttgngcgngtcagatggtgcgcgccgagttagggacgcagatgacagatcttaaagcctatatgaccgacctaggtagacgcgcgcgcgatgcntcagcttcaatcgctaaagcgactacgggtcaaaagaacgcggcgctactggcaatagcncagcatatcgangacgcgcgtgaggtgctcctcgaggcgaatgcnctagacatggcngcgggtcaagaaaaggggctcgatgctgcgctactcgatcgcttagaactgacgactgcacgcatcgatgcgatgctcgaggggcttcggcaagtggctgcgctcgacgatcccattggcggcattagcgagatgaaaccacggcctagcggtatccaggtagggcgtatgcgtgtgcccctcggcgtcatcgggatcatctatgagtcgcgcccgaatgtgacctgcgaagctgcgagtctttgcctcaaatcgggcaatgcgacgattctgcgcggtggctcggaggcgctgaattctaatcaagcgattgcacgctgcatcgcgttagggcttgctgaggcagagttgcctaccgatgccgtgcaagtactagatcgccctgatcgagatgcggtaggccatttgattactatgcccgagtttgtcgatgtcattgtcccacgcggtggtaaggggttaatngaacgtattagtcgcgattcccgcgtaccngtgatcaaacatctngacggcaattgccacctgtacatcgagtcagatgctgatttcgataaggcggtgcgcgtggcaatcaacgccaagacccagcgttatgggacctgctgcacgctggagtcattacttatcgacgacgcaattgcagaagcgcttttgccttcgctcgccgccgaatatgctaatcatggggtggagttaaggggatgtgccagagtactttctcttgttccgacggcgatcgcagcgaccgaagaagactggggagaggaatatcttgctcctattctatcggtcaaggttgtcagtggcctggatcaggcaatagctcacatcaaccattacagttcggggcacacggaatctatcattaccgagaatttcacaaaggcgcagcgttttttgcgtgaagtggattccagttcggtaatgattaacgcgtcgactcgattcgccgatggcttcgaatatggnctcggcgccgaaattggtatatcgactgataaacttcacgcgcgaggccctgtgggtttagaaggcctgacttcgcagaaatatatcgtgttaggggatgggcatatccgcacatgagtaagagagtcggtgtctacggtggaatgtttgacccagtgcactgcggtcatctcgccgtagccgagctcgcgctggaggcacttagnctcgatcacgtgcttttggtnccctgtaaactccctaatcaccggcatgcagcgagtgcgactggtgctcaacgccttganatgttgaccctcgcatgtgcggacagcgcccaactcgtcgcgagctctattgaactagagcgagagggtatttcttatagtatcgatacgctcgcgcagttaaagaacgacgatccgagcacggatttcgtcttcgtgcttggaagagacgcgttcgaggggctgcctctctgggatagatgggagcggcttttggatgaaaatttactcgcggtggtttcacgtccggggatatctgtatcacgcgaaagcgcagagctaacgcagctcgcttcgcgaatggtgagaagtccggaagcgcttttcgatggaggcaggggcaaaattattctgctggaggagttacagaatcatttgtcgtctacacgcgttcgcgcggcgctttctggggtaaacggtcgcactcaatcgacagatatgaggttggatgactggttaccggacacagtacgcgcctatatcgagactcatgatctctacagatagacgtagatttaacttnatntagctaacttaattaattgatttacaaggaataagtattgaaaaatttaaaggcncttaaaagcgaccagttagccgagctggcagtaactgcgcttagtgacatgaaggggcaggaaatacgcagcattagcgttaaagggctgacctcgattacggacttcatggttatcgctactggttcgtctagtacgcatgtgaaagcgcttgccgattcagtcgataaggcggcaaaagaggctgggcaaaccgttaaaagcattgagggcaaactagcggcagaatgggtgctagtcgaccttggcgatgttgttgtccatctaatggttgccccaatgcgcgcgctttataatttggaggagctctggagttttaagccaccaactgaggaaatcaccaccgagaccgcagtcgagcatgaaacttaagttaattagcattgggaccaaaatgccgcgctgggtgcaggaaggggttgatgaatacagtaaacgaatcgttggtgatttgggctttagtctcctagagctcccgatggccaagcgcaccaaggctcagagccccgaggtatgtcgcgagaaagagggcgaggcgattctagcttccgtgcaagacgccgattatgtagtaagcctcgaagtgttaggtaagccgcttgatacaccggcgctcgccgcgagactcgagcacttcaagagtcaaggtcgaaatatttgccttttggttggtggtcccgatggattgtctaaggcatgcgcagcacgtgcagatgagagctggtcgctttcggcgatgaccttacctcaccctctggtgcgcgtaataatggtcgaacaactctatcgcgcgaacagcctgagcaaagggcacccataccatcgagcgtgagtactaggaatagagcgttagcagcgagccaaataataggtaaagctttcgcgcacagacagtgtcgaacttacaaacggtgagaagcggagtgaagagtggaaggtaggtggcagctcaaagatcgggaggctgaacgaaggcttttcgcgagacgcatgctcgttgcgagcatcgtcgttgcgtttctgttcgctgcattgctggtcaaacttattaaccttcaagtcacccaatacgattattttgctgcgcgagcagatggcaatcggctccactcgcagtatgtgccccccgcacgagggctaatattcgatcgaagcggcgaactgcttgctgataaccagccgatttttaatctttcggttgtgagagaacgggtcgacgatatcgaggcgactttcgagctgttatcttcgcttattcgcctcgctccagaggatgttgagcaattcagagaaaggctcaagcgccgccgagttcctttctcctcagttccacttcgctatgtcctcaccgaagaggaaaaggcacgcgtgtcggttaatgcgcatcgtcttcctggtattagcattgagccccaatttgtgcgcagctatcctactggtgaactcaacgcgcacgcgattggctatgtatctgagatcaatcgtgaagagctcgacgcgtttgccgaggatgcgcgtgaaaattatggcgggacgaatcacataggtaagacaggaatcgagcgcacctacgaggctcttcttcacggcgaggttggctacgaggtagtcgagaagaacaatcgcggtcaggtcatgcgtcggcttgaacgcacggacccaattgccggtaagaatctgacgcttttcctagaaaatcgattgcagcgtgtcgctaccgaagccttaggtgagcatcggggcgcggttgtggcaattgatcctgcaaccggtggaatcctagcaatggtcagtaagccgggctttgatcctaatttgttcgtgacagggataagcaatgccgactactcgcagctcataaccgacactgtcaatacgccattattcgacaggaccgtgaatccctatcctccggcgtcgacggtaaagccttttatcggtcttggtggtttgcagc

SEQ ID NO: 1581 - DNA, 4000 bp, Escherichia coli
  misc_feature (177)..(177): n is a, c, g, or t
  misc_feature (180)..(180): n is a, c, g, or t
  misc_feature (183)..(183): n is a, c, g, or t
  misc_feature (1254)..(1254): n is a, c, g, or t
  misc_feature (1407)..(1407): n is a, c, g, or t
  misc_feature (1416)..(1416): n is a, c, g, or t
  misc_feature (1462)..(1462): n is a, c, g, or t
  misc_feature (1542)..(1542): n is a, c, g, or t
  misc_feature (1992)..(1992): n is a, c, g, or t
  misc_feature (1994)..(1994): n is a, c, g, or t
  misc_feature (3149)..(3149): n is a, c, g, or t
  misc_feature (3269)..(3269): n is a, c, g, or t
  misc_feature (3293)..(3293): n is a, c, g, or t
  misc_feature (3306)..(3306): n is a, c, g, or t
  misc_feature (3387)..(3387): n is a, c, g, or t
  misc_feature (3412)..(3412): n is a, c, g, or t
  misc_feature (3506)..(3506): n is a, c, g, or t
  misc_feature (3518)..(3518): n is a, c, g, or t
  misc_feature (3732)..(3732): n is a, c, g, or t
  misc_feature (3789)..(3789): n is a, c, g, or t
  misc_feature (3801)..(3801): n is a, c, g, or t
  misc_feature (3804)..(3804): n is a, c, g, or t
  misc_feature (3816)..(3816): n is a, c, g, or t
  misc_feature (3828)..(3828): n is a, c, g, or t
  misc_feature (3849)..(3849): n is a, c, g, or t
  misc_feature (3900)..(3900): n is a, c, g, or t
  misc_feature (3912)..(3912): n is a, c, g, or t
  misc_feature (3924)..(3924): n is a, c, g, or t
  misc_feature (3933)..(3933): n is a, c, g, or t
  misc_feature (3936)..(3936): n is a, c, g, or t
  misc_feature (3942)..(3942): n is a, c, g, or t
  misc_feature (3954)..(3954): n is a, c, g, or t
  misc_feature (3963)..(3963): n is a, c, g, or t
gaacaggtgaaaagtggacgagcagtaggggaattaaatcaccctgaaggtccaacaattaacctggataaagtttcacataagattacagatctcagatttgaaggaagtaatgttattggaaaagcatcaattcttaaaacccctatgggacaaatcgttgaaggtttgctcganggnggngttaagcttggtgtatcaagtcgtggtatgggtagtcttgtacagaagaatggtactagttacgtgggcaaggattttatgcttgcaactgtagatatagtccaggacccttccgctccagaggcatttgtcaatggaattatggaaggtgttgattggatatggaataacggtatcttaactgcacaagaaattgaatcaattgagactgaaataaagcgtactcctaagaagcatttagctgaagcagagatcaaagcgtttaaaaatttcctctctaaactttaattcttaataggagaatataaaatgtcattagaagacgcaattaaatccactgctgttgcagaggaagaggctgtgttagacatctctgaagatgctgagctagattctgaagaagagctcgttgaaaacgaagttggaaacgaggaagaagctttagatgaagtagtagccgaagcaaaggttgaagaagacgaagatgaagacaaaaaagacgaagaaaaagtcgaagagtctgcacctgtagtccctaaaactaaagctggtgttattaacgctgcattggagatgtttaaaaaggccaaaaaagaagacgcgcaaaagctatatgctaaattgacaaaagtagaagaatcagaagacgatggatcagttgataaaacaattgatgctgttgctaaagataagaaagcacctaaagctaagctagaggctgctgactattctgaagatttggatatcttagtagctgaagaagctacattgtcagatggattccgtgttaaagctggtgcaatttttgaagctgcttacgcaagtaaagtaggtgctgaaattgataggctagaaggcgaatacgcgcaaaatcttgaagaagaagtcgctgatattcagagctcactcgtagaaaaggtagattcataccttaactatgttgttgaaaactggatgaaagaaaatgaagtagcagtagagactggactaaggtctgaaatcgctgaagactttatgagtgcacttcaggtagtattcaaggaacattacattgaagttccagaaggtaangttgatctagtagatgagttatcatcacaggttgctgagctagaggaatcactcaataaaaccacagaagaaaatattcgtttatacgagtcaactcaatctttagaaagagctgaaatcgtaagaagacattcttcaggcttggctgaaacngaagctganaagttatcatcattggtagaagacattgaattcgataacgctgaanctttcgaaatgaaagtatcagttgttaaagagtcatacttcaagcaagatgttactgaatcagttgacgaagtaaatgcngcaattggaaatgaagaagctgacgaagttcagtctatctctaattcaatggctgcttacactcaagctataactaaatctattaaataaaacataaacctaaggggaaataaaaaatgtttaacgcagataaaaatctagtagagaaatggactcctgtccttgatcacgaagatgctccaagcatcggtgacaagcacaagagagctgttactgctagactcttggaaaaccaagaaatcgcactacaagaaaacagagctcattctgattttcaacttaatgaaacagcagctaacgctactggttctggtattagtaactttgatccagtattgatctctcttgtaagacgtgcaatgcctaaccttatcgcatacgatatcgcaggcgtacaaccaatgaacggacctactggtctaatcttcgcaatgaagtcaagatacaccncncaagatggtgctgaagctttacataacgaagctgatactgatttctcaggaactggtacacatcaagctgatcctactggattggtcggtgtagctgattctggagacgcaggtacttctatcgctgatgaagctgatactgtatctactttcggttctggtatcactacagctaatgcagaagctaaaggtacagctgtacccggttcagctatttcaagtgctaaccagtttggccaaatggctttctcaatcgaaaaggctcaagtactagctaactcaagagctcttaaagctgaatacactatggaacttgctcaagatcttaaagcaatccacggtctagatgctgaaggcgaattagctaatattctttcttctgaaatccttgcggaaatcaacagagagatggttagaactattcttactaaagctaaaatcggtgcacttcaagcaagtgttgcacttaaaggtgtatttaacgttaatactgattctgacggaagatggatggttgagagatttaaaggtctcatcatgcaactcgaaagagaagctaacgtaatcgctaaagaaacaagaagaggaaaaggtaattttgtactttgttcttctgatgttgcttcagcactagcagcagctggtcttttagactacactcctgctctttcaactgacctaaatgttgacgatactggtaatacttttgctggtgttcttaacggtagaatgaaagtatatatcgatccttatgctactagcgatttcgcttgtgtaggttacagaggttcaaatccatacgacgcaggtatcttctattgcccatacgttcctttaactatggttaaagcgattggcgagaatgacttccagccaagaattggattcaaaactagatatggaatgcagcagaacccattcgtgggaacagctacaggtgcgggtactaaccgtgtcaacccatatttcagaatctttagagtagacggaattatggtgtaaaccgtaattagttaattctaattctgatgaagaggggtcttaggatccctctttttttgtctgagttctatgctaaaagacttataaatagtattaggagattattatatggctacactaacttcaaataaaaactatttaagtcctgttggntttaaatttactattgacaatcaattgtaccctaatttagaatacttttgtactgcagtatctttaccatcaattagtattgctgaagcaccaatgcctttcagaggagctaatgtaggntttactggagacagaattacattngatgatttaactnttaagtttaatattactgaagatatggataactataaggaaacttttgattggattcataatatagttaatgttggagagnaatttaaatctgatgccattttaantatattaacctcacacaataacgtaagtaaaactattaggttctcagatgtttttcctattagtttaagtggtgttgaatttacaacaggtgcnactgaaattgantacttacaagcagacgtaacttttaaatatacctcgtttgaatttatataataactactatcatatatagtagtataggaaattaattatgttagatattgaaaaaatattagaaatgtggaagaaagactcaaacattgatgaaatgcaacttgacgaatcttctaaagactcagcaaaactccacgcaaaatacctcgaatttgtaacacanaatcgtttagatcttaagaaaagagaaatggaatttaaggtcttacttaaagataantggttacactanaanggaaaaatgtcnaaagaagatatngacgatagaggttgggattangatccattaaatggattaaaggtattaaaaggggatatggattattactangattcagatccngatattcaaaangctcaagcncgnattgantatcttaaaacnactgcaganacattaaaagaaattttagataatgttaagtggagac

SEQ ID NO: 1582 - DNA, 4000 bp, Escherichia coli
  misc_feature (86)..(86): n is a, c, g, or t
  misc_feature (416)..(416): n is a, c, g, or t
  misc_feature (419)..(419): n is a, c, g, or t
  misc_feature (458)..(458): n is a, c, g, or t
  misc_feature (692)..(692): n is a, c, g, or t
  misc_feature (770)..(770): n is a, c, g, or t
  misc_feature (788)..(788): n is a, c, g, or t
  misc_feature (947)..(947): n is a, c, g, or t
  misc_feature (1040)..(1040): n is a, c, g, or t
  misc_feature (1055)..(1055): n is a, c, g, or t
  misc_feature (1262)..(1262): n is a, c, g, or t
  misc_feature (1289)..(1289): n is a, c, g, or t
  misc_feature (1364)..(1364): n is a, c, g, or t
  misc_feature (1376)..(1376): n is a, c, g, or t
  misc_feature (1379)..(1379): n is a, c, g, or t
  misc_feature (1388)..(1388): n is a, c, g, or t
  misc_feature (1481)..(1481): n is a, c, g, or t
  misc_feature (1616)..(1616): n is a, c, g, or t
  misc_feature (1922)..(1922): n is a, c, g, or t
  misc_feature (1985)..(1985): n is a, c, g, or t
  misc_feature (2490)..(2490): n is a, c, g, or t
  misc_feature (2497)..(2497): n is a, c, g, or t
  misc_feature (2502)..(2502): n is a, c, g, or t
  misc_feature (2509)..(2509): n is a, c, g, or t
  misc_feature (2511)..(2511): n is a, c, g, or t
  misc_feature (2513)..(2513): n is a, c, g, or t
  misc_feature (2518)..(2518): n is a, c, g, or t
  misc_feature (2535)..(2535): n is a, c, g, or t
  misc_feature (2540)..(2540): n is a, c, g, or t
  misc_feature (2543)..(2545): n is a, c, g, or t
  misc_feature (2549)..(2550): n is a, c, g, or t
  misc_feature (2553)..(2576): n is a, c, g, or t
  misc_feature (2579)..(2586): n is a, c, g, or t
  misc_feature (2588)..(2588): n is a, c, g, or t
  misc_feature (2590)..(2602): n is a, c, g, or t
  misc_feature (2604)..(2606): n is a, c, g, or t
  misc_feature (2608)..(2620): n is a, c, g, or t
  misc_feature (2622)..(2637): n is a, c, g, or t
  misc_feature (2639)..(2647): n is a, c, g, or t
  misc_feature (2649)..(2652): n is a, c, g, or t
  misc_feature (2654)..(2657): n is a, c, g, or t
  misc_feature (2660)..(2661): n is a, c, g, or t
  misc_feature (2663)..(2664): n is a, c, g, or t
  misc_feature (2666)..(2672): n is a, c, g, or t
  misc_feature (2674)..(2682): n is a, c, g, or t
  misc_feature (2684)..(2685): n is a, c, g, or t
  misc_feature (2687)..(2690): n is a, c, g, or t
  misc_feature (2693)..(2694): n is a, c, g, or t
  misc_feature (2696)..(2696): n is a, c, g, or t
  misc_feature (2698)..(2701): n is a, c, g, or t
  misc_feature (2703)..(2725): n is a, c, g, or t
  misc_feature (2727)..(2761): n is a, c, g, or t
  misc_feature (2763)..(2767): n is a, c, g, or t
  misc_feature (2772)..(2799): n is a, c, g, or t
  misc_feature (2803)..(2887): n is a, c, g, or t
  misc_feature (2889)..(2897): n is a, c, g, or t
  misc_feature (2899)..(2903): n is a, c, g, or t
  misc_feature (2905)..(2912): n is a, c, g, or t
  misc_feature (2914)..(2933): n is a, c, g, or t
  misc_feature (2935)..(2943): n is a, c, g, or t
  misc_feature (2945)..(2950): n is a, c, g, or t
  misc_feature (2952)..(3036): n is a, c, g, or t
  misc_feature (3039)..(3129): n is a, c, g, or t
  misc_feature (3131)..(3167): n is a, c, g, or t
  misc_feature (3169)..(3176): n is a, c, g, or t
  misc_feature (3178)..(3210): n is a, c, g, or t
  misc_feature (3212)..(3223): n is a, c, g, or t
  misc_feature (3225)..(3240): n is a, c, g, or t
  misc_feature (3243)..(3258): n is a, c, g, or t
  misc_feature (3260)..(3264): n is a, c, g, or t
  misc_feature (3266)..(3267): n is a, c, g, or t
  misc_feature (3269)..(3295): n is a, c, g, or t
  misc_feature (3297)..(3314): n is a, c, g, or t
  misc_feature (3316)..(3468): n is a, c, g, or t
  misc_feature (3470)..(3512): n is a, c, g, or t
  misc_feature (3514)..(3524): n is a, c, g, or t
  misc_feature (3527)..(3537): n is a, c, g, or t
  misc_feature (3539)..(3560): n is a, c, g, or t
  misc_feature (3562)..(3572): n is a, c, g, or t
  misc_feature (3574)..(3618): n is a, c, g, or t
  misc_feature (3620)..(3628): n is a, c, g, or t
  misc_feature (3630)..(3641): n is a, c, g, or t
  misc_feature (3643)..(3797): n is a, c, g, or t
  misc_feature (3799)..(3830): n is a, c, g, or t
  misc_feature (3832)..(3974): n is a, c, g, or t
  misc_feature (3976)..(3981): n is a, c, g, or t
  misc_feature (3983)..(3984): n is a, c, g, or t
  misc_feature (3986)..(4000): n is a, c, g, or t
ggctctaaagagtaatcgtcatcgcaggaggaaagaaaatgggtaaaacaaaagggcgtttaaccctaccaagtgaatcgaatttncttgaacagactaaagaattgctcgaccgttggggtgcagatgcaattcgtgatagcgatggaacgaaactcgatgaagcaaccaaacaattagatgcaaaaatctatacaacctactttgtagcacgtaaccataatgatttcatcaaagatcatatggaagagtgccaacaaatcttcgtcatgtcaaaattctggttagcaacagaagatacgctaacgattccatttatggaaggctacttcgaagaccaagtgcaaccagactatgtacatgatccaaaaagatattgggaagtcatcgaccgtactactggagaagtggttccngtngagagatggactgtccatgaagaaaacaacacgattacnattgaaggcactcgtcctttccatgagtatacagtgtcgtttctagtgtatgcgatttgggatccaactcaaatgtacaatcatattacgaataactggggcgatgttcctcacgatattccatttgatgtacgtggacctcattcaaatcaattcatgcactcttatttaaaacaatggttaaaagacaatccggatactgatgtggttcgttttacaacgttcttctatcanttcacattaattttcaacaacttaggaaaagaaaaatttgtggactggttcggatatggtgccagcgtttcagtcgcngcacttgaagcttttgcnaaggaaaaaggctatcgcttaagagcagaagacatcgtggatgaagggtactataactcaacattccgcacaccaagtaaagcgtacttagactatatcgacttcattcaagcattcgttgctagagaagctaaaaaattagtcgacgaagtacacgangctggtaaagaagccatgatgttcttaggagataactggattggtacagaaccatacggaccatacttcgaacaaatcggattagatgcagtngtgggttctgtcggnggcggagcaacacttcgtatgatttcagatattccacacgtaaaatatacagaaggaagattcttaccatacttcttcccagatgtattccgtgaaggaaatgatcctacgattgaagctaataaaaactggttatcagcaagacgtgccatcatgcgtaaccctgtagaccgtatcggatacggcggttatttaagtcttgcatanaaattccctaaatttgtcgactacatngaacatgtaacagatgaatttagagaaatctacgatatcgtaaaacatacaaaaccatatactggtttgaaagtngccatcttaaangcntggggacgnttaagaacttggcaagcacacatggttgcccatgaacttccatacaaacaaatctattcttaccttggaattatggaagccttaagtggtgcnagtgtggacgtaagctttatcagctttgacgatatcattaacgatggagttccagaaggtgtcgatgtcatcatcaacgcgggggatgccggtacttcatttagcggtggagaggtttggaagaatgaaacgctnattacacgtattcgtgaattcgtgtataacggcggcggatttgtcggagttggggaaccaacagccgttcatcatcaaggaagattcttccaacttggagatattttgggtgttgaaagagaaatgggatatagcctttcaacagataaatactttacaaaagaattgaaagaacactttattatcgaagatattgaagatgttcataagattgactttggggaaaatattaaaaacgtgtatggcttaacgagtgcaacagaagtacttgaatttagcaatccgaaagtaagcgcaggtggcgtngaagaaggaatcgttcttccagccaatgccgaaggaaaagaattcggggaaatccatcttgcngccaacccttacggaaaaggtcgtggggtttacattgcaggacttccatacacaccagaaaatacaagattattaatgcgtgcgttattctacgcagcgaataaagaaagtgaattaacaaaatggtatgcaagcaatccattagtggaagtacatgcttatcctgaaaaaggagtgtatgcaatcgtgaataatacgaacgaattgcaatcaacactcgtttatgatggagcaggtgtatcaagaactgtggaacttgagccaagcgaaattagatgggagaagatatcatgaatcctaaagtgaaaatttggatccgcgtcgtattgatgttggtattcttatatgtagttattttggggcatcagatgattggcaaagaaggcgttgcaacaatgcttgttggcttagctggattacttctcttgctatgggattacaatcgtccgtactctaaatcgatgaagcgttaataaaacttaactaggaacaggggcttgtttancaacaanccccngttcctntntncatanacacaatatttaaaaanaaaanaannnaaannaannnnnnnnnnnnnnnnnnnnnnnntgnnnnnnnntntnnnnnnnnnnnnnannngnnnnnnnnnnnnncnnnnnnnnnnnnnnnntnnnnnnnnnannnngnnnnaannannannnnnnnannnnnnnnnanntnnnnttnntncnnnntnnnnnnnnnnnnnnnnnnnnnnncnnnnnnnnnnnnnnnnnnnnnnnnnnnnnnnnnnntnnnnnttttnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnannnnntnnnnnnnntnnnnnnnnnnnnnnnnnnnnannnnnnnnnannnnnnannnnnnnnnnnnnnnnnnnnnnnnnnnnnnnnnnnnnnnnnnnnnnnnnnnnnnnnnnnnnnnnnnnnnnnnnnnnnnnnnnnnnaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnannnnnnnnannnnnnnnnnnnnnnnnnnnnnnnnnnnnnnnntnnnnnnnnnnnnannnnnnnnnnnnnnnnaannnnnnnnnnnnnnnntnnnnntnntnnnnnnnnnnnnnnnnnnnnnnnnnnngnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnannnnnnnnnnnaannnnnnnnnnnannnnnnnnnnnnnnnnnnnnnnannnnnnnnnnnannnnnnnnnnnnnnnnnnnnnnnnnnnnnnnnnnnnnnnnnnnnnannnnnnnnnannnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnannannnnnnnnnnnnnnn

SEQ ID NO: 1583 - DNA, 4000 bp, Escherichia coli
  misc_feature (9)..(10): n is a, c, g, or t
  misc_feature (15)..(16): n is a, c, g, or t
  misc_feature (18)..(18): n is a, c, g, or t
  misc_feature (22)..(22): n is a, c, g, or t
  misc_feature (24)..(27): n is a, c, g, or t
  misc_feature (31)..(31): n is a, c, g, or t
  misc_feature (34)..(36): n is a, c, g, or t
  misc_feature (39)..(40): n is a, c, g, or t
  misc_feature (43)..(48): n is a, c, g, or t
  misc_feature (51)..(51): n is a, c, g, or t
  misc_feature (59)..(60): n is a, c, g, or t
  misc_feature (64)..(64): n is a, c, g, or t
  misc_feature (66)..(67): n is a, c, g, or t
  misc_feature (72)..(76): n is a, c, g, or t
  misc_feature (78)..(82): n is a, c, g, or t
  misc_feature (87)..(88): n is a, c, g, or t
  misc_feature (103)..(103): n is a, c, g, or t
  misc_feature (135)..(135): n is a, c, g, or t
  misc_feature (140)..(140): n is a, c, g, or t
  misc_feature (143)..(145): n is a, c, g, or t
  misc_feature (147)..(147): n is a, c, g, or t
  misc_feature (161)..(161): n is a, c, g, or t
  misc_feature (166)..(168): n is a, c, g, or t
  misc_feature (172)..(175): n is a, c, g, or t
  misc_feature (180)..(181): n is a, c, g, or t
  misc_feature (187)..(187): n is a, c, g, or t
  misc_feature (190)..(190): n is a, c, g, or t
  misc_feature (196)..(199): n is a, c, g, or t
  misc_feature (201)..(204): n is a, c, g, or t
  misc_feature (208)..(208): n is a, c, g, or t
  misc_feature (210)..(211): n is a, c, g, or t
  misc_feature (213)..(214): n is a, c, g, or t
  misc_feature (216)..(220): n is a, c, g, or t
  misc_feature (224)..(225): n is a, c, g, or t
  misc_feature (228)..(228): n is a, c, g, or t
  misc_feature (232)..(233): n is a, c, g, or t
  misc_feature (235)..(235): n is a, c, g, or t
  misc_feature (662)..(662): n is a, c, g, or t
  misc_feature (1170)..(1172): n is a, c, g, or t
  misc_feature (1711)..(1711): n is a, c, g, or t
  misc_feature (1888)..(1888): n is a, c, g, or t
  misc_feature (1987)..(1987): n is a, c, g, or t
  misc_feature (1991)..(1991): n is a, c, g, or t
  misc_feature (2245)..(2245): n is a, c, g, or t
  misc_feature (2699)..(2699): n is a, c, g, or t
  misc_feature (3319)..(3319): n is a, c, g, or t
  misc_feature (3484)..(3484): n is a, c, g, or t
gcgcgccgnngcggnncncccncnnnnggancgnnnccnngcnnnnnntgncgccccgnncggncnncaggnnnnngnnnnnggccnngctcatgtccaccgncagcaccgccgccgccatctccaccgccgccncccgnccnnngntcgtgggcgatccntcccnnngggnnnngatcnncggcgncgngccccnnnngnnnnacgncnncnncnnnnncacnncgncgcnngncggcgcgtggctgtcgcccgcggcgcaggcgcggatccgccaccgccccatcaccatgcgcggcgtcttcaccttcgatctcgaacgaaccacggacccaggcgcgaaagcgaaagcggcggccgcatgagcggggatcacccacaacaaggatatcgctgcgttacgcagcgatcgaagaaatacttaactctcgtcaatgccttaccgcgcgatccgtggcgcaggctactgcatcctggcaacgccagccccaacatgggacggcccgacggcctcaaaagaggcggcgccaagctgacccagcgcgcgcgccagctccagcttcagaatctccatcgcgcgccgcgcgcctgcggcgccgcccgcgccgacgccgaacgccagcgcccgcccggtgaaggcgaagtcggcgcccagcgccctngcgcgcaggatgtcggcgccgcgccgcacgccgctgtcgaggatgatcttcatccggtcgccaaccgccccgccgaccgcctttgcgacgcccggcagcgcctcgatggtcggcggcccgaacgcgacctggcggccgccgtggttcgagacgacaatcccgtcgcagccgatctcggcgcagcgcagcgcgtcgtcggggtgcagcacgcccttcaccagcagcgttccccgccagcggtcgcgcaggcgcgcaaggtcgcgccaggtgaaggcgggcgtgatcagcgtcttctggacgtcggcgtaggacgtggcggcttgcagcaggtcggcatagttcgcgatgccgggcttgccatggcgcagcgtctccagcgaccagcgcgggtgggcgagcagtcccagcgcgacctccggcgtgatccggaacggcacgctcaactggttgcggatgtcgcggtcgcgcttgcctgcggcgggcacgtcggcggtcaccatcatcaccnnntagtccgccgcctcggcgcgcgcgaccaggctttcggtcaccgccgcgtcgccggagacgtagagctggaaccagcccctgccgtcggcggcctccgccagacgctccagcgtcgtcgaggcggcggagctggcgacataggggatgttctcggcggcgcacagccgcgcgaggatcaggtcggcgccgggccagaacgcgttcagcatcccgatgggcgccatgccgaacggcaggtcgaaggtctggccgaacagcgtcgcgcgcgtgtcgatcgcggagacatcgaccatgtagcgcggcgtgagctgcacctcctcgaacgcttcgacgttgcgccgcagattgcgctcggattccgcgccgccatcgaccagatcgaaggcgaagcgcgggatccggcgccgggcgcgccgccgcaggtcttcaatcgacgccgcgcgctcaaggcccatcagatcgaccatccgccgtcgatggcgaaggcctgaccggtggtgaagccggacagatcgcccgcgagatagcacaccatctcngcgatctcctcgggcgtgccgaaccggcccatcggctggcgcgcggtgaaggcggcgtgcgccttgtcgtaatcgcccgtggcggtgagacgctgtttcagcgaggggctttccaccgtgcccggacagatcgcgttgcagcgcacgccctggcccacgaagtcggcggcgatgganttggtcatgccgatgatcgcggccttggaggcgccataggcgaagcggcgcggcgcgcccttgaggctggagaccaccgaggcgatggtgatgatcgancccnggccctgcgccagcatccccggcagcaccgctttcgtcagccggaagatcgccttggcgttgaggtcgaaggaccggtcccatgtcgcctcgtcacagtcgaggatggtgccgtcatgcacatagcccgcgcagttcacgaggatgtccagcggcggcagggaggcgaccagcgcttgcaccgcgcctgcgtcgagcacgtcgagccggtgcgcggtgatgcgctccgccccggcggcgaggtcctgcactgcngcgccgtcgatgtcggtggcgatcacggcggcgcccagtcgggccagcgcctcggccgaggcgcggccgatgccctgaccggcggcggtcacgagggcggtttttccttgaagggtctgggtcatgggtcctctctcagcgcgccagccagccgccgtccaccgtcaccacgcttccgtggcaataggcggcggcgtcggatgacaggaaaacggcggccccggcgatctcggacggctcggcgaagcgccccgccgggatgcgcgccagcagcgcgcgcgaccgctccggatcgtcgcgcagggcctgggtgttgtcggtggcggtgtagccgggcgcgatggcgttgacgttgacgccatgcgccgcccactcgttgcacagcgcccgcgtcaggccgatcacggcgtgcttgctggcggcgtaggcgggcacgcgcagcccgccctgcgtncccagcacggaagacacgatcacgatcttgcccgcgccttgcgccaccatgcgccgtccggcggcctggctcagcagccagaccgagtcgaggttcaccgacaggacgcgccgccagtcggcgaaagccatgtccgccgagtcgccgcgatggatgatcccggcgttgttcaccaggatgtcgagaccgcccagcgcatcggcggcgaagccgatgacgtctccggcggcggcttcgtccatgtcggcgaagtcggcccgcacggcggcggccttgcggcccaggctctcgatccggaccatcgtcgcgtcgggctggtggctgcggaaggtcagcgcgacatcggcgccggcggcggcgagggcgagggccacgccctcgccgatgccggtggcgccgccagtcacaagggccttgcggccggtcaggtcaaacggactggccatcgtcagtagcggttcgcgatcggcagttcctcggcgggaaacagcgagatcacctcgcagccggtcggggtcaccaccacctcctcctcgatccgggcggcggagtagccgtcggcggcggggcaataggtctccagcgcgaacaccatgccggtctggatctccatcgggtgntcgaggctgacggcgcgcgagatgatcgggcgttcgtgcagcgcaaggcccaggccatggccgaactgcaggccaaaggcggcgtcctcgctgggaaaaccgaattcctcggccttcggccagaccttcgcgacggtgtcggtggtcacccccggcttgatcagngcgatggaggcgtcgatccactcgcgggccttcacataggcgtcattctgcacaggcgtggcgcggccgatgttgaaggtgcggtagtagcaggtgcgatagccctgatagctttgcaggatgtcgaagaacgcctggtcgccggggcgaaagtaacggtcggtgaagttgtgcggatgcgggttgcagcgctcgccggaaatggcgttgatcgcctccacatcgtcgctgcccatctcgtagagcagcttgttggacagcgcgacgatgtcgttctcgcgcacgcccggtttcagttcttcatagatcatgtgatagacgccatcgaccatggctgcggcctgggtcagaagctggatttcgtcccagttcttgatctcgcgcgccgccagcatgatctgctggccatcgatcaccttgatcccctcctcctgaagcgcgtggaacatggcggtctcggcgtagtccacgcccaccggcatgtcggccatgcctgcgtcgcggatcaggcccgcg

SEQ ID NO: 1584 - DNA, 4000 bp, Escherichia coli
  misc_feature (2192)..(2192): n is a, c, g, or t
  misc_feature (3512)..(3512): n is a, c, g, or t
  misc_feature (3737)..(3737): n is a, c, g, or t
gcaactagctcgggcatggaggtcatttccaccctcctcgccattactgcaccaataatcgcaccaccaagcatcaagggaaccagcagttcgaagttggaaaccttaccacttaaaaaggtagccagtacggcaatcgtcattccgacaatgccgtagagatttccccttcgggcagtctcctgtttagaaagacctccaaggctgagaatgaaaaagatagcagacactaggtaagccatggtaaccaagccatcgctcagaggataaaaagatgatatatttcctgagttcattacttacggaacattttcagcatgcgctgagttacgagaaatcctccggccacattgatggtggccacaaagattgccaccccagcaagccagggattagccccagaaacaaagagcataccaccgatcaggatgattccactaatcgcgttggttacactcatcaatggggtatgcaaagatggtgtcacattccagaccaccatgtaacccacaaaacaggcgagaacaaagacggtaatctgatcgagaaattcactcgatccattccagcccagggcaagcagagcaaacgagagcaaacccagcaaaaacccaccggaaagtagtgggtttttagtttttttctctttcccaagttcttccggcttagcctctggctttttggttggggcgaccgatgtttccaccggtggtgggggccagcttaatttaccctgatcaagaaccatagctccacgaaccacctcatcttcctgattgatcttaaaatcatctgcctgcccaagcaactggacaaacttgaccaggttgttcccgtagagccggcttgactgggtgggcagacgggagggaaagtcggtgtatccgattatggtgaccccgtgtgcgaccttggcctggccgctttcggtaagctcgcaattccctcccccctcggcagccaggtccacgatcaccgaacccggcttcatactccggaccatctcctcggtgataagcacgggtgatttcttgccgggaatcatcgccgtggtgataatgacatctacctccgcggcctgctcggcaaaaagtttcatttctgcctcgataaattctttactcattaacttggcatacccaccggaaccagcaccatcttcctcgaaatcaagttcaagaaaggcagctccaagacttttcacttcttccttaactgcaggcctggtatcaaaggcacgcacgatcgcccccatgttacgagcggcaccgatggcagcaagaccagccaccccggctccgatgatcaaaaccttggcgggaggcactttcccagcggcagtgatctgcccagtgaagaagcgaccaaacacatgcgaggcttccactaccgctcgatatccagcgacattggccatcgaactaagggcgtccatcgactgagcacgggaaatgcgcggcacgcagtccatcgccagcagattgatttttcgatccgccagtttttggatcagttcctcatttctcgcagggtagacaaaactgataagggtggctccttcacggattcctcccgcttcgtccattgaggggggagtgacttttaaaataaggtcgcacttccatacctcggcggcatccgcagcgatgcgggctccggcctcctcataggcagaatcggctaggttagccgctttgcccgctcccctttcaatcaatacctcgtatccgagcttggcaaaggctgcgacattttccggagcaatggccactcgcttttccgaagggtaggtttcctttggtatagcaattatcataatagtaagatgaattctgtcccaatctaaggatcgttggcaaaggtaaagtggatatcctcagaaagtatctttcacgaaatttttaaaatttgtaggcaattgggttttggatcgacgggaactcaaaggagaatggtttcggctcgtcaaatgatgaattcatgatatggtaaactttaatttagccaatctttgaaacaaaggctcacaagtggatggaattcataagaaaagtgggcaaaggttcaaacttggccattaagagccaataacaataccccaattttatcttatgactgaagaagaactcccccaaggggagcatgattcggaaggtcctcgttttgaggacttcgatcttgccccagcaatncaaaaagcggtagcccgcgttggctacgaaactccctctcctattcaaaggcggtctattcctcccttgctggagggatgtgatctcttaggagttgcccaaaccggaactggtaaaaccgcagccttttctctcccgctcctgtccaggctcgatccagatctgaaagtcgttcagatgttgtgcctcgcaccgacccgagaacttgcgattcaggttgctgaagctatggaaacatttgctgaagatattcccggtctacgtattctggcggtctatggaggtactggttacacggaacaaattcgtgaactcaagcggggtgctcaaattgtggtaggcacgcctgggcgcgtcatggatcatgttaagaaaaagtacatgaaactcgaccaggttaaggccatggttttggacgaggctgatgaaatgctcagcatgggattcatcgaagatatcgagtggattttggaacaaactcccagtgaccgtcagaccgctcttttttccgcaactatgcccaagcctattcggaagttggccgacaagcacctcaatgaacccgttgaaatcacgattgaggtaaagcgggaaaatgctcccaacatccgccaacgattccttaaagtacgcccgcatgagaaaatcgacatgctcagtcgcattcttgaaatagaaaccttcggtgcgatgcttatctttgcccgcactaaaaatgcgactacagatattgccgagacccttatggccaaagggtatccagcagaagcacttaatggtgatatgcctcaaaaattaagggaaaaaacggtggatcgccttcgtaagggacatgttaaggttgtggtcgccaccgatgttgcggcccgtggcctggatgtggatgtcatcacccatgtggtcaattatgatgctcccttcgatctagaatcctatactcaccgaatcggtcgcacgggtcgtgcaggccgtgagggagacgccatcctttttgtcaccaataaggaaatgaggatgctcaatgccattgaaagaacattaaaatccaaatgcgacgagtacaaattccccaccttggaggagatgaatgagcgtaaactgggggagtttttcacccgaatggaagaagctctaacctccaatgatcttacagattacaggcaagctattcaaaaatttcttgaagaaagtggtaaggattccatcgatgtagctgctgccctagcctacctggatgctggtaaaaaacccttattttacgatgaaatgcccaccgcacccaaaggtcccaaaagagagaggcgcgagcgtggcggagancgggatgatcgctatgtaaataacaacgatttgcaaagctaccgcgttgaggttggtgaatatcatggtgccgaaaagcgagatctggttggtgcgattgccaatgaaatcggcatggattcaaaattcatcggcaagatccgaatgttcaaagatcactcatttatcgaccttcctaaagatatgcccaaagaggtccatgaggcccttaagcaagtttgggtncagggacaccagctcaatatctcagttgatcgtggaagaccacgacaagaaggcagaggaggaaagttcagaggcaagggaggtggcggcttccgcaagggtggaggattccgcaaaggggatggccgttccaaatctggaggtggcttcaaaggtggtggaaaattccacaaagaaagataggaagggtcacagcccctttcactttcgattatttcctcaaagaaaaaacttcctgtaaaagctacttggatgtagcccaa

SEQ ID NO: 1585 - DNA, 4000 bp, Escherichia coli
  misc_feature (319)..(320): n is a, c, g, or t
  misc_feature (322)..(323): n is a, c, g, or t
  misc_feature (326)..(326): n is a, c, g, or t
  misc_feature (328)..(328): n is a, c, g, or t
  misc_feature (330)..(332): n is a, c, g, or t
  misc_feature (334)..(336): n is a, c, g, or t
  misc_feature (338)..(338): n is a, c, g, or t
  misc_feature (340)..(340): n is a, c, g, or t
  misc_feature (343)..(343): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (358)..(359): n is a, c, g, or t
  misc_feature (361)..(361): n is a, c, g, or t
  misc_feature (365)..(365): n is a, c, g, or t
  misc_feature (367)..(367): n is a, c, g, or t
  misc_feature (369)..(369): n is a, c, g, or t
  misc_feature (376)..(380): n is a, c, g, or t
  misc_feature (384)..(384): n is a, c, g, or t
  misc_feature (388)..(389): n is a, c, g, or t
  misc_feature (397)..(399): n is a, c, g, or t
  misc_feature (401)..(401): n is a, c, g, or t
  misc_feature (403)..(403): n is a, c, g, or t
  misc_feature (406)..(406): n is a, c, g, or t
  misc_feature (409)..(409): n is a, c, g, or t
  misc_feature (414)..(414): n is a, c, g, or t
  misc_feature (416)..(418): n is a, c, g, or t
  misc_feature (421)..(422): n is a, c, g, or t
  misc_feature (427)..(428): n is a, c, g, or t
  misc_feature (431)..(431): n is a, c, g, or t
  misc_feature (434)..(436): n is a, c, g, or t
  misc_feature (439)..(439): n is a, c, g, or t
  misc_feature (447)..(450): n is a, c, g, or t
  misc_feature (452)..(452): n is a, c, g, or t
  misc_feature (454)..(454): n is a, c, g, or t
  misc_feature (460)..(460): n is a, c, g, or t
  misc_feature (462)..(463): n is a, c, g, or t
  misc_feature (471)..(471): n is a, c, g, or t
  misc_feature (475)..(476): n is a, c, g, or t
  misc_feature (484)..(484): n is a, c, g, or t
  misc_feature (488)..(488): n is a, c, g, or t
  misc_feature (490)..(490): n is a, c, g, or t
  misc_feature (495)..(495): n is a, c, g, or t
  misc_feature (497)..(497): n is a, c, g, or t
  misc_feature (508)..(509): n is a, c, g, or t
  misc_feature (511)..(511): n is a, c, g, or t
  misc_feature (513)..(513): n is a, c, g, or t
  misc_feature (516)..(516): n is a, c, g, or t
  misc_feature (518)..(518): n is a, c, g, or t
  misc_feature (520)..(521): n is a, c, g, or t
  misc_feature (523)..(524): n is a, c, g, or t
  misc_feature (526)..(526): n is a, c, g, or t
  misc_feature (528)..(528): n is a, c, g, or t
  misc_feature (531)..(531): n is a, c, g, or t
  misc_feature (534)..(534): n is a, c, g, or t
  misc_feature (536)..(540): n is a, c, g, or t
  misc_feature (542)..(543): n is a, c, g, or t
  misc_feature (545)..(547): n is a, c, g, or t
  misc_feature (553)..(553): n is a, c, g, or t
  misc_feature (557)..(557): n is a, c, g, or t
  misc_feature (560)..(561): n is a, c, g, or t
  misc_feature (566)..(567): n is a, c, g, or t
  misc_feature (569)..(570): n is a, c, g, or t
  misc_feature (574)..(575): n is a, c, g, or t
  misc_feature (578)..(578): n is a, c, g, or t
  misc_feature (583)..(583): n is a, c, g, or t
  misc_feature (586)..(589): n is a, c, g, or t
  misc_feature (592)..(592): n is a, c, g, or t
  misc_feature (595)..(596): n is a, c, g, or t
  misc_feature (598)..(598): n is a, c, g, or t
  misc_feature (600)..(601): n is a, c, g, or t
  misc_feature (604)..(604): n is a, c, g, or t
  misc_feature (606)..(611): n is a, c, g, or t
  misc_feature (617)..(617): n is a, c, g, or t
  misc_feature (620)..(620): n is a, c, g, or t
  misc_feature (626)..(626): n is a, c, g, or t
  misc_feature (628)..(628): n is a, c, g, or t
  misc_feature (630)..(630): n is a, c, g, or t
  misc_feature (632)..(632): n is a, c, g, or t
  misc_feature (634)..(635): n is a, c, g, or t
  misc_feature (637)..(637): n is a, c, g, or t
  misc_feature (639)..(639): n is a, c, g, or t
  misc_feature (642)..(642): n is a, c, g, or t
  misc_feature (647)..(648): n is a, c, g, or t
  misc_feature (650)..(650): n is a, c, g, or t
  misc_feature (657)..(657): n is a, c, g, or t
  misc_feature (664)..(664): n is a, c, g, or t
  misc_feature (666)..(666): n is a, c, g, or t
  misc_feature (669)..(669): n is a, c, g, or t
  misc_feature (673)..(673): n is a, c, g, or t
  misc_feature (679)..(681): n is a, c, g, or t
  misc_feature (684)..(685): n is a, c, g, or t
  misc_feature (689)..(697): n is a, c, g, or t
  misc_feature (700)..(701): n is a, c, g, or t
  misc_feature (703)..(703): n is a, c, g, or t
  misc_feature (705)..(705): n is a, c, g, or t
  misc_feature (709)..(709): n is a, c, g, or t
  misc_feature (715)..(718): n is a, c, g, or t
  misc_feature (722)..(722): n is a, c, g, or t
  misc_feature (724)..(724): n is a, c, g, or t
  misc_feature (727)..(728): n is a, c, g, or t
  misc_feature (730)..(731): n is a, c, g, or t
  misc_feature (733)..(733): n is a, c, g, or t
  misc_feature (735)..(736): n is a, c, g, or t
  misc_feature (738)..(738): n is a, c, g, or t
  misc_feature (741)..(741): n is a, c, g, or t
  misc_feature (743)..(744): n is a, c, g, or t
  misc_feature (748)..(749): n is a, c, g, or t
  misc_feature (752)..(752): n is a, c, g, or t
  misc_feature (754)..(754): n is a, c, g, or t
  misc_feature (757)..(757): n is a, c, g, or t
  misc_feature (759)..(759): n is a, c, g, or t
  misc_feature (762)..(762): n is a, c, g, or t
  misc_feature (765)..(765): n is a, c, g, or t
  misc_feature (770)..(771): n is a, c, g, or t
  misc_feature (773)..(773): n is a, c, g, or t
  misc_feature (778)..(778): n is a, c, g, or t
  misc_feature (780)..(780): n is a, c, g, or t
  misc_feature (783)..(784): n is a, c, g, or t
  misc_feature (786)..(786): n is a, c, g, or t
  misc_feature (788)..(788): n is a, c, g, or t
  misc_feature (793)..(793): n is a, c, g, or t
  misc_feature (797)..(798): n is a, c, g, or t
  misc_feature (800)..(800): n is a, c, g, or t
  misc_feature (802)..(803): n is a, c, g, or t
  misc_feature (805)..(805): n is a, c, g, or t
  misc_feature (811)..(811): n is a, c, g, or t
  misc_feature (813)..(813): n is a, c, g, or t
  misc_feature (815)..(816): n is a, c, g, or t
  misc_feature (820)..(820): n is a, c, g, or t
  misc_feature (822)..(822): n is a, c, g, or t
  misc_feature (824)..(825): n is a, c, g, or t
  misc_feature (829)..(829): n is a, c, g, or t
  misc_feature (833)..(833): n is a, c, g, or t
  misc_feature (845)..(846): n is a, c, g, or t
  misc_feature (856)..(856): n is a, c, g, or t
  misc_feature (858)..(858): n is a, c, g, or t
  misc_feature (860)..(861): n is a, c, g, or t
  misc_feature (875)..(875): n is a, c, g, or t
  misc_feature (880)..(881): n is a, c, g, or t
  misc_feature (883)..(884): n is a, c, g, or t
  misc_feature (886)..(886): n is a, c, g, or t
  misc_feature (888)..(888): n is a, c, g, or t
  misc_feature (891)..(892): n is a, c, g, or t
  misc_feature (901)..(901): n is a, c, g, or t
  misc_feature (903)..(905): n is a, c, g, or t
  misc_feature (907)..(907): n is a, c, g, or t
  misc_feature (911)..(912): n is a, c, g, or t
  misc_feature (917)..(918): n is a, c, g, or t
  misc_feature (921)..(921): n is a, c, g, or t
  misc_feature (923)..(924): n is a, c, g, or t
  misc_feature (926)..(926): n is a, c, g, or t
  misc_feature (930)..(930): n is a, c, g, or t
  misc_feature (932)..(934): n is a, c, g, or t
  misc_feature (956)..(956): n is a, c, g, or t
  misc_feature (958)..(959): n is a, c, g, or t
  misc_feature (968)..(968): n is a, c, g, or t
  misc_feature (1977)..(1977): n is a, c, g, or t
  misc_feature (2343)..(2343): n is a, c, g, or t
  misc_feature (3541)..(3541): n is a, c, g, or t
  misc_feature (3544)..(3544): n is a, c, g, or t
  misc_feature (3571)..(3571): n is a, c, g, or t
  misc_feature (3625)..(3625): n is a, c, g, or t
  misc_feature (3628)..(3628): n is a, c, g, or t
aattccctaggattgattgacttggaaagagctgcgaagatatctggagccagattttatttcctgaaaaatgagcttgttctgatgaatcaagctttgacaaactatgctctggactttcttgttgaaaacgggtatcaattgattcagcctccgtatatgctgaagaacgatgcaattaaaggctccatcatcatggatgattttgaagacgtaatctacaaaattgaaaatgaagacctgtacatgattgggacatcagaacacgcaatggcttcaatgcatatggatgagatattggattcaaaaaaccttcctnntnnatncngnnntnnnantncangnttnagnaaggaannangagntnanggaaaannnnngaangggnnttttagannncntnaanttnaaaangnnnaannatttnnggnaannnacnctccaaannnntncnctgaanannaaagaatnttgnntataacanaaangntttancnaaatttggatnnancnttnangnntnnantnttnaanannnnngnnannnggaaantatnctnnaaaanntnngatnncgnggcanggnnnnccnggnnanannagnannnnnnaattgnttnttgttntnantntnncnanttncaagnnanaagattnaggatangncanagangaaaannnaannaagnnnnnnnnnttnngnanacantaaacnnnncccntntcnncnntnanngnacnanngtannaantnttnanaantancaaannantaatnanaanntnanagttncaanngnanngngaaaananannggtngnannaaanaaanaaaagtaaaatnnattatttttnantnnttattaattattantaaanntnncntnatnnaagttccancnnnanaggnnaaaanntcnanncncatntnnnaattaaatttttaaatttaatntnnaattgtttnttgtttgttaaaaaaaatcttaccacttttttatcaaatcagtttatagcaatgcaaaagtaacacaagatttaaaaaagggaataaagcaattgatgaaaaaccggttgagtgatgaacaagaaacaaccaagcccaccgaccagttgcatgtgtagactggtacaactggtgggttgttttacacaagtagttgcgaagaaagttatagaaatctgctaacgattctaaaaaaatttaatacaagaataacctacaaacgttaatggacattcaatttcgcaccagttttaattaattccacttgaaatccgaagtatctggaaagaacctatcaatgggcacaaattcgcgtccgaagatttcaccttgcggaaactcctttgtggcgacgacaacataaacatcttcattctggaccaatttgtgaagggtccttaaagatttacctttcaattctccttggagatcgtcagaagttacaccgcccacagcaactgtaccttcaacttcatgtttttttgatagcagaatatttgcctctttaaacctgtctttaactttgacttcctttgattcttgtaataaatccaaaagcatagttggatttttatttttggcgatgtcaccactattgtatagatatatgccggttatgttgtgaatattattcacattaatgttgtacacgagttgcttaaagtcctctctgaatttcacgccaacaaacccatgaggatcatttgtagatggcgtttgttcatgcgattcaagaatgctccagtacctgtctactggtactgcatttactgttgcgttagaatagatcgtgccaaacaacatgcacaagatacaaatcacagaaatgaaaattaaaattatattcattattagtctccttcaaatattatccaatttaattttttatctagttcagtaacatggctagattgttaaaaccgtcaaacgtctcatataacctaaaaacctattttttccattttccatngtatgaggacgttccgaaagtccaatttcctttgtataggtgttgtcaagtagtggtggaaatttgtattattttatttcacagtcaccaaagtcacgatcgccgtcaagcggactgaaggttccaattctgtcggttcccggcccacatctaaagtaatctgctccaggtccgcctctgagtgtatcattaccaggtccgccatacaggcgatcgtcaccttgtcctccatctaaaatgtcgttggccaatccaccatacaatacatcattttctgttcctccaaaaattttatcccgtccatcatccccatgcaattcatcatttccctgtcctccatctaaagtatcaaagtcgtcaccaccngttaaatagtcattacccgcagaaccattcaaaagatcgtcgccttgctgaccttcaatttcatcgttcccatccaatccgtcaatagtatcttgtccgttgcggccgcgaatatcatcatcggttattgttcccctaatattgtccgggcctgaggcgccattaatatcaactgctcgggaaactaaagctggtctagatagaaaaaatagactgcatacaatgattacgaatccaatttggtaaaacaaatcagaacttcctttacttgatattaccacagttttccaatcatttttgaattcaatacttattaaacatgattatgaaagttgggataaattgttagtggtattggaagcgagagtcagttctatttatattatactggcatatctcaatcagtggatttaatgaaactgaatacaacttggactgcatgttttttagtcttaagtttgtctcttgtgttagtaacagcacaaggaatttcaaataactactttaaattgtgggccgaaggatcgcaatcttcaaaaggataaactatttcaagagtatagtaaaaaggaaatcataaacggatttgctcagaaaccaattagtcttgacaatttagtccaagaagtaagtaatcaattacatagatacgaactggaaaaaatacctgcctcctaattaccggaatcatatactgccatctaccacttatcggtgttttaggttttaaattcaatagttgctcataatgaattatgggtcgaacaattccttcgtatagaattgccacagaaattgaaagaagtaaatggaatttatttgggcaaaaattgacgctttagcacctaagttttttgaaaataatgtgaggttggcattgtggatattgatgaggacgaaatgaggcccatgacggaacaggagatacagtaagcacagataaaagaaggataagtgacactataacacgaagacgtaggtattaatgttaaaatattaaactttataagtagtgctaccggcaatattttctatgttaaatcagaaaaatttgagcctaatcttagtaagtgcaacgttattttcactgatgtttgtagccgcggtaaactctaattttacctttgcgcagaatgagaaattcaaagcaaaactaaaaggagaaagtgaggttcctccagtaaattcatctgcaacnggnaaagccaaattcaaagtcaaggatggngtcattacaattaacgttaacgtaacaggattaaaagacataactgctgcccanatntatgccggggctaagggacaaaatggagaacctgtagtggatctattaaaggctggcaagcagaacaatgcaggcgagagaatcattgttaagggggaaattactgcttcggatcttcaaggtcctatgtctggaaagacactccaagacttccaaacagcaatgggtaatgaggagacatacgtcaatatacagacaagcgataatcccgacggagagataagaggacaaattaaagtaagcggtggtaacgcgacagaaacaggatctatgaatgaaaatgccactgctgacgttgaggatcccactgctgacgttgaggatgagtagttaagtttcatctaactcaagaaacctatttttttcattttt

SEQ ID NO: 1586 - DNA, 4000 bp, Escherichia coli
  misc_feature (6)..(6): n is a, c, g, or t
  misc_feature (162)..(162): n is a, c, g, or t
  misc_feature (175)..(175): n is a, c, g, or t
  misc_feature (349)..(349): n is a, c, g, or t
  misc_feature (370)..(370): n is a, c, g, or t
  misc_feature (628)..(628): n is a, c, g, or t
  misc_feature (640)..(640): n is a, c, g, or t
  misc_feature (646)..(646): n is a, c, g, or t
  misc_feature (820)..(820): n is a, c, g, or t
  misc_feature (1313)..(1313): n is a, c, g, or t
  misc_feature (1378)..(1378): n is a, c, g, or t
  misc_feature (1380)..(1380): n is a, c, g, or t
  misc_feature (1473)..(1473): n is a, c, g, or t
  misc_feature (1992)..(1992): n is a, c, g, or t
  misc_feature (1996)..(1996): n is a, c, g, or t
  misc_feature (3899)..(3899): n is a, c, g, or t
tccgcncaaatattctgtttcatttgtttttcctgttgctgctacaacattgtatcccaaatgtgacaatagagctactgatatgctcccgacacctcctgttgaaccggtcactacgatttcaccctgctccggagacactccgtgtttttgcagtgcatnaaccgaaagagcngccgtgaaacctgctgtaccataaaccattgcatctttgaaagaaagaccttccggaagtggaaccacccaatcagcaggaacgcgtatgtattctccaaaacctccggaggtattcatacctaaatcataactggtgacaatcacagaatcaccggtcttgaactgcgaatcngaactttctgtaacctttccngatgcgtctattccaggcgtgtgaggataattgcgagttacacctggatttccaatgcatgaaagcccgtctttataattcagtgaagaaaaatgtacccggatgagcacctcaccttccggaagatcgctgattgagcgctcggtgatttcacgggtaaaagttttttcgtcagttttactgaccaccaatgcgcgaaaagttgaaacattcatatctaattattcctttttttgtcagtctaaaaattttaccagnggcactattacngccagntcatcctcatcacaggtttcaagcctggaatcttcttttccgattttgacaatcagtattggaccccaacatggattttcattaaattcccattctgtctgtctttcctgcgatgctccttctccatcaaaataagccaggaatggtccgcccaactcttccatatcagtagantcacaacgtaataattcacaaagcatgtctaaattaagagtctcttctaaaagctctatactctgttcatccggatcaacatagatccatgttccaaattgtttaaaatcaatattcatctgccccacaaactcaacaagcagaaattactaaaaaaatgcagtttgaaatcgcagtcagatgttctttctgttatactttgattcttcaaaagacaaattcacaaaaaaatgctaaaaacatcagttacaatttacaccgatggtgcctgctcgcctaatccgggaattggaggttggggagcagttttgatttccaaagaacacaatctccgcaccgaactttccggctctgaagttgactctactaataaccgtatggaaatgactgctgccatcaaagccctggaagccttaaaaaaatcatgtgttgttaaactctacacagattccagttatctaaaaaatgcatttgagaaaaactggttaaatanttggcagaataacggctggaaaagtaaagcaagaaaacctgttgcaaataaagacctctggcttngnctgctcgaagtcagtaagaagcatgaagtttcatggcattgggtcaaaggtcattccgggaatcccgaaaatgaccgctgcgacgaacttgcngttcaggcccgaaagaaatttgcgaagtcaaactgattaataatcaaccgaattttgagtcttccactactacaaattatcccaaacggtttttactatttccttaacctgcgtatcagtgaatttaccatcaacactataaagtactttcccatctttagagaagagcactacgttactgttatcatcacttaacccccacttttgaacaagagttttttcaaggtcttttacatagactgttgttttatattcctcttgtttgcttttcagtttgatgttaatcgcaaaatttggaagccatgttgctgccatgttgatgactgcaacagaaccataattttctggagggtatttttctgccttgagagcttcacttacatggttgttcagatcagattcgtccggatcgacataaaaaaggacaaggacttttccggaaaccaattcctcactgctccactgagtaccatcaagtcttccacctaaatcatcttttagaacaattgttggtggaanttcnccaatgggcaattccccaaaaacaaaagttgaagaaataataaaaattgttaaaattgcgagtattttcatattatttttttgggcaaagggttattaagaatgcatacattaaaactaaaacaactcaattgaaagacaaaaatactattatccggaagcaggtgctggaatatccttaatattcaaacaacgcgggagtttaattgaaccgtctttttgttgaccattctctatgagggcaatcaaagttctggaaaccgcaattgcagttccatttagcatatggacaaatctgttttttcctgtttccgggtctttaaagcgaatgttcatgcgacgtgactgataatctgtacagtttgaagtggatgtcacctcgccccatttgccacgccccggcatccaggcttccaaatcatatttgcgataagctgctcctccaaggtcacctacgcaaatattaaccagctgatatgggatctccaaatcctggtaaatttgttcctcaatttcacgcattttttcatgcatttcttcagacttatctggatgggtaaaggcaaacatttctattttagaaaactgatgtaccctgtataatcctcgtgattcacgtccggccgcacctgcttctgtgcggtaacaatgagaaagccctgcatacagaatcggtaactgttccggttggagtacctgatcgatcaacaaaccgcccaaagttatttctgcagtcgcaatcagacagagatccgattcttctactgaataaatctgtgtttctgcaccacgtggattaaatccaataccgtccaaaatctgatgccgagccaagtccggtgtaatatgtactgtaaatccttctttttgcagcaaactcagggcatattgggccaaagctaattccaaaaatacagcctgatttttgaggtagtaaaacttttgtccagaaacttttgcacctccgtcaaagtcaatcaaatcaagtgcttccattaactcaacatggtccttaggttcaaaatcaaattcgcgttttgttccaacttcccgaattggaacattttcttcatcagtaaaaccttccggagattctggatgtgtcaagtttggaacctgcttgtgcaaatcaagccgctgctcaagcagttctcgaagtattgaatctttttccgactcttcttcacgcaagttttttgattcttcaatcagaggctgacgttcctcaggtggaattttgcctttcattttattactgatgtcattccgtcgttgtctgacagaatcaacttcagatgtaatctgccgtacttgctcatcaaatgctaacaatttttcaatatcaacgtcaacgttccgttttcggcaattctctgcaattacttcaggctggcttctgattatttttagatcaagcattcagtcaggtttcaggtttgagatttaagattctttgattgcagatttgcaatccacttttcatgttttatggttttgttgcaaaaactttttctggtcgcagtttatgaaatgcagtcagttcttgaatggcagatgcggttgctaaaaggttatgatcttcaaaacgccggcccattaattgtaacccaactggtaatccgtcactggttggtcttccaggaattgagattgcaggtgttcgtgtcaggtttgcaagtacactgcaaatatctgccaagtacattgccagtggatcttcatttttttctcctaacttgaatgcaggaaaaggagaaactggtcccagtataaaatcaaattcctcaaacagcaatgccacttgtttttccatccaagccctcacctgcacagctcgtccataatattgatcataataacctgaactgagtacaaatgttccaagcatgattctgcgttttacntccacaccaaaaccctttttcctggtagatgtgtatagtgatttcaaggatggctgatcctgcttccttattccgtaacgaattccgtcgaaacgtcccag

SEQ ID NO: 1587 - DNA, 4000 bp, Escherichia coli
  misc_feature (1986)..(1986): n is a, c, g, or t
  misc_feature (1992)..(1992): n is a, c, g, or t
aagttgaggttgtcaatcaaaaaaacacatatccaaaccaactgcactaatgaactagacaatatgggggtagatatcacacctcatccaagaaagaagttgaggttgccaatcaacaaaacatatatccagaccaactacattaatgaattggacaatgtgcaaggcctagcgcaaaaacttcatcccaacgctagagcataatattagcaccaacaatccaagaagctagtagattccctaaagtccattgagtcacttctttcacacgtgcagcatcagctagtagcaacctacaggggtcaaaggccctctaattcatcctttaaaattttactcaacaacaacttaaccaacctctttagtttatgacacttgaagaatttatggcatcacaacttggcctaaggacaatccatttcaagaagaaggggttggtggtgcaacactagaagcacaaggtgcaacaatagaaaatcaagcacaaccaacgcttgagccataaccacacaactcaagcaacaacaccaacattgaggctggtggctcaaaaaatgtgtaaggcactgatgcacatgttgatgcttcaaaagaaaaagacgccaatattgaaattggtgcatttgaggaaactaaaaaataaccccttactgaaggatttaaaaatgtacaagaagaaggcaacaaccttctagcaatgaggaggcagcaataacacagacaaagaagaggggcaaggatctgatgagttctttgaatttaagagagcctctaaatcatccaatccagtagattagtgaagaaaccaccatcatcgtcaaccaataaaacaaagttatttttaagttttttgcattttaattttagttttagtttttaaattgtgtgttagaagtagttttttttattattaagtatgcatgtcttaggtatcataggatgtaaataccttttggacatggttggattaggaactaagtagaaaaggaaaaatacactctaaaaaactgttttgaaatctgagaatgcaaggaaggaaagaagaaataaccatgagtacttaaaagcaaaattgacacaatgtaggtcagcttttagttaaaggttgacacatgaaagtgaatctgatcttgtgagttgagtgagccaaacacatcatgggagaatgagagaaacacataagtgattgagccataggttttgtgtctaattttttataattgttaaacatgattggcataaaaaggatcaaaggcaagttttctcgtgaaaatttctgcataatctagaccaaacaaccaccttgcataaatttttgaaaaatactccttttgaaccttggcctgaaacatgcaccctgagtctagaatgtatgtaacccaacctttcttactgatgagaaggatgcaacaaaggtgtgtgtgtgtgtatgtgtgtgtgtgtgccatgaaaggaaatggtgactttgaagtggataaaaaggaataaagttggggtatgctttgagcatacccaaaaatgcaaaaatacaaaatgcattttgaaattgaggcacctcaaaacaaaaaataatgtagcaaagcaagtcaatcaaaggtttactcaaaggaaaggaaaagaaaaagaaattgggttgagaaaaaacaaaaagaaaagaagactagaataactagactcattgcacttatacattgttgttatcctttttagtagtgagtcttgtttgtcttgtaagacaaagttctttcatagcccaaccacgttacaagcccaaaagaccatattgattttgccaattgtgtgtaggggtggcaaaacaggccagctagccacgcctttggcctatcaaaaatgggtcaggttgggttggctcgccactaagaaacgagttggacaattcaacccacctcaccttagggcgggctgggccacccccttttttaatttttttaatttttttaatttttcttttaactttttttttanattttntttataaattatatatatatatatatatatatatatatatatttaaacataaaaaataaaagaaaaaatggattggtgggtctaaatgggttggcctgccagttgagcgggctaggcgggccgggccacaaggttggcgggttggaaattctaacctggttcacccttttcaaacttgcaaacctctacctcgaccgagagacaaaaagtgatctgatcatgcaacaaagccactcattagcaaagactcaatatgaagaccaaaaagacacatgccaacaagaaaaactcacattcacaggagaatgaaacagacgagaaaaaggaagataaactaacttacctcaaacaagaaattgattgtttgatcttgatgagctctccgcaaggaactatccaccgatcttgaattttcaaaaggattaattgggagtgagcaacaaaagaagaagatggagctaaagatcaaggagaggatgcatttaaaaaaaaacgtttatgtgctttttgaattaaaacgggttgcttcatttcttttaaaataaaggcatattcacatttttaaagagttctacgattatcatcaaaacataatttattagaataattcagtatatctaaacgatctaaagttatatcatttttctaatttttcttgtggaattttgtactatactacacagataggaccaacaagaccaaatacccaaccctagccgtcaacttatagtcatgtttggtatagatcactaatcaactatatagaaagacaatacatacatggtggctaaggctacaaatcggtagggaccgcctactttaaacttaggaaataacacctaaatacgcagaatcaattcataggcatagtacttggaccttgatcaggcccacacaagtccaaaggagaccctgcagcgagccaataaaggcccagctcatgagccgggtaatctgtgattaatattctataaatatagatagaccccaacaattaaaggtacacaatccattaatactaaaaattaatatttaattttaagaattcttggtgacttaatcgttggagtctcttttgcatgtaatctccaagatattctcagctcaggataagataagatttatatcacattattgtccttgcaggaacaattttcaaagatcggttgtctccgtttgagaaggattggaccgattataaagcctcttttaccatatatatatataccgttttagtttctgttcattatttctacccagatctttagcttcttgcacaatcgtgttattcggacagaaatatcttatttatttgaattattaatgataattaaattgaagattacacactatatacttaataaaatgtaactgggtcatgttattcaattgcttctttattatctgtttgaagtaaagaatctgagtgaaaccaataatataaaatggtcgtttaactttgagaaattatttatgaaatgcaaaaggggtaataatattcataaatttcgataataaatagatagattagtttaaacatatactcctagaaaacaatttaaatgttgagttcttaaattaattctattatagattcaaggaaaggaaacattgtgaaacttttatttaaaaagtcttactgttatgtcacacaagtctttctgtttttatcaagagtacatcattgtcttgaaatcaactaatttccttgagcattgcaaatcttaaaactaatccctaatggattattgttctcgttaacagcatcacctaatggattattgctctcgttaacagcatcacctaatggattattgttctcgctaacagcatcagaaatgtgaatcgttgaaccttcttcacctctttctgaggttgattgtttcctagcatagggcacaagaaatttgtccataccagcagcaatagttagcagttctgctcgcaaaaacacacatttttgcatgatatactccaaaccaccagatttcatgagagctgcaacgta

SEQ ID NO: 1588 - DNA, 4000 bp, Escherichia coli
  misc_feature (6)..(7): n is a, c, g, or t
  misc_feature (9)..(9): n is a, c, g, or t
  misc_feature (15)..(15): n is a, c, g, or t
  misc_feature (17)..(17): n is a, c, g, or t
  misc_feature (24)..(24): n is a, c, g, or t
  misc_feature (27)..(28): n is a, c, g, or t
  misc_feature (30)..(30): n is a, c, g, or t
  misc_feature (35)..(35): n is a, c, g, or t
  misc_feature (42)..(42): n is a, c, g, or t
  misc_feature (44)..(44): n is a, c, g, or t
  misc_feature (46)..(46): n is a, c, g, or t
  misc_feature (53)..(54): n is a, c, g, or t
  misc_feature (56)..(57): n is a, c, g, or t
  misc_feature (59)..(59): n is a, c, g, or t
  misc_feature (66)..(66): n is a, c, g, or t
  misc_feature (69)..(71): n is a, c, g, or t
  misc_feature (73)..(73): n is a, c, g, or t
  misc_feature (75)..(75): n is a, c, g, or t
  misc_feature (79)..(79): n is a, c, g, or t
  misc_feature (81)..(81): n is a, c, g, or t
  misc_feature (83)..(83): n is a, c, g, or t
  misc_feature (93)..(93): n is a, c, g, or t
  misc_feature (95)..(95): n is a, c, g, or t
  misc_feature (98)..(98): n is a, c, g, or t
  misc_feature (100)..(101): n is a, c, g, or t
  misc_feature (115)..(115): n is a, c, g, or t
  misc_feature (118)..(119): n is a, c, g, or t
  misc_feature (121)..(121): n is a, c, g, or t
  misc_feature (123)..(123): n is a, c, g, or t
  misc_feature (125)..(125): n is a, c, g, or t
  misc_feature (135)..(135): n is a, c, g, or t
  misc_feature (143)..(144): n is a, c, g, or t
  misc_feature (167)..(169): n is a, c, g, or t
  misc_feature (173)..(174): n is a, c, g, or t
  misc_feature (180)..(180): n is a, c, g, or t
  misc_feature (183)..(183): n is a, c, g, or t
  misc_feature (200)..(201): n is a, c, g, or t
  misc_feature (203)..(203): n is a, c, g, or t
  misc_feature (207)..(208): n is a, c, g, or t
  misc_feature (210)..(212): n is a, c, g, or t
  misc_feature (214)..(214): n is a, c, g, or t
  misc_feature (219)..(219): n is a, c, g, or t
  misc_feature (223)..(224): n is a, c, g, or t
  misc_feature (226)..(227): n is a, c, g, or t
  misc_feature (230)..(230): n is a, c, g, or t
  misc_feature (243)..(244): n is a, c, g, or t
  misc_feature (248)..(248): n is a, c, g, or t
  misc_feature (257)..(257): n is a, c, g, or t
  misc_feature (259)..(261): n is a, c, g, or t
  misc_feature (263)..(263): n is a, c, g, or t
  misc_feature (266)..(266): n is a, c, g, or t
  misc_feature (268)..(271): n is a, c, g, or t
  misc_feature (274)..(275): n is a, c, g, or t
  misc_feature (282)..(283): n is a, c, g, or t
  misc_feature (286)..(288): n is a, c, g, or t
  misc_feature (290)..(290): n is a, c, g, or t
  misc_feature (295)..(295): n is a, c, g, or t
  misc_feature (299)..(299): n is a, c, g, or t
  misc_feature (301)..(301): n is a, c, g, or t
  misc_feature (306)..(306): n is a, c, g, or t
  misc_feature (313)..(314): n is a, c, g, or t
  misc_feature (322)..(323): n is a, c, g, or t
  misc_feature (326)..(326): n is a, c, g, or t
  misc_feature (328)..(328): n is a, c, g, or t
  misc_feature (330)..(330): n is a, c, g, or t
  misc_feature (332)..(332): n is a, c, g, or t
  misc_feature (337)..(338): n is a, c, g, or t
  misc_feature (340)..(341): n is a, c, g, or t
  misc_feature (345)..(345): n is a, c, g, or t
  misc_feature (347)..(348): n is a, c, g, or t
  misc_feature (354)..(354): n is a, c, g, or t
  misc_feature (367)..(368): n is a, c, g, or t
  misc_feature (371)..(372): n is a, c, g, or t
  misc_feature (375)..(376): n is a, c, g, or t
  misc_feature (378)..(378): n is a, c, g, or t
  misc_feature (381)..(381): n is a, c, g, or t
  misc_feature (385)..(385): n is a, c, g, or t
  misc_feature (387)..(388): n is a, c, g, or t
  misc_feature (391)..(391): n is a, c, g, or t
  misc_feature (393)..(393): n is a, c, g, or t
  misc_feature (398)..(398): n is a, c, g, or t
  misc_feature (414)..(415): n is a, c, g, or t
  misc_feature (417)..(417): n is a, c, g, or t
  misc_feature (419)..(421): n is a, c, g, or t
  misc_feature (424)..(424): n is a, c, g, or t
  misc_feature (426)..(426): n is a, c, g, or t
  misc_feature (429)..(429): n is a, c, g, or t
  misc_feature (436)..(436): n is a, c, g, or t
  misc_feature (438)..(440): n is a, c, g, or t
  misc_feature (447)..(447): n is a, c, g, or t
  misc_feature (454)..(455): n is a, c, g, or t
  misc_feature (458)..(458): n is a, c, g, or t
  misc_feature (460)..(460): n is a, c, g, or t
  misc_feature (463)..(463): n is a, c, g, or t
  misc_feature (465)..(465): n is a, c, g, or t
  misc_feature (470)..(470): n is a, c, g, or t
  misc_feature (472)..(472): n is a, c, g, or t
  misc_feature (482)..(482): n is a, c, g, or t
  misc_feature (488)..(488): n is a, c, g, or t
  misc_feature (491)..(491): n is a, c, g, or t
  misc_feature (494)..(494): n is a, c, g, or t
  misc_feature (496)..(496): n is a, c, g, or t
  misc_feature (502)..(502): n is a, c, g, or t
  misc_feature (505)..(507): n is a, c, g, or t
  misc_feature (512)..(513): n is a, c, g, or t
  misc_feature (516)..(516): n is a, c, g, or t
  misc_feature (518)..(519): n is a, c, g, or t
  misc_feature (521)..(521): n is a, c, g, or t
  misc_feature (524)..(524): n is a, c, g, or t
  misc_feature (527)..(527): n is a, c, g, or t
  misc_feature (529)..(529): n is a, c, g, or t
  misc_feature (532)..(532): n is a, c, g, or t
  misc_feature (535)..(535): n is a, c, g, or t
  misc_feature (538)..(539): n is a, c, g, or t
  misc_feature (542)..(542): n is a, c, g, or t
  misc_feature (544)..(544): n is a, c, g, or t
  misc_feature (547)..(547): n is a, c, g, or t
  misc_feature (556)..(556): n is a, c, g, or t
  misc_feature (558)..(558): n is a, c, g, or t
  misc_feature (561)..(561): n is a, c, g, or t
  misc_feature (564)..(565): n is a, c, g, or t
  misc_feature (567)..(567): n is a, c, g, or t
  misc_feature (570)..(570): n is a, c, g, or t
  misc_feature (573)..(573): n is a, c, g, or t
  misc_feature (576)..(576): n is a, c, g, or t
  misc_feature (582)..(583): n is a, c, g, or t
  misc_feature (586)..(586): n is a, c, g, or t
  misc_feature (598)..(599): n is a, c, g, or t
  misc_feature (601)..(601): n is a, c, g, or t
  misc_feature (604)..(605): n is a, c, g, or t
  misc_feature (607)..(607): n is a, c, g, or t
  misc_feature (613)..(614): n is a, c, g, or t
  misc_feature (618)..(618): n is a, c, g, or t
  misc_feature (622)..(624): n is a, c, g, or t
  misc_feature (626)..(626): n is a, c, g, or t
  misc_feature (631)..(632): n is a, c, g, or t
  misc_feature (634)..(634): n is a, c, g, or t
  misc_feature (639)..(639): n is a, c, g, or t
  misc_feature (643)..(643): n is a, c, g, or t
  misc_feature (645)..(646): n is a, c, g, or t
  misc_feature (648)..(649): n is a, c, g, or t
  misc_feature (653)..(653): n is a, c, g, or t
  misc_feature (656)..(659): n is a, c, g, or t
  misc_feature (661)..(661): n is a, c, g, or t
  misc_feature (664)..(664): n is a, c, g, or t
  misc_feature (667)..(667): n is a, c, g, or t
  misc_feature (673)..(674): n is a, c, g, or t
  misc_feature (679)..(679): n is a, c, g, or t
  misc_feature (681)..(681): n is a, c, g, or t
  misc_feature (683)..(685): n is a, c, g, or t
  misc_feature (687)..(688): n is a, c, g, or t
  misc_feature (697)..(698): n is a, c, g, or t
  misc_feature (701)..(701): n is a, c, g, or t
  misc_feature (708)..(709): n is a, c, g, or t
  misc_feature (716)..(716): n is a, c, g, or t
  misc_feature (721)..(722): n is a, c, g, or t
  misc_feature (725)..(725): n is a, c, g, or t
  misc_feature (727)..(727): n is a, c, g, or t
  misc_feature (741)..(742): n is a, c, g, or t
  misc_feature (746)..(747): n is a, c, g, or t
  misc_feature (749)..(749): n is a, c, g, or t
  misc_feature (752)..(752): n is a, c, g, or t
  misc_feature (754)..(754): n is a, c, g, or t
  misc_feature (756)..(758): n is a, c, g, or t
  misc_feature (760)..(760): n is a, c, g, or t
  misc_feature (766)..(766): n is a, c, g, or t
  misc_feature (768)..(768): n is a, c, g, or t
  misc_feature (770)..(770): n is a, c, g, or t
  misc_feature (774)..(776): n is a, c, g, or t
  misc_feature (784)..(784): n is a, c, g, or t
  misc_feature (789)..(789): n is a, c, g, or t
  misc_feature (795)..(795): n is a, c, g, or t
  misc_feature (797)..(797): n is a, c, g, or t
  misc_feature (801)..(801): n is a, c, g, or t
  misc_feature (803)..(803): n is a, c, g, or t
  misc_feature (805)..(805): n is a, c, g, or t
  misc_feature (816)..(817): n is a, c, g, or t
  misc_feature (820)..(820): n is a, c, g, or t
  misc_feature (826)..(826): n is a, c, g, or t
  misc_feature (828)..(828): n is a, c, g, or t
  misc_feature (831)..(831): n is a, c, g, or t
  misc_feature (833)..(833): n is a, c, g, or t
  misc_feature (837)..(837): n is a, c, g, or t
  misc_feature (841)..(842): n is a, c, g, or t
  misc_feature (850)..(850): n is a, c, g, or t
  misc_feature (854)..(854): n is a, c, g, or t
  misc_feature (856)..(857): n is a, c, g, or t
  misc_feature (859)..(860): n is a, c, g, or t
  misc_feature (862)..(862): n is a, c, g, or t
  misc_feature (864)..(864): n is a, c, g, or t
  misc_feature (866)..(867): n is a, c, g, or t
  misc_feature (876)..(876): n is a, c, g, or t
  misc_feature (879)..(879): n is a, c, g, or t
  misc_feature (894)..(894): n is a, c, g, or t
  misc_feature (906)..(906): n is a, c, g, or t
  misc_feature (908)..(908): n is a, c, g, or t
  misc_feature (910)..(911): n is a, c, g, or t
  misc_feature (917)..(918): n is a, c, g, or t
  misc_feature (921)..(922): n is a, c, g, or t
  misc_feature (932)..(932): n is a, c, g, or t
  misc_feature (934)..(934): n is a, c, g, or t
  misc_feature (937)..(937): n is a, c, g, or t
  misc_feature (944)..(944): n is a, c, g, or t
  misc_feature (951)..(953): n is a, c, g, or t
  misc_feature (959)..(959): n is a, c, g, or t
  misc_feature (962)..(962): n is a, c, g, or t
  misc_feature (969)..(969): n is a, c, g, or t
  misc_feature (971)..(971): n is a, c, g, or t
  misc_feature (975)..(976): n is a, c, g, or t
  misc_feature (978)..(978): n is a, c, g, or t
  misc_feature (980)..(980): n is a, c, g, or t
  misc_feature (982)..(982): n is a, c, g, or t
  misc_feature (986)..(986): n is a, c, g, or t
  misc_feature (988)..(988): n is a, c, g, or t
  misc_feature (992)..(992): n is a, c, g, or t
  misc_feature (994)..(994): n is a, c, g, or t
  misc_feature (997)..(997): n is a, c, g, or t
  misc_feature (999)..(1010): n is a, c, g, or t
  misc_feature (1012)..(1013): n is a, c, g, or t
  misc_feature (1015)..(1028): n is a, c, g, or t
  misc_feature (1030)..(1030): n is a, c, g, or t
  misc_feature (1032)..(1033): n is a, c, g, or t
  misc_feature (1035)..(1035): n is a, c, g, or t
  misc_feature (1037)..(1044): n is a, c, g, or t
  misc_feature (1046)..(1046): n is a, c, g, or t
  misc_feature (1048)..(1062): n is a, c, g, or t
  misc_feature (1064)..(1079): n is a, c, g, or t
  misc_feature (1082)..(1082): n is a, c, g, or t
  misc_feature (1992)..(1992): n is a, c, g, or t
gccggnngnctttgncnccggggnggnngncgccntcttttncntnttcttcnncnncnggggggntcnnngngnggancntngttttccccnancangnngggggggcccccgnagnngngngngaggggggcncgcggggnnttttggggggggttttttttttnnnagannatcccncgntttttgttttttcccgnngncggnncnnntntctcnaaanncnncgnaaaacaacaaaanngcgngcccccccngnnncncgntnnnngtnngcggcgnngannngnagaanacangntttcnccgccanngggggggnnggngngncncgggnncnnctgntnngggggngcccccccgccgnngtnntcnncnccncgcncnncgngnggccnttttttgtggtggtgnngntnnncangngcngcgcgtngnnnctcctcngcgcggnnctngnggntnccccngnggtttttctnccgccncgnggngnggaggnggnnnacatnncgntnntngtngtntntgnggngtnncangnggngcggcggcngntgntgnngncgncgnagncgtggnnggncggcggcgcggnngncgnnancccgcnntttngggnnnanaaaanngngagcngcgncnncnngaanaannnncnccncgngggggnncgggnangnnncnncgcgcgggnnatnttcttcnncgccganaacgnngtngnggccggggcggggnncacnntntangnannntngccccncngngcgnnntttctccncagcngcgtgntnctcncncncgtttttttcnnccnccacangngcntngttnttcnnttttttcnccgngnncnngngnanngcggcgcgncgntgtcggcggcggccnccgccgcgcccntngnngggggnnctnncccccgggancnccncgcgganggggggnnngtggtnctnccccccncnctcnncncncncgcncncgcncncgngnnnnnnnnnnnngnngnnnnnnnnnnnnnngngnngngnnnnnnnngngnnnnnnnnnnnnnnngnnnnnnnnnnnnnnnntanctagctaaaagtaaatgaagacaaccgacgcgtcgcgtctccgcgttccggagctcgcgcgttgtctctccatcactgtcaccgtcgcgatcactcgccctcgccgggaccgtgtgtgcgttcgatgccgtgcctcctcaaggtttcctggatcgcctcgcacgcctcgcccgcgcgtcgcacggagaactcgccgggcacggacaggtcgacgatggttgaccccgctcgagtggcggcaatgcgcccgccgtcgaagacgcacgcgcactcagaccaaaggtgctcgaactcctccaccgccagcgtgctgggcttcccgctcgggttcgcggacgtcagcgcgatggcgtggccgtacgcgcgagctaccgcgcggatgaactcggagtccgggacgcgcacgcccagcagcgcggcgtcgggattcaacgccgacgacagcggcgtgtcgtcggtttttctgcgtaacaagagcgtgatgggccccggcagcaactcctccagcaaacccgggtttaagtgcgcgacgtccgcgtacttgctcacgtcggatgcctcgccgacacacaccgcgagcgggacgtgatacgcgcgctgtttcgcctcgtacagcctctggatgcccttctcggaacacgcgctcgcggcgaggccgtaaatcgtgtccgtggggacgccgatcactttttcgcgtcgcagcgcctccaccgcctctgcgacgcgaggaagcgtcgcgggcaggacgcgcgcgcgagccgcgcgcgaggacatcatcgtcgctctcggtccggggatcgcgcacaggcgcgcggacgcgagcatttttgacacgagcagagcattgcgaatcgacgcgttccgaaggaccgaatcacaacacgtcgtcgtcgctttttgcaaacctctnaaccttcgtcgttcagtggcccgggcacgctttttcataacaaccggttgctctcgcgctatgcgcgactttccggaagcctgaggctgcgcacaccgcgtttcgtacaaatcaccccgccctccctccgcgtgatgctcgatgacgatcatggcccacgctacgcgctggtcaggtcatccttgaagtacaggtggatcaccggtatggcggcgtccgacggtatggacagcgcctcgaacgtctcggcgtcgtccaccaccccgttttcctccagcgtcttgtccaggtccacgtccacgaacttcagctcccggtccccgtctgggtcgcgccgcagaacccgccacgcgtacgactcggagtgccagttgtattcggcgtagcgcgtgcggatctcgcgcagcgtctcctcccccggcacctccagcaggtgctcctgtcgcgtcagcacgttcttcacgcgcaccgcgcgcggcttcaacgacaccgcgcccactacggaggtcctgtcctgccaccagggcgtcgtggggcgcgcgtcccattccacgctggggtcgttcgggggcacgtgcacgaaccgcccgttcgggcagtacggccgaacgaggttcgtcaccgggtcgacgtgcgtcttgagctcgacggttttcgcggcgtcgtcgccttcgtcgcccgcgcgcgtctcgaaccagtgcgagatgtccgagccggcgacccgcagcaggggctgcacgagcggcccctcgttctcggcgatcacgcgcgtgatgtcgtacacgtcgccgtggaacgacacccagcagtcgtcgggtgcgctgtgcgccgcgacctgcacgggtcgtcgcggggaggatggagaagaagcgtttcgcgtcggcggatgtcggggggcgcgtcgggagggacgaggggtcagcgcgcgtcgcgtggagccgaggacgcgcgcgtcgcgacgcgacggcgcacatcgacgcgtctcgtggtggttggagtgataggcgcgcgcgcggaaaagacgcgtgatctcgatcggtctcgcgtggaccgcgccgcgtcctccaccgggacgcgcggggtcggcatctccccttttgggtacgaccggtctcgcgcgcccgtcggggtgaggcgacccgtcgcgcgggtgcgtcggcggaggctcgggacgtacctccgcgggcgtgtagatgcgcatggtcgtgtcgcggcgaccgcgagtcgacgcggacaggcgttcgcgacgaacggtgtgatgacctggacggctccggcttgcttgtgtgggctcgacgtccacgtaaacgaacgtctccccacggcgcgaaaagcgcgccaactttttggtattcctcgggcaacaacgtcggcggaagatcttcgggagggtttgccgcgccgtcacagtccgcagcgccgcgcacactcgcccggctgagagcgtcgtcggccgcttcgcgcgctcctcagatcccaccggatctgatacgcgccgtcgcgaaggctgcgcccgtgaacgcctcgccaagcgccatgagcgcgaagaaggacatggacgtgtgggcccatttcggcgaaggcggtgccctgagcgtcgacgtggtgtcccggtccgaagccgaggagctctcggtgagggtggccgaactggaagatgaggtacgtcggagtgcgcgtcgcgatctccccgcgaaccccggcggatcttccgcgcgcgccgcgacggaccgcgattgcgcacgcgtcccgtcgacaattccgaggatcggccttcccgaagcgaacgctttcgcgcgaaagaagagcgaatcgtcgacgctcttcggcggcggagcccatcctgacctcgcccgattcccggacgttcgcgccccaccgacgcgtgaccgaaaacacacgaacgcacgtgacagctcgcgcgagcgcacgccaacgtcaccgagctcctcgccgaccgcgaggagtcccttcgccacgacgagtacgtcgagtcgatggtggagca

SEQ ID NO: 1589 - DNA, 4000 bp, Escherichia coli
  misc_feature (1924)..(1924): n is a, c, g, or t
  misc_feature (1987)..(1989): n is a, c, g, or t
  misc_feature (2872)..(2872): n is a, c, g, or t
ccagcgtcgccaatgccccagacgatttcgggcttaatgtcgtcgtgggggaaagcgcgcgcgcattgacggagaatcgtagcctccatttttcgagcaccagacgcatatgcgcgcgcggtcgccacgacgccaacgttgcgagatttgccgtgcgcggcggacgacgcgtctcggtgtagcgcgtaaaacctttcgcggtccataggcgctcgacgatctattggtgctctcgcgcccaagcctgcaccgcgccgctccctcgcgtgaatgcgcagtcgcaagcgtcgcgacatcgtgcgcgcggcgcgacgccgcgctagcgttcgctcgtgaatctctcgcgcggtcagtcgcagtgtctctatcccgcattgctgtggaacgacgcactgatctccatcgagagcaaagacgaatgacatcgcagtcaatgcaacgcgacggcctggatctcccaataccacagcaatgatcctgcgttgttgcacttgaggtgctggcagcgcctgttgttgcactggaattgctggcagcgccggtcgttgagcgcctgcctggcccgccgctgccgccgccgccgccgcctcctgcggtttgaacaagaaaccgatcgaacgcgcccccttcacgatggatgtcgcaaactcatatccacgcggcgcgcgcggtacgcggaaaaaactcttaataaaccacgatagagcgtgtttatcgaatgcgacgcgctcatcgccacgattgctacctggcggtttccccccttcgggatttagaaaccacgacgcgccacccgaccgagtggcggttacacatgtgacatcagccgacacgagatccagtaatgcactctgcggtatgttcatcgcgcatctagaacgtggcgcgcagaatgcacgacacaacgcgcgagatcgctttggtcgccactgtcgacggacgggcatctggacgaaattgggtggtcgcaaccgtcgcaactgctgcgcctgagcgttgcgccaattagtttggacgtgttcgcgtatgatctctacccatttcgcgcggtacagccgccgctgtcgaccgtcgcgtaagtctttcaacatgttgagattgcggagcgcggaccacacgcgggtaaagtgccgcatgtggtcatgaaaacctatcgccgcttcgcgataaaactcttcctcgcgcatagccgcgtcaacaccgacgccacgagctcgcgcccacgcgcccacgacggattgaaaaagcttgcggacgcccctcttcagcttgccgggagcgcgaacgtctgctctttgaatgagccattgaaagcttcgcgcgtctatcgcccccgcgccgacgccgtcatcgacgacttgctccccgtcactgtcgtcgtcgcctacaacgtgctgcagctcggctagttggccgtcgtcgagtgcgagcatgcgactaaagacattcgtcgtgttttcgagtagcgcagcgtcctcgtcttcaatcgccacgtttggtggccgattcggatcaaactgcgccacgtatccttgcgctgccttcttggcagcaagagaaaacgcggcacgcaaccaccgagcgttacgcgcgctcgacgccgtcacagcgggcaccatgcgcttgaccgtctctcgcgcgatgatatcgaccgcttcgcgcaactcgacttggagttcatactgcgcttccgcgggacgccccaccgccgcatcgagcctgttttcgatatccaccatgcgctcgccggcgcgatcaatcgcgcggtagagcgccgacgtcacccccggcctcttctgagcagagcgacgactgatgttacgcggcgccttagccaccacattcggtccatggccggtttgggaccaacacgcgcacacccgcgccaagacggcttcgagcgcatctagcacctcagcggtcngtatagacgcttcgagttgttgtcttctttgcatgtgttcttcgtcgatcacattcgatttgnnntaaaccgcatcaaatacgtaatcgaatgcgttacggcgcacctcgggttgttcgaggatttctcgcgtcgcggctcgagcaacgaagtcggacatgcgctgcacgtcgtcgtgatccgcgttccgcacgagaacgcgcgcgatttcacctaaacgcgtgggatcatttgcgcaaccgagattggcgagttcaagttggacgtgacgtttgatgcgcttctccacgtgcagccgtgcgttcgtctcgcaattcatgagaattcgagtcgctgcgcattgtacagttcgatacgtgaagacattgatatccggtccaatttcgacgtctttgaatcccgcgagagccaccttggcttctcgcagaataagatcgcgttcttcggccagcgccctcctcgcagcatccgcgcgccgtggatccacgtacgtggcgatgacggcatttacgcttgacaggcgggctcgttcgagtctatctatccgcgcttgtagccgcgggtttggtacacccggatttaaattgatcatctccctcgccatcgcgctcgtaacgtctttgaggcacgtctgaaagctggctattttactcaacagcgtgaactcttcgtcggccgccgccttggcgtcccatatgttgagtaacgcctcccatgcgtattcttgaatgaacaccgcggcgcgggcacacacgagcgacgcaagctctgtgccgccatgcattaccgcgaacatcatcctcatcgacgtcaacgctgcatctgcgccaagacgttgctcctctggcttccgcttaatcgcaccgcgctcagcctgcacgggcacgccagcgtcgagggtcccattccgcacgcaatgcacacccttgcgaaagcctcgaacgatgnccataactggatcgtcttgttggcggaagacattgaggtgctgcaacgtctccgacgatcggcgaaaagcggcggcatacgtgatgatgtctctccagcgcgcccgcatcgcgccatcgccatccccatcgcccgctcgttgacgttcgccgacttcggctaaaaatagattcaccacgtccggacgtcccagcgctccgagttgcgcaactgtgtggtttaaaatatggcgcacacgttctgcaaccatcgccacgaacgacccatcgttcctcagttcgcttttaacgtacgcatcgatgcgcgcgcggccttcgggagagcgctcgggaagctcgacatccaacatcctgattcccctgttggcgagctctgccaattttcgcacgcaatcatcccttatgacatcatccgctctggcattgcgtcgatccagtgcatgggcgggcacggcgtcacccaacgcccgttttataacaccccggtcggcgccgtgccaaccaaacgccacgtccaacacgactgtctccgtcaccttcagtcgttttatgtacctccgccaaatagctccggcctcacgtctcaatgccacgaccgcggcatctgcgcacgttccatagaaacgtcgcagagcgcgcaaattagttcgcggatccggcggcaacttcgtgccatccgtcggaagacgcaccgtcttccaatccgcctcttcctcctcctggtctccgcctctgcctccgcctctacctccgcctctacctccgcctctacctccgcctccgcctctacctctgcctctacctctgcctctgcctctggcgacttgggcgtcagccatgacgagcgtcgatgcacaccaaaatttcacagcctgaaaagcaggcgcgtctcggacgtccaacgcccctcggtcttcccttcgtccgagcgcaacgctcagtacgccacctggagcgcgttacccacgttcgcgcctcctcctggttactgcgatcgccaggaaatttagctcacttatcacagtgtcgtcgtcgagtgacaccgcgcgcagtgacgaccgcgtcacgcgcccgccatcgcgcgagatcgatcgccatcgcgacgcgacggttcgtcgatgatggcctg

SEQ ID NO: 1590 - DNA, 4000 bp, Escherichia coli
  misc_feature (1987)..(1987): n is a, c, g, or t
  misc_feature (1992)..(1992): n is a, c, g, or t
gggctccgaaatccgtgcgcggcaggaacacctgccccacggccatcagctcatccattcgcggcgtatggccggtgcgttcgatttgatcatagaagaatggcacaggaatttgcacatggatgccagccccgtcacctgttttgccatctgcatcgaccgcgccgcggtgccaaaccgctttgagcgcatcaataccggcctgaaccaccttgcggcttggcgacccatcgatggacaccacaagccccacaccacagctggcgtgctcttcagcctcagagtaaaggccattttcagccatatacttgcgcttggcttcttccgctttcacccagttcgcatcaaattttgtcatgctcatctcctaaaatgcccacgcgggacattgttatgtcgcaaaggtccagatccacgcaggcgcttattcagcggcgatggatcgggcctcgtcaaactgtgctaaaattgcagcggcgcagtcgcgaccgtcgcgaatggcccaaaccacgagcgaggcaccgcggacaatatcaccgacggcataaacgcccggcagccgggtttggccggtttcaaaatccgcccggatcgtgccccagcgcgtcacctcgagaccttcagcgccccaaagctgcggcaaatcttcgggttcaaaccccaaagccttgatcaccaaatccgcaggttccacataatctgccccgtcaatcaactctgggctttggcgtccggtcgcatcgggcagacccaaacgcattttctggacgttaaccccggtgacaggattgccaacaaacccattgggcgcggtcagccagacgaattcaacaccctcttcctcagcgttttgggtctcacgcagagatccaggcatatttgctttgtcgcggcggtaaaggcatttgacggaggtggcgccttgccggatcgctgtgcgcacgcaatccattgccgtgtcgccgccgccaatgaccacaacccgcttgctggccgcattcaagctgccatcttcgaattcaggcacagtgtcgccaaaaccatggcgattgctggcggtcaaatagtcaatggcttttacaatgccatccgctcctgatcccggccccgccagatcgcgggatttataaacgcccgtggcgataatcaccgcatcatgtttactgcggatctcatcaaagcttatgtccacgcccacattgcagttggtgacaatttctatgccgccctcttcaagctgggtcacacgctgcatcaccacatctttttcaagcttaaatccgggaattccataggtcaaaagccctcccgcgcgatcataacgatcatagaccgtgacctgcacaccggcccggcgcagcatatcggccgcagccaatccccctgggcccgcgccgatgatgccgacggattccccgcgggtcgcggcgggcttaatgggttgcacccatccctcagcccaggcggtatcggtgatatatttctcaactgacccaatggtcaccgtttcatggcccgactgttcgatgacgcaattgccttcgcacaagcgatcctgcggacaaatacggccgcaaatctcagggaatgtattcgtggcctggctgatgtcataggcctctcgaagccgcccctctgccgtcaggcgcagccaatcggggatattattgtgcagcgggcagtgggtttggcaataaggcacgccgcattggctacagcggctggcttgctctgcggccttatcctccgaaaattctgcatagatctcgccaaaatcatgcgcgcgatctgacgcttcacgcttttgaggcatgagccgtggaattttcacaaacttcagcatcggattttcagccataacatcctcgattcgcaacatcgctatatttttaagtacttctgacaaattaatgtcagcacagatgacctatataatagggaattcgatatggcgacactttcatgaaattttcaagctctttttaantccgnttcggacctatatttttgctggcgcttatacgccatgggtatatggtcccctggattgcagaggatcccaacacatgccgctttatcatctggtaataattgcgcttattcagggcataacagaatttctgccggtctcctcatcggggcatttgatcctcttgcccgggctgaccggcctcaccgatcaaggccccgtgattgatgttgccgcccatgtcggaactttattggcggtcatcgtctacttctggtcagatgtgcgccacatagtgcaaggtgttccgcaggtcctgcgcggccagtttgataccccctccgcgcggctgctcatcgccatgagcttggccacgctgcctgtcatggtgctgggcttgattttgaaactcactggcctgtcagacgccctgcgctccatcaccgtgatcggctggagcatgctggtattcggcattttactctattggatggatcaacgtgcccaatccacgcgccaactccaagacctgacattgcgagacgcgtggatccttgggctgtggcaagcactggcgcttatcccaggcacctcgcgttccggcatcaccatcaccggcgccctcaatgcgggcttcacgcgcaaagaggccgcccgcatcgccatgctgatgtcgatcccgaccattatcgcctctggcgcgctcacctctttagatttgatcggcggcaccgtgcccctgcgcgatacatctatcgtcgttgccctcagcttcgcagcagcgctcttggctctcagtctgatgatgcgcttgctaaacagcctgacctatacgccctatgtggtttaccgcataggactcggcctcacgctgctcaccataggctacagcggcggcctcgggtcgtgacgccctaggcttttagattttttgcagaggctttgatatcggcatattggcctgacacacggaagggccatagataatctggcaatacgctttccaatgccgttggctcaatctgtagatccgccaagcccatacagtcgccgctcggcacattgtccacgctcagactgtggatctggtcacgggtgatcggcatcggcgccaagccaaaactcagtttattggcaagcgtaaagcccgtggccatgagacgcgcaacaaacatcggcaagccgatgatcaaccgccgacgctggatgacatccaacatgcgctgcatcagaccgcggaaactgtcccgctcgggtccagccaactcataaatgccgcccgccgcgacacctgtcgcacccagcactacggcccgtgcgacgtcatctacaaacaccggctgaaattgcgtctcagccccgacgatcggcaaaataggaccaaagcgcgccatactcgcaaatctgttgaaaaattgatcctctgccccaaagacgatggacggtcgcacaatcattgcgcccggcatatgcgccaagacctccgcctcacccgccgcctttgagcgggaataggcgctgtcgctcgtcagatccgcacccatggccgagatatgcaccatttgcgcgataccaccttcagctgccaagcgcgcaatgcggccggcgccatgagtttgcacggcgtcgaaacgattgcgccctgattcttgtaatatgccaacgcaattgatcacagcatcggcgccgcgcaaagcccgctttaccgatgcgtcatcgcgaatgttgcaaaagaccggctcaacctgacctacaaccccataaggcttgacaaatatcgcctcattgggccgccgaacagccacccgaacccgccaaccagcctttgccatgcgccgcgcgacatagcgcccaacgaaacctgacccaccgaatatagttacaagcttagacatgatgacatcccaagtatttctctgtggaagggaggtactccgtgcaccgcctcatgacaagtccattccccattcgacagccgccgcaccccgatatgcggcgcgcgaaacctggcgcctaagggggccgcccaaa

SEQ ID NO: 1591 - DNA, 4000 bp, Escherichia coli
  misc_feature (2760)..(2760): n is a, c, g, or t
  misc_feature (2763)..(2763): n is a, c, g, or t
  misc_feature (3768)..(3768): n is a, c, g, or t
  misc_feature (3803)..(3805): n is a, c, g, or t
  misc_feature (3810)..(3812): n is a, c, g, or t
  misc_feature (3815)..(3815): n is a, c, g, or t
  misc_feature (3819)..(3820): n is a, c, g, or t
  misc_feature (3823)..(3823): n is a, c, g, or t
  misc_feature (3828)..(3830): n is a, c, g, or t
  misc_feature (3834)..(3834): n is a, c, g, or t
  misc_feature (3836)..(3836): n is a, c, g, or t
  misc_feature (3844)..(3846): n is a, c, g, or t
  misc_feature (3852)..(3852): n is a, c, g, or t
  misc_feature (3857)..(3858): n is a, c, g, or t
  misc_feature (3861)..(3861): n is a, c, g, or t
  misc_feature (3864)..(3864): n is a, c, g, or t
  misc_feature (3867)..(3867): n is a, c, g, or t
  misc_feature (3872)..(3872): n is a, c, g, or t
  misc_feature (3874)..(3875): n is a, c, g, or t
  misc_feature (3877)..(3877): n is a, c, g, or t
  misc_feature (3879)..(3879): n is a, c, g, or t
  misc_feature (3887)..(3887): n is a, c, g, or t
  misc_feature (3894)..(3895): n is a, c, g, or t
  misc_feature (3897)..(3897): n is a, c, g, or t
  misc_feature (3905)..(3905): n is a, c, g, or t
  misc_feature (3916)..(3917): n is a, c, g, or t
  misc_feature (3919)..(3919): n is a, c, g, or t
  misc_feature (3922)..(3922): n is a, c, g, or t
  misc_feature (3925)..(3925): n is a, c, g, or t
ggcgacgctaagacgctttatttaatcccaacgggcgaggtgccaatcactaacatggtgcgtgatacaattgttaaagaggatgacttgccacttaaatttgttggacatacgccaagtttccgttctgaagccggtgcttatggaaaagacaccagaggcttgattcgtcagcatcagtttgaaaaggtggaattggtgcaagtggttaaagcacaggattcgtatcaagcattagaagagctcacggcccatgctgaaggcatcttacaggcgctggagttgccgtatcgtaaagtggtcctatgtgcgggtgatttggggtttagtgctgctaaaacctacgatttagaggtgtggttgcctgggcaagatgcttatcgtgagatttcttcttgttcttgttttgaagattttcaagcaagacgtttacagcttagatggaaaaaccctgagactaataaaagtgaattgctgcatacgcttaacggttcgggtttagcagtcggaagaacgttggtggctgtgttagaaaaccaccaacaagcggatgggagtattaaaataccatctgttttacaaagctacatgggtggcttagacattattaattaataggagttaaatatgagtttattagatttagttatatcaccggcttacgctgaaggtgtagaattagcaggtgcgggatcgttaggtgggctgccatttttggcagttatgtttgtgttgatgtattttttactcatcaggccacagcaaaaacgcgccaaagagcacaaaaatttgttgtctgagctaaaaaaaggcgatgaaatagtaaccaatggtggtgtgattgggaaggtgatgtcggtggatgagtcgtttgcaactttagagattgcaaaggatgtggtggtgaaagtgcaaaaacaaggcattaaccaaaaattaccaaaaggtagtgctaaaatttaaacaataatactcaatttatcatagattatgaatcattactccggtttgaaaaacgcattaattgcttttttcttattacttgcctctttgtacgctctgcccaatatttttggttcagacttagcggtacagatatcgagcgcaggtgatgcagcaattgctcaaaccgatttagggaaagttgaaactattcttaaagacaagggcgtttcttataaatcagccgcattgtccaatcgtagaattttagttcgttttaatgatacggctaatcaacttttagctaaagattttcttaaaacagggttgggccgtaattacgtaacggcactaaatttagcgccatcggttccattgtggttggctgatttaggcggtaaggccatgtcgttaggcttagaccttagaggcggcgtgcatttcttacttgaggttgatatggaagccgtattggcaatgtcaattgataaatcctacaatgagttgcgtactattttgcgtgctgatcgtttgtataagagtattaaaaaagaaggcgacagtattgctattcgatttaaacaggttgatttaaaaaacaaggctgttgatttaattaattcagaactcagtgatttggtgattcttgaaactgataatcaagatgaattgcttatcaatgttggtattagcgacagggcgcaaaaagaagctaagcagagtgcattgaagcaaaatattaccacactcagaaaccgagtgaatgaattaggcgtggctgagccgattattcaacagcaagggaaagagcgtattgtggtgcaattgccaggcgttcaagatacggccagagccaaagagattttaggtgcagtagcaacactagaattcagattggtggatgaaaagaacgacccacaaaccgccattcagtctggaagaacgccgattggttcaaaactttattattttaaagacgggcgcccactgctgttaaaaaccagagtgattgccatgggtgagaacattactggtgctgctagcgggatcgaccaggaaaacagtactcctatggttagcattactttggacaatgctggtggtcgagccatgcttgacacgactaaaaaatacctgcaccaccgtatggcggttatttttattgaaaataaggttgaaacagtcattgaaaatggaaaaacggttaagaagcgcagtaccactaaagatgttattaatgcagcaaccatccaaggtacgttttcaaatcgttttcaaattaccggcatagacagtgcgcgtgaagcgcgtaatctggcattattactcagagcgggttcgctttctgcacccattgaaattattgaggaacgcactattgggccaagcttaggtgcagacaacattaaaaaaggcgtgttgtcagtgattgcagggtttgtactagtgctgttgtttatggcagtgcgttatcgcgtgtttggcatggtagccaatgtggcgcttacgcttaatttggtgatgattgttgccgtgttgtcgcttttgcaggccacattaactttgccaggtattgccggtattgtgctcacagtaggcatggcagtggatgccaacgtgcttatttttgagcgcattaaagaagagctcggcactgatagtaatattcaaaaagcaatctcgagtggttacgataaagccctgcttaccattgctgatgcaaacatcactacgctgattgcatcactggtgttgtttagttttggcacaggccctattaagggatttgccattactttatccattggtattgtcacntcnatgttcaccgcgattgttgtttcaagggcgattgtgaataagatttatggtggtaaaaaactgcaggagttatcgatatgaaggctttgaacgtccctacgattgattttgttggaaaacgcacttatgcgattgttttttctgtggtgttgattgctgtatctatattctcattagcaacgcaaggattgaagtttggtattgattttactggcggcactttgattgaagtgggctataaaaaatcagttgatttgagcaaggtaagagacactttgagtgatgcaaaattcaaaggtgccaatgttcaatatttcggctccaccaatgagattttaattcgtttagagcctcaagcaatttcaagtgcaaaattaagtacaaaaattattcgtttattgggtgatgatgttgatatccgacgagttgaattcgtaggacctaaggttggtgaagagttaaccaatgatggtggtttggcaatgctttatgcgctgatcggtattttgatttacgtggcttttcgctttgaataccgtttttctctgggttcaatatcggcattgatgcatgatgtgatcataaccttgggtattttttcattactgcaaattgagtttgatttaaccgtgcttgccgctattctagcagtgatcggctattcgctcaatgataccattgtggtatttgatcgaattcgtgaaaatttcttatccactcgtcacgttgatcctgaaaaaattattaatggcgcccttaatcaaactctatccagaactatcatgacctcagtaacgaccttgatagtgttgctggcattgttcttcttgggcggtgagattattcacagctttgctttggcattactgattggcgtgattattggtacgtattcttctatctacgtggccagttcaatgattcttaccatgggcatcaccaaagaggatttgctgccatcggaaaaagagaagcaagaaatcgactctcgaccttaacttcgtnttttgtctttttgtggcgttggattgcaaaaaaannnttggnnncanattnnaanatatnnncccncnaatttttnnnaacccnccttnnaanacnaanaaaananncncnaagggttntgttgtnntnagttggtngtaattttttnngnttntanttctattgcttaaatttctcaaacactaagcaagcgttcgttccaccgaaaccgaagctgttagacattacacga

SEQ ID NO: 1592 - DNA, 4000 bp, Escherichia coli
  misc_feature (1)..(6): n is a, c, g, or t
  misc_feature (8)..(22): n is a, c, g, or t
  misc_feature (25)..(40): n is a, c, g, or t
  misc_feature (42)..(55): n is a, c, g, or t
  misc_feature (57)..(73): n is a, c, g, or t
  misc_feature (75)..(115): n is a, c, g, or t
  misc_feature (117)..(182): n is a, c, g, or t
  misc_feature (184)..(213): n is a, c, g, or t
  misc_feature (215)..(238): n is a, c, g, or t
  misc_feature (240)..(248): n is a, c, g, or t
  misc_feature (250)..(255): n is a, c, g, or t
  misc_feature (257)..(453): n is a, c, g, or t
  misc_feature (455)..(455): n is a, c, g, or t
  misc_feature (457)..(512): n is a, c, g, or t
  misc_feature (514)..(551): n is a, c, g, or t
  misc_feature (553)..(589): n is a, c, g, or t
  misc_feature (591)..(593): n is a, c, g, or t
  misc_feature (595)..(599): n is a, c, g, or t
  misc_feature (601)..(615): n is a, c, g, or t
  misc_feature (617)..(617): n is a, c, g, or t
  misc_feature (619)..(671): n is a, c, g, or t
  misc_feature (673)..(708): n is a, c, g, or t
  misc_feature (710)..(711): n is a, c, g, or t
  misc_feature (713)..(730): n is a, c, g, or t
  misc_feature (732)..(732): n is a, c, g, or t
  misc_feature (734)..(804): n is a, c, g, or t
  misc_feature (806)..(818): n is a, c, g, or t
  misc_feature (820)..(859): n is a, c, g, or t
  misc_feature (861)..(904): n is a, c, g, or t
  misc_feature (906)..(947): n is a, c, g, or t
  misc_feature (949)..(1020): n is a, c, g, or t
  misc_feature (1022)..(1061): n is a, c, g, or t
  misc_feature (1063)..(1269): n is a, c, g, or t
  misc_feature (1271)..(1303): n is a, c, g, or t
  misc_feature (1305)..(1549): n is a, c, g, or t
  misc_feature (1551)..(1678): n is a, c, g, or t
  misc_feature (1680)..(1744): n is a, c, g, or t
  misc_feature (1747)..(1753): n is a, c, g, or t
  misc_feature (1755)..(1759): n is a, c, g, or t
  misc_feature (1762)..(1762): n is a, c, g, or t
  misc_feature (1766)..(1767): n is a, c, g, or t
  misc_feature (1787)..(1787): n is a, c, g, or t
  misc_feature (1796)..(1796): n is a, c, g, or t
  misc_feature (1810)..(1810): n is a, c, g, or t
  misc_feature (1813)..(1813): n is a, c, g, or t
  misc_feature (1992)..(1992): n is a, c, g, or t
  misc_feature (2488)..(2488): n is a, c, g, or t
  misc_feature (2695)..(2695): n is a, c, g, or t
  misc_feature (2794)..(2794): n is a, c, g, or t
  misc_feature (2831)..(2831): n is a, c, g, or t
  misc_feature (2894)..(2894): n is a, c, g, or t
  misc_feature (2896)..(2896): n is a, c, g, or t
  misc_feature (2900)..(2902): n is a, c, g, or t
  misc_feature (2906)..(2908): n is a, c, g, or t
  misc_feature (2911)..(2912): n is a, c, g, or t
  misc_feature (2916)..(2917): n is a, c, g, or t
  misc_feature (2922)..(2922): n is a, c, g, or t
  misc_feature (2926)..(2928): n is a, c, g, or t
  misc_feature (2931)..(2932): n is a, c, g, or t
  misc_feature (2936)..(2938): n is a, c, g, or t
  misc_feature (2940)..(2942): n is a, c, g, or t
  misc_feature (2948)..(2948): n is a, c, g, or t
  misc_feature (2952)..(2953): n is a, c, g, or t
  misc_feature (2956)..(2957): n is a, c, g, or t
  misc_feature (2959)..(2961): n is a, c, g, or t
  misc_feature (2963)..(2966): n is a, c, g, or t
  misc_feature (2970)..(2970): n is a, c, g, or t
  misc_feature (2972)..(2974): n is a, c, g, or t
  misc_feature (2977)..(2977): n is a, c, g, or t
  misc_feature (2980)..(2980): n is a, c, g, or t
  misc_feature (2982)..(2982): n is a, c, g, or t
  misc_feature (2984)..(2987): n is a, c, g, or t
  misc_feature (2990)..(2992): n is a, c, g, or t
  misc_feature (2994)..(2994): n is a, c, g, or t
  misc_feature (2996)..(2997): n is a, c, g, or t
  misc_feature (3000)..(3005): n is a, c, g, or t
  misc_feature (3008)..(3009): n is a, c, g, or t
  misc_feature (3012)..(3012): n is a, c, g, or t
  misc_feature (3016)..(3017): n is a, c, g, or t
  misc_feature (3020)..(3021): n is a, c, g, or t
  misc_feature (3025)..(3026): n is a, c, g, or t
  misc_feature (3033)..(3033): n is a, c, g, or t
  misc_feature (3035)..(3035): n is a, c, g, or t
  misc_feature (3037)..(3037): n is a, c, g, or t
  misc_feature (3039)..(3041): n is a, c, g, or t
  misc_feature (3044)..(3048): n is a, c, g, or t
  misc_feature (3052)..(3052): n is a, c, g, or t
  misc_feature (3054)..(3054): n is a, c, g, or t
  misc_feature (3060)..(3060): n is a, c, g, or t
  misc_feature (3065)..(3065): n is a, c, g, or t
  misc_feature (3067)..(3069): n is a, c, g, or t
  misc_feature (3071)..(3071): n is a, c, g, or t
  misc_feature (3078)..(3078): n is a, c, g, or t
  misc_feature (3081)..(3081): n is a, c, g, or t
  misc_feature (3085)..(3087): n is a, c, g, or t
  misc_feature (3090)..(3090): n is a, c, g, or t
  misc_feature (3095)..(3097): n is a, c, g, or t
  misc_feature (3099)..(3099): n is a, c, g, or t
  misc_feature (3101)..(3101): n is a, c, g, or t
  misc_feature (3104)..(3105): n is a, c, g, or t
  misc_feature (3107)..(3107): n is a, c, g, or t
  misc_feature (3109)..(3109): n is a, c, g, or t
  misc_feature (3111)..(3112): n is a, c, g, or t
  misc_feature (3116)..(3116): n is a, c, g, or t
  misc_feature (3118)..(3118): n is a, c, g, or t
  misc_feature (3120)..(3121): n is a, c, g, or t
  misc_feature (3124)..(3125): n is a, c, g, or t
  misc_feature (3127)..(3129): n is a, c, g, or t
  misc_feature (3132)..(3134): n is a, c, g, or t
  misc_feature (3136)..(3136): n is a, c, g, or t
  misc_feature (3139)..(3141): n is a, c, g, or t
  misc_feature (3143)..(3143): n is a, c, g, or t
  misc_feature (3145)..(3145): n is a, c, g, or t
  misc_feature (3148)..(3151): n is a, c, g, or t
  misc_feature (3153)..(3153): n is a, c, g, or t
  misc_feature (3155)..(3155): n is a, c, g, or t
  misc_feature (3160)..(3161): n is a, c, g, or t
  misc_feature (3165)..(3166): n is a, c, g, or t
  misc_feature (3171)..(3171): n is a, c, g, or t
  misc_feature (3176)..(3176): n is a, c, g, or t
  misc_feature (3179)..(3180): n is a, c, g, or t
  misc_feature (3184)..(3184): n is a, c, g, or t
  misc_feature (3186)..(3186): n is a, c, g, or t
  misc_feature (3188)..(3188): n is a, c, g, or t
  misc_feature (3192)..(3196): n is a, c, g, or t
  misc_feature (3202)..(3202): n is a, c, g, or t
  misc_feature (3208)..(3209): n is a, c, g, or t
  misc_feature (3211)..(3213): n is a, c, g, or t
  misc_feature (3215)..(3217): n is a, c, g, or t
  misc_feature (3219)..(3221): n is a, c, g, or t
  misc_feature (3224)..(3226): n is a, c, g, or t
  misc_feature (3228)..(3228): n is a, c, g, or t
  misc_feature (3233)..(3235): n is a, c, g, or t
  misc_feature (3237)..(3237): n is a, c, g, or t
  misc_feature (3239)..(3239): n is a, c, g, or t
  misc_feature (3243)..(3243): n is a, c, g, or t
  misc_feature (3245)..(3248): n is a, c, g, or t
  misc_feature (3250)..(3251): n is a, c, g, or t
  misc_feature (3253)..(3253): n is a, c, g, or t
  misc_feature (3255)..(3258): n is a, c, g, or t
  misc_feature (3262)..(3262): n is a, c, g, or t
  misc_feature (3264)..(3264): n is a, c, g, or t
  misc_feature (3266)..(3266): n is a, c, g, or t
  misc_feature (3269)..(3270): n is a, c, g, or t
  misc_feature (3273)..(3273): n is a, c, g, or t
  misc_feature (3277)..(3277): n is a, c, g, or t
  misc_feature (3281)..(3281): n is a, c, g, or t
  misc_feature (3284)..(3286): n is a, c, g, or t
  misc_feature (3288)..(3289): n is a, c, g, or t
  misc_feature (3293)..(3293): n is a, c, g, or t
  misc_feature (3295)..(3295): n is a, c, g, or t
  misc_feature (3298)..(3298): n is a, c, g, or t
  misc_feature (3301)..(3301): n is a, c, g, or t
  misc_feature (3303)..(3303): n is a, c, g, or t
  misc_feature (3307)..(3307): n is a, c, g, or t
  misc_feature (3310)..(3311): n is a, c, g, or t
  misc_feature (3313)..(3313): n is a, c, g, or t
  misc_feature (3315)..(3315): n is a, c, g, or t
  misc_feature (3317)..(3317): n is a, c, g, or t
  misc_feature (3320)..(3321): n is a, c, g, or t
  misc_feature (3325)..(3325): n is a, c, g, or t
  misc_feature (3327)..(3327): n is a, c, g, or t
  misc_feature (3332)..(3337): n is a, c, g, or t
  misc_feature (3340)..(3340): n is a, c, g, or t
  misc_feature (3342)..(3342): n is a, c, g, or t
  misc_feature (3344)..(3344): n is a, c, g, or t
  misc_feature (3346)..(3346): n is a, c, g, or t
  misc_feature (3350)..(3350): n is a, c, g, or t
  misc_feature (3352)..(3355): n is a, c, g, or t
  misc_feature (3357)..(3358): n is a, c, g, or t
  misc_feature (3360)..(3362): n is a, c, g, or t
  misc_feature (3368)..(3370): n is a, c, g, or t
  misc_feature (3379)..(3379): n is a, c, g, or t
  misc_feature (3383)..(3385): n is a, c, g, or t
  misc_feature (3387)..(3389): n is a, c, g, or t
  misc_feature (3391)..(3395): n is a, c, g, or t
  misc_feature (3399)..(3399): n is a, c, g, or t
  misc_feature (3401)..(3401): n is a, c, g, or t
  misc_feature (3404)..(3405): n is a, c, g, or t
  misc_feature (3407)..(3407): n is a, c, g, or t
  misc_feature (3409)..(3410): n is a, c, g, or t
  misc_feature (3414)..(3416): n is a, c, g, or t
  misc_feature (3418)..(3418): n is a, c, g, or t
  misc_feature (3421)..(3421): n is a, c, g, or t
  misc_feature (3424)..(3424): n is a, c, g, or t
  misc_feature (3426)..(3429): n is a, c, g, or t
  misc_feature (3433)..(3433): n is a, c, g, or t
  misc_feature (3436)..(3439): n is a, c, g, or t
  misc_feature (3441)..(3442): n is a, c, g, or t
  misc_feature (3444)..(3446): n is a, c, g, or t
  misc_feature (3450)..(3450): n is a, c, g, or t
  misc_feature (3452)..(3452): n is a, c, g, or t
  misc_feature (3454)..(3454): n is a, c, g, or t
  misc_feature (3458)..(3460): n is a, c, g, or t
  misc_feature (3462)..(3466): n is a, c, g, or t
  misc_feature (3468)..(3468): n is a, c, g, or t
  misc_feature (3471)..(3471): n is a, c, g, or t
  misc_feature (3473)..(3476): n is a, c, g, or t
  misc_feature (3478)..(3479): n is a, c, g, or t
  misc_feature (3481)..(3483): n is a, c, g, or t
  misc_feature (3486)..(3489): n is a, c, g, or t
  misc_feature (3491)..(3491): n is a, c, g, or t
  misc_feature (3494)..(3494): n is a, c, g, or t
  misc_feature (3497)..(3498): n is a, c, g, or t
  misc_feature (3501)..(3508): n is a, c, g, or t
  misc_feature (3511)..(3511): n is a, c, g, or t
  misc_feature (3513)..(3515): n is a, c, g, or t
  misc_feature (3517)..(3517): n is a, c, g, or t
  misc_feature (3520)..(3522): n is a, c, g, or t
  misc_feature (3525)..(3527): n is a, c, g, or t
  misc_feature (3530)..(3530): n is a, c, g, or t
  misc_feature (3532)..(3533): n is a, c, g, or t
  misc_feature (3536)..(3537): n is a, c, g, or t
  misc_feature (3539)..(3539): n is a, c, g, or t
  misc_feature (3545)..(3545): n is a, c, g, or t
  misc_feature (3547)..(3547): n is a, c, g, or t
  misc_feature (3549)..(3549): n is a, c, g, or t
  misc_feature (3552)..(3553): n is a, c, g, or t
  misc_feature (3556)..(3556): n is a, c, g, or t
  misc_feature (3562)..(3562): n is a, c, g, or t
  misc_feature (3566)..(3566): n is a, c, g, or t
  misc_feature (3569)..(3569): n is a, c, g, or t
  misc_feature (3571)..(3572): n is a, c, g, or t
  misc_feature (3574)..(3574): n is a, c, g, or t
  misc_feature (3576)..(3577): n is a, c, g, or t
  misc_feature (3580)..(3581): n is a, c, g, or t
  misc_feature (3585)..(3586): n is a, c, g, or t
  misc_feature (3589)..(3589): n is a, c, g, or t
  misc_feature (3591)..(3592): n is a, c, g, or t
  misc_feature (3595)..(3596): n is a, c, g, or t
  misc_feature (3598)..(3598): n is a, c, g, or t
  misc_feature (3605)..(3605): n is a, c, g, or t
  misc_feature (3608)..(3612): n is a, c, g, or t
  misc_feature (3614)..(3617): n is a, c, g, or t
  misc_feature (3620)..(3620): n is a, c, g, or t
  misc_feature (3622)..(3622): n is a, c, g, or t
  misc_feature (3624)..(3624): n is a, c, g, or t
  misc_feature (3626)..(3626): n is a, c, g, or t
  misc_feature (3628)..(3628): n is a, c, g, or t
  misc_feature (3631)..(3632): n is a, c, g, or t
  misc_feature (3634)..(3634): n is a, c, g, or t
  misc_feature (3640)..(3641): n is a, c, g, or t
  misc_feature (3644)..(3644): n is a, c, g, or t
  misc_feature (3647)..(3647): n is a, c, g, or t
  misc_feature (3649)..(3649): n is a, c, g, or t
  misc_feature (3651)..(3652): n is a, c, g, or t
  misc_feature (3656)..(3656): n is a, c, g, or t
  misc_feature (3658)..(3658): n is a, c, g, or t
  misc_feature (3661)..(3664): n is a, c, g, or t
  misc_feature (3667)..(3668): n is a, c, g, or t
  misc_feature (3670)..(3674): n is a, c, g, or t
  misc_feature (3676)..(3677): n is a, c, g, or t
  misc_feature (3682)..(3683): n is a, c, g, or t
  misc_feature (3685)..(3687): n is a, c, g, or t
  misc_feature (3690)..(3692): n is a, c, g, or t
  misc_feature (3694)..(3696): n is a, c, g, or t
  misc_feature (3698)..(3698): n is a, c, g, or t
  misc_feature (3701)..(3701): n is a, c, g, or t
  misc_feature (3703)..(3704): n is a, c, g, or t
  misc_feature (3707)..(3707): n is a, c, g, or t
  misc_feature (3712)..(3712): n is a, c, g, or t
  misc_feature (3715)..(3718): n is a, c, g, or t
  misc_feature (3720)..(3720): n is a, c, g, or t
  misc_feature (3724)..(3726): n is a, c, g, or t
  misc_feature (3728)..(3728): n is a, c, g, or t
  misc_feature (3730)..(3731): n is a, c, g, or t
  misc_feature (3737)..(3737): n is a, c, g, or t
  misc_feature (3739)..(3742): n is a, c, g, or t
  misc_feature (3744)..(3744): n is a, c, g, or t
  misc_feature (3750)..(3751): n is a, c, g, or t
  misc_feature (3757)..(3758): n is a, c, g, or t
  misc_feature (3760)..(3760): n is a, c, g, or t
  misc_feature (3762)..(3762): n is a, c, g, or t
  misc_feature (3766)..(3766): n is a, c, g, or t
  misc_feature (3769)..(3770): n is a, c, g, or t
  misc_feature (3772)..(3778): n is a, c, g, or t
  misc_feature (3780)..(3782): n is a, c, g, or t
  misc_feature (3785)..(3787): n is a, c, g, or t
  misc_feature (3790)..(3791): n is a, c, g, or t
  misc_feature (3794)..(3794): n is a, c, g, or t
  misc_feature (3796)..(3797): n is a, c, g, or t
  misc_feature (3801)..(3803): n is a, c, g, or t
  misc_feature (3806)..(3806): n is a, c, g, or t
  misc_feature (3811)..(3811): n is a, c, g, or t
  misc_feature (3815)..(3815): n is a, c, g, or t
  misc_feature (3818)..(3818): n is a, c, g, or t
  misc_feature (3820)..(3822): n is a, c, g, or t
  misc_feature (3825)..(3826): n is a, c, g, or t
  misc_feature (3829)..(3830): n is a, c, g, or t
  misc_feature (3833)..(3833): n is a, c, g, or t
  misc_feature (3835)..(3839): n is a, c, g, or t
  misc_feature (3841)..(3846): n is a, c, g, or t
  misc_feature (3848)..(3849): n is a, c, g, or t
  misc_feature (3853)..(3853): n is a, c, g, or t
  misc_feature (3855)..(3856): n is a, c, g, or t
  misc_feature (3858)..(3858): n is a, c, g, or t
  misc_feature (3863)..(3863): n is a, c, g, or t
  misc_feature (3869)..(3869): n is a, c, g, or t
  misc_feature (3872)..(3872): n is a, c, g, or t
  misc_feature (3877)..(3879): n is a, c, g, or t
  misc_feature (3883)..(3885): n is a, c, g, or t
  misc_feature (3887)..(3887): n is a, c, g, or t
  misc_feature (3890)..(3890): n is a, c, g, or t
  misc_feature (3893)..(3894): n is a, c, g, or t
  misc_feature (3896)..(3897): n is a, c, g, or t
  misc_feature (3901)..(3901): n is a, c, g, or t
  misc_feature (3909)..(3909): n is a, c, g, or t
  misc_feature (3911)..(3911): n is a, c, g, or t
  misc_feature (3913)..(3913): n is a, c, g, or t
  misc_feature (3915)..(3915): n is a, c, g, or t
  misc_feature (3917)..(3917): n is a, c, g, or t
  misc_feature (3919)..(3920): n is a, c, g, or t
  misc_feature (3923)..(3925): n is a, c, g, or t
  misc_feature (3927)..(3928): n is a, c, g, or t
  misc_feature (3930)..(3931): n is a, c, g, or t
  misc_feature (3934)..(3934): n is a, c, g, or t
  misc_feature (3937)..(3938): n is a, c, g, or t
  misc_feature (3940)..(3940): n is a, c, g, or t
  misc_feature (3944)..(3949): n is a, c, g, or t
  misc_feature (3951)..(3951): n is a, c, g, or t
  misc_feature (3953)..(3953): n is a, c, g, or t
  misc_feature (3957)..(3957): n is a, c, g, or t
  misc_feature (3968)..(3969): n is a, c, g, or t
  misc_feature (3972)..(3974): n is a, c, g, or t
  misc_feature (3979)..(3980): n is a, c, g, or t
  misc_feature (3988)..(3988): n is a, c, g, or t
  misc_feature (3990)..(3990): n is a, c, g, or t
  misc_feature (3992)..(3992): n is a, c, g, or t
  misc_feature (3995)..(3997): n is a, c, g, or t
  misc_feature (3999)..(3999): n is a, c, g, or t
nnnnnngnnnnnnnnnnnnnnngcnnnnnnnnnnnnnnnncnnnnnnnnnnnnnncnnnnnnnnnnnnnnnnngnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnncnnnnnnnnnnnnnnnnnnnnnnnngnnnnnnnnncnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngncnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnncnnnnnnnnnnnnnnnnnnnnnnnnnnnnnnnnnnnnngnnncnnnnncnnnnnnnnnnnnnnncncnnnnnnnnnnnnnnnnnnnnnnnnnnnnnnnnnnnnnnnnnnnnnnnnnnnnngnnnnnnnnnnnnnnnnnnnnnnnnnnnnnnnnnnnngnncnnnnnnnnnnnnnnnnnngncnnnnnnnnnnnnnnnnnnnnnnnnnnnnnnnnnnnnnnnnnnnnnnnnnnnnnnnnnnnnnnnnnnnnnnncnnnnnnnnnnnnncnnnnnnnnnnnnnnnnnnnnnnnnnnnnnnnnnnnnnnnngnnnnnnnnnnnnnnnnnnnnnnnnnnnnnnnnnnnnnnnnnnnngnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnccnnnnnnntnnnnnggnaaanncacgggaccgatcatacgcntcctgtttnacggctaagccgcnaangcaccaccgacgggtgctaatgtggctatggcggttagtggcggcgggctgaacacgtcgcccttgcgagcttcgtgcgtacacccccgctctatcaacgtcgtcgactacgacggccataagatgcctcgtcttgagggcggtttccggcttagatgctttcagccgttatccgcatngcgcgtggctgctgggcaatgccttgccagacaacccatacactagaggcgccgatcccccgttcctctcgtacttaagggaccttcccctcaggcatcaaagcgcttccaccaaaaagcaacaaacctgtctcacgacggtctgaacccagctcacgatcccttttaatgggcgaacaaccccacccttggcagctcatgcaccaccaggataggaagagccgacgtcgaagtagcaagcctccgggtcgataggaactctagccggagacgactcagttatccccggggtaacttttctgacatccatggcccgcataaatcaggctcatgggttcgctaggcccctctttcgagtcgtggactctcgttgggcaagtccacgtcaggctagcttttccccttacagttcacggtggatttctgacccacctaagctaacctttgggcgcccttgttatctttttgagggcgtggcgccccacccaaactgccnacctaccgttgttcaccttgcggtgttagccgtacgaacccggaagggcggtgtttcatcggtgcctcggaaccgaactagcgtccggccctggtaacggctcccgcctacgctacacatctagaatcatacggcagcggcagactgcagtaaagctccacggggtcttcgctttcaggtggaaggtactggactgtgcgccagtangtcagtttcaccggcctccacgcggggacagtagagctctcgttgggccttcatgcaagtcgccaattaagcgacaaggtattacgctcactgctgttncttcgcgtgacctgattcacgagggattcaggcgggncacgatttctcgtgacctcctcacgtcgccgtgagggtcggactttatcttcaccgctggcgngnggtnnncggnnnaanntctnngaggnttcnnnccnnttcnnngnnnggcctncccnncgnntnnncnnnncctngnnnttnttncngnnnnggnnncncnnggnnnnnnggnnttncccnnatnnggcnnatttttntnangnnncgnnnnnggancnttaagngggtnannntnacccccnccntttnnnggnccttnnncngnttnnancngnntttnanannccnncnnnggnnngnctnnngngnccnnnnananccttnngatnnggcgnccacntanntttngntnaaannnnnggggcncccttnncnnngnnncnnnccnnncncgcgnnngncncccntnnnncnnangnnnngggncnanttnnccnaatncccncgnnngnntttncnccnacncncctnggnntncncnccnngggncncctgnnnnnnttntngntncggncnnnngnntnnnccccannncccttttcncggnnncnnngnnnnngcgnanggnntngnncccnnncnccngcntnnnncccnttnnnncnntnnnggcncncngggnnntnnnnngnttnannnncnngnnnagnnnncnccnccnnccnnnnnnnntcngnnntnggnnnggnnnccncnnggnncnggaatntnanccnnctncccttncgcnttntnngntnnggnnaacnnttngnnccnncnaaccctnggnnnnngnnnnttncngngnanccnngncccctnnggnggngngnnttcncnccnnnnttnncnnnnncnnctccnngnnnccnnntnnnancgngnnccnccggnccnnnngncccnnntncnncccgcncnnnncncccccnnacaagnncncntttnggnncnnnnnnntnnnggnnncgnnctnanncccnnnccnttttngggnccnannntcnnggnnggngnnnnntnnnnnnanntttnanngntggcngcttcnaancccannncccnnntntcnganncnncggnctcccttngntntncncnntgnnncnncnnttnggnncnttannnnnngntngggnggtttcccttnnggnnnccaannttaccccngncnccnnncnc

SEQ ID NO: 1593 - DNA, 4000 bp, Escherichia coli
  misc_feature (1992)..(1992): n is a, c, g, or t
  misc_feature (2993)..(2993): n is a, c, g, or t
gattccacggctggcggtttttactaaatactgccaagccatttcctcacttctggctgcatcttcccagttgcctttaccagcagcttcttttgcactggcacgcaacggataatgcagtttgaactgctctacagcatcataaaactgcattgctgcatctacatggagtattttcctgtctgtcaactcttcaatgagttcatcagggtccatgtcatccagttcctctatttcacccatcactttctgtacacctactgcagatccaactggatctttggcattgcaaacattcagtgatgaatccactaacttaggacagacatagttaatgacaccggcaataactccgattgtgccattgttgactttcacctttttctcataatcacttttcgcgtcagcccaagcagactgcgaaaagcctgtcagcaaaaagactgagaatgctgtcactaacattccttttattaatttgtacatagtactcctctattaattttggtcgttatccgacacaagtattgaacaaaagacaactcaccctgctcaccggaagacttttcagcagttccggaagcaaggttggtggtttagggtttgaccagaaaataaccggtcatctccagatgcaatgctgagcagaactcagtacagtagaaggggtaaacgccttctttgtctgcaacaaatttgaaagttgcagtttcacctggctcaatactgccgtgaacgttgtaattatccactgcaaaaccatgaacctgatcctgcgcacgttccacatttgtgatgtgccatgtgatctcgtcacccactttaacctcaattacttccgggctgaagtgactgcggattgcagtagcgtaaatggtgactttgttgccgtttcgttctacacgctcattaccggcacgcacataatgttcaaagtcctttttgctgaagcgaatcaacggcttcaatttgtcagctttgatcatttgcacataatgtggttctcccagaggcagaggcatatcataaagcaactgcattggacggcccgctgtgatatcaatcaactgatggttctgcggatgcaaaggtcctacaggtgaaaaacggtcaatcgctaatttatttaatgcaatcagatactttccgtcaggatccacagtatcaccttctgcggtcaccaaatgaccgatattgtagtgaattggaattttattgagcactttacctttcaaataatcccaacgtacaaccatcgaatcgacatagagagaggtgtaaaccacacctttttctttgtcatactgagtatgcaatggtcccaaaccaacgtttacctgagtatgcattgattttttcatatccagaattggaattccccatgggtctttaccggcaaaatctttgttatccaccaatgccttgattttcttaaaatcataaacagttgtgtgagtatcaagttttccggaaacaatgatgtaacgtccgtcaggactgacatctgcaccgtgagggctttttgcttcaggcaggaggaagagagcattcgctgctaccatgtctttcatggaaagtactgcatgtccattaaatttagtgaacttgccggccttgaaaagtttctccgcagctttccagtttacgatgtgcatgtagtcagtgtctttagacgacataccagcttcgtttgccaggcggtgtttccacttagtgttgcctttaccaaaaccaccgatatagagttcagtgtttacggagttcgtgaaagaccaaccttcacttataccttttcctacatcactgatgtcctgcatatatggaggcatttcaacagtaaatgatttttcaggcagtaaccgaccctgcttactggcatacttgagaatgtttttcttatgttcttttaaaccacctgcaccaagtttctcagacacagcagccaaaaatgcggcttctccgtgaaattcttgattcatcaaggctttcagncctttggtaggaacaccctttttctttaagcgccgtagtgctttactggtaagagacatcaaagcatttctgtcaaacttccaatatgtaactccaccacgatacttttgctggtattcgtctagggaaacatattcttttccgtaaggagctggatattgtgctgcttccaaaacataatcagtgtttggagttacaaaagttccgccgtgttctgatttgaaaatcggatttacgactatctgctttgtttcaaaagttgacaaatcgatcacggcaatccgtggatttgctttgtcattgatgaaaaggtactttccatcgtaatcaccgttcgtttctgaaagagcaggatggtgagtatctccccagcggatttctcttccatcaatctttccttcttccaggattttcatactttctacttcaccataaccgtaaccctgccacggttcaggtgtaaaaaccgcgatatacttgagaatgcgcatcgaaggcactccatagacaatcacttgtcctgactgtcctccggaagaaaaaacaagatattcatctttctttcctgaaggattaaaagtttttgctgcggccagcaggtctttttcgcttaatccgcgttgcttcattacttcctgcagcgattgcgcataagctgctcccgctactgtaagagccacactcataacaactaccattcgcatgaccttcactagaacactcaacatcgttctactcctacatctagattcaacatttatataagcctcagaagaggccgagactccttttacttctatgacaagagcaccgaagaaggcaggaaaaaacctcgatattcagaatctcaaatatatctaaatgtgactatacgcaaatttacggagttaaatgccgaagaaggttctggcaaaatttccggagggaagaattaggaagaaatggacttttttggtgcagactaatcctgcgctgcataccactgataaacttgatgaagnccttccttcaaggggatacgtggcttccatcccaatgaattaattttggaaatatcaagaattttttggggagtaccgtttggatatgaactgtcaaagtcaagacgaccactaaagccgacaactttctgaatagtttccgctaatttccggatcgtctggtcttcaccacagccgacattgactattgctgaatcatcgtaactttccatcaaaaacaatagtgcctcagcaagatcatctgtatgtagaaattcacggcgtgctgtgccgttaccccaaatgttgactgattctgcatttgagagttttgcttcatgaaacttgcggatcagggcaggcagtacatgtgagttttccggatgaaaattgtcgtttattccatagagatttgtaggcattgcagaaataaaatttgttccgtactgttgattgtaactttgacaggttttgatacctgcaattttagccaacgcatatgcgtcattggttgactcaagttcgccggtcagcaaatattcctctttaattggctgagggcagagtttcggatatatacaggaactgccgagaaacattaatttttcaactccgtgactccatgcttcgtggatgatattcgtttgcactagtaaattctcacgcataaaatcagcagggtatgtgctgtttgcgtgtattcctccaacttttgctgccgccagaaaaacatattccggtttagtctcagcaaaaaatttctgcacagcaaccgcatccatcaattccagctctgcatgtgtacatgtaattaaattttcaaatcctttttgttcaagtgctctgatgattgcagaaccgaccaaaccgcgatgccctgcgacataaatacgggaatttattttcattacttatgctttttttcttgggggatttttatttatttttgcgaatccagacaaccaacgctgcaaaatattattcagtttcaataaatactatgtagctatcatacatttgattttcta

SEQ ID NO: 1594 - DNA, 4000 bp, Escherichia coli
  misc_feature (1040)..(1040): n is a, c, g, or t
  misc_feature (1446)..(1446): n is a, c, g, or t
  misc_feature (2897)..(2897): n is a, c, g, or t
  misc_feature (3263)..(3263): n is a, c, g, or t
  misc_feature (3777)..(3777): n is a, c, g, or t
agagcgtttgccagatggctgattgtctgtcgcttcattgcgcggcaagtgccgatacatttcatattttgaatgctgaccggttggcgatgatgaagccggatgcctatgtcattaatacggcgcgtggtgatgttgttgatgaagctgctttggcggtggcgctgtcggccagacgcattggcggggctgggctggatgtgtttcaaggtgagccggtcattgatccggcattactagctgcgccaaataccgttttattgccgcatctggggtcggcaacaatcgaaacgcgaacggcgatggggctaaaggttgtcgaaaatgcgcgtgccttttttgctggccagcctttgattgaccctgtttgaggtggatcgaatgaattttgacgcttcaagcgaagctttggttcgcaaaagctttgctgcggcgcttgccgctggacagcctgatcgcatcacccgatcggcctatatgtcgattaaccggcaaccaacggcggttattgcgcttggcaaggcggctggcgcgatggcaatggcggttcgcaacggtggctatgatggttcgggtcttgtcatcaccaccgatgaaaatcaccggcagattgatggttttgaatgttttgcctgtgcgcatccagttcccgatgagcgcggtctaaccgcggcgattgcggttgaaaatctggtcaaatcccttggtcagaccgatcatttgctgttgctgatcagtggtggcggctcggccttgttgccagcaccatcaagcggcatcagccttgccgaaaaaatcgcgctgaatgatgcattgctggcaagcggtcttgatattcacgcaatgaatgtggtccggcggttattttcacggctaaaaggcggccggttggcgcgtttggcagcacccgccaaggtaacgcaatttctgttatcggatgtgccgggtgatttgccggaatcaatcgccagcggccctgctgttgccgatccggtgccgcttgatgatgcgtttgcgctgattcaaaaacatggtcttgntcggctggattttgtgatgccgcatttgcaggcaatccgaaatgggacggcagacgggccagtgcgatcgggtgatccggtttttgatagggtgcaaaccaagattctggcaagcaatgcgcaatgccgtgatgcggcagcagactatatccgccaagccatgcccgatatgcattttctcgatgcgccagcccttgacggcgaagcaagccagatggcggtgcatctggcggcgcaggttataagccagcgccagcatcatgctggtaagccctatgcattggtgactggcggcgaaacaacggtgacgcttgatatgaatgatcccggcaaaggggggcgatcgcaagaattggcgcttgcctttgcgtcggcaatgacagctgccggatcaaatgcgccaaancaatgggtgattctggctggcggcaccgatggccgcgatgggccaaccgatgcggctggcggtattattgccgcgtcacaagattttgatcatgcggcggctcgggccgcgctgttatcacataacagctatgattatctcaaagcgcatgatcagctattgatggttggggcaaccggcaccaaccttgccgatctggttttgattgttgcgcaagattgaccatctagccaatggcgttttgccgcccgacatagcctgcataaaaaagggccggacaagacataaagtcctgaccgaccctgatttgcggataggattggcaaaccaaacaaactcccccaagctggctttgttcgccgcggcctatatcgcaaagctctataaatcgtcgtctaaattcgtgcagatctcctgctgttgatgcgtctgacctgcatctttgttgtgccttttttgcgggacttcaggcaaggaaaaaaaagcaaatttgaaaattgtaaaatatttacattttctatttacaggttatgctgaaaccccaggtaaagctgagccagcggccaagtggaggaaatgacgcgatgcaggaaaaaattcttgtcgggcataaattgcggcggtttcgcaaatctattggcctatcgcaaacagcgatggcggaaacgctggagatcagcccctcttatttaaatcttttagagcataatcagcgccctttgaccgttggattgcttcttcgccttggcaatagctttgatattgatctcaaagattttgccgaagatgacgcggctagcctttcaacgggcatgtctgaaatttttgccgatccattgctggcagatgagcaggtgccacgccgcgaaattcaggacatgatcaccgctgcgccaggtgcggcgcgcggcttggttacgctgtttcaggcctatcgcaaagtgcgtgatgaattagaggcgaccgcgggtgatggcggcattcggcagatgagcaaccctgttgaaaaggtacgcgctacattgcagcaggcgaataattactttccccttcttgaagaagcggcagatgaattgcgccgtacggccaaaattgaatcgattagtgattttggcctgacgggcgataatacgcttgccagccttgccgcccatgtgaaagacacgcttggccttcgcgttaggatcatgccggtagaggtgatgcaaaaccagcttcggcgctatgatctacatcgccgcgagattttgctaagtgaggcgttgcgtcgcccgcaacgacagtttcatcttttgattcaaatcgcgcttcttagccagcaagcggccttggacaaaatctgccaagatcaggcggttcaggatgcgcaggcgcaatccttgttgaaaatcacccttgccggttattttgccggtgccgttatgatgccctattcggcctttctcgattcngcaaaaagccttcgctatgatcttgacctattggggcgccggtttggttgcagctttgaacaggtctgtcaccgcctcaccacattgaatgcgccgaatgcgcgtggtatcccgtttttcttcattcgggttgatgatgctgggaatatttccaaacggcttgccgcggccggcatgcaatttgccacacatggtggcacctgcccgaaatggacgatgcacaaagcctttcggacaccggaaaagattttggcacaagcggccgaattaccaaatgggcagaaatatttcatgcttgcccgcaccgcgccaccattatggtcgccaaccttggcgcaatcgccggaatttgccgtcactcttggntgtgaattgcatcatgcccgcgatatgatttatgcggatcagattgatatttccaaatcggcgcggcttgaccagattggtgttggctgctcagtttgcgagcgaatggattgcacccaaagagcgcatccgcccattggccatgaattgcgctttgatgggccgatgcgccggatcggtctttatgaccttggtgtcaaaggcacaaacaataaataacctgcaaatatcttttcttccgaaatatcattggttttgcgaaccgatgcgtctgttcatgccgatggcaatggccggatttgtttgaaatattattacaaaaacggcgattttggctttttgaaataaaattaccaagcaaaatttgcctcggtttagtgccatgtgttgttttaaaaccacccgcgatctgctagcgtgtcgcatgagatttgatgagggccggtgcgggcatagatgcggtgaaatctgatctaacggtcacgaagatggcgtggaagcaatgatgcatganaatgaacagattgatcgcaaggatgacggcagtgaccggcttgcggcgctttatggcctgacgccaaaggttgaaacggcaattattgatgctgttcaggcgggcgctgttcgccgtcttcgcacgcttgttgcgccgcttcacccggctgatcaagccgatcttttggaacgcatgccagcgcggacagcggcgtcactcgtaaggtttcttggcgatcatc

SEQ ID NO: 1595 - DNA, 4000 bp, Escherichia coli
  misc_feature (347)..(347): n is a, c, g, or t
  misc_feature (2320)..(2320): n is a, c, g, or t
  misc_feature (2400)..(2400): n is a, c, g, or t
  misc_feature (2638)..(2638): n is a, c, g, or t
  misc_feature (2731)..(2731): n is a, c, g, or t
attggtgatgaactcgcgtgctgacgcggatggcgcgacccaagttttggtatataatacgggccttaaaatatttgacgcaggcgagtagatataaaataagcataaaataaaacctaaacgcaaatcttggcgtaagcggcatcttggggcaggcgaggtaattgggcgcgcttggcaagtcatttttaggtggtgtatgagacaggatgcccagtgccctttgtgctttggtgatggcaagccttccacctaatgcaggatacagcgatattttagagcataatctgcatttaatcagcgcggataaacagtgttgccctttgaaaggttggtgggtctttttngtcagaatttagggcgtttttgaccctattaagtaaaatgatccgttctaatactcgctgcgtttaactgggcagagcttacccaaatttcaaacgaaaaggcagggatcatgacagcaacagatcagtttggcttcggaactcagattagaaaatctccttattttgacgccacagttcgctggggggcaaaagggttttcggtttataatcatatgtatatcccccgtgacttcggagatcctgagcagaatttttggaatttggtgaacgaagcaatcctatgcgatgtcgccgttgaacggcaggtcgaagtgacagggcctgatgcggcagcgtttgtgcaactgttaaccccccgcgatctttccaaaatggcggtgggtcaatgtaaatacattcttatcacaaatgccgatggtgggctgttaaacgatccaattcttttgcgactggcagaaaatcatttttggatttccttggcggatagcgatattttactctgggcgcagggggtggccgtacattctggcttggatgtaagtatttgtgagccggatgtgtccccgttacaattgcagggccccaattctgggaaaatcatgaaggctttgttcggagaatctatagaagatctgcgctattattggctgcgcgagcttgagcttgagggcattccactgcttgtgtcacgcaccggctggtcaagcgaattgggttatgagatttacctcagggatggggcctatggaagtgagctttgggagcgcatcatggccgctggcgctcggtttggtctgaagccggggcacacgtcttcaatccggcgcatcgaagggggaatgctatcttatcatgcggatgcggatattcacacgaacccgtttgaactgggtttagaccggttggttaacctggatatcgaggcgaattttattggtaaatcttcgctgcgccgtatcaaggccaaaggggtagagcgcaaacaagttggtttggttttggatggcgcgcctttgacgggacccaataccagtttttgggccattacagataagggaaaaacgattggcaaggtgacctctgcggttttctcgccgcgcttgcagaaaaatattgcgcttgcgatggtgtctgtagatcgtactgccttgggaactgagctgcgtgttcttgcgggggcggagcagcgcaccgcattggtggttgaacggccattttttgacccgaagaaaaagatcacggccgccgcgctctcaaattgaacactctgtacaaagccaagctgccctttaaagcttgctttggctatgcggatgcaccggccaatcggcgcaattctttaggccagcagtctcgctcgcttgggacagccgattggtatggttttcatggtgtgatccgtggcaatatggggtgtacattttagtggctagactcgctctcctcccaaacagagagcctagccactaatgtctcaagcctgacatgacgagacgatgcaacacaactcaagctgcgttaaagcgacagtaatagcttaattattaagcaacacaagaacttttagatttgcatagaatgcatatcggcaatgcaatcttgtgcattgctgacagaggctggttttcgctatcaaagggtcagcaagtttctcctcccattaatttgctatcgttgaaaattctcctcccagatgttttcaatttttttggcagtgctttttagcactgcctttttttttgaacggaggcagcgcgcgccgtccgcgatcgtgacgctactttttctggggtgcttttatgccggttttcaatatttagcttgggcgatgcaaaatttgcgcaaaagcgccaaatcaaaacctgccgcgtgatgttcttttcggccagaaagcaattacagaagcaaaatatgggttgcctaaatatccgcaaattttgacgcgtagcgttaaattcgcccttttcctntaggaaggcagcatcgaccatcctgcgggcggttttttgccgttaagaacgtggtttacccgttgcgatggcgtatgaangcggcggggttacgcgtctcagaagccttggtatgggcactgctcaagcggttttgaacgcgatatgcgcgtgcacttcccctaatttcagcccgtattttttgatttttgcgcaagctctaatgcctcggtggtggcctcaagagacagtaaaattgaagcatggcggtttttaaattgagctgcggggtgcaaaacctcaagatcgtgaaacggatctgcaggtatcgggccatcngcggttaacatggcctgcaattctgcgcaggccacccgaacttgcatggcgctgcagccgatgatggctttggcggtgatgcacgcggcggcntgtcccaacgcgcaggcctttacgtcttgggtaaaggcagccacgcgcccttcgcagagttggagttcaacactcacgctggatccgcagaggggagaacgtttttttgcgcgagctgtcacatgctcaagctctgcataatgtggtaaatcggccgccaaggccaaaatctttttagagtataattttatcagatctgggtcgcccggcatagtctttccctttttcccgcaacacaatacataaggcgaagcagcgcagaagcaaaggtttgtaagaatggaatttaacgttgaggaacttgcatttaacgaagatggcttgattccagcgattgcgcaggatgccaatagcaacgaagtgctgatgatggcttggatgaatgcccaggcggtaaagctcacgcttcaaacagggcgggtaacctattggtcccgctcgcgtcgcgcgatgtgggtgaaaggcgaaacctcggggcatatccagaagctggttgagcttcgcgtagattgtgaccgcgattgcctgctgttgttgattgatcaaactgggcctgcgtgccatacgaatcgccgcagttgcttttacatcaccgtgcaggatggtgcagagcatgaacgcttgccgattctgctttaaggcgctgaaaataaacgttctgtgatatcttgggcagagtggccggcttttcgcaaactgctgagcgcttcagaatcgctgcgttttgccaagcgtttgcccgtttcatcccttatcaaggaatggtggtgataacgaggggtcggaatattcagcaattgttgtaacacgacatgaatttgcgtcgcggcgttcagatctgcgccgcgcaccacatcggtgatgttttgcgcatcatcatctatgaccacggcaagatgataggctgccccctgatcctttctgcgcagtaccacgtctccaacctgcgcaataagcgcctctgctttgagcgtgatccgtttcgaatgctgctcgccaaattcttcataggtcacgggtttttgtagggctttaacggctttgcgcatatccaagcgcagcgcgtcgccggggcgggcctgcgacaggctgcgatggcggcaggtgcccgggtagatgcggccatcgggcccaaattcgggcacgccttcttggggggctgctgcggcttgcgcaatatcggcccggttgcaacaacacggatagatcaatccggcgcgtgccagcgcatcaagcgctctttgataagtgtcggtttcctgcgattga

SEQ ID NO: 1596 - DNA, 4000 bp, Escherichia coli
cgcgcggaacgtgccatcatggtcaccttagatgcgctacaaactattccagcctttgcctatttgcttcctatcctgctgctatttggctttggcgtcgtggtggggctgattgcgggcatcttatatgccttccctccaatggtacgcaacacgctgcttggtctacgccgggttgcgccggaagtgatcgaatctggtttgatgtcgggggccaccgcgacccaattgttctttcgggtgcgcgtaccaagcgcagcaagacaaattatgttagggattaaccagaccacgatggcggcgttttcaatggtgatcattgcgtcaattattggtggggcctccgatattggctgggaagttttatcggcgatgcgcaaggcacggtttggtgaaagcttggtggcaggcgtggtgattgccttgatggccatggttatggatcgcataacggcggggtttgcaaaccgaaaaccaaaggaaacgacccttgtttccgaaccgttttactggcgtcaccaattcactttaaccgccgttacgggcgccttatgcctttatttaattagccttattttgccaccacttcaaacctatccaaagtcttgggtctacgacccttctggccctttaaacaacgcgatcgattatatcatcattgaatatgcagcctggattgcgctgattaaaacttgggcgttcttttacctaatgcttccaatcaaaatggggttagagcaggtgatttcgcccttttcttgggggttcacatttacccccgcattgaaggccggttatgctttgacggcactggcattgatggcgcttgcagggctgcgaagacggcagagacttgcggtggtgattggattgctggcgattatgctgttttttggattgacccgcatgccatggcctgcgctctggttgattatggcttttgtgtgctggcaattatctggtccaaagctggctttgtccgttttaatcgggctcgcctatctgttactgtcaggcatctggccgcagaccttactgagtgtttatctctgcggcattggcgtcgttttgtcattcacccttggctctgcactgggcattttggcctctgaattcaaatctgtttcgcgggttttgcagcccattaatgacacgctgcaaaccatgccactctttgtgctgctgatcccttttgtaatgatcttcaaaattggcgagttcacagccctcctggccgtgatggcttatgccatggtccctgcaatccggtattctgagcatggattgcgaagcgtaccacatgaggtggttgaagcggccacttgcatgggctgcacccgttggcaattattgtggcgggtaaagattcccttggctcttcccgaaatgatgctgggccttaatcagacaatcatgttcgggatttctatgctggttatcgcggccttagtgggcaccagcggcctgggtcaacaagtctatatcgggctgggagatggtgattttggcgttggtatgaccgccgggattggcatggcgattatcgcaatcatcgcagaccgaatgaccgctgcctggagcgtcaagctgcaggaacgctacacatcaaacccagccagctgaaggttagcgctatggtaaaaacacctgccctgcccctgacaagtacgcattggggcacctatcgcgccaaggtcgcgaatggccgcgtgcaagagctgctaccctttgagcatgaccaagacccctcgcccatcgggccaggcattttggatgtgcagcatgggccaatgcgcatagatatgcctatgatacgcaaaagctggttagagggcaaagctggccatagcaccgacttgcgcgggcgcgagccgttcgtggccgtaagctgggcggatgcgaaccgtctggttgcggatgagcttacgcgggtacgccgcgactttggcaatcaggcgatctatggcggctcttacggctgggcaagcgccggccggtttcatcatgcccaaagtcaactcaagcggttcttgaactgcatcggcggctttaccagttcaaaattcacctatagtttcgccgctgctgaggccatggtgccgcatatcctgggcagctttcgcgcgtatctggacacctgtacaagttgggaagtgatcagggaccacacgcagcttttcgtctgtttcggaggcgtgccgctgaaaaacggtcagatcagtcaaggcggcaccggctgtcatattcagcgcgaagccttgttggccgcaggcagcgcggggatcgagattatcaatgtcagccccataaaatctgacatgcttgaagatgttgacgctgaatgggtgcccctgcgccctaatacggatgtggcgatgatgctggggctagcgcatactttgcagatcgaagggcttacggatcaggcctttttggatcgttacacgcagggatttgaagcctttctgccttatttgatgggcgagcccgacggcatcgcaaaaaccgcggattgggcagctaagatttgtgaaattcctgcagagacgatccgcgcattggcccgccgcatggcagcccagcgcacgatgatttcactcagttggtcgctcacgcgtcaagaccatggtgagcaacccttctggatgggtataacattggcctcaatgctcggccagatcggtttgcttggtggcgggtttggatttggttacagcgcgatgaattacatcgggggcaaattcaaaagcatttccggagcatctcttccacagggaaaaaatccaattgaaaactttattccagtggcccgtatcactgacttgctgcttaacccgggtcggcccttcgattttgacggggtagagtacacatatcctgatattaaactggtgtggtgggccggaggcaatccttttcaccatcatcaagacctgaacctgatgatgcaggcttggcaaaggccagacacgatcatcgtcaatgagtggtgctggaattcacttgccaaacacgctgatatcgtgctgccctgcaccacgccgatggaacgggctgatatcgcgataaccccgcgcgacccctatgtggttgccatggcgaaactgacagaaccctttgcgcaggcccgcgacgattatgagatttttgccggtattgctgaggccatgggtgttgcagaggctttcaccgaagggcgtagcgctgctgattggcagaggcaaatatacgaacaaaccatcactcgagcccataaagacggcgttgagatgcccgagtatgaccgtattcttgataagggctggttcaaacttgcagagcctgcgcaccccaccgtcatgttagaggattttcgcgccgatcctgcggcaaatccgctgaccacgcctagcggtaaaattgaaatcttttcaaaaacggttgcagattttggctacgccgattgccccggacatccgctttggcaggaaccttatgaatggttgggcaatagggctgactatccacttcatctgatatcaaaccagccaaaggaaaaattacactcccagctcgatcatggttctgtcagcaaggcccgtaaagttggaggccgcgaaccattgcacatgcaccctgaggatgccgatatgcgcgggcttaaaaccggggatcttgtgcgcgcgtttaacgatcgcggtgcctgcctggcaggcattgtggttgaccccaccatgcgccctgcagttgttcagatgagcaccggtgcctggtatgatccagatgaaaccggtttgtgcaaacatggcaaccccaacgtgctgacccgtgacaagggcacatcaaaactggggcaaggccccagcgcccattcctgcctgatcgaggttgaactgttcacaggctcagcgccatctgtcacggcacatgcgccgcccaccatcctacgccccagcccagataacgatcgaatggagaagacatgagcaatcttcaagaagcctctgatttgcataacaac

SEQ ID NO: 1597 - DNA, 4000 bp, Escherichia coli
  misc_feature (477)..(477): n is a, c, g, or t
  misc_feature (498)..(498): n is a, c, g, or t
  misc_feature (1984)..(1984): n is a, c, g, or t
  misc_feature (1986)..(1986): n is a, c, g, or t
  misc_feature (1989)..(1989): n is a, c, g, or t
  misc_feature (2663)..(2663): n is a, c, g, or t
  misc_feature (2894)..(2894): n is a, c, g, or t
  misc_feature (2896)..(2896): n is a, c, g, or t
  misc_feature (2900)..(2901): n is a, c, g, or t
  misc_feature (2906)..(2906): n is a, c, g, or t
  misc_feature (2908)..(2908): n is a, c, g, or t
  misc_feature (2910)..(2920): n is a, c, g, or t
  misc_feature (2922)..(2922): n is a, c, g, or t
  misc_feature (2924)..(2927): n is a, c, g, or t
  misc_feature (2929)..(2931): n is a, c, g, or t
  misc_feature (2933)..(2937): n is a, c, g, or t
  misc_feature (2939)..(2941): n is a, c, g, or t
  misc_feature (2943)..(2945): n is a, c, g, or t
  misc_feature (2947)..(2948): n is a, c, g, or t
  misc_feature (2950)..(2951): n is a, c, g, or t
  misc_feature (2953)..(2953): n is a, c, g, or t
  misc_feature (2955)..(2956): n is a, c, g, or t
  misc_feature (2959)..(2960): n is a, c, g, or t
  misc_feature (2962)..(2963): n is a, c, g, or t
  misc_feature (2965)..(2966): n is a, c, g, or t
  misc_feature (2968)..(2972): n is a, c, g, or t
  misc_feature (2974)..(2974): n is a, c, g, or t
  misc_feature (2976)..(2981): n is a, c, g, or t
  misc_feature (2983)..(2987): n is a, c, g, or t
  misc_feature (2989)..(2992): n is a, c, g, or t
  misc_feature (2996)..(2996): n is a, c, g, or t
  misc_feature (3001)..(3003): n is a, c, g, or t
  misc_feature (3005)..(3005): n is a, c, g, or t
  misc_feature (3007)..(3007): n is a, c, g, or t
  misc_feature (3009)..(3018): n is a, c, g, or t
  misc_feature (3022)..(3026): n is a, c, g, or t
  misc_feature (3028)..(3028): n is a, c, g, or t
  misc_feature (3031)..(3031): n is a, c, g, or t
  misc_feature (3034)..(3036): n is a, c, g, or t
  misc_feature (3041)..(3042): n is a, c, g, or t
  misc_feature (3044)..(3044): n is a, c, g, or t
  misc_feature (3046)..(3046): n is a, c, g, or t
  misc_feature (3050)..(3051): n is a, c, g, or t
  misc_feature (3054)..(3055): n is a, c, g, or t
  misc_feature (3057)..(3062): n is a, c, g, or t
  misc_feature (3064)..(3065): n is a, c, g, or t
  misc_feature (3069)..(3075): n is a, c, g, or t
  misc_feature (3077)..(3086): n is a, c, g, or t
  misc_feature (3088)..(3088): n is a, c, g, or t
  misc_feature (3091)..(3091): n is a, c, g, or t
  misc_feature (3093)..(3093): n is a, c, g, or t
  misc_feature (3097)..(3100): n is a, c, g, or t
  misc_feature (3102)..(3102): n is a, c, g, or t
  misc_feature (3105)..(3111): n is a, c, g, or t
  misc_feature (3113)..(3128): n is a, c, g, or t
  misc_feature (3130)..(3130): n is a, c, g, or t
  misc_feature (3132)..(3132): n is a, c, g, or t
  misc_feature (3135)..(3135): n is a, c, g, or t
  misc_feature (3137)..(3138): n is a, c, g, or t
  misc_feature (3140)..(3141): n is a, c, g, or t
  misc_feature (3143)..(3144): n is a, c, g, or t
  misc_feature (3147)..(3148): n is a, c, g, or t
  misc_feature (3152)..(3154): n is a, c, g, or t
  misc_feature (3157)..(3158): n is a, c, g, or t
  misc_feature (3160)..(3161): n is a, c, g, or t
  misc_feature (3163)..(3167): n is a, c, g, or t
  misc_feature (3173)..(3174): n is a, c, g, or t
  misc_feature (3177)..(3179): n is a, c, g, or t
  misc_feature (3181)..(3181): n is a, c, g, or t
  misc_feature (3183)..(3184): n is a, c, g, or t
  misc_feature (3186)..(3189): n is a, c, g, or t
  misc_feature (3192)..(3195): n is a, c, g, or t
  misc_feature (3199)..(3201): n is a, c, g, or t
  misc_feature (3203)..(3208): n is a, c, g, or t
  misc_feature (3210)..(3210): n is a, c, g, or t
  misc_feature (3213)..(3213): n is a, c, g, or t
  misc_feature (3215)..(3215): n is a, c, g, or t
  misc_feature (3218)..(3219): n is a, c, g, or t
  misc_feature (3221)..(3226): n is a, c, g, or t
  misc_feature (3229)..(3230): n is a, c, g, or t
  misc_feature (3232)..(3232): n is a, c, g, or t
  misc_feature (3235)..(3235): n is a, c, g, or t
  misc_feature (3238)..(3241): n is a, c, g, or t
  misc_feature (3243)..(3243): n is a, c, g, or t
  misc_feature (3246)..(3247): n is a, c, g, or t
  misc_feature (3249)..(3249): n is a, c, g, or t
  misc_feature (3253)..(3253): n is a, c, g, or t
  misc_feature (3255)..(3255): n is a, c, g, or t
  misc_feature (3257)..(3257): n is a, c, g, or t
  misc_feature (3259)..(3264): n is a, c, g, or t
  misc_feature (3266)..(3267): n is a, c, g, or t
  misc_feature (3270)..(3270): n is a, c, g, or t
  misc_feature (3274)..(3276): n is a, c, g, or t
  misc_feature (3280)..(3280): n is a, c, g, or t
  misc_feature (3286)..(3286): n is a, c, g, or t
  misc_feature (3289)..(3289): n is a, c, g, or t
  misc_feature (3295)..(3295): n is a, c, g, or t
  misc_feature (3297)..(3302): n is a, c, g, or t
  misc_feature (3307)..(3307): n is a, c, g, or t
  misc_feature (3309)..(3309): n is a, c, g, or t
  misc_feature (3311)..(3311): n is a, c, g, or t
  misc_feature (3315)..(3315): n is a, c, g, or t
  misc_feature (3321)..(3323): n is a, c, g, or t
  misc_feature (3328)..(3330): n is a, c, g, or t
  misc_feature (3333)..(3334): n is a, c, g, or t
  misc_feature (3336)..(3336): n is a, c, g, or t
  misc_feature (3338)..(3339): n is a, c, g, or t
  misc_feature (3343)..(3346): n is a, c, g, or t
  misc_feature (3349)..(3357): n is a, c, g, or t
  misc_feature (3360)..(3362): n is a, c, g, or t
  misc_feature (3367)..(3367): n is a, c, g, or t
  misc_feature (3369)..(3369): n is a, c, g, or t
  misc_feature (3373)..(3377): n is a, c, g, or t
  misc_feature (3379)..(3382): n is a, c, g, or t
  misc_feature (3384)..(3389): n is a, c, g, or t
  misc_feature (3392)..(3392): n is a, c, g, or t
  misc_feature (3394)..(3395): n is a, c, g, or t
  misc_feature (3397)..(3397): n is a, c, g, or t
  misc_feature (3399)..(3400): n is a, c, g, or t
  misc_feature (3402)..(3402): n is a, c, g, or t
  misc_feature (3405)..(3405): n is a, c, g, or t
  misc_feature (3408)..(3408): n is a, c, g, or t
  misc_feature (3411)..(3411): n is a, c, g, or t
  misc_feature (3416)..(3418): n is a, c, g, or t
  misc_feature (3420)..(3420): n is a, c, g, or t
  misc_feature (3424)..(3424): n is a, c, g, or t
  misc_feature (3427)..(3429): n is a, c, g, or t
  misc_feature (3432)..(3436): n is a, c, g, or t
  misc_feature (3438)..(3440): n is a, c, g, or t
  misc_feature (3442)..(3443): n is a, c, g, or t
  misc_feature (3445)..(3446): n is a, c, g, or t
  misc_feature (3449)..(3449): n is a, c, g, or t
  misc_feature (3451)..(3451): n is a, c, g, or t
  misc_feature (3454)..(3456): n is a, c, g, or t
  misc_feature (3458)..(3458): n is a, c, g, or t
  misc_feature (3464)..(3464): n is a, c, g, or t
  misc_feature (3466)..(3466): n is a, c, g, or t
  misc_feature (3468)..(3469): n is a, c, g, or t
  misc_feature (3472)..(3476): n is a, c, g, or t
  misc_feature (3478)..(3480): n is a, c, g, or t
  misc_feature (3482)..(3482): n is a, c, g, or t
  misc_feature (3484)..(3484): n is a, c, g, or t
  misc_feature (3487)..(3487): n is a, c, g, or t
  misc_feature (3490)..(3491): n is a, c, g, or t
  misc_feature (3493)..(3502): n is a, c, g, or t
  misc_feature (3505)..(3505): n is a, c, g, or t
  misc_feature (3507)..(3508): n is a, c, g, or t
  misc_feature (3510)..(3513): n is a, c, g, or t
  misc_feature (3517)..(3519): n is a, c, g, or t
  misc_feature (3522)..(3524): n is a, c, g, or t
  misc_feature (3526)..(3526): n is a, c, g, or t
  misc_feature (3528)..(3529): n is a, c, g, or t
  misc_feature (3532)..(3533): n is a, c, g, or t
  misc_feature (3536)..(3536): n is a, c, g, or t
  misc_feature (3538)..(3539): n is a, c, g, or t
  misc_feature (3541)..(3541): n is a, c, g, or t
  misc_feature (3544)..(3544): n is a, c, g, or t
  misc_feature (3546)..(3546): n is a, c, g, or t
  misc_feature (3548)..(3548): n is a, c, g, or t
  misc_feature (3550)..(3553): n is a, c, g, or t
  misc_feature (3555)..(3555): n is a, c, g, or t
  misc_feature (3558)..(3559): n is a, c, g, or t
  misc_feature (3562)..(3563): n is a, c, g, or t
  misc_feature (3565)..(3565): n is a, c, g, or t
  misc_feature (3568)..(3569): n is a, c, g, or t
  misc_feature (3577)..(3579): n is a, c, g, or t
  misc_feature (3581)..(3582): n is a, c, g, or t
  misc_feature (3584)..(3584): n is a, c, g, or t
  misc_feature (3586)..(3589): n is a, c, g, or t
  misc_feature (3591)..(3591): n is a, c, g, or t
  misc_feature (3595)..(3599): n is a, c, g, or t
  misc_feature (3602)..(3602): n is a, c, g, or t
  misc_feature (3604)..(3604): n is a, c, g, or t
  misc_feature (3606)..(3606): n is a, c, g, or t
  misc_feature (3611)..(3611): n is a, c, g, or t
  misc_feature (3613)..(3613): n is a, c, g, or t
  misc_feature (3615)..(3616): n is a, c, g, or t
  misc_feature (3618)..(3620): n is a, c, g, or t
  misc_feature (3623)..(3632): n is a, c, g, or t
  misc_feature (3634)..(3635): n is a, c, g, or t
  misc_feature (3638)..(3641): n is a, c, g, or t
  misc_feature (3645)..(3645): n is a, c, g, or t
  misc_feature (3649)..(3649): n is a, c, g, or t
  misc_feature (3651)..(3651): n is a, c, g, or t
  misc_feature (3654)..(3657): n is a, c, g, or t
  misc_feature (3659)..(3663): n is a, c, g, or t
  misc_feature (3666)..(3668): n is a, c, g, or t
  misc_feature (3672)..(3676): n is a, c, g, or t
  misc_feature (3678)..(3678): n is a, c, g, or t
  misc_feature (3685)..(3685): n is a, c, g, or t
  misc_feature (3688)..(3689): n is a, c, g, or t
  misc_feature (3692)..(3696): n is a, c, g, or t
  misc_feature (3699)..(3699): n is a, c, g, or t
  misc_feature (3704)..(3705): n is a, c, g, or t
  misc_feature (3707)..(3708): n is a, c, g, or t
  misc_feature (3711)..(3713): n is a, c, g, or t
  misc_feature (3716)..(3716): n is a, c, g, or t
  misc_feature (3719)..(3720): n is a, c, g, or t
  misc_feature (3723)..(3723): n is a, c, g, or t
  misc_feature (3725)..(3725): n is a, c, g, or t
  misc_feature (3727)..(3728): n is a, c, g, or t
  misc_feature (3730)..(3730): n is a, c, g, or t
  misc_feature (3732)..(3733): n is a, c, g, or t
  misc_feature (3735)..(3735): n is a, c, g, or t
  misc_feature (3737)..(3738): n is a, c, g, or t
  misc_feature (3740)..(3741): n is a, c, g, or t
  misc_feature (3743)..(3744): n is a, c, g, or t
  misc_feature (3746)..(3746): n is a, c, g, or t
  misc_feature (3750)..(3750): n is a, c, g, or t
  misc_feature (3752)..(3752): n is a, c, g, or t
  misc_feature (3754)..(3754): n is a, c, g, or t
  misc_feature (3759)..(3761): n is a, c, g, or t
  misc_feature (3765)..(3765): n is a, c, g, or t
  misc_feature (3775)..(3775): n is a, c, g, or t
  misc_feature (3777)..(3779): n is a, c, g, or t
  misc_feature (3784)..(3784): n is a, c, g, or t
  misc_feature (3786)..(3786): n is a, c, g, or t
  misc_feature (3792)..(3793): n is a, c, g, or t
  misc_feature (3795)..(3797): n is a, c, g, or t
  misc_feature (3803)..(3803): n is a, c, g, or t
  misc_feature (3805)..(3809): n is a, c, g, or t
  misc_feature (3813)..(3814): n is a, c, g, or t
  misc_feature (3817)..(3817): n is a, c, g, or t
  misc_feature (3820)..(3821): n is a, c, g, or t
  misc_feature (3823)..(3826): n is a, c, g, or t
  misc_feature (3828)..(3829): n is a, c, g, or t
  misc_feature (3831)..(3837): n is a, c, g, or t
  misc_feature (3839)..(3841): n is a, c, g, or t
  misc_feature (3843)..(3845): n is a, c, g, or t
  misc_feature (3848)..(3849): n is a, c, g, or t
  misc_feature (3851)..(3852): n is a, c, g, or t
  misc_feature (3854)..(3856): n is a, c, g, or t
  misc_feature (3860)..(3860): n is a, c, g, or t
  misc_feature (3865)..(3866): n is a, c, g, or t
  misc_feature (3869)..(3869): n is a, c, g, or t
  misc_feature (3871)..(3872): n is a, c, g, or t
  misc_feature (3878)..(3879): n is a, c, g, or t
  misc_feature (3881)..(3883): n is a, c, g, or t
  misc_feature (3886)..(3886): n is a, c, g, or t
  misc_feature (3894)..(3894): n is a, c, g, or t
atcgtcgccccggtcatggtcggcgacgaggtcccctcctacctgatcaccatcgacccggcggacaacctcttcggtgaggacatgagcctgctggtgaccgagcacgccgcgaccatctgcggcgtcatcctcggccgcgagcgcgtggtcgcggccgccgccagaagggtccgcgacgacctggtggaaggcctgctgctcggccgcggccgggacaatgccgacgccggccggtgggccgcgcacctgggttacgatccggcccgggaccacaaggtggtggcgatcgcgttcgagctgccagccgggccggtctacaacggggccgccgccccgggagctccgcatcccggagacggcgcggcgctgcggcagcggatctgggagagcatcgagcacttcgtgaccacccgggcgcccgatgcgatcgtctcggcccgcgagtccgaggtcgtggtggtgacgaccaccccngaggcgccgaacgggcccgcnctggacgcgcgccagctggccgcctcctgcctggcccggctggccgagctcttcccgacggccaaggtcgtcatcgggatcggcgggacctgccgggatccgggtgagatcgcccgctcctacgcccaggcgcagcgcacgacccagaccctgcggcggctgggccgctccggcaccgtctcggcgttcagcgacctcggcatcctccgcctgctgctgcaggtgcccgacctggccgagctgcgctccttcgcctccgatgtgctcggcaagctcagcatgcacgagcacgagcacaagtcggagtacctgaccacgctggcctgctacttccgggagaacaacagcccgcagcgggcctcgcgcatcctgcacgtgcaccccaacacggtggcctaccgggtcaagcggatcgaggagatcaccgggctgcggctggacaactactccgaccggctcatcgcgcaggtggcgctggagatcctcgattcgctcggggacgagccgtgaccgctcccagccagaccccggcggtcctgctggccgggcggcgcgtgctggtctgcgacggcgcgatgggcaccatgctgcacgcggccggcgccgcgctcgaccggtcgctgcccgagctcaacctgaccgacccgggactggtcagcaccatccacgagagctacctgagcgcgggcgcggacatcatccaggccaacacgttcggggccaaccggctctggctcggcgaccacggcgtcggcgacaaggtggccgagatcaaccgggccggggtccggatcgcccgtgcggcccaggaccggtgcgagcgggacgtgctggtggccggctcggtctcacccgcggtgaccggcctgcaacggcgccgtaccggttcggccgaacgggccgaggtgctacgcgagcagatcgaggctctgctcgggcgcggggaaggccccggcgtcgacatcttgatcctggagaccttcggctaccttgacgagctcgtcgaggccgtcggcgtggccagcgagctgagcgacgtgccgatcgtcgcccaggccaccttcgccgacgacgcgcacacgctgggcggcgagaccccgcgcgaggtcgccaccgtgctgtccggcctgccggtggccatgctcggcaccaattgcaccatcggcccgcagcggatgctcaccgtggccgaggacctggtccggtacgcgtccgtgccggtcagcgcgcagccgaacgcgggccagccgcgccgcaccgggccgcgcagcttcgagttcagcatcggcggcgactacttcgcccgctacttccgccggttcgccgaggccggggtgtccctggtcggcggctgctgcggcaccacccccgcgcacatccgcgccgcggccggcgcggtcacggcgatccccgcgcgggcccggcgcacccacccggccggaaccggaatatccggaaccgtaatatccggaactggaacggccgngncanccggctccgtgccgttcgccgggaccctggccgaccagctggccgggcggcggttcatcgtcgccgccgcgatcgcgtccggcgggcgcccggccgaggcggtgcaggccgccgcggtgctgcaggcccagggcgccggggtgttcgcggtcctgccggcccagagcgcccgcacccattccgactcccttgacctggcgctgcacctgcagcagcaggccggcgtggagaccatcgccacgctgaccacctgggacaagaccatcatgaccctgcaggccgaactcctcggcgcgcatgccctcggcatccgcaacgtcatctgcacgaccggcagcccgccggtgctcggcgactacccggccgtggacggcatctgggaggtcgactcgctcggcctgatcgcgctgctggccggcctgaacgagggccgcgactccaacgggctcgccaccgccacccagacctcgttctgcgtcggcgcccgggtcaacccgggcgcgcgggaccaggaggccgagatcgcccgggcccgggccaaggtcagggcgggagcgcacttcctggtgagcaggccggtctacgagctggactcgctgctccggacggtgaccgcgctggagggcacgcaggtgccgctgctgctgtccgtcaccccgctgcgcagcttcgangaggccgactacctggccaacgaggttcccggggtgatgatcccgccggatacgctgcgggccatggagcgggccgcccacggggccgcccgcgcgaccggcatcgagctggccgtagccctggtccggcaggccagaaagctggtcagcggcgtcatcgtcacggtcgccgccgacgacccggcggtgctggcccccctcctgtccgcagccggctgaagcagggacatngncagnnggggncngnnnnnnnnnnncngnnnncnnncnnnnncnnngnnngnncnngncnncgnngnngnngnnnnncngnnnnnncnnnnngnnnncggnggggnnnantngnnnnnnnnnncggnnnnngnccnggnnnccggnngncntttnngcnncnnnnnngnnggcnnnnnnngnnnnnnnnnncnggncngggnnnncnggnnnnnnntnnnnnnnnnnnnnnnngncnagncnntnntnntcnncctnnnttnngnngnnnnnggggannaannngncnngnnnnaannnngggnnnannnnnncnggntnccnntnnnnnnggnngncgncgnnnnangcnncnccgncngncnnnnnnanncgntggnnnacgncggggnccncgccgncnnnnnnctggngncnggcngcagcnnngcggnnnaanngntnntccnnnnggnnnnnnnnnctnnnttcgncngccnnnnncnnnngnnnnnngangnngncnncnccnccncgncggcnnncnaccnccnnnatnnnnncnnngnngnnttncnggnnngncggggncngnnctnnnnngnnncngncgnagnngnnnnnnnnnncancnngnnnngctnnntgnnnancnncgnngangnncntgncntnannnncnccnnccnngncgnngggggggnnnanncngnnnncnggcnnnnngtngncnccccngncnncnnncannnnnnnnnngnngtnnnngccnccgncnggnnnnannnnnccnnnggcnnnnngntttttgncgnnggnnnnnccnggaanngnnggnnnggnggnnggntngnngncnngncnncnngnnanggcngncnggggnnnttcncccccctccncnnnggggncnggaacnncnnncggggncnnnnngcanngcngcnncnnnncnngnnnnnnngnnncnnnctnntnncnnncaangaacnncgncnntccccnncnnnccngaacgggnccggtccccggcgccctcaccggaacagccggtcgatgtagtccgcgccgatgccgttcttctcgtagtggtcgcggaccagcgcgatgtagtcgaacacgtcgaa

SEQ ID NO: 1598 - DNA, 4000 bp, Escherichia coli
  misc_feature (69)..(69): n is a, c, g, or t
  misc_feature (168)..(168): n is a, c, g, or t
  misc_feature (835)..(835): n is a, c, g, or t
  misc_feature (2449)..(2449): n is a, c, g, or t
  misc_feature (2477)..(2477): n is a, c, g, or t
  misc_feature (3105)..(3105): n is a, c, g, or t
  misc_feature (3213)..(3213): n is a, c, g, or t
atatatattcttgagggaaaagctgtttatcatcttaatcaagactgggttgaggtggaggcaggagantttttgtggcttcgagctttttgccctcaggcatgttatgcaggaggaccaggacctttcagatatttactttataaggatgtaaataggcatatgccntttttataagtttattggatattttttttaggcactattaagtagagaattaattcggttactttatccaaattttccgtggcaaaaccagcctcctggtagttgcgctccatgagcataaaatagccataaaaattctccatcattacatcgtacctgccaataatcacgcactccacttcgccaattattatcttctatccaccattctggtgcaatccgttctggtcccaatttagtttttacttggtataattttttcctccaaataaaatgatcttctagtcttgaatgctttggcacttctaatgcttctggtggccataaaaatgaaggtctattgcggtttgaagttggccagcttttcatgtcataatttgaccatgctgcatttaaaacctgccacgatttttcaggtatatgactttgagctggtatgtgtctgataattgcatctaatccaacttttgttcccagccgcgttattaggtttttaagtacgttattttgattttttattaccttttcatgcagatccaaattattaatggattgagattgtgtgataggacctacattgattgcttcaagtcggataatatcaatgccaaaatttggtttaatttcatctaatttgagcagtaaaacagagaagatacgttcaggntcattagtgaaacatgccagacttaccaaaagtgattgtgtttcattattactaaaacccaaatcaatttttaattcctgaaatcctaaaacagcagtttttaatttgttacataaacgaataagcaatttttctatagcgttcttgatatcctcaataagcccaataggttctggaaagcttattctcacaccaaaatgctttttgtcagtaattggtgaaattgtctctggcacatgtcctagtgcctggtctaatctggcaatcaatgtagggccaaagcgtctggcaagaggtgcccttggttgtttcaacaggtcttttacagattttaagccaagttggtttaatttagttactattttattttcaatacgcagtgatgcaattggaagtttagctaatgagttataagtatttcccgctggtgcaatgcgtattgcattatttttaagtaattgcgtcacttgctgttttgtatcgtctatttgtattttttttgtagcacggctacgggttgcgcgagcttcttgatcaatagaattacttttaaggtagctttctgttggcttgggagtaaagcgagctagtgcccaagcacctcctacagtatcagccactccacttgttacggtcaagccgaatgtttctgtacgagatacaattaaatcaagcattccttcttcaccaccaaataagtgtgcgcaacctttaatgttaaggatcactccgtcatagttgtcggctgctacccaaggtgtgaattgagtataccaacgacataaggcgtgtagaaaagttaattcgcattttacagatcgaacacgggtcattaattctgggcatatggcttttgcatcttgcaatggctggccgatatttaatcctgaattatgtgcaccgaaagatacggaagataatgtttgtgtattaccattattttcaattatcgcaagcttatgatttttttcgaatttgaaaattcgttgtacccgttctgccccaaaatatgggaaccataaagaaatgtatcttgggcttgacattctaacctcaaatgttcttgttttgttctatttatataatagatatattgtccagtttaataatcaagattgatactttttttttatattcagtgagctacatcctttatactggagaataaaaatgaaaacaaaaattatatgtttggcatcaatagcttttcttgcacttcctgtctttgcacatgaaggtgtaaaaaatgatgctgtgaagcagcgcatgcagttgatgacagtaattaaagatacgatggcaaaaattggtgcaatggcacgtggattggacccatttactgaagaaagtgcagcaaatgcaaagcaaacactattgctagccgcggcagatattgaagttaaatttaaattaaatgaaaccgacccactatcagaaagttctccagctatttgggaaaattgggaagattttgtcgaaaaggccgatgattttgcatttatgattgagggtcttgaaacaagttctgcagataccctggcagctgggcttgggaatataggccaatcttgtggttcatgtcacaaagcttatcggataaaaaaatagacccgncataatttaattttaaatttggtcctcngcttaagctttaaaggatacttacagcaatatttttcagggcccctgagttatactgattgcaaaatattttttgctgtgcaggatattaataacaatgggaggacattatgagaactcgtgctgcagttgcaatagaagctggaaaaccactggaagtgatggacgtcaaccttgaagggcccaaggctggtgaagttttagtggagataaaagctactggcatatgtcatacggacgaatttactttatctggttctgacccggaagggctgtttccggctatcctgggacatgaaggagctggtgtggttgtagaagttggtcctgatgtttttgacctaaaagttggagaccatgtaatcccgctatatactccagaatgtaggcagtgtgaatattgtctccatcccaaaacaaatctttgtcaagccattagagaaactcaaggacgaggcttaatgccagacggcaccactcggtttagtatgttggatggtactccaattctacattacatgggctgctcgaccttttctaatttcaccgttttacctgagatcgctttggctaagattaattcaaaggcaccgtttgataaagtttgctatattggttgtggtgtaacnactggaattggtgctgttattaatacagccaaagttgaaattggaagtcggaccattgttttcgggttgggaggcattggccttaacgtgatacaaggacttaggttngcaggtgctgatcaaattgtgggagttgacctaaacccgcagaaatcaaaaatggcgaaaaaatttggtatgacggattatgtgaatccaaacgaagtttctggggatctggttcaacatttagtaaatataacgaaaggtggtgcagattatacgtttgatgccactggtaatgttgaggtaatgcgagcagcgttggaaagtgctcacaaaggttggggtgaaagtataataattggagtagcccctgcgggagcggaaatttctactcgcccatttcagcttgttacaggtcgagtatggaaaggaacagcctttggaggtgcacgcggtcgcacagatgttccaaaaattgtggactggtatatggaaggaaaaatcgagatcgacccgatgattactcacacttttgggcttgaagaaattaacaaaggtttcgatttgatgcatgctggagaaagcattagatccgtagttgtgtattagttatagactagtgctgtccgtatttagccaaaaaaacttgcacaactccatctgcaacacgatcaatctcggcatctgtaaatttttgttggattccaaatagtgcttttgtgtaaaggtcggctttacacaattccgtaaactgatctgctgccaggtatagatcacttattttcaaacaaccttgttgctctgcatatttgaaatactcgataagcttagattggcccattaagggaccattttcataaaaacttttccctaaaattgggaatcgttcgatttcggaaacgcaaattcg

SEQ ID NO: 1599 - DNA, 4000 bp, Escherichia coli
  misc_feature (2011)..(2011): n is a, c, g, or t
  misc_feature (2064)..(2064): n is a, c, g, or t
caatgccaatggccacaccaatggccacagtaacacgcaaagctttaaccttgataaatccacccgatacttgatttgctttaatggccaccgctaagagcgagggctcagcaatggtggtagcaaagccaataaaaccggcaaaaatataaacccaataataagcataccagtttttaggattactgaccaaatcagatgatgtgagttgcgttgccataattttacctagtgggaaaagtgctttttctaggccaataattaaaaaagttagcccgatccaaaccaagataaagccaacaacaatgcgttgtaaatgtggaattttttgctttaagatgcctacttgaaaaataaataggatggcaataataggtaaaactgcccagaaggtttcaacaaagtgatgtggtagtgacatcattgaaaaattccaaataacatgatggcaataataggtaatagagaggcgatggcgatcataccaaagccatcaataagcggatttctggcacgaatactgctactaagacctacacctaatgcggttaaaaggggaacggtaattggaccagtggttaccccgccagcatcataagcaataccaatgataaaatcaggtgccagggtggtgctaaccattactaataagtagccgctaataattaaatactgaattggccagccttttaaaattttaatcacaccaataaccactgaaagtcctacagcaatagcaacggtataacgtaaggtttgagcataacgatgcagttcaacatcggtggtgataatgccgccaaactgggctacttttgcagcctcattggccatgacaattagatcgggttcggcaatggttgcaccaaatccaagtgcaaaagaaaaagccaatagccaagtgatagagccttttttaacaaaggagaaggccagtatctcaccaatgggaaataggccaagcttaagtccgtgcataaataaagataggccaatgagcacgaaccctgtgcctatgataatattatcaatattggggatgggtttctgtaatacaaaaatctgaaaaaaagcaatcaccagtacaatcggcgccaaatcttttgcactgtcagtcagattatgggcaaattgataaagcgtttttttcataagtgttcttttataagtgcactgaattataatacttgctcatgagtcatgtcatcttaattaacggaaaaaaacaaaccaaactgagtgtgttcaatcgcctagtgcaatttggcgatggattgtttgagacttgtatggctgttgaccagagattactattggctgaagcgcattttcaaaggttagaaaagggcgccaagcgtctaaaaattatccccatttcccgctcaatattaaccaaagagattgctaaagcggtctctatgtctaaactagatagagcagtagtcaaggttattctttctcgaggtgaaagtgctagaggttatggatatgataaatccatcgctcctactcgaattatcatagtttctagtgtgcctgatttgccgcagacttatacgctaagtttgtgcgatagtggttacgctactaatcagctattatctgaaattaagcattgtaatcgcttggagcaaattcttgcgcgtacccatcttaaaacgcaagaatgtattatgcttgatccgcaagcccaagtagtttctgttacgcaaggtaatattttcgctattaaaaatggcgtgctactaacaccaggattgagcgaatgtggcattgagggtacacgtcgccaagcgattatcgagctagctagaaaacaagggttatcagttgaagtctgctgtttaagtgttgcggagttgctggcttgtgacgaagtgtttattagtaatagtgtgatgggtattaggccgattagtcaaattaatgagcaaaaatattcacaacatcagattaccgatcgactcatagaggtttttaatcagcacctattaaaacgcggtaactcggntttattaaaacctaaaaaaaatcctttaaagatatgggctattgtttttttancactattcacggcttgggcaatgtgggcaaacaaaataaacatactcaagccgactgtttatcagctaccccaaggagcaaatatttattctactgctgataatcttaagcgttatggtttggttaattcaagccagtttgtggtgtgggcggcaaaagtgttaggggcgagcgaaacattaaaatcaggccattatgagctgacccctgataccagtgtattgagtttgctagatgatttttctaatgctcacgtagccacccggaaaatcaccctagtcgagggtcaaaccgtacagacgtattttcaaatgctaagtcaacaccaagccttaacaacaaaactttcttttgagaaaaccttacaaaacacaaatgccaagcctccgtatgacggacaattttggccagatacttatcaggttaactatgcagacagtgtgctgagcgtgttaaatagatcgcacgctttattgcaagaaaaattatccaaggcttgggataatagagctaaagatcacctactaaaaaacaaaaaccaattattaatactggcatctcttgttgaaaaagagactgctaatcatgcagaaaaggcaaaaattgcaggcgtgtttattaatcgtttaaaaaaaggtatgcgtctacaaactgatccgacagttgtgtacgctttaggtgatgcttatacgggaaaattaagcaagcaagatttatggtttaagagtccgtacaatacttatcgacataaaggcttgccacctggcccaattggatcagtgggcttggaatctttaaaggcagcagcgcaaccattgaaatctgattttttgtattttgtatctaaaaaagatggcacacatgcatttgcaaaaacttacaaacaacaccttattaatattaagaagcatctaaaataaaacctatgaaaacaggaaaatttattaccatagatggcgttgaaggtgccggaaaaagtacacaaataaaatttatttgtgactatttgcaagccaaaggtattaacgttgttttaactcgagagccgggcggtaccgatttgggtgaaaaaattcgccaacttttacttagcacccaaacccagccaatgcatagtgatagcgaattgctactcatgtttgcagctcgaaacgaacacattcatcacaagattattccggcattgaaaaaaggtgattgggtattgagcgatcgctttaccgatgcttcgtatgcttatcaaggtggcggcagagggttggatattgagcgtattgaacacttggagcgctgggtgttgggagatttcaccccagacatgacactactcttggatattcctgtggatcttggcatgtcgcgtgtggagtctagaggtgagaaggatcgcattgagctagaggcaaaggatttttttgagcgagttaggcaagcctacattgccagatcagaaaagtatccagaacgcattaagctgattgactcctccaaggagcgcgaacatactagcacccaaattgaacaaatattagcaacattatgaaccttccttggcacgatcaagcgctttcaaagttgcaaaaaatgatcgatcaaaaccacctgccccatgccttgttaatgactggcgctgaacagattggaaagtttgagttaatgcagcagttggtaggaattttgcttaaggatgacgcactaattagaaaagataatatccttcaagagcttgatcatccagtcttgattaggcgttctagctataccaatatgatttattgccgatctggtgagataaatgcaaatactaaaaatcgatctaaagatatccgcatagaccaggttcgcgctttttgtgaagcactaaacaaaacggcagacaatttgcaaatcggtgttattttttatggtgaccagatgacggtcaacgcagcaaata

SEQ ID NO: 1600 - DNA, 4000 bp, Escherichia coli
cgcctgatcgaaaagatgccgggcctcaagcgcgtttattactgcaactctgggtcagaagcgaacgaaaaagcgttcaagatggttcgccaaatcgcgcacaaacgatatggcggcaaaaagcacaaagtgttgtaccgcgagcgtgattatcacggcacgacgattgcgtgtttgtccgccggtggtcaagatgagcgcaatgcacaatacggcccctttacacccgggttcgtgcgggtgccgcattgtcttgaataccgcgcacaatgggatttgacaggcgaagcctatggcaaacgcgcagctgacgcgattgaagaagtgatcttggccgaaggtccagacacagtcggcgcattgtgccttgagcccgtgaccgcaggtggtggcgtgattacaccccctgttggatactgggaacgcgttcaggaaatctgtaagaaatacgatatcctgcttcacatcgacgaagtcgtttgtggcgttgggcgcacaggaacttggttcgggtaccaacattacggcatcaaaccagacatggtaaccatggcaaaaggcgtggcctctggctatgcggcgattgcatgtttggtaacgaccgaagaagtttttgacatgttcaaagacgactcgtctgatccgatgaactatttccgcgatatttccacctttggtggctgtacagcaggccctgcagcggcattggaaaacatgcgtatcatcgaagatgagaacctattggacaacaccaacgtcatgggcgcacggatgttggacaacctcaatgccttggctgaaaagcacaaggtgattggtgatgttcggggcaaaggtttattctgcggtgcggaattggtggcagatcgtgcaaccaaagaagctgcaaatgaaaagatggtccaagcggttgtggccgaatgtggcgcacaaggtgtgatcatcggggcgacgaaccggtccttacccggcttgaacaatacgctgtgcttcagccccgcgttgatttcaacagcagacgacatcgacaatattaccgatgccgttgataaagctttgaccaaagtatttggttgattggaaacgattgggcgcagacagcctgcgcccaatcatagcccgtctgatgcaagatagttttggtatttttggggaatctccgcaatcggacaaaacccagtcttgcgcgccgcgctcagaatatccgacgtcgattgctccagcggctgcaaaatgcagggaacgacattttttccaatcggatttgccgaactcataatcatacagcgcccttggaaaaatccgcgcgtcgtccatgtgcgtgtcgaaaaattatccacccccaacacgctgttgggcacacgtgtcgcatatacaatcgacaacgcttcattggtttgcaacatcacgcctctgtattctcgtgcagaaattggcgtcaaatccgaccgcttcatgcctggtgcgacaggatccaccccccgcaccatgcgcgcaccatttcgtacaaaaacgcgcaccatcccaatccaaatttgcgtatctatcaaaaaagacggccgatacatgagatgcagaccgtctggcagaatatcctgcaacatgttttcaggaacaaagtaatcccgcccaaacaaggtgtaattccaaacatccgaaatatccgcgtcgtgaggttggaacgcacctgtttccaattcgtccaacggctgcagcaaaatccgcgcatcgacgttaaaatattcgcaaatccgctttaacatgccgggctttggaaaactctcgccattcaaaatacggttcatctgtacgcggtttatttcaagactgtcagcaacctcggcaatcgtaccgacgcgcctgcacagctgtcgcaaatttttaccaaaaattagatgcgttgaaacaaaatcaacttcattcgtcactcaaaacaccccgatcaaatcttactttttaaatatagacatattaacaaaggacgcaacgctacccaaaagggtagtcctttttaggtccaaaagcaacgtatgacatgtggaccagccatcgctcgatactctatccaccaattacgcgcctatgattcatgtcgattcttccgcatcaatcataagtccagtttacgttgccgctttagtccaataaaataccctcatggcgattcctgtagaaaacttttatctcgacacgaactttcaagggacgttgcaggcgcgcatccaacagatgatcgcccaaggcatcctgatcggccgttttcgaacgggcgaacggttgccgtccacccgagcattggcgcggcatttgaaagtcagccggctgactgtcacgctggcctataccgaattattggcgagcgattacataacgtcgcgggatcgttcgggatatttcgtgtccgacaccgcgccagaggcgacacaatattcgacacccatagaacccaccgatgccattgattggacccgcgcgattggtcaaaaattcaccggtggaagctggccagaaaagccgcaaaactgggccacattcaaatacccctttatctatggtcaaaccgatccaaacctatttgatcatgcaaattggcgtttgtgtgcgttgaccgcattgggtgccaaggattttaatgcgctgacatcggattattatgacaaagacgatccaatgttggtcgaattcatcgcccgccaaagcctgccgcgccgtggaattttcgcaaagcctgaacagatcttggtgacgctaggggcgcaaaacgcgttgtggcttgcgacacaagtcttgctgacacagcgacgcacagcggtgattgagaacccgtgttacccagcgctgcgcgatattttggatcaatcgcgttgtcatgtcgaagcggtcgatgtcgataaacacggactaaaccccgacacggtgccaaacggtgcatcggtcatttttacgacgccaagtcatcagtgtccgacaacaacgacgatgcccgtgcagcgacgacaccatctgttgcaacgggcggcacaattggatgccttgatcgtggaagatgattatgaatttgaaatgtcgtcaacgacggcagcaacccctgccctgaaatccttggacaaagacggccgtgttatttacgtgggcagcttttccaaatccctatttccggggctgcggttgggatatttggttggggcagaaccctttatccgcgaagcgcgcgcactgcgggcatcaatcctgcgccatccacctggccatatccagcgcacggctgcatatttcctaagtttgggtcactatgatgcgttgatcaagcgcaccgcgcgacaatttcaaatgcgccgatccttgatgcaagatgcgatcaccgaatttggattgaccatcgcggggacgccgccaaaaggtgggtcgtccttttggatgcaagccccaaaacatatcaataccgtcgaattggcacgtaaactcgaaccgcatggcgtgttaattgaacctgcgcgatcattcttttcgggtgacactattcctaatcatttttatcgtcttgcattttcttcgatccctgacgggcgcatccgcgaagggataaaaataatttccgatgtgatttctgaaattggacctaaatcgtaaagccaactggccctattgaacatattgcgatacccgtaaggttcctgcaaaaggcgacagccctgattttcaaggagacaccgcaatgaaaatgacaaccgaagaagcatttgtaaaagttttgcaaatgcacggcatccaacacgcctttggcattattggatcggcgatgatgcctatttccgatctgttcccaaaagcgggtattaaattctgggattgtgcgcacgaaggatctgccggcatgatggccgatggatacacccgcgcgaccggcaaaatgtcgatgatgatcgcacaaaacggccccggcattacgaactttgtgaccgctgtgaaaacagcctattggaaccacaccccactgttg

SEQ ID NO: 1601 - DNA, 4000 bp, Escherichia coli
  misc_feature (1)..(1): n is a, c, g, or t
  misc_feature (4)..(4): n is a, c, g, or t
  misc_feature (8)..(8): n is a, c, g, or t
  misc_feature (12)..(12): n is a, c, g, or t
  misc_feature (16)..(19): n is a, c, g, or t
  misc_feature (22)..(23): n is a, c, g, or t
  misc_feature (25)..(25): n is a, c, g, or t
  misc_feature (31)..(33): n is a, c, g, or t
  misc_feature (36)..(37): n is a, c, g, or t
  misc_feature (40)..(41): n is a, c, g, or t
  misc_feature (45)..(45): n is a, c, g, or t
  misc_feature (47)..(47): n is a, c, g, or t
  misc_feature (49)..(49): n is a, c, g, or t
  misc_feature (51)..(51): n is a, c, g, or t
  misc_feature (54)..(54): n is a, c, g, or t
  misc_feature (58)..(59): n is a, c, g, or t
  misc_feature (70)..(70): n is a, c, g, or t
  misc_feature (76)..(78): n is a, c, g, or t
  misc_feature (80)..(80): n is a, c, g, or t
  misc_feature (82)..(82): n is a, c, g, or t
  misc_feature (84)..(87): n is a, c, g, or t
  misc_feature (90)..(92): n is a, c, g, or t
  misc_feature (94)..(95): n is a, c, g, or t
  misc_feature (98)..(98): n is a, c, g, or t
  misc_feature (103)..(103): n is a, c, g, or t
  misc_feature (105)..(105): n is a, c, g, or t
  misc_feature (111)..(111): n is a, c, g, or t
  misc_feature (113)..(113): n is a, c, g, or t
  misc_feature (115)..(116): n is a, c, g, or t
  misc_feature (118)..(122): n is a, c, g, or t
  misc_feature (124)..(127): n is a, c, g, or t
  misc_feature (133)..(133): n is a, c, g, or t
  misc_feature (138)..(139): n is a, c, g, or t
  misc_feature (142)..(144): n is a, c, g, or t
  misc_feature (146)..(148): n is a, c, g, or t
  misc_feature (150)..(150): n is a, c, g, or t
  misc_feature (152)..(152): n is a, c, g, or t
  misc_feature (154)..(154): n is a, c, g, or t
  misc_feature (156)..(156): n is a, c, g, or t
  misc_feature (158)..(164): n is a, c, g, or t
  misc_feature (167)..(167): n is a, c, g, or t
  misc_feature (169)..(169): n is a, c, g, or t
  misc_feature (171)..(173): n is a, c, g, or t
  misc_feature (176)..(176): n is a, c, g, or t
  misc_feature (178)..(178): n is a, c, g, or t
  misc_feature (180)..(183): n is a, c, g, or t
  misc_feature (189)..(193): n is a, c, g, or t
  misc_feature (195)..(199): n is a, c, g, or t
  misc_feature (201)..(202): n is a, c, g, or t
  misc_feature (204)..(204): n is a, c, g, or t
  misc_feature (206)..(208): n is a, c, g, or t
  misc_feature (210)..(210): n is a, c, g, or t
  misc_feature (215)..(215): n is a, c, g, or t
  misc_feature (221)..(222): n is a, c, g, or t
  misc_feature (224)..(224): n is a, c, g, or t
  misc_feature (227)..(237): n is a, c, g, or t
  misc_feature (239)..(242): n is a, c, g, or t
  misc_feature (245)..(247): n is a, c, g, or t
  misc_feature (252)..(257): n is a, c, g, or t
  misc_feature (264)..(268): n is a, c, g, or t
  misc_feature (270)..(270): n is a, c, g, or t
  misc_feature (276)..(277): n is a, c, g, or t
  misc_feature (279)..(279): n is a, c, g, or t
  misc_feature (282)..(282): n is a, c, g, or t
  misc_feature (284)..(284): n is a, c, g, or t
  misc_feature (288)..(288): n is a, c, g, or t
  misc_feature (292)..(297): n is a, c, g, or t
  misc_feature (300)..(302): n is a, c, g, or t
  misc_feature (306)..(307): n is a, c, g, or t
  misc_feature (309)..(309): n is a, c, g, or t
  misc_feature (311)..(313): n is a, c, g, or t
  misc_feature (318)..(321): n is a, c, g, or t
  misc_feature (324)..(325): n is a, c, g, or t
  misc_feature (328)..(328): n is a, c, g, or t
  misc_feature (331)..(331): n is a, c, g, or t
  misc_feature (333)..(334): n is a, c, g, or t
  misc_feature (338)..(339): n is a, c, g, or t
  misc_feature (341)..(344): n is a, c, g, or t
  misc_feature (346)..(346): n is a, c, g, or t
  misc_feature (349)..(349): n is a, c, g, or t
  misc_feature (351)..(352): n is a, c, g, or t
  misc_feature (354)..(357): n is a, c, g, or t
  misc_feature (361)..(361): n is a, c, g, or t
  misc_feature (363)..(373): n is a, c, g, or t
  misc_feature (375)..(376): n is a, c, g, or t
  misc_feature (378)..(379): n is a, c, g, or t
  misc_feature (382)..(383): n is a, c, g, or t
  misc_feature (385)..(385): n is a, c, g, or t
  misc_feature (387)..(387): n is a, c, g, or t
  misc_feature (389)..(390): n is a, c, g, or t
  misc_feature (392)..(401): n is a, c, g, or t
  misc_feature (403)..(405): n is a, c, g, or t
  misc_feature (407)..(407): n is a, c, g, or t
  misc_feature (410)..(414): n is a, c, g, or t
  misc_feature (416)..(417): n is a, c, g, or t
  misc_feature (419)..(423): n is a, c, g, or t
  misc_feature (425)..(427): n is a, c, g, or t
  misc_feature (429)..(429): n is a, c, g, or t
  misc_feature (432)..(432): n is a, c, g, or t
  misc_feature (434)..(436): n is a, c, g, or t
  misc_feature (441)..(442): n is a, c, g, or t
  misc_feature (444)..(444): n is a, c, g, or t
  misc_feature (447)..(447): n is a, c, g, or t
  misc_feature (449)..(452): n is a, c, g, or t
  misc_feature (454)..(454): n is a, c, g, or t
  misc_feature (456)..(470): n is a, c, g, or t
  misc_feature (472)..(473): n is a, c, g, or t
  misc_feature (475)..(480): n is a, c, g, or t
  misc_feature (482)..(484): n is a, c, g, or t
  misc_feature (486)..(487): n is a, c, g, or t
  misc_feature (634)..(634): n is a, c, g, or t
  misc_feature (649)..(649): n is a, c, g, or t
  misc_feature (676)..(676): n is a, c, g, or t
  misc_feature (697)..(697): n is a, c, g, or t
  misc_feature (802)..(802): n is a, c, g, or t
  misc_feature (915)..(915): n is a, c, g, or t
  misc_feature (1146)..(1146): n is a, c, g, or t
  misc_feature (1185)..(1185): n is a, c, g, or t
  misc_feature (1395)..(1395): n is a, c, g, or t
  misc_feature (1410)..(1410): n is a, c, g, or t
  misc_feature (1431)..(1431): n is a, c, g, or t
  misc_feature (1539)..(1539): n is a, c, g, or t
  misc_feature (1608)..(1608): n is a, c, g, or t
  misc_feature (1614)..(1614): n is a, c, g, or t
  misc_feature (2668)..(2668): n is a, c, g, or t
  misc_feature (3910)..(3910): n is a, c, g, or t
ngancctnaganttcnnnnatnncntttaannnttnnaannattnantnanttntttnntggttttattngtgggnnnantngnnnntcnnnannttntaatnanttttgnantnntnnnnnannnntgaaanctttnnttnnngnnntnanancngnnnnnnntgnantnnntgnantnnnnaaaaannnnnannnnncnnangnnntngatgntacagnnanaannnnnnnnnnncnnnncannnttgtnnnnnntgtgatnnnnntncttttnntnggntnattnattnnnnnngtnnncctnntncnnncctannnnctnnatnatntnntcannannnncngcnanngnnnnaggntnnnnnnnnnnngnnannagnncnantnntnnnnnnnnnngnnnanagnnnnnanngnnnnnannntnatnannntcatnntntgnannnntngnnnnnnnnnnnnnnncnntnnnnnncnnntnntgcgaatcatcagcgtgatcttcagagtgatcatcgtgagaatgattatgattgctatgatcctcttgagctgttttttgagactgaaccacttcgtgataaacgccaagagctttgctaatagaaattagctcatcttgttttgcngttaagcccttgaangatgaattaaaagctttagcaaagttntccaggtttcctagatctctntccggatcaacagagacaaatacaacttgaagttgatcactattttccattaactgtgatgcttggtttattttagagaggtcaattggacaaacatctggacangaagtgtagccaaaatacagaagcgcccatttatcatctgccacatctgataaatgagtgttttttgatgcatcatcgataaagttgagtttgtctgaaactgattttgcttnaggatataaggacgcagcaggagcaacagactttttgagttcctccatattgggcttgccaccaaagaagaagaaaactgcagcactaataatggctgcaagaataaggaaataaatttgagtactttttgtcataataagacctacaaatgtggcaattagttttgaagagcgttttcttttgtgaacattttgtgagcaaggttcacaagactcaagagcagcgcaagnccgattacattgtgcattgtggcagcaaacataggcagngacattactacattaataatccccagcgcaacttgaattgttagaagggcaagaactataagtaaactgtttctgagtgctttgtagtttctaagagcaaatgaaaaagtaattattgctgcagttacaacaagggcgccaacacgatgaaccatttggattgctgttcgtgtttcattttctaggacaccaaactcataatcaactccnagtggcccccaatantaggcattattaaagtccatntcatcaggccacatctctcctagacagctaggaaaatagtccccacaggcaagtgcagcatagttagtgctggtccaccctccaagaaaaatttgaaaaactagaagnacagtaacaatggcaagcattatcttatgcttgttgagaattggctgatcaagagtaagaggcttacgntcattnagaagcagccaaaagagaagagttgttgttgaaaagccacccaataaatgcatcgtaactatccctggatgtactaattccgttactgtccacatccctagggcgccttgaaaaccaaccaatagtagaagtgcagttggcaactttacagaacggagcgtgtccggcctcctaaaaattgccaataaaaagataataacaattgataggccaagtattgaagcggcgtagcgatggaccatttctttccaggcttttgctatatcaaggggcctgtcatattctgcagagatgacatctggaaccaacagctgaccatagcagcctggccagtcgggacatcctagtcccgcatcagcaaggcgagtatatgctcctaagatgacaactatgagagctaaaataaatgagaggttaagtgctttagagtacataaaatccagtaaatgaggcaaccattttagttaacaaagtagttgcttgattaaaaaattcaaaaaactttaaataaatgtgcatcttttatttaggggtttattcttttttttcaacaataggagtgtaattttttagcattcagtttgttggtgaaaaaagttcaatcaatattgagaataaaggtgaattattacttggtaaaaaagagataaacaggtatcatttggttgcattttttaattgaaacttgaaattgcacattcaagtactatttatatagctataaaaggtttaattcggagaatctatgaaactatttttgactattactagcgctattgcagcattattaggccctagatctgcttttgcagagtacacacttaatatgacaaaaggcatcactgaccttagccaggacatttactggcttcatatgatggcattttgggtttgtgttggtatcggcgttgtagtatttggtgctatgttctattcaatcattgcccacagaaagtcaaagggagctaaggctgcacattttcatgagagtacgacagttgaatttatatggacaggaattccaatcttaatcttaattgcaatggcaattccngcctccaaaacattgattgatattgaggtccttgaaaaggcagacatgactatcaaggttaccggcattcaatggaagtggcagtatgactatcctgaagaaggaatcagctttgtttcaaatttggcacaatcttcgagagacgttattaaggcatcacctgaggagcgtgaagctgttcacaaggaaagtgactaccttcgctcagttgacaatcatcttgttcttccagttgatacaacggttagatttttaattacttctaatgacgttattcataactggtgggttcccgcttttggcgtcaagcaggatgctaatcctggatttatcaatgatgcatgggctaagccaaatgaaattggaacttatagaggacaatgtgctgagctttgtggaaaagatcatgggtttatgccaattgtggtagacgttgtttctaaagccgactatgcggcttgggttgagagcaaacaggctgaaaaagttgctgaattagctagcgctacacaagaatggacagaggctgatttggttgcaaggggtgaggaagtttacaacgcaaactgctctggttgtcatcaaaaagacggctcaggtattccaggagtcttcccagcaatgatagggtcagaagtaacaaatggccccgcagattatcaaataggcatggttttaaatggcttaaggggaatgcctgcatttaagatgcttagcgatacagatattgcatcggtaattacctacgaaagaagatcttttggtaacaatggatcagttgttcaaccatcagatgttacatctgcacgttaatttaaggagaaacacatgagctcaactacagcggcagcagcacacgacgatcaccatcatggccctgaaaaaggactcctaagatgggttaaaacaactaatcacaaggatattggaacgctttatctgtggttttcttttgcaatgctcttggtgggcggtgccttcgctatgggcattcgttcagaattattacagcctggtttacaattgtttgaaccacaattctataaccagctgacaacaatgcatgggctgatcatggtatttggtgccattatgcctgcctttgtaggccttgcaaactggctgattcctatgatggtaggagctcccgatatggctcttccaagaatgaataattggagtttttggatactgccttttgctggcacgattctactgagcacattttttatggaaggtggngcacctgcttttggatggactttttatgctccactctcaacaacatttgcaccagattcaactgacttctttatctttgcaattcacttg

SEQ ID NO: 1602 - DNA, 4000 bp, Escherichia coli
  misc_feature (1689)..(1689): n is a, c, g, or t
  misc_feature (1715)..(1715): n is a, c, g, or t
  misc_feature (1728)..(1728): n is a, c, g, or t
  misc_feature (2726)..(2726): n is a, c, g, or t
  misc_feature (2917)..(2917): n is a, c, g, or t
  misc_feature (3430)..(3430): n is a, c, g, or t
tcttcacttgagacttagcggttactttctttacggctgcttttacttttgataataacgaatttttttttgccataactaaatcctcaaaaaatttctagacgccgaagtttacactttttgaaattcattgcaagctagaattatttagtttttgagcttgaagagtgttttccatcaaagtcgaaactgtcattggaccaactcctccaggtacgggtgtgatatatgaagcatttttgcttgctacctcaaattcaacatcacctactaatttgttatcaattctattgataccaatatcaataactattgctccttttttaatccattctcctcgaactagattttgctttccagcagcaacaacaactaaatcagcttgtcgtactttttcttctaaatttttggttctactgtgacaagatgtaatagtacatttttcaagcaataattctaatgccattgggcgtccaacattgtttgagactcctactattgttgcatccagcccttctaattctatatcggaagctttgagcatttttataacaccataaggtgtacaagatcttaatcttggttgtcgtatggcaagagagcctatattaaaaggatgaaaaccatcaacatctttatttgggctgatgagttcaattatcaattcttcattgagattttttggcaatggagattgtacaagaattccatcaacatctttatttttgttgagtgtattaattaaatcgtttaaatctgattgagttgtattagagggtaaatgatgagagacagattttattccaacgttttcacatgcagatttctttttatttacataaatagaagaagcaggatcatcacccaccaaaattacagcaaggcaaggtggcctaattccttcattttttctttgttgaatctcttctttgagtaaacttaaacattctttggaaatagcattaccatcaataatttttgcaaccatatcttaaaaataccttcattaaataaacaatatatattatcagaacataagccaaaatatatactatcttttaatataaaatttgaccgaaagccttatttacgctatatttgcgcgttcggggtgtagcgtagcctggtagcgcgcctgctttgggagcaggatgtcgggagttcgaatctctccaccccgaccagataaaaaaaagtaaatgcaagcccgttaaaatgctttactataatttagttagctgcccgtagctcagctggatagagcatctgccttctaagcagagggtcacaggttcgaatcctgtcgggcaggccaatttctatggtggctgtagctcagttggtagagccctggattgtgattccagttgtcgtgggttcgagccccatcagccaccccaatttgtttcttgtttctagttgtgaaatactctttataattttgataatagtaaataaatatgcaagacaaagacctggaaagatatagtcgacatattttgttgccagaaatagaatttgaaggtcaaaaaaagttacttcaaagtcattgtttaataataggcgcaggtggtttaggttcacctgttgcaatttatttggcagcatcagggataggtaagattacaatttgtgattttgatgatgttgatttatcaaatttacaacgtcaaattgttcataatgagnaatcaattggtaaaaataaagctgantctgcaaaagtanccattagtaaaattaactcagatatcaaagtaagatcaataaagaaccaattgaatcttgaggaagttaaagtcatagcaaaagaggtagatatcatattagattgctctgataactttgagacgcgttatgcactaaataaaattgcttatgatttaaagttacctttagtttcaggagcagcaataaaatttgatggccaagtgtctgtttttgattttagagctaaaacttcaccttgttacaactgcctttttccgagtgctgatgaagaacaaaatttaaaatgttctgatcatggagttttttctcctttggtagggttagttggttcaattcaagcaggagaggcgataaaggtactattaaatattggaacttcactaactggaaaattattgttaataaaccataaagataccaattttaagactttgaaaatccaaaaagataacctttgtgatatttgttcttaaatagctattttaaaaaaagttaaacctagacccatggtaaaattaaaaacttaaatccctaacttagttttatgaaaaaagaattatccaaatcattttcaccaattgatatcgagaccaaatggtaccaatattgggagtcaaacgattactacaaaattggggatgatgagtctaaaccaaattctttttcaattttattaccacccccaaatgtaacgggcactcttcatatgggccatggatttaatcaaacactcatggatatgcttactagatatcatagaatgaagggagaaaacactttatggcaacctgggactgatcatgcaggaattgcaactcaaattgtagttgagaggcaattagatcaaaaaggtatttcaagacatgatttaggaagagaaaaatttattgaaaaagtttgggagtggaagaaggactcaggaggtaaaatcacacaacaaatgcgtcgattaggtacttcaccagattggtcaagagaaagatttacaatggatnaaggcctatcaaaaagtgtcactgaagtttttgttaaattgtatcaagatggtttgatttatcgagggaaaagactagttaattgggatgtcacacttcaaaccgctgtatctgatttagaggttattcaagaagaagaagatggctttttatggcaaattaattatccacttaagaatgaaaagaatcancttactattgctacaacaagaccagaaacaatgttgggtgattctgccttaatggttcatccagaagatgatcgatataaaaagtttataggtaaaacagttttaattccgcttattgataaagagattccaataattgcagatgattatgttgacccaacatttggaacaggaattgttaaagttaccccaggacatgactttaatgattatgctgttgggataaggcatgatttaccaataataaatattttaactcttgatggccatattaatgaaaatggaacaaagctttatgagggcttagatcgttttgaagcaagaaaaaaaattattgaagatttaaaggaaaaaaaataccttgatagtataaaaaaacataaattaaaagttccaagaggagataggactaactcaataatcgaaccaatgttaactgatcaatggtatgtatccatgacaaaaccatctggttcagatgggaaaagtattgcacaagaggcactagatttngtagatagaggtgaaattaaattttatccaaataattgggtgaacacttacaatcaatggttagaaaatatccaagattggtgcatatcacgtcaactttggtggggccatcaaatacctgcttggtatggagagaatcaagaggtttttgttgcgcattcgtttgaagaagcatctgagttagctaagaaaaagggctataaaggttctttgaaaagagataatgatgttctagatacttggttttcatccgccctgtgggcattcacaacattagattggacacctgaatacccaaaaaaatctaacccagcgcttgataggtacttaccttcttccgtgctcgttacaggttttgatattatatttttctgggtagctaggatggtaatgatgacgaaatatgtcacaaataaaataccatttaaacatgtctatgttcatggattgatcagagaccaggatggacaaaaaatgagcaaatcaaaaggcaatgtccttgatcccattgatttaatcgatggcatttctcttgatgatctcttgaaaaaaagaactcaaggcctaatg

SEQ ID NO: 1603 - DNA, 4000 bp, Escherichia coli
  misc_feature (1)..(1): n is a, c, g, or t
  misc_feature (4)..(6): n is a, c, g, or t
  misc_feature (8)..(8): n is a, c, g, or t
  misc_feature (11)..(12): n is a, c, g, or t
  misc_feature (14)..(14): n is a, c, g, or t
  misc_feature (16)..(18): n is a, c, g, or t
  misc_feature (21)..(23): n is a, c, g, or t
  misc_feature (26)..(26): n is a, c, g, or t
  misc_feature (29)..(29): n is a, c, g, or t
  misc_feature (31)..(31): n is a, c, g, or t
  misc_feature (33)..(33): n is a, c, g, or t
  misc_feature (36)..(38): n is a, c, g, or t
  misc_feature (40)..(40): n is a, c, g, or t
  misc_feature (45)..(45): n is a, c, g, or t
  misc_feature (47)..(50): n is a, c, g, or t
  misc_feature (57)..(57): n is a, c, g, or t
  misc_feature (60)..(60): n is a, c, g, or t
  misc_feature (64)..(70): n is a, c, g, or t
  misc_feature (72)..(72): n is a, c, g, or t
  misc_feature (75)..(75): n is a, c, g, or t
  misc_feature (77)..(80): n is a, c, g, or t
  misc_feature (83)..(84): n is a, c, g, or t
  misc_feature (88)..(88): n is a, c, g, or t
  misc_feature (91)..(92): n is a, c, g, or t
  misc_feature (94)..(95): n is a, c, g, or t
  misc_feature (103)..(103): n is a, c, g, or t
  misc_feature (105)..(105): n is a, c, g, or t
  misc_feature (108)..(108): n is a, c, g, or t
  misc_feature (110)..(111): n is a, c, g, or t
  misc_feature (113)..(113): n is a, c, g, or t
  misc_feature (115)..(115): n is a, c, g, or t
  misc_feature (119)..(122): n is a, c, g, or t
  misc_feature (124)..(124): n is a, c, g, or t
  misc_feature (127)..(128): n is a, c, g, or t
  misc_feature (130)..(133): n is a, c, g, or t
  misc_feature (138)..(138): n is a, c, g, or t
  misc_feature (140)..(140): n is a, c, g, or t
  misc_feature (143)..(146): n is a, c, g, or t
  misc_feature (148)..(148): n is a, c, g, or t
  misc_feature (150)..(150): n is a, c, g, or t
  misc_feature (152)..(154): n is a, c, g, or t
  misc_feature (156)..(158): n is a, c, g, or t
  misc_feature (160)..(161): n is a, c, g, or t
  misc_feature (163)..(163): n is a, c, g, or t
  misc_feature (165)..(165): n is a, c, g, or t
  misc_feature (172)..(173): n is a, c, g, or t
  misc_feature (175)..(175): n is a, c, g, or t
  misc_feature (177)..(180): n is a, c, g, or t
  misc_feature (182)..(182): n is a, c, g, or t
  misc_feature (184)..(188): n is a, c, g, or t
  misc_feature (190)..(190): n is a, c, g, or t
  misc_feature (195)..(195): n is a, c, g, or t
  misc_feature (197)..(198): n is a, c, g, or t
  misc_feature (200)..(200): n is a, c, g, or t
  misc_feature (203)..(203): n is a, c, g, or t
  misc_feature (205)..(208): n is a, c, g, or t
  misc_feature (210)..(210): n is a, c, g, or t
  misc_feature (213)..(213): n is a, c, g, or t
  misc_feature (216)..(216): n is a, c, g, or t
  misc_feature (220)..(220): n is a, c, g, or t
  misc_feature (222)..(223): n is a, c, g, or t
  misc_feature (226)..(226): n is a, c, g, or t
  misc_feature (232)..(233): n is a, c, g, or t
  misc_feature (235)..(241): n is a, c, g, or t
  misc_feature (246)..(249): n is a, c, g, or t
  misc_feature (253)..(253): n is a, c, g, or t
  misc_feature (256)..(258): n is a, c, g, or t
  misc_feature (260)..(260): n is a, c, g, or t
  misc_feature (268)..(269): n is a, c, g, or t
  misc_feature (271)..(271): n is a, c, g, or t
  misc_feature (277)..(281): n is a, c, g, or t
  misc_feature (284)..(284): n is a, c, g, or t
  misc_feature (286)..(287): n is a, c, g, or t
  misc_feature (289)..(291): n is a, c, g, or t
  misc_feature (293)..(294): n is a, c, g, or t
  misc_feature (298)..(298): n is a, c, g, or t
  misc_feature (300)..(301): n is a, c, g, or t
  misc_feature (303)..(303): n is a, c, g, or t
  misc_feature (305)..(307): n is a, c, g, or t
  misc_feature (310)..(312): n is a, c, g, or t
  misc_feature (316)..(316): n is a, c, g, or t
  misc_feature (319)..(320): n is a, c, g, or t
  misc_feature (322)..(323): n is a, c, g, or t
  misc_feature (325)..(326): n is a, c, g, or t
  misc_feature (329)..(329): n is a, c, g, or t
  misc_feature (331)..(332): n is a, c, g, or t
  misc_feature (334)..(336): n is a, c, g, or t
  misc_feature (338)..(343): n is a, c, g, or t
  misc_feature (345)..(349): n is a, c, g, or t
  misc_feature (353)..(353): n is a, c, g, or t
  misc_feature (355)..(355): n is a, c, g, or t
  misc_feature (357)..(357): n is a, c, g, or t
  misc_feature (360)..(360): n is a, c, g, or t
  misc_feature (362)..(363): n is a, c, g, or t
  misc_feature (366)..(366): n is a, c, g, or t
  misc_feature (370)..(370): n is a, c, g, or t
  misc_feature (374)..(375): n is a, c, g, or t
  misc_feature (377)..(380): n is a, c, g, or t
  misc_feature (387)..(387): n is a, c, g, or t
  misc_feature (389)..(389): n is a, c, g, or t
  misc_feature (395)..(395): n is a, c, g, or t
  misc_feature (398)..(399): n is a, c, g, or t
  misc_feature (402)..(402): n is a, c, g, or t
  misc_feature (405)..(405): n is a, c, g, or t
  misc_feature (407)..(408): n is a, c, g, or t
  misc_feature (411)..(412): n is a, c, g, or t
  misc_feature (414)..(414): n is a, c, g, or t
  misc_feature (416)..(418): n is a, c, g, or t
  misc_feature (420)..(420): n is a, c, g, or t
  misc_feature (422)..(424): n is a, c, g, or t
  misc_feature (427)..(428): n is a, c, g, or t
  misc_feature (430)..(430): n is a, c, g, or t
  misc_feature (432)..(436): n is a, c, g, or t
  misc_feature (438)..(440): n is a, c, g, or t
  misc_feature (442)..(442): n is a, c, g, or t
  misc_feature (447)..(448): n is a, c, g, or t
  misc_feature (454)..(457): n is a, c, g, or t
  misc_feature (461)..(467): n is a, c, g, or t
  misc_feature (469)..(474): n is a, c, g, or t
  misc_feature (477)..(478): n is a, c, g, or t
  misc_feature (480)..(480): n is a, c, g, or t
  misc_feature (483)..(486): n is a, c, g, or t
  misc_feature (488)..(492): n is a, c, g, or t
  misc_feature (494)..(494): n is a, c, g, or t
  misc_feature (499)..(500): n is a, c, g, or t
  misc_feature (502)..(512): n is a, c, g, or t
  misc_feature (515)..(517): n is a, c, g, or t
  misc_feature (520)..(522): n is a, c, g, or t
  misc_feature (526)..(526): n is a, c, g, or t
  misc_feature (530)..(531): n is a, c, g, or t
  misc_feature (533)..(534): n is a, c, g, or t
  misc_feature (537)..(541): n is a, c, g, or t
  misc_feature (543)..(544): n is a, c, g, or t
  misc_feature (549)..(550): n is a, c, g, or t
  misc_feature (553)..(555): n is a, c, g, or t
  misc_feature (557)..(558): n is a, c, g, or t
  misc_feature (560)..(561): n is a, c, g, or t
  misc_feature (563)..(566): n is a, c, g, or t
  misc_feature (568)..(569): n is a, c, g, or t
  misc_feature (571)..(571): n is a, c, g, or t
  misc_feature (574)..(574): n is a, c, g, or t
  misc_feature (576)..(576): n is a, c, g, or t
  misc_feature (581)..(583): n is a, c, g, or t
  misc_feature (587)..(588): n is a, c, g, or t
  misc_feature (592)..(592): n is a, c, g, or t
  misc_feature (595)..(595): n is a, c, g, or t
  misc_feature (601)..(602): n is a, c, g, or t
  misc_feature (604)..(605): n is a, c, g, or t
  misc_feature (608)..(608): n is a, c, g, or t
  misc_feature (610)..(612): n is a, c, g, or t
  misc_feature (614)..(614): n is a, c, g, or t
  misc_feature (617)..(619): n is a, c, g, or t
  misc_feature (625)..(628): n is a, c, g, or t
  misc_feature (631)..(632): n is a, c, g, or t
  misc_feature (635)..(637): n is a, c, g, or t
  misc_feature (639)..(642): n is a, c, g, or t
  misc_feature (644)..(644): n is a, c, g, or t
  misc_feature (646)..(647): n is a, c, g, or t
  misc_feature (649)..(651): n is a, c, g, or t
  misc_feature (653)..(653): n is a, c, g, or t
  misc_feature (655)..(657): n is a, c, g, or t
  misc_feature (662)..(663): n is a, c, g, or t
  misc_feature (668)..(670): n is a, c, g, or t
  misc_feature (672)..(674): n is a, c, g, or t
  misc_feature (676)..(677): n is a, c, g, or t
  misc_feature (679)..(680): n is a, c, g, or t
  misc_feature (682)..(683): n is a, c, g, or t
  misc_feature (686)..(687): n is a, c, g, or t
  misc_feature (689)..(689): n is a, c, g, or t
  misc_feature (691)..(691): n is a, c, g, or t
  misc_feature (693)..(693): n is a, c, g, or t
  misc_feature (695)..(696): n is a, c, g, or t
  misc_feature (700)..(701): n is a, c, g, or t
  misc_feature (704)..(704): n is a, c, g, or t
  misc_feature (707)..(707): n is a, c, g, or t
  misc_feature (710)..(710): n is a, c, g, or t
  misc_feature (712)..(712): n is a, c, g, or t
  misc_feature (714)..(717): n is a, c, g, or t
  misc_feature (720)..(720): n is a, c, g, or t
  misc_feature (723)..(723): n is a, c, g, or t
  misc_feature (728)..(728): n is a, c, g, or t
  misc_feature (730)..(730): n is a, c, g, or t
  misc_feature (734)..(735): n is a, c, g, or t
  misc_feature (737)..(738): n is a, c, g, or t
  misc_feature (740)..(740): n is a, c, g, or t
  misc_feature (744)..(745): n is a, c, g, or t
  misc_feature (748)..(748): n is a, c, g, or t
  misc_feature (751)..(751): n is a, c, g, or t
  misc_feature (755)..(755): n is a, c, g, or t
  misc_feature (758)..(758): n is a, c, g, or t
  misc_feature (760)..(761): n is a, c, g, or t
  misc_feature (765)..(765): n is a, c, g, or t
  misc_feature (768)..(768): n is a, c, g, or t
  misc_feature (771)..(773): n is a, c, g, or t
  misc_feature (775)..(777): n is a, c, g, or t
  misc_feature (779)..(779): n is a, c, g, or t
  misc_feature (781)..(784): n is a, c, g, or t
  misc_feature (786)..(788): n is a, c, g, or t
  misc_feature (791)..(791): n is a, c, g, or t
  misc_feature (794)..(797): n is a, c, g, or t
  misc_feature (800)..(802): n is a, c, g, or t
  misc_feature (804)..(806): n is a, c, g, or t
  misc_feature (809)..(809): n is a, c, g, or t
  misc_feature (811)..(811): n is a, c, g, or t
  misc_feature (814)..(816): n is a, c, g, or t
  misc_feature (819)..(819): n is a, c, g, or t
  misc_feature (821)..(821): n is a, c, g, or t
  misc_feature (823)..(825): n is a, c, g, or t
  misc_feature (828)..(833): n is a, c, g, or t
  misc_feature (835)..(836): n is a, c, g, or t
  misc_feature (838)..(839): n is a, c, g, or t
  misc_feature (841)..(841): n is a, c, g, or t
  misc_feature (843)..(847): n is a, c, g, or t
  misc_feature (849)..(849): n is a, c, g, or t
  misc_feature (852)..(854): n is a, c, g, or t
  misc_feature (856)..(856): n is a, c, g, or t
  misc_feature (858)..(858): n is a, c, g, or t
  misc_feature (861)..(861): n is a, c, g, or t
  misc_feature (863)..(863): n is a, c, g, or t
  misc_feature (865)..(866): n is a, c, g, or t
  misc_feature (868)..(869): n is a, c, g, or t
  misc_feature (871)..(871): n is a, c, g, or t
  misc_feature (873)..(875): n is a, c, g, or t
  misc_feature (878)..(878): n is a, c, g, or t
  misc_feature (884)..(888): n is a, c, g, or t
  misc_feature (890)..(890): n is a, c, g, or t
  misc_feature (893)..(895): n is a, c, g, or t
  misc_feature (897)..(899): n is a, c, g, or t
  misc_feature (901)..(904): n is a, c, g, or t
  misc_feature (906)..(906): n is a, c, g, or t
  misc_feature (908)..(909): n is a, c, g, or t
  misc_feature (912)..(913): n is a, c, g, or t
  misc_feature (916)..(918): n is a, c, g, or t
  misc_feature (920)..(922): n is a, c, g, or t
  misc_feature (924)..(927): n is a, c, g, or t
  misc_feature (929)..(929): n is a, c, g, or t
  misc_feature (931)..(936): n is a, c, g, or t
  misc_feature (939)..(939): n is a, c, g, or t
  misc_feature (941)..(941): n is a, c, g, or t
  misc_feature (945)..(945): n is a, c, g, or t
  misc_feature (948)..(951): n is a, c, g, or t
  misc_feature (954)..(955): n is a, c, g, or t
  misc_feature (959)..(959): n is a, c, g, or t
  misc_feature (965)..(967): n is a, c, g, or t
  misc_feature (972)..(972): n is a, c, g, or t
  misc_feature (974)..(974): n is a, c, g, or t
  misc_feature (980)..(981): n is a, c, g, or t
  misc_feature (985)..(985): n is a, c, g, or t
  misc_feature (989)..(989): n is a, c, g, or t
  misc_feature (991)..(993): n is a, c, g, or t
  misc_feature (999)..(1001): n is a, c, g, or t
  misc_feature (1004)..(1004): n is a, c, g, or t
  misc_feature (1008)..(1011): n is a, c, g, or t
  misc_feature (1015)..(1015): n is a, c, g, or t
  misc_feature (1017)..(1018): n is a, c, g, or t
  misc_feature (1020)..(1020): n is a, c, g, or t
  misc_feature (1022)..(1022): n is a, c, g, or t
  misc_feature (1024)..(1024): n is a, c, g, or t
  misc_feature (1026)..(1028): n is a, c, g, or t
  misc_feature (1030)..(1031): n is a, c, g, or t
  misc_feature (1035)..(1035): n is a, c, g, or t
  misc_feature (1038)..(1039): n is a, c, g, or t
  misc_feature (1046)..(1047): n is a, c, g, or t
  misc_feature (1049)..(1052): n is a, c, g, or t
  misc_feature (1056)..(1057): n is a, c, g, or t
  misc_feature (1059)..(1060): n is a, c, g, or t
  misc_feature (1075)..(1075): n is a, c, g, or t
  misc_feature (1166)..(1166): n is a, c, g, or t
  misc_feature (1260)..(1260): n is a, c, g, or t
  misc_feature (1266)..(1266): n is a, c, g, or t
  misc_feature (1293)..(1293): n is a, c, g, or t
  misc_feature (1295)..(1295): n is a, c, g, or t
  misc_feature (1313)..(1313): n is a, c, g, or t
  misc_feature (1343)..(1343): n is a, c, g, or t
  misc_feature (1367)..(1367): n is a, c, g, or t
  misc_feature (1373)..(1373): n is a, c, g, or t
  misc_feature (1387)..(1387): n is a, c, g, or t
  misc_feature (1496)..(1496): n is a, c, g, or t
  misc_feature (1628)..(1628): n is a, c, g, or t
  misc_feature (1989)..(1990): n is a, c, g, or t
  misc_feature (2337)..(2337): n is a, c, g, or t
  misc_feature (2436)..(2436): n is a, c, g, or t
  misc_feature (2448)..(2448): n is a, c, g, or t
  misc_feature (2711)..(2711): n is a, c, g, or t
  misc_feature (2717)..(2717): n is a, c, g, or t
  misc_feature (2720)..(2720): n is a, c, g, or t
  misc_feature (2855)..(2855): n is a, c, g, or t
  misc_feature (3224)..(3224): n is a, c, g, or t
  misc_feature (3325)..(3325): n is a, c, g, or t
  misc_feature (3368)..(3368): n is a, c, g, or t
  misc_feature (3724)..(3724): n is a, c, g, or t
  misc_feature (3754)..(3754): n is a, c, g, or t
  misc_feature (3817)..(3817): n is a, c, g, or t
  misc_feature (3886)..(3886): n is a, c, g, or t
  misc_feature (3916)..(3916): n is a, c, g, or t
nttnnnanctnntntnnncannnctnaanancnacnnntntgtcntnnnntttcgtnttncttnnnnnnntntcntnnnnctnnaatnaanntnnttacttcntntcntnntntnctannnncncanntnnnnatttntntannnncntngnnncnnntnnantntcagatnntntnnnntntnnnnntncaatntnncnatntnnnnanttntcnaatncnnttntctcanntnnnnnnncttcnnnnttanatnnntngttttctnnancttctnnnnnaananntnnntnngttntnntntnnnaannnatanctnnanntnnaancnntnnntnnnnnncnnnnntttntncnaantnntcnaacnttgnntnnnnttcttcnantttttnaannttngcntnntcnngntnnntntnnnagnntntnnnnntnnngngattnntatagnnnncaannnnnnnannnnnntanntntannnntnnnnntnacctnnannnnnnnnnnnaannnatnnntgancacnntnntcnnnnnanncatannatnnntnnanntnnnntnntnatncntttgnnngttnntttnctnatatcnntnnatntnnntntannnttgcannnntgnntgnnngnnnntnanntnnncntnnntgatnnaatannntnnnanntnntnnatnnanananannaatnnatnttnatntntnnnnatnganttaanancttnntnntnttcnnttnaanaatnaananntagntcntgnnntnnngnannnnannnacnaannnnttnnngnnntgnanatnnncanantnnnaannnnnntnntnnantnnnnnantcnnnancnttnantnntnnantnnnttnatcaannnnntnaannnannnannnntntnnttnnttnnncnnncnnnntnannnnnnatntnattnttnnnnttnngctntgatgnnntaaanancttaannactnaatntnnnattgcnnnatncatnnnnaatntnncnantntnnntnnattnatnntttattnntnnnntacnnanntatatattatacagnataatcctatacttgttcaaaatttgcgaatcatttgttatatggtaaaatacctatacacatttaatatataaatatataaaggaaaaangttatggaaaacgaaaagaagatcaaaacgagatttctcagtgttccgacactgcttaaattcttattacttgtatctgtatgcttattctgcntagctntctatgtaaatagtcatccagaattantnaagaagacaacacctacnccagagcctacaacagctgcttcaacggtngaacctacggcatctgctttaccngcccanttaacagatccaancagtgttacggtattggttgataaaaatcactctctatcacgtgactttgtgccaacaaacttagctactccttatttacagagtactgcggatgtcatccaaatccgncaagatgttggtgatgcggctaagtctatgatttctgctgcggaagctgctggtattaagttatatgtaactgctggataccgttcttatgatgaccaacaaacactttatgaggaccgtgttagtaagttnggtgaaaaagaagcttctgatacaacagccaaagctggttatagtgaaaatcaaacaggtttagcactcgacttcacagatacagcaactggcacaagctctgtagatttcgcaaatacacctgctggtaaatggttatatgagaatgcacattcttatggctttatcctacgttaccctgataagaaacaggatattacaggatattcctatatgccatggcactatcgttatgttggtacagatgtttctaatgcaatgtacgaacaaggtggatccaatttaacatttgaagaattttatcagataacaaagtagaaaatctctactttgttttttgtatgtgtaaaaattaactagnnagtttttcatctattttcattctagcgttgacatttttcacttcaaaaagtattatttatgagcatatgttcaatatatagtaatttggaggtggcatgaatgaagagaacataccaaccaagcaagaaaaagaataaagctacacacggctttagagcccgtatggctactgtgggtggacgtaaagttatcaacagacgtagagctaagggaagaaaggtcttatctgcttaagaagccaccattggtggtttttttcttactgtagaggttagagatgaaagtaaagaatcgaattaaaaaagcggaagaattccaatctatgattaaaaagggggcaaaggtngtcaatcagtcgtttgtcgtctatcatcagcctaaagaaggagatgaagctcgtattggaatttctgtatctaagaagctaggaaatgccgtacatcgnaacctatataancgtcaggttcgtatgatgtgccatgaattggttgattttaaaaatacaaattacgatatggtcttgattatccgcttcaactattcttctcttagctatgaggagaataaaaataacttggaaaaactattaataaaggctaaaattaaatagttgaaacataaggagaaaatatgaaatttacccctcgtacaaagaaactacttgccttgatggcaattgtgacaatcgtagtgacagctacaggttgtacagctccaaangatgcnaanggacacattattttgatttccgaaagcacaacttttggtgaaatcttccaaactgaaaactggtttaatgccttatttgtttggccactcagctgggtattaaacaaattagcaccagtcatcacagtaggtggngcaatcgctgtcgttactgcggttgtaaatggtttactagcagtatttacattgaagtctcagatgggcatgcaaagaatgcaaatgttgcagcctgagttaaacaagattcaacgtaaatatgaaggtcgtgatgatcaagcatctaagatgcgtatggctcaagaacaacagcagttaatgaataagtacaacgttaaccctggttctatgatgttagtacagtttattcagttaccaatcatcatggcaatgttcatggctatccaacgtgcagaagcagttgtcaatggtacattcttaggaatgaacttacaggtaaagcctagcgaagcattcggcttactatttaaaggtgatttaagtggnttaccatacatcatcttgttcttattaatggctgttacacaggttatcttagtattattaccaatgtacttccaaaagaagaaggctgctgcagaagctgngaaacatcaccgtaagccagaacctacaaataaccaaaacgtnatgatgcagatgtacatgattgttatggtacttgcattcggtttaatgtggcaatcaggtatgtccttattctggttcatccgtaacatcgtagatattattaagacaattattgtccaaaatatcatggagaacaattcacagaaagaaggcttaagataatgcaaatctatactgcaaaaacacttgaagaacttctacaaaacgctgctgaagaaaagggtgttacaatcgatgaattagaatacacagttgtggaagagaaaaaaggattattgggaattggtaattctgtatccgcaaaagtatttagttctgaagatgtaaaagaatttatctttgattacttaggtganttctttacacatattgatttggatattgangttgcgttagaggaactagatgatagttatgtaatcaatctaaattctgataacaatgctatnctcatcggtaagatgggtaagacattagctgcattcaatactgtattacgtgctgctgtaaacgctgantttgaaaagcgcattgatgtattaattganatcaatcactacaaagaagagcgctattacaagattcgttcaatggcaaagcgtatcgcaaaacaggtacaacgttcaaaggtt

SEQ ID NO: 1604 - DNA, 4000 bp, Escherichia coli
  misc_feature (1)..(1): n is a, c, g, or t
  misc_feature (3)..(5): n is a, c, g, or t
  misc_feature (7)..(8): n is a, c, g, or t
  misc_feature (12)..(15): n is a, c, g, or t
  misc_feature (17)..(17): n is a, c, g, or t
  misc_feature (20)..(20): n is a, c, g, or t
  misc_feature (22)..(24): n is a, c, g, or t
  misc_feature (26)..(26): n is a, c, g, or t
  misc_feature (29)..(29): n is a, c, g, or t
  misc_feature (31)..(31): n is a, c, g, or t
  misc_feature (33)..(34): n is a, c, g, or t
  misc_feature (37)..(40): n is a, c, g, or t
  misc_feature (62)..(62): n is a, c, g, or t
  misc_feature (103)..(103): n is a, c, g, or t
  misc_feature (106)..(114): n is a, c, g, or t
  misc_feature (117)..(120): n is a, c, g, or t
  misc_feature (122)..(123): n is a, c, g, or t
  misc_feature (126)..(133): n is a, c, g, or t
  misc_feature (136)..(147): n is a, c, g, or t
  misc_feature (149)..(157): n is a, c, g, or t
  misc_feature (159)..(164): n is a, c, g, or t
  misc_feature (166)..(169): n is a, c, g, or t
  misc_feature (171)..(174): n is a, c, g, or t
  misc_feature (177)..(179): n is a, c, g, or t
  misc_feature (181)..(181): n is a, c, g, or t
  misc_feature (183)..(188): n is a, c, g, or t
  misc_feature (191)..(193): n is a, c, g, or t
  misc_feature (195)..(196): n is a, c, g, or t
  misc_feature (198)..(199): n is a, c, g, or t
  misc_feature (201)..(209): n is a, c, g, or t
  misc_feature (211)..(217): n is a, c, g, or t
  misc_feature (219)..(224): n is a, c, g, or t
  misc_feature (226)..(230): n is a, c, g, or t
  misc_feature (232)..(244): n is a, c, g, or t
  misc_feature (246)..(246): n is a, c, g, or t
  misc_feature (249)..(253): n is a, c, g, or t
  misc_feature (255)..(265): n is a, c, g, or t
  misc_feature (267)..(269): n is a, c, g, or t
  misc_feature (271)..(271): n is a, c, g, or t
  misc_feature (273)..(281): n is a, c, g, or t
  misc_feature (283)..(285): n is a, c, g, or t
  misc_feature (288)..(290): n is a, c, g, or t
  misc_feature (293)..(298): n is a, c, g, or t
  misc_feature (300)..(300): n is a, c, g, or t
  misc_feature (302)..(303): n is a, c, g, or t
  misc_feature (305)..(306): n is a, c, g, or t
  misc_feature (308)..(308): n is a, c, g, or t
  misc_feature (310)..(310): n is a, c, g, or t
  misc_feature (312)..(312): n is a, c, g, or t
  misc_feature (315)..(320): n is a, c, g, or t
  misc_feature (322)..(322): n is a, c, g, or t
  misc_feature (325)..(327): n is a, c, g, or t
  misc_feature (329)..(333): n is a, c, g, or t
  misc_feature (335)..(336): n is a, c, g, or t
  misc_feature (338)..(345): n is a, c, g, or t
  misc_feature (347)..(348): n is a, c, g, or t
  misc_feature (351)..(370): n is a, c, g, or t
  misc_feature (372)..(384): n is a, c, g, or t
  misc_feature (386)..(386): n is a, c, g, or t
  misc_feature (388)..(388): n is a, c, g, or t
  misc_feature (390)..(391): n is a, c, g, or t
  misc_feature (393)..(404): n is a, c, g, or t
  misc_feature (406)..(408): n is a, c, g, or t
  misc_feature (412)..(415): n is a, c, g, or t
  misc_feature (418)..(421): n is a, c, g, or t
  misc_feature (423)..(427): n is a, c, g, or t
  misc_feature (429)..(434): n is a, c, g, or t
  misc_feature (436)..(439): n is a, c, g, or t
  misc_feature (441)..(449): n is a, c, g, or t
  misc_feature (451)..(451): n is a, c, g, or t
  misc_feature (453)..(454): n is a, c, g, or t
  misc_feature (457)..(458): n is a, c, g, or t
  misc_feature (460)..(475): n is a, c, g, or t
  misc_feature (477)..(478): n is a, c, g, or t
  misc_feature (481)..(484): n is a, c, g, or t
  misc_feature (486)..(489): n is a, c, g, or t
  misc_feature (491)..(491): n is a, c, g, or t
  misc_feature (493)..(493): n is a, c, g, or t
  misc_feature (497)..(502): n is a, c, g, or t
  misc_feature (506)..(508): n is a, c, g, or t
  misc_feature (510)..(519): n is a, c, g, or t
  misc_feature (522)..(534): n is a, c, g, or t
  misc_feature (536)..(536): n is a, c, g, or t
  misc_feature (538)..(539): n is a, c, g, or t
  misc_feature (542)..(542): n is a, c, g, or t
  misc_feature (544)..(546): n is a, c, g, or t
  misc_feature (549)..(551): n is a, c, g, or t
  misc_feature (553)..(559): n is a, c, g, or t
  misc_feature (561)..(562): n is a, c, g, or t
  misc_feature (564)..(569): n is a, c, g, or t
  misc_feature (572)..(579): n is a, c, g, or t
  misc_feature (581)..(592): n is a, c, g, or t
  misc_feature (595)..(595): n is a, c, g, or t
  misc_feature (597)..(600): n is a, c, g, or t
  misc_feature (602)..(602): n is a, c, g, or t
  misc_feature (604)..(604): n is a, c, g, or t
  misc_feature (608)..(611): n is a, c, g, or t
  misc_feature (613)..(613): n is a, c, g, or t
  misc_feature (615)..(619): n is a, c, g, or t
  misc_feature (621)..(622): n is a, c, g, or t
  misc_feature (625)..(628): n is a, c, g, or t
  misc_feature (630)..(633): n is a, c, g, or t
  misc_feature (635)..(640): n is a, c, g, or t
  misc_feature (643)..(646): n is a, c, g, or t
  misc_feature (648)..(654): n is a, c, g, or t
  misc_feature (657)..(657): n is a, c, g, or t
  misc_feature (660)..(662): n is a, c, g, or t
  misc_feature (664)..(665): n is a, c, g, or t
  misc_feature (667)..(672): n is a, c, g, or t
  misc_feature (674)..(675): n is a, c, g, or t
  misc_feature (677)..(689): n is a, c, g, or t
  misc_feature (691)..(691): n is a, c, g, or t
  misc_feature (693)..(696): n is a, c, g, or t
  misc_feature (699)..(706): n is a, c, g, or t
  misc_feature (708)..(708): n is a, c, g, or t
  misc_feature (710)..(713): n is a, c, g, or t
  misc_feature (715)..(717): n is a, c, g, or t
  misc_feature (720)..(723): n is a, c, g, or t
  misc_feature (725)..(726): n is a, c, g, or t
  misc_feature (730)..(730): n is a, c, g, or t
  misc_feature (732)..(735): n is a, c, g, or t
  misc_feature (738)..(738): n is a, c, g, or t
  misc_feature (740)..(740): n is a, c, g, or t
  misc_feature (742)..(742): n is a, c, g, or t
  misc_feature (752)..(752): n is a, c, g, or t
  misc_feature (758)..(758): n is a, c, g, or t
  misc_feature (764)..(764): n is a, c, g, or t
  misc_feature (803)..(803): n is a, c, g, or t
  misc_feature (1010)..(1010): n is a, c, g, or t
  misc_feature (1989)..(1989): n is a, c, g, or t
  misc_feature (1994)..(1994): n is a, c, g, or t
  misc_feature (2148)..(2148): n is a, c, g, or t
  misc_feature (2580)..(2580): n is a, c, g, or t
  misc_feature (2583)..(2583): n is a, c, g, or t
  misc_feature (2592)..(2592): n is a, c, g, or t
  misc_feature (2594)..(2595): n is a, c, g, or t
  misc_feature (2607)..(2607): n is a, c, g, or t
  misc_feature (2675)..(2675): n is a, c, g, or t
  misc_feature (2714)..(2714): n is a, c, g, or t
  misc_feature (2822)..(2822): n is a, c, g, or t
  misc_feature (3022)..(3022): n is a, c, g, or t
  misc_feature (3032)..(3032): n is a, c, g, or t
  misc_feature (3035)..(3035): n is a, c, g, or t
  misc_feature (3037)..(3037): n is a, c, g, or t
  misc_feature (3040)..(3040): n is a, c, g, or t
  misc_feature (3118)..(3118): n is a, c, g, or t
  misc_feature (3174)..(3174): n is a, c, g, or t
  misc_feature (3257)..(3257): n is a, c, g, or t
  misc_feature (3362)..(3362): n is a, c, g, or t
  misc_feature (3443)..(3443): n is a, c, g, or t
  misc_feature (3449)..(3449): n is a, c, g, or t
  misc_feature (3459)..(3459): n is a, c, g, or t
  misc_feature (3473)..(3473): n is a, c, g, or t
  misc_feature (3476)..(3476): n is a, c, g, or t
  misc_feature (3482)..(3482): n is a, c, g, or t
  misc_feature (3484)..(3484): n is a, c, g, or t
  misc_feature (3486)..(3486): n is a, c, g, or t
  misc_feature (3491)..(3495): n is a, c, g, or t
  misc_feature (3498)..(3499): n is a, c, g, or t
  misc_feature (3501)..(3503): n is a, c, g, or t
  misc_feature (3509)..(3510): n is a, c, g, or t
  misc_feature (3516)..(3520): n is a, c, g, or t
  misc_feature (3522)..(3524): n is a, c, g, or t
  misc_feature (3526)..(3526): n is a, c, g, or t
  misc_feature (3528)..(3528): n is a, c, g, or t
  misc_feature (3531)..(3531): n is a, c, g, or t
  misc_feature (3533)..(3534): n is a, c, g, or t
  misc_feature (3536)..(3537): n is a, c, g, or t
  misc_feature (3539)..(3540): n is a, c, g, or t
  misc_feature (3542)..(3545): n is a, c, g, or t
  misc_feature (3547)..(3549): n is a, c, g, or t
  misc_feature (3551)..(3552): n is a, c, g, or t
  misc_feature (3555)..(3555): n is a, c, g, or t
  misc_feature (3558)..(3559): n is a, c, g, or t
  misc_feature (3563)..(3565): n is a, c, g, or t
  misc_feature (3567)..(3568): n is a, c, g, or t
  misc_feature (3572)..(3572): n is a, c, g, or t
  misc_feature (3574)..(3574): n is a, c, g, or t
  misc_feature (3576)..(3577): n is a, c, g, or t
  misc_feature (3581)..(3582): n is a, c, g, or t
  misc_feature (3584)..(3584): n is a, c, g, or t
  misc_feature (3587)..(3589): n is a, c, g, or t
  misc_feature (3591)..(3591): n is a, c, g, or t
  misc_feature (3593)..(3594): n is a, c, g, or t
  misc_feature (3596)..(3596): n is a, c, g, or t
  misc_feature (3598)..(3598): n is a, c, g, or t
  misc_feature (3601)..(3601): n is a, c, g, or t
  misc_feature (3605)..(3605): n is a, c, g, or t
  misc_feature (3607)..(3607): n is a, c, g, or t
  misc_feature (3609)..(3609): n is a, c, g, or t
  misc_feature (3613)..(3613): n is a, c, g, or t
  misc_feature (3622)..(3624): n is a, c, g, or t
  misc_feature (3626)..(3626): n is a, c, g, or t
  misc_feature (3628)..(3629): n is a, c, g, or t
  misc_feature (3631)..(3632): n is a, c, g, or t
  misc_feature (3635)..(3635): n is a, c, g, or t
  misc_feature (3637)..(3640): n is a, c, g, or t
  misc_feature (3643)..(3643): n is a, c, g, or t
  misc_feature (3647)..(3648): n is a, c, g, or t
  misc_feature (3650)..(3650): n is a, c, g, or t
  misc_feature (3652)..(3652): n is a, c, g, or t
  misc_feature (3654)..(3654): n is a, c, g, or t
  misc_feature (3656)..(3657): n is a, c, g, or t
  misc_feature (3659)..(3660): n is a, c, g, or t
  misc_feature (3662)..(3663): n is a, c, g, or t
  misc_feature (3666)..(3666): n is a, c, g, or t
  misc_feature (3669)..(3669): n is a, c, g, or t
  misc_feature (3671)..(3672): n is a, c, g, or t
  misc_feature (3677)..(3677): n is a, c, g, or t
  misc_feature (3681)..(3686): n is a, c, g, or t
  misc_feature (3688)..(3690): n is a, c, g, or t
  misc_feature (3692)..(3692): n is a, c, g, or t
  misc_feature (3695)..(3696): n is a, c, g, or t
  misc_feature (3699)..(3699): n is a, c, g, or t
  misc_feature (3701)..(3701): n is a, c, g, or t
  misc_feature (3703)..(3704): n is a, c, g, or t
  misc_feature (3706)..(3706): n is a, c, g, or t
  misc_feature (3708)..(3709): n is a, c, g, or t
  misc_feature (3714)..(3714): n is a, c, g, or t
  misc_feature (3717)..(3719): n is a, c, g, or t
  misc_feature (3721)..(3722): n is a, c, g, or t
  misc_feature (3724)..(3727): n is a, c, g, or t
  misc_feature (3731)..(3731): n is a, c, g, or t
  misc_feature (3733)..(3735): n is a, c, g, or t
  misc_feature (3739)..(3741): n is a, c, g, or t
  misc_feature (3743)..(3748): n is a, c, g, or t
  misc_feature (3752)..(3753): n is a, c, g, or t
  misc_feature (3755)..(3756): n is a, c, g, or t
  misc_feature (3758)..(3760): n is a, c, g, or t
  misc_feature (3762)..(3763): n is a, c, g, or t
  misc_feature (3765)..(3766): n is a, c, g, or t
  misc_feature (3770)..(3771): n is a, c, g, or t
  misc_feature (3773)..(3773): n is a, c, g, or t
  misc_feature (3775)..(3777): n is a, c, g, or t
  misc_feature (3779)..(3780): n is a, c, g, or t
  misc_feature (3782)..(3787): n is a, c, g, or t
  misc_feature (3789)..(3790): n is a, c, g, or t
  misc_feature (3796)..(3796): n is a, c, g, or t
  misc_feature (3800)..(3800): n is a, c, g, or t
  misc_feature (3804)..(3806): n is a, c, g, or t
  misc_feature (3808)..(3809): n is a, c, g, or t
  misc_feature (3811)..(3813): n is a, c, g, or t
  misc_feature (3858)..(3858): n is a, c, g, or t
  misc_feature (3884)..(3884): n is a, c, g, or t
  misc_feature (3887)..(3887): n is a, c, g, or t
  misc_feature (3899)..(3899): n is a, c, g, or t
  misc_feature (3902)..(3902): n is a, c, g, or t
  misc_feature (3926)..(3926): n is a, c, g, or t
  misc_feature (3935)..(3935): n is a, c, g, or t
  misc_feature (3992)..(3992): n is a, c, g, or t
nannnanngggnnnngngtncnnngnccncngnnccnnnnccggcactggcatatcctccanaaccagatcttgtccaaacgccgcaattgaatgggctgggnggnnnnnnnnnttnnnncnngtnnnnnnnncannnnnnnnnnnntnnnnnnnnntnnnnnntnnnnannnntcnnntntnnnnnnttnnnanntnnannnnnnnnntnnnnnnntnnnnnntnnnnntnnnnnnnnnnnnngncannnnncnnnnnnnnnnngnnntngnnnnnnnnnannnaannntgnnnnnngntnntnnancntnaannnnnnanacnnnannnnncnngnnnnnnnnanncannnnnnnnnnnnnnnnnnnnannnnnnnnnnnnngntngnngnnnnnnnnnnnntnnnaatnnnnaannnnannnnnannnnnnannnnannnnnnnnngntnnttnntnnnnnnnnnnnnnnnncnnatnnnngnnnnangngttnnnnnntttnnnannnnnnnnnnatnnnnnnnnnnnnngnannatngnnnatnnnannnnnnntnngnnnnnnggnnnnnnnntnnnnnnnnnnnntgnannnngnangcannnngnannnnngnntannnnannnnannnnnnagnnnnannnnnnntanttnnnanntnnnnnntnntnnnnnnnnnnnnnantnnnnagnnnnnnnntnannnnannnaannnnanngganannnnctnancnccaaagatgntttttnaccttntcataaaaaacaggaacctcattcaaggggtcattcatncccagtgtctcaatggggatattgcccttgtaattggaggattgaatgatggagcagagccgtttgaggtccatgggcgtttgtaccccattgatcagtaacttttcttttacctgccagttcacagccaggggcaatgattttcggatttcttcgtaagggtctgtggcaatgaaattacctgtgtccactaccaatcccagccanggactgttgatagaccctatcagttcatggcattcatctgcagttctcagaaagtcgttgtggttttgtatgcccagtatgacaccatgggattttgccttttcgaggcatttgttcaatgcaaacaaaattcgttcattcacccttttcctttcatcaccggtactgtattgcttggctgtaaaaatgcgcaatacaggagctcccatcttggctgccacttctatccaacgcaaaacagtgtcaatttctttggccaatgcattgctgtcgctgtacgaaaattcatttcgtactcccgtgccactgatctcaatccccactgcatgcgcctttcttttgaacgcataaatttcagtatctgatggtgtttcaggataagaagaaaaataatatcctgtcatgtctacggcatcaaagccagtgttggcgcagaattcgagcaattcatccttgctgatttttttcttcatcagcatatcattgaaggagtatgcgttcaggcttaggcggaaacgattggctttcttcgatgggatgtcatcagaaaaaggaacagcccttgccagcgagatggctggaagggctgtgagaaaatttcttctgttgaagttgggcatgttagattgttgacatgtcaataacgaacctgtatttgatatcacccttgatcatccgctcatacgcctcgtttatttgagagaccgcaatggtctcgatttctgcaaaaatgctgtgttcatgacagaaatcaagcatctcctgggtttcttgtatgcttccaatcatagaaccaacgatgcttcgcctgttcttgatcagggcaaaaggagaaacttttggctggtgctcgggcaaacctaccaccaataattttccgtagagtccgagcaaattgaggtactgtgtataatcatggtcggctgaaatagcatccagcacaatatcaaaagatgatgcatggtcattcagcactgcnggatncttggccaagataaaatgatgtgcgcccagtttagaggcttcctgaaccttagacgctgatgtactgataacggtaacttcagccccaaaagcaacagcaaatttcaccgccatatggcccagtccgcccagtccaactaccgccactttcatncctgccttgacacctgcaaaccgaaggggagaataagtggtgatgccagcacagagcagcggtgcaatgcctgccaggttttcctcgcccttgatccgcaagacatagttttcatcagtgacaatttcagcagaatatccacccatggtgagcatgcctgaaccatccctttccggtgcgttataggttccggtcatcccttcttcacaatattgctcatggttgctcttgcaatttttacaggtacggcagctgtcaaccattacacctactcccactgtttgaccaacggtgaactgtgttacagcactgccgactgcttttaccttccccacaatttcatgacccggaacaacaggataaacggtgccagcccactcactccttactgtatggatgtcactgtgacagatgccacaataaagaatttcnacntgaacatcntnngggcgaaggtcncttctttggatgttcagcggttcaataggagattggctgctggatgctccgtaagctttaacaattgncataaatatttatttttctgaattgattactgttttgcngccaggtattttgcaggctctttttggaactcagccttgcattctgctgaacaaaaaccataggccttgtcttcataatggcaggtatcgctgattccggcagagacnggcattccacaggcaaaatcagttgtattgaccaccatttctggtgtaaactggctgtggttttccatggatgattccatttctgcaggcttgttttcaacagcagctttttcggtcttgttagaacaggcaagtgagaagatgataaaggaaagggtaacgatagaatttctcattgttttcttttgaagttacttaanatctactaantcntngtngcgcacaaaattgcgataggtttgtcaatttccattgaaaacgggttaattttatcaataatttctagaaatgcagcnaaataatacatcaatggccatcaggcttatcaaactcaaggcaatttggttgccanttctatttttttgcactgcgttgactgctcaacaaaaaactaaaaataatttacccattggtgttttcgactctggaacaggngggctgacggtattggaagccatgcttaccctggatgccttcaacaacattaccggtaaaccgggtgctgatggcatgctcgattttgacaaagaatatttccantacctcgcagaccaggccaacatgccttatggaaactatgctgctgaaaacaaaacaaaactcttgcaggaacatgtggtnaaaaanatggattttntgctcaagaacagntangatatnantnggatnnnnnaannannncccaannaaaaannnnngnnnangntgntnntnntnncnnnnannncnnctnctnntttnnngnnggangngnngaannanttnnnanannanantgncacnangnctcntgttgttgnnntnannanngcngnnnnganggcnncntngncnnannannccnccnannaaaangggnnnnnngnnntnttnnccncngnngntnntgttnctnnngnngnnnncccnannnccannngnnnnnnggcnncnncnnngnngnnggcnncncnnntnntnnnnnncnngggtgntttngggnnngnngnnnccatcgatcgcgattacagtttttatgttgataccgcaagtgccnacagaaaagattataagggaccatcngtnaacaatacgaantanaagattgatacggcactgctcaangtctacaanttcaacaaggaaaacaacaagctgctctgcgagtacgatgacaagggcaagtgtctngacatcca

SEQ ID NO: 1605 - DNA, 4000 bp, Escherichia coli
  misc_feature (1986)..(1986): n is a, c, g, or t
  misc_feature (2235)..(2235): n is a, c, g, or t
gacgagttggcggcgttgcgacgcgcgcggacgctcgcgcgcgatgtgttgcgcgtgttggcggtgatgcgcgcgttcgcggagacacagcgcgcgatcgtgagcgacatggcgtcgttgaatgacgtcgtggcgcgtcattaaacagcgttcagcgcgcggtcgcgatgtcgcgcgccgacgccgcgccaccgcacgcgctggaagacttgtccacgttcacggtgcgcgaaatcatcaacgatggacgcgatgcggcggggaaattggtgattctcggtcagtttgcaaattgctcgagcgacgcattggtgaagctgcagcgcgcgccgttgccgcacgacgagcgaggcgtgcgcgagatgctggaacgcatccgtttgcgttcgcgcgcgccgtatagcggggcagagtacgggtattacgtcggggagctcgcgccgtcgacgtcggcgtcgagcggcggcgaagacgtcgagtgcgacgtgctgtatccgggatgtttgctcgacgccgacgagacgagccgggcgaagttgctgaagaaacacatcacgcgaagctcgacgcaaaagttggtgtgcgtgcgagaaacacccgagttgtacgcgaaggcgcacgaaaagtatatcgcttcgatcccgcgcgaagcgacggcgtgggtgcgaaagattttgagtctggaaaaggaacgcgagcggttgttgcattgcgacgacgactttttgctcaacgttgactcgaaatggacgacacatcccgattgcgacggcgccgatcgcgcgacttggcgcgcgcactcgagcgtgactgatttatattgcctcggtttgtgcgttcgcgaagactttaagagtttgcgagacgcgcgcgccgagcatttgccgctgcttcgagcgatgctgcgcaagggtcgcgccgtcatcgaagacatttacggcgtcaatgcggaagaaatgcgcgtattcgtgcactaccctccgcagttttatcactttcacgtgcattatcaagcgctcagcgccaaggagcagggatgcgcgtgcgagcgggcgcactcgctcgaggacatcatcgacaacctcgagcgagacggtgaccactacgcgcgcgctaacttatcgctcaagatgggtgagcgagacgcgctgtacgcgttttacaacgacgcagccacgcgcgcgtgaaatacaacccaacccaaaccgactcgacgcggcggttgcgccgccgcgtcgccgcctcactcgccgcctcgcgcgcgtcgtctcgtcttcgcgatgacggcggcgctggaaagcgcgatgcgcggcgtcggcatcgacgcgtccagcgcgtccaaatccttcgcgcgacgcttcgatgcgtcgtcgcgcgtcgtcgccgtcccgcgcgcgcgtcgtcggcgcgtcgaggcttcgtcgtcgtcgttcgtcgcgcgcgcgacgtccgcgcgctcgagcggcatcgcgcgcggtcgccacgcgcggtcgcgtccgcgcgacgccatcgtcgcgcgcgccgaacgcgaaacccgcctggtgtcggtgctcacgtcgctgccgcggcggttcaacctgtactttcagcgcagaaattatcgcgtgacgctttggcgcgccatcagcgcgtactttgggttctatctcgcaaacgtcatgacgctgagcttcggggccatagggatcaacgacgtcgtcgcgggagcgctgagcgtggcgttttttgaggtggtgacgcggatttattacgcgagcgccgagacgaacaaatggctcgaatttctcaactggttcaaggtcgggtactgttactccctgatcgccgacgcgttcaaactcgggtcgtgagcgcgcgcgcgcgcgcgtcggatttcgaaatcgcgagcgaaaactcgtcttgtaatacaacaatgtggatacagtagtttcatttcattcgtccacggttggcgaaccgtcgagttgccgcaaagcctcgtacacnccgatgccgcacgacacggacaaattcaaactcctcacgtgactttcgtcgatgggaattctacgcacaccccccgtggctttgcacgcctccatcgccgcgtctggcagccccgtggtctcggcgccgaacaacaaccaatcccccggtcgatacgcgccgtcctccgcgtgcggccgcgcgccgaattttgaaaacgccaccaaccgcccacgctcgtccccgagctcgcgccaatacgcgtaaaangcatcccaatcatcgtgcaccttgacgcacaccgatttccaatagtccaacccggcgcgcttcaactgcgcgtcgtcgagcgaaaatccgagcggcgccaccaagtgcagcggcaccctcgacgccgcgcacgtccgcgcgatgcacccggtgttcccgggaatctttggcgtcaccaaaaccacgtgcaggtccttcctctgcgcgtcgctcgccgtctcgatcgcgcgcacggtgacgttcggtcccatggcgtcgccgccgccaccgacgcgcaccgccgtcccgcgcgcgagcggcgcgcgcgcgcgcgcgtcgacgcgacgggcgagcgcgagcgtgcgcgcgatcgttcgcgcggcgtcgttcgtgcgtatcgacgcgcgcgcgcgcatcgatgcgcgacgccgagtgatgcgatcggtgtgcgcgcacacgcacacgcgcgcgcgtcgcgcgcgacccggcgatgacgcgcggcgtcgcgagcgacgcgatgaccgcgcgcgatcgcgtcgtcgccgcgctgtgcgcgtgcgtcgcgctcgcgctcgtgcacgtcgcgatgatgtttaagacgagcgcgaaacagcgacggcgcgttcgcggcgtcgtgcgcggcgcggggcgcgggagagtgattggattttatcacccgagcggtggggacggtggcggcggcgaacgcgtgctgttcgccgcgatcgcggcggcgcagcgaggtgatttcgatggcgatcggcgcggcgcgcgaggcgacgacgccgacgccgacgcggcggagaaggaaggcgaggcggcgattatgtcgcgcgcggacgagcgccgggacgcgcggtcggacgtgagatcgaacagtgcgcgcgagacgcgcgaatggagagcgacggagggaagggatgtcacgtgttgcgtgtacgcgggcgcgacgtcggcgcgaggcgacgaacccgtcgaggacggcgacgaactcatcgcgcgcgcgcgcgaacggttcgggatcgagttgcgagcgcccataaacgttattagactcacgcgtgagcgatgggcgcgcgcggagacgtacaaacggtgcacgatattggggcagtttatcggcggcgcgtggctcgggctcgaggcgctgtggacgttcgcgccggatgtgttcgtggataccgtcggacacgcggcgacgtatccgatcgcgcgatatctgtttgggtgccaaacagtggcgtacgtgcactatccgacggtgtcgagggacatgatcgcgcgcgtggagagcggaagactgatgtacaacaacagccgcctgttcgcgtcgtccaagtttttgagcggcctcaaggtactttattaccgcgcctttgccgtcgtgtacgggtggtgcggacgatcgtgtaagtgcgtgatggtgaactcttcgtggactaaatcgcacatcgacgcattgtggcgggttgattcacgggtggtgtatcccccgtgcaacgtcgaagacttgtccaaactcccgttgacgcgcccgaggttgaacgcgcgcgggacgccggtgaaaaaggacaagtcgtcgatacgcgttgttagcgtggggcagtttcgaccggaaaaagcgcacgtggttcaaatcgccgcctggaaggctttgaaaaagttcaagacgaaatcgagcaagattgaaaacgccattttggtcttcgtcggtggatgccgtgacgaagccgaccgcgagcgcttggcagatttgcaacaaagtgtcaaagatctggagctcgag

SEQ ID NO: 1606 - DNA, 4000 bp, Escherichia coli
  misc_feature (1443)..(1443): n is a, c, g, or t
  misc_feature (1479)..(1479): n is a, c, g, or t
  misc_feature (1738)..(1738): n is a, c, g, or t
  misc_feature (1796)..(1796): n is a, c, g, or t
  misc_feature (2002)..(2002): n is a, c, g, or t
  misc_feature (2015)..(2015): n is a, c, g, or t
  misc_feature (2287)..(2287): n is a, c, g, or t
  misc_feature (2377)..(2377): n is a, c, g, or t
  misc_feature (2464)..(2464): n is a, c, g, or t
  misc_feature (2473)..(2473): n is a, c, g, or t
ggctggatttgagtccgttgaattcggcctccctgtgaaattgctcaaaggggctatgacggttcgaattcatgctgattacgctcgaactgaagatgatgtgacatgggtcgaatgccggcttgtttctgatttgtccaattcgaagggtgaagtgtttggtgaacgtgagcatcacaaggccatggttcgattggtcgagaaatgtgatgacatctgtccattcctggaacgagaagtccatgctttgccaaacattggtattcctgctcctggtgaagtgattgaaggcccctcgttcatctatcgccggtacttccacggaccacgcttccagtcacatggtggtgtgttgcgtggcattggcgatgatgccatgcctggtgcagacgggattgccttgatgcgccaccaattgcctgcgtccgatcagttcgctcacgaagcgaatggcgaatcggtgctgttggaagcccttccgatgttgattgaagctggtttccaaaacgctggtctcgtggcgatggaggcagaaggcttctcttctctcccaatcggtattgagtggtcctcaatgctgagggtcccagatcgagatgaacaacttcgaatgcgcagccttctaatggccgttgaagaagctggtgtcaccgttcacgatgttgtaatcgttggtgacgatgacgcccctgtgcttgccctcaaaggcttgcgactcaaaggaatggcgcccgtctcgaattcggatgcattccaattggaccgttgacgaggtttgatgatgtccgtggaagaactacaccccccgggtgtgaatcaaccacgaatgctcctgcttcgcatgcctgtacgttccttttcgattgatgaggtggcattggcgaatgccgatgaggtggccacttttgcgattgaaaaacgacgtgatgagcatctttctggccgttggttgttggggcaagccgttgaggcttggggattggacatcgccggtttgtcggtccatcgaactgatcatcgagcaccataccttcgacacatacctggtttgtggagaaacacgcccttgccgtcaatcagcatcggacacgcctctggatgggcctttgtggccattattgagcatggatggcggattggaatcgatgcggaatctgcgaaccgtgggttgcaagaaaatgcattcaacctgatgtgtaagggcgaagaattgcttgcattgcaggacgcaccatcgcatgcaatcgaactctgggttgccaaagaagcggtgcaaaaagcgttgggattaggcatgcatcttaatccacgcgatattggaattccaattggagttccacatgcaactattacaattgaaaatttaaatttgcaattggtaaattgggttaacgactcgatgcaaatgagtcttgcttggggccaattttccctctccattcnaacccccgaggatgcgcttctcgacgccacccgcgnagcgatgcaagaaggtgaatggggcgttggttgcaagaccactcggggcaattgttgatcagcgccagaaggcgtaactgtctcggcttgattcccagggcaggccgagttggatgccaatttccgttagaatgacgtaattgaacagcatgtaggaaatgtaggtcactgcaaggaccagaagagatatgttgatgattttccgacgttctctctttgcttggtcaagcgtgcagatgccttggtttcggaagtagancaccaaaccaattcccacgctggcaagggctatgaggcccataagtggtctgaaccangaatatccatcatcgccccagtacaatgtgtctgagatgacggcgccagttgatacggtggcgagtccaaacatcaccaagacgaccgatgggaggcaacacatcgatgcaattaacgtggaacttgcgatgaccttccaaagcgaccgcagagggttgtctttggtcgtagcatacgcatcgctcatgttgggaattctgtgctnctgcttttgaagngatgttttgcttctcaagcgaggttacggatttccggggtctggtcggccacaatgaattcaagcattgcagcccacattacaaactcgatcgacttctccaattccgcttgtcctccgacggaactgatcatgttgtcgagggtgtcattcggtgagtggtaggcgtcatagtcatcgtcgtatgcgccgaggtggaagattgtctgagcacctctgtctcgaaacgtcacgtggtctgaccggccaaatgtgtcttcatggacatccatnaccaagttgtcatgttcatcccagtgttggtcacaacctgctccataagtgccgtcgatcctcaaatccatcggcgctttgaggatgttnctgtgcacatggtccatcacttcggtgatcggcagttcgtcaacggagggatcgttgtccggtccagaccatgcgtggtaggggaanggctcaccngtgtccttcaatgcgggccacgagatgcccatcatatccatgttaatgtagaaacgaagctccttgtcttgagggaggcagtaatcacagtcattgtttgcgaatgcattggagcctcggagcccttcctcttcagatgaccagagggcgaggaatgtgtcgcattcaacttcaaggtcaacaaacgcctttgcgtacaacatcattgccacagtccctgccgtgttgtcataggcgccttcgtaggtgcctcctgcgggtggtgatgctggaggtgcgatgtccatgtgcgcacccatgccctggacgcaggtgtcagagcgtccctctttccaagcaataatgttcaacgattcaggttgagttgggttgaggtggtcggtcacccgcatgatgtgagtttcatacccaaggccttcgaaatggccgtggaagaagctagcagctcgttcaaacgcagggtttggtgaccccatccatcggttgatgtagccgccgcactccgttgagtctgcacatacattcagaatgaactccatcttgtcgaaccactcttcgccatttacaatgggcgttccgttttccacaatgaggtcaatggttgctccgctgccatcctcgtacacgatgttcaggacggttgattcgacatagggcgttgtgaggatcttcccgatcagaataccatcttcctgtacttggacaacgccaagggggacgatgctgttgttcacaaacagcaagacatcttgttgaaccacaagacgtgtgccctctccttcgagcgtgaacgtatgccattcaccagctcgcaacggaagatcacctgctgggaggaaatcgattttgaggacatcggcttttgtttcacgatcgctgtcagcttcgccaaaacaaccggcaagcggtgcgagcatcatcaacgcaatcaggccaaaggctcgaacagagtttctcatgagggtccccgactttagggcgacctcttcccctcttaggggttcgctttctttggaatcgctggacataaagttcagtgactttgatttcgtgaacttgatatagggtgacacacaggccactatgtaactgatagttcagtagtggaaaggtgagtcgatgacgagcggtgaagattgggaagaaaaactggttgagcaacttgtggaaatgttccgaaacatgggcatggacatggacaaagaacaaatccgcggcatgatggaacagttccgctctcagttcgaaaacatgggcctcgatgctgaaaaaatcgcaaaaggcgatgtgaatttcaatttcgatctttctcacttggccaagatgttccagtctggaaaaccaatggaagacattctctccaacctaggcatggacgtccaagtcgatgccagccctgttgaaatcaaagcgccaaagatggatgaaccagacgacatcatcaatattccagcaaacgatgtttacctcgaaggctggaacatggcagtgacggtcgacttcacgctgcgcggcgaagtcgaacaa

SEQ ID NO: 1607 - DNA, 4000 bp, Escherichia coli
  misc_feature (32)..(32): n is a, c, g, or t
  misc_feature (504)..(504): n is a, c, g, or t
  misc_feature (838)..(838): n is a, c, g, or t
  misc_feature (1298)..(1298): n is a, c, g, or t
  misc_feature (1691)..(1691): n is a, c, g, or t
  misc_feature (2169)..(2169): n is a, c, g, or t
  misc_feature (2685)..(2685): n is a, c, g, or t
  misc_feature (2927)..(2927): n is a, c, g, or t
  misc_feature (3754)..(3754): n is a, c, g, or t
  misc_feature (3814)..(3814): n is a, c, g, or t
  misc_feature (3953)..(3953): n is a, c, g, or t
gttgaacctttttactggtcatttaaatctgntgggccagaactcaagatgttgggtgccatgcaaaacagagtttgtttgtttctgatatcaatggtttttataactatgagtgtgcccgcgatgtcatacgaggaacccaagtacaaaatcatcacaaagactgacatctatgaggtgcggcggtatgaacagcggactgttgctcaggcaaaatatgataaggcggacagtggcttcagaattttattcgactatatatccggtgaaaatgaaagcgcaaccgatgtcgcgatgacgatacccgtcgctcaatctacagaaatcaatatgacggccccagtcactcagactaatactcgcgggaaaatggtgatgcagtttttcctaccaaaaaaatacaccaaagaaacagcacccagaccaaaagatggcaggatcgatattattgaccttccaaccacttattatgcagttatctcctattcaggatttgcatctganaaaaactttcaaacacaccatagaaaactaaaaaacgcgcttgatgaaagtagaattactgttagtggccctccaatcagagcgacctacaactcaccatttactctaccattctttcgccgcaacgaggctatgtacccactagattgggattaaatattcgattaataaatcgagattacagttcaaagatcataattcggaagcctccctgtctacaatcgtatcactgttagactgtggactccccctgatagagaaatcacttttttctcacataattcgctaattaaatttttggcaagcacctgaaataaagcgcatgtttgaatgngtctcgattttggtgaagggtggatggaaagagacgtgggccgttcagagacctattttggccgaaaccccagcgtctgatagccggatggtctcgctaaacccctttgaaacaaatagaaaaaaggccccgctagggacctgtttttgggtttgcgatgtgcaagtggcggagggacggggattcgaaccccggaggggcgttaaccccaacacgctttccaggcgtgcgccttaaaccactcggccatccctcccagtacgcaactgttattcgaccttgattagctcttcggggcgaaagttaacaggcttggctcatcatgtaaactagccgaaacagcttcgaattagcgttttcaagcaccaaccccaaaatattaaacctcaacatcacatccgattgtgggggaaacgccaaactcaaaccgagcccaacaattgccatggttagaatgtanaaattcactggtcagaaaatactggtcactagataaatctcttgtgtcgagttgcagttatgaacatgatgatcttattatgaaatatttttttcgacttatcgccacccttgcgggactggtcgctgcctatgctatttggcaggacctgaccagcagctatagcgccagcacgccacttggccggttatggtatctatatagcccaacaacattacagaccaccgaatccattatcagccgctatattgacccgtgcgggttgattacggcattagattgttcgccctttttatggcatccgtttatcgccaccattttaggctggccagccgccttggtcatgatcggattcagcattatattctggtgggttggtggcttgtttggccngcatttaacgcgccccaaaaaggccgcgcgcgcgctcaaacgacagggtgaaaaatagccggtgatatgcagttcctaatcgaatcgcgataaaacctcaaatagtcgcaagtttcaccgccataggccgcaccaaagacaggtcagagcctagcgttaattatcacccattttcaaggcttcgaaaaaggcgttctgcggaatttcgaccttgccgaattggcgcattttctttttgccctctttttgcttatcgagaagctttttcttgcggctgatatcgccaccataacattttgccgttacgtctttgcgcagcgccgcaatcgtttcacgcgcaatgactttgccgccaatcgcggcttgcagtgccactttgaacatttgacgtggcacaaggtcttttagccttatgcaaattgcacgacctttgccttcggcctgatcacgatgcacaatcatcgacaaggcatcgacnagatcgccgttcacaaggattgacactttcacgagatcaccctcgcgatagctatcaagcgcatagtcaaagctggcatagccgcgggtgattgatttcaaccggtcataaaaatcgaaaacaacttcattcaacggcaggcggtaaacagccattgcccgattgccagcataggtaaggtcaatctgttcgccgcgccgctcggtacaaagcgttaaaaccggccctaaaaattcatcaggcgtcataatggtggctttgatccaaggctcttcgatcgaggcaagacggctaacttcgggcatatcggccggattatgcaaatataaatgtttcccatcggtaagggtcatttgataaacaaccgatggcgctgttgaaatcagctcaagattaaattcgcggctcaatcgctcgcggatcacttccatatgaagaagacctaaaaatccgcagcgaaagccaaagccaagcgccgctgaggtttcagcctcgaatgaaaaagacgcatcattnagtgatagtttttcaagcgcctcacgaaggccgctgaaatcatttgtgtccaccggaaacaagccgcagaacaccactggaattgatggcgcaaatccgggcaaggctgtgtcggttgggcggcgctcttcggtgatcgtatcacccacctttgcatcggcaacgcgtttcacgccagcattgataaagccaatttcacccggaccaagctgatcaagcgcaatcggttttggcgcaaaaanaccaacgcgttcgataacatgggttgcgcctgtcgccatcatacggattttcatgccctttttcagcacgccatgacgcacccgcaccaaggtcataacgccaagataggcgtcataccagctatccaccaaaagcgcctgcaagggggcatccttgtcgccaacaggtggcggtaattttgtgaccagcgcttcgagaatatcttcaatacctgcgcccgtttttgccgatgctgcaatggcatcatcagcaggcaaaccaatcacttcttcaatttgggctttgacgcgttcaggctcagccgcgggaaggtcaatcttattgagaaccggcacaatttcatgatcggcattgatcgcctgatagacattggccagcgtttgcgcctcgacgccctgactagcatcaacaataagcaatgagccttcacaagccgccaatgatcgcgatacctcatagccaaaatccacatggcctggcgtatccatcagattcaaaacataggattgtccgtcttttgctttgtaatccagccggacagtttgcgccttaattgtaatcccgcgttcgcgctcgatatccatactatccagcacttgttctttcatttcgcggtcactaagcccaccacagacctgaatcaaccgatcggcaatcgttgatttgccatgatcaatatgggcaatgatggaaaaattgcggattttgttgatgtcgatcatgatttactttgcaatctgaaacgggctgaaatggcatggttcagcccatgctatacaacaatttctgatgaaataccgcatttaatcatggttcgggttaaagnttcgcgatctttttcctgtttcaacctgccgcttgtgcgtatattatccagttcgttctntcgcgataagacagatatttcaaattctttagataaagagaagctgatgccaagcctgcgtcatgaaaaataccgcccatttatcggccctgatttaggtgaccgtacatggccgagccaacaaattaaaacagcaccnatctggtgttcggttgatttgcgtgatggcaatcaggccttgatcga

SEQ ID NO: 1608 - DNA, 4000 bp, Escherichia coli
  misc_feature (4)..(4): n is a, c, g, or t
  misc_feature (6)..(6): n is a, c, g, or t
  misc_feature (11)..(11): n is a, c, g, or t
  misc_feature (15)..(15): n is a, c, g, or t
  misc_feature (18)..(18): n is a, c, g, or t
  misc_feature (22)..(22): n is a, c, g, or t
  misc_feature (27)..(27): n is a, c, g, or t
  misc_feature (29)..(29): n is a, c, g, or t
  misc_feature (31)..(33): n is a, c, g, or t
  misc_feature (35)..(35): n is a, c, g, or t
  misc_feature (37)..(37): n is a, c, g, or t
  misc_feature (56)..(62): n is a, c, g, or t
  misc_feature (64)..(67): n is a, c, g, or t
  misc_feature (71)..(72): n is a, c, g, or t
  misc_feature (75)..(76): n is a, c, g, or t
  misc_feature (80)..(80): n is a, c, g, or t
  misc_feature (83)..(83): n is a, c, g, or t
  misc_feature (85)..(85): n is a, c, g, or t
  misc_feature (96)..(98): n is a, c, g, or t
  misc_feature (101)..(106): n is a, c, g, or t
  misc_feature (108)..(108): n is a, c, g, or t
  misc_feature (110)..(110): n is a, c, g, or t
  misc_feature (434)..(434): n is a, c, g, or t
  misc_feature (465)..(465): n is a, c, g, or t
  misc_feature (571)..(571): n is a, c, g, or t
  misc_feature (1626)..(1626): n is a, c, g, or t
  misc_feature (2980)..(2980): n is a, c, g, or t
ctcncnccctnctanccnctcnctccncncnnntngnagcccccaaatggcccagnnnnnnncnnnngtanntcnntttnttntnttgtttttccnnngcnnnnnncncncgcgcagaccggctcgaaccttcgtcggtctcttcctcacacaaaaaccaaatcaggagacgggcacacgatgttcagagtgcgtcacattgctttttcgttggccattgtcggagtcgcggcctcattgccgaccgatcttgctcacgcgaggggccaggccctaaagcgccacatccattccgcatcattggggagaaagcctgcgcggtggtgcggatggtggatgaggacccagaagggcggcgggcccgagatgaacctcgcgcgcaattgggcccgttggggcagcccgtcaggcccgcgcgtcggcgcagtggtggnttggcctcaccatgtcggcctcattaccggncaaactgcgagcggcgagtggatcgtgcgctcgggcaatgacggtgggcgggtacgcgagcggccccgctcggtggccggcgccgtgttccgcatctaatagcccncagagaagccccggttgccgagcgcgaccggggtttttagcgtcaaacgatgaggcttagttcacgcgcgacttgagcgcgtcgatgccctgcttgacgagcttgtcggcagtctcgggcgtgaggcccttggcaatgagtgtctgcgcggcaatgaccgcggcatcggcagcggcattgcggacctcgcgcaaggcctcggcctcggctcgcgcgatcttgtcctcggcaagtttcatgcgccgctcgaaatgctctttcatcgaacggcgagtctcctcggcaagaatttccgcctctttgccggcgaggctgatgatctcttgcgcctctttggcgacatcgccctcttttcgcttgtagtcggcgagtaccttttcggccgcctcgcgcaggtgcctcgcttcttcaagctccttcttgatctgggcggcgcgattgtcgagcgcagcggcgatcttcttgtgcacgccgagatagagcacgaggccgacaaaaatgaagaacgagacggcgacccagaattcgggctcgaagatgaattccatcgcttactctttccgcgcggctgccaccgccttgtcgatttccgcttttggcggcgccgcgccaatcagccggcgcactatatcggcggcgacgtccgccgctacggcgttcacgtccttcatggccgacgtcttggctgcctcgatgcgcgcctctgcctctgcgctcttctcggcgagatccgcctcgagcttcgcccgctgttgcgctgtctcctcgttgagcgcggcgcggccttcctcgacgatggcgtgcgccttctgcttcgcctcggcgagagcctgctcataggcggcgatggcttcctcggtcttgcggcgaagccgatcggcttccgcgagatcattggcaatatgtgctgcgcgtttctcgatcacgcctccgatacgcggcaaggcgacatacaccatcagcagatagagagcgccgaaggtgatgagaagccagacgagctgaggcccccaatcgagcgggttgagctgtggcatgatcgtcctcgcgcgcgncggcgaacggcggcagagctagaacacgaacaggatgatcagtgccaccacgaggccgaacaggccggtggcttccgcaagggcaaagccgagcagaagattggcgaactgcgtcggcgccgccgacgggttgcgcagcgcaccttggagataattgccgaagatcgtgccgatgcccacgccggcgccgacaagcgcgatcgaggcaagccccgcgccgatcaattttgctgctgatggatccatttctctctccctttgaaacaatattgccgattcagtgaaggctagtgatgcatgtgaagcgcgtcgttcagatagatgcaggtcaaaatcgcgaacacgtaggcctggaggagcgcgaccaggatctcaagcccggtgaacgccaccatgaaggcaagcggggcccagccgcccaagatgccgagcgcgacgacgaaggcgccgaacactttcagcatggtgtggccggccatcatgttggcgaacaaccgcaccgacagcgacagcgggcgcgtcaggtaggagatcacctcgatgaccacgagaagcggcagcatgatcaagggcacgccctcgggcacaaagaatttgaggaacttcgctccatgcttgatgaagccgatcagcgtcacgccgaggaagatgaaggcggcgagcgcgaaggtgacgatgatgtggctcgtcacggtgaacgagtaggggaccatgccgagcatgttcagcacgagcacaaacatgaacagcgtgaacacgaacgggaaatatttcatgccgtcggtgccgacattgtcgcgcaccatgttggccacaaattcgtaggagagctcggcgaccgactgcacgcgcgagggcactagcgcgcgattgcgcatggcgtaaatggtgaacagcgtgatgatcgtgccggcgatcaccatgaacagcgcggaattggtgaaggaagcatcgaagccgaacagctcgagcggaatgatccgtttgatctcgaactggtgcatggggttgggcaggccgcctgcaccggccccgccatgctctgccccttctgcggcgtatgcctcgatcacctcgaaacgcctctaatcgtcatcgtcatccaaaacagcgggcggtgcgttgccgggactcacctcggtctgcatcgccttggcggtccgcactacgttcagtatccccgcggcggagcccaagatcaaaaacaccaccatcaggaacggcgccgagccgaacagccggtcgagcgcccaaccgatgaaaccccccacgaccacgcctgcgaccagctcggtcgcgagtcttagagccttgccgagcgcggccccccgtgcctctggctccgactgtggcnccgcggcgcgctttcccttggcctccgccagttgctgcccaagcttgtcgagccgctgacgaatgctttcggggtcacggccgctaggttcgcgaccggacttgttgtcggctccggccattggcactgctcaatttccgggagagcctttggaccggctggtccttaagcttggccggcactttagtttgcgatttgcccctgtcaagaaagtccggggcttaaacagactgcaagaaagggggctcgtcattcccgcgaaagcgggaatccagtaatcaccgcgttcggttcaccaataagcgcaggggtcactggattgcccggtcaagccaggcaacgacagagaggtcgattaggagcgattaactcgcatcgcgcaggcgctctgctgtctcgaggtcgaccgagacgagctggctcacgccgcgctcggccatggtgacgccgaacagccggctcatgcgcgccatggtgagtgggtggtgggtgatgatgaggaagcgcgtatcggtctcgttggccatctcttccatcagccggcagaagcgttcgacattggcatcgtcgagcggcgcgtccacctcgtcgagcacgcagatcggcgaggggttggtgaggaacacggcgaagatgagcgcaagcgcagtcaacgccttctcgccccccgatagcagcgttagcgcctggagccgcttgcccggcgggcaggccattatctcgagcccagattcgagcggatcgtcggaatcgacgagcctgagctcggcggtgccgccgccgaacagcgtcttgaacaggcggccgaaatggccgttgaccgtatcgaaggcttcgagcagccgcttgcggccctcgcggttcaaattggcgatgccttggcggagccgcgcaatagcctgctcaacgtcggccttctcgcgctccatctcttcgagcttggcggaaagctccgcctcctcctcctcggcggcaagattaacgccgccgagcctctcgcgatcgcctttgagcttcaag

SEQ ID NO: 1609 - DNA, 4000 bp, Escherichia coli
  misc_feature (2649)..(2649): n is a, c, g, or t
gactcccacactcccaacgccggcggcctaggctgcttggccatcggtgtgggaggcgccgacgccgctgatgtgatggccggcctgccctgggaggtcaagtacccgactctagtgggcgtccgtctgacgggcgagctcagcggttggacggcccccaaagacgtgatcatctacctagccggcgtgctgactgtcgccggcggcaccaacgccattatcgagtacttcggacccggcgtgaactccataagctgcaccggcaaggccacgatcaccaacatgggcgctgaacttggcgcaaccggggacgtattccccttcgacgagcggatggccacctacctgaaagcaaccaaccgccctgaacttgccgagttggctgagagatacaagcatctgctcacatccgaccccgaggtcgagcaagacccggcccagtactacgaccgcatcgtggagatcgatctttcgactctggagcctcagatcaccgggccccattcccccgaccgcgcccgccctatatccgctatggccaaggagatcgaggaggagggcttccccgacaaactctccgtggccttggtcggtagctgcaccaactcctcctacgaggatatgagccgctgcgccgacgtggccagtcaagcaacggagcacggccttcaagccgtgtccgaattcatgattacgcccggatcggaacaagtacgggccaccatcgcccgcgacggccaacaggcggctttagaagaactaggcggcatggtgttggccaacgcctgcggcccctgcatcggacagtggaagagggaaggagttccggatggcgaaccgaactccatcgtcacgtcctacaaccggaacttccccaagcgcaacgacgcgaactccgggaccatgaacttcatcaccagtcccgagttggccgtggcgatgagcctgagcggccgcctgagtttcaatccgctcaccgatacactgaccggcgccgacggcaaagaattcatgctggaagcgcccggacccgccccggaagtacccgcgggcggctttgacgccggcgagcagggctacgtagccccgcccgaagacggaagcagcatcgacgtcaatgttgatccaaacagcacccggctgcagattttggagccctggcccgcctgggatggcgaggacttcaaggctatgccggtgctggtcaaggcggcgggaaagtgcaccactgaccatatctctccggccggggcctggctccgcttccgcggacacctggataacctgagcgacaacatgttcttgggcgcggtgaacgccttcaccgacgagcctggcaccgggaagaaccaactatccggtgagcagatacaacccatccctcagatcgcccgggagtacaaggcccagggcatgcaatggatcgccgtcggcgacaacaactacggagagggcagcagccgtgaacatgccgccatgtctccccggatgttgggcgcggcggcagtcatcacccgcagtttcgccaggatccacgaagccaacctcaagaagcagggcatattgcccctgacctttgaggacccaggcgactacgaccgcatcagggccgacgaccggctgagcatcatcgggctgtcggacctggctccaggtcagccgctggtctgcgtggtctcccatgaggacggggaagaggagcgcatcaacctgcgtcacaccatgaacctcggacagatcgattggttcaaagccggctcagcgatgaaccacatgaagaacacggcaggagggtaggcgacccctgattctgccttgaccagatgttgttggaccaagctaagccgtggttcgacaggctcagcttgagagggatgagagtaatacaaatccgttcgtcctgtccttccccggaaggatgtcgaaggaccggcatcagtcaagctctcaatgtggaactgaaacgaaaaaggggcgtcccgatcaatcgggacgcccctttttgctagttcgcgccagaagttgtttaacccaagtcgtccaaacaggcctcaacgggcttggcgatgcaggagaagatgggggtatccaccaaagtgtagggccgggccttggactcgcgaaggtccatcaccaggtccaggaagtgggacgggtcgtcggtctcaaatccgagcacgaattcctggtcgtcgagtccgaacgaatacgccgtgctgatcttcacatcagggtatttatgcccgatgacgaaatgctcgttcatcagctcctggcgttcttccttgggtagttgataccactcgtgggtcttaatgaagggatagatgaacaggtacttccggccgatgatgcgcatggtcgcggagcccgttccctcttggccttcgtgcttatgatcgtcgatatacggcgaccggcgggtcatggccaagtatgaataaggcatcgtcaggtagcgggccagatcggtgtggttaaccctggccatcagctcgttgatggcttccagttcctcgctcaccttccacagcaggaaatcggcgtcgccacgggtgccaaccatgctgtagctggacatggacacgcggtcggaaaactctcccaacacctcggcaaactgggccttgttgtcctggcgttccttcnccggaaggcgccgccactcggggtcgaccttgaagaatgaatacttcacgaaatctcgcctgacttgttctgtcatctaaccctacttcgcggtttttcggcccgccgtcgaatcttggatgcggggataccgaaattatcatagcaacggccaatggctcgtggcaacgtaaagctcgtcttgggccggttgaccgaaatataagaaccgggtctgcggcctcgttgctttcccttgtggcggtgctacaatctccgggtgtcccttacgggggcttaaatcaccagaaaattaacagaaatcgaggatgtagcgatggtaactcttggctcaggcgccttcacttatgaggtagaagagggttggggcacgctccccgacggttggtcttacaaagagtgcgccgcagtcggagttgactcccaagaaaacgtatacgttttcaaccggggcgagcatccgatgatcgtcttcgacaaggacggtaatttcctccgctcctggggcgagggtgtctaccctagggctcacggcatcacgatggggcccgacgacagcatctatctgaccgacgacggcgaccacaccgtgcgcaagtgcaaacttgacggcaccgtcatcttcaccctgggcatcagcggcaagccggcgcccttcatgagcggagaccccttcaaccgttgcacccacgttgccctggaccctcagacagccgaattctacgtatccgacggctacggcaatgcccgtgttcacaaatactcgccggacggcaagctgctgttctcctggggcgaatcaggcaccggaccgggccagttcaatatcgcccataacgtctgcaccgacaaagacggctgggtctacgtggctgaccgggagaaccagcggatacaggtcttcgacaagaacggcaagttcgagactcagtggaaggacatggcccgtccctgtggcctgtttatcgacaccagcggcgaccagagggtctacgttggcgaattgggcgcggctatcggccccaacgaccaggcgtctggcttaggcccccgaattggcatcatggatctgaagggcaattacttggccaaattgggcgacattcccgagggcgaagagcccggcacgttcatcgccccccacggtgtctgcatcaacggcaaaggcgacatcttcgtgggcgaggtatcctggacccacacgggcagccgcctcaacccaccccgtgaggtacgctccctacagaagttgaccaagaagtaggggtaggacttcagagagcagcccttcgcaacgggagggagttagggtgagggccgccctctcgcacaagacacttagatcggagca

SEQ ID NO: 1610 - DNA, 4000 bp, Escherichia coli
  misc_feature (13)..(13): n is a, c, g, or t
  misc_feature (22)..(22): n is a, c, g, or t
  misc_feature (70)..(70): n is a, c, g, or t
  misc_feature (85)..(85): n is a, c, g, or t
  misc_feature (91)..(91): n is a, c, g, or t
  misc_feature (106)..(106): n is a, c, g, or t
  misc_feature (244)..(244): n is a, c, g, or t
  misc_feature (319)..(319): n is a, c, g, or t
  misc_feature (571)..(571): n is a, c, g, or t
  misc_feature (613)..(613): n is a, c, g, or t
  misc_feature (619)..(619): n is a, c, g, or t
  misc_feature (622)..(622): n is a, c, g, or t
  misc_feature (769)..(769): n is a, c, g, or t
  misc_feature (871)..(871): n is a, c, g, or t
  misc_feature (877)..(877): n is a, c, g, or t
  misc_feature (880)..(880): n is a, c, g, or t
  misc_feature (1457)..(1457): n is a, c, g, or t
  misc_feature (2561)..(2561): n is a, c, g, or t
  misc_feature (3052)..(3052): n is a, c, g, or t
  misc_feature (3165)..(3165): n is a, c, g, or t
  misc_feature (3387)..(3387): n is a, c, g, or t
aaactttatcaancctacaganttcagttatcataaagtagtacaaatcttattgttccctgtatttggnggttctaatgtagtntggggntccgtactcggttcnttcattcttacattgttgccagaagtattgcgtttcttatccgactatcgcgatatcatttatggtgcattgttagtcattttgatggctgttcgtccagatggtattttaaccgaatctatggtagataagattagncgtaaattaggctttaaaaaagctccatacattcctgaaacacaagtattaacagaacgttttgaagcgtataancgtaaacaacaagataaacaaggataggaggggaactgaatgctattagaattaaatgacgtaagtaaaagctttggtggcgttgcagctctcacaggcatatcctttggtgttaagcaaggtgaagtgtttggtgttatcggaccaaatggtgctggtaagactacactctttaacttgattacaggtgtattccctgtaagttctggcgaaattgtatttgatggtatgtctgttgtaggcattaaaccncatagaacggtagaaatgggcattgctcgtacattccaaaanattcgnctntttggcaatatgacagctttggaaacagtattaactggtatgcattgccgaactggttctggtttcgttgctagtttcttaagaacaaaacgccaacgtattgaagaagaacgttgtcgtggcattgcctatgaatttttaaaactngtaggtcttgaagaagatgctgaagaagttgctacatcattaccatatggcaaacaacgtcgtctcgaaatcgcgcgtgctttagctacacatcctcaattnattttnctngatgaaccagcagcaggtatgaatgatagtgaaacggaagcgttacgccaattgattggtaaaattcgcgacttaggtattactgttgtcgtaattgaacatgccatggaattgatgatgaatatctgtgaccgtttggtggtattcaattttggtaaaaagattgctgaaggtacacctcaagaaattcaaaataatgaggctgttatcgaagcatacttaggtaaagaggaggtgtaatatgttaaagctagaaaacatcgtggctggttatggacatattacagccttaaaagacattagcttagaagtaccacaagggtctatcgtatccttgatcggtgccaacggcgctggtaagtcgacaacaatgaagactattatgggccttgtaaagcctacatcaggtaaggtgctatttgagggtcaagacattactggacataaaactcatcaaattgtacataatggtatttccttagtacctgaaggtcgtcaaattcttcaagatatgagcgtttacgagaatcttgaaatgggcgcttatatacgcaatgataatgagattgaagcgganattaaaaaggtatttaaacgctttccaattctcgatgaacggagctatcaactaggtggtacattatctggtggccaacaacaaatgcttgccattggtcgtgctcttatggcccgtcctaagttattgctactagacgaaccatctatggggcttgcaccattagtagtaaacgaaatctttgaaactattaaagaaattagtgcagaaggcaccaccgttctcttggtagaacaaaacgtccgtcaagcattgaaaatcgctgattatgcgtatgtattggaaacaggcaaaatggtattgtctggtccagctgatgaagtacgacatgatcctcgtgtcatggaagcttatttgggcggtcgtgtcgaataaaattaaatacaatttatttggatgtatatatctattattaaacggatatatacatccattttttttgcaaactcctaaatatagaaattttttattagtaatagaaatatatagaacaaaataacacttcgatatgtgaagaaaaatacacatatacgggtaagcattaaacatagataatttcagtattcttgatgcttcatgaaaaccatataaagaagcttcatcttgcttatatagtagttacaaagaaacgatgataaaatatgtgtacgataattaattaaatattaaatttatttaaatagttgtgttaaggtgttttgttaattgaaatgaatgctatgaggtgcatgtatgaatcaaaaatggattgctttatctcttgtcataggtacgatagccactacgggttttgcaaaggatgtttctcctgtagtagttacaacatcaaatatgaatacgtctgcatctacaattggttctgatcaagagtatcgtctacgacaaggggatgaactcatgattgatgtagtacaacaagcagatttaggtgcaaataaaactttcaccattcgaccagatggatatgtatccattcctatggcaggtaatattaaggcggatggaatgacagtagaagaattcacccgaaatgtatctaacgcattatccatatacattatcaatcctgatgtgtcggttaatgttacaaaattaggtggcgtncgcgtttatgtatttggtgaaattaataaaccaggtgcttatacattaacaaaatcgagtaccgttattgatgcgattggggtcgcgggtagtttcaactgggatacggctaagaagaagatattcttaattcatcaaaatgatcctacaaaacctattgaaatcaatttaaataatatgttgaaaactggtgatatgtcccaaaattacgttatgcgtgaaggcgatatcttgtacttaactaagaacagtaagattagtttctctagagatattgctcctattttgacaggtgcttacatggtatctcgcataggtaaagactaattagtaaaaatagtatcatatgtaagtcatataaggggggctttcattgcgttcatatttattacccggcttattacttattgtagatgttattactattattggtgtggcattgatcagtttgcttatacgatttgatggttatataacatcacattatctgnatcagatgatagatgcattgcctataatggtaatctcctatattgttatgcttttgtccatgcatctatatacgcgcatatggcgctatgcaggtatgcgcgaaatggttgcngtattgattgcgaccaccttaggagcaggacttttctatacagggatgtatgtatttgataaatctttacctagatccatatatttgattagctggattcttagtaccggtgttatcggaattggtagaatggtactccattatattgccatgcgatatggtggaaaacaaagtactgatgctgatatggtaaataccttaatcattggcgcaggtgatgcnggtgccacaattgctcgtgaaattgaacggtatcataaacggtctcgtaaggtaattggtttcatcgatgatgatgagtctaaattcaatcgtctaatgggcggcgttcgtatactaggtaatcgccatgatatcccatctattgtaaaagaaaataaggtgaaagaaattataattgccatgccttctgttacacgtaatgaaatcagaaatatcatggaaatctgttcacctcttaaatgtaaagtcaatacattaccggggatgtatcaattgttagatgatgaggtactagtatcccatttacatcctgtatccatagaagacctattagaacgtgatgaggttcgtctcgatatggatattgtagaacattatattcgcgataaggttgttctggttactggtgctggtggatctataggttcagaaatttgtcgtcaaattatgcgtgttggccctaaacagctcttattgttaggccatggtgaaaatagtatataccttatcaatcaagagttgaaaaatatatataaagacggcccgattataccaattattgcagatattagagataaacaacaattagatcaaatattcactcaatataatc

SEQ ID NO: 1611 - DNA, 4000 bp, Escherichia coli
  misc_feature (912)..(912): n is a, c, g, or t
  misc_feature (1200)..(1200): n is a, c, g, or t
  misc_feature (1368)..(1368): n is a, c, g, or t
  misc_feature (1988)..(1988): n is a, c, g, or t
  misc_feature (2421)..(2421): n is a, c, g, or t
  misc_feature (2430)..(2430): n is a, c, g, or t
  misc_feature (2439)..(2439): n is a, c, g, or t
  misc_feature (2445)..(2445): n is a, c, g, or t
  misc_feature (2487)..(2487): n is a, c, g, or t
  misc_feature (2499)..(2499): n is a, c, g, or t
  misc_feature (2505)..(2505): n is a, c, g, or t
  misc_feature (2513)..(2513): n is a, c, g, or t
  misc_feature (2539)..(2539): n is a, c, g, or t
  misc_feature (2568)..(2568): n is a, c, g, or t
  misc_feature (2583)..(2583): n is a, c, g, or t
  misc_feature (2586)..(2586): n is a, c, g, or t
  misc_feature (2604)..(2604): n is a, c, g, or t
  misc_feature (2703)..(2703): n is a, c, g, or t
  misc_feature (2771)..(2771): n is a, c, g, or t
  misc_feature (2831)..(2831): n is a, c, g, or t
  misc_feature (2947)..(2947): n is a, c, g, or t
  misc_feature (2962)..(2962): n is a, c, g, or t
  misc_feature (2976)..(2976): n is a, c, g, or t
  misc_feature (2980)..(2980): n is a, c, g, or t
  misc_feature (2983)..(2983): n is a, c, g, or t
  misc_feature (2986)..(2986): n is a, c, g, or t
  misc_feature (2989)..(2989): n is a, c, g, or t
  misc_feature (2992)..(2992): n is a, c, g, or t
  misc_feature (3019)..(3019): n is a, c, g, or t
  misc_feature (3022)..(3022): n is a, c, g, or t
  misc_feature (3088)..(3088): n is a, c, g, or t
  misc_feature (3107)..(3108): n is a, c, g, or t
  misc_feature (3118)..(3118): n is a, c, g, or t
  misc_feature (3241)..(3241): n is a, c, g, or t
  misc_feature (3397)..(3398): n is a, c, g, or t
  misc_feature (3425)..(3425): n is a, c, g, or t
  misc_feature (3778)..(3778): n is a, c, g, or t
agtgcttgccccgcccaattcttcagaggtaacctcttcgtgcgtgacagttttaacaacatttgggcccgttacaaacatgtaggaggattcctcgaccatcatgataaaatcggtcaaggcaggcgaatatactgcgccccctgcacaaggtcccatcatagctgacagttgtggtatgacgcctgaggcttgaacattgcggtaaaagatatcgctgtaccccccgagcgaaacgacaccttcttgtattcgtgcgccaccactgtcgttaagaccaatcacaggagcacccgttttcatcgcaaggtccatcacttttgtgattttttctgcgtgcgcttcggcaagtgaaccgcctaaaacggtgaaatcttgtgcataaacgtaggtaagtctgccgttcacggtaccgtaccccgtaacgactccatcgcctaaaattttctgctcatctagaccaaatagattgcttcggtgctgaacgagcgctcccatctcttggaaactcccttcgtcgagaagaaagtgaatgcgctcgcgagcggtcaatttacccttcgcgtgctgggcttctatgcgtttctcgccgccgccaactttgctctgcttttgaagttcttgcaggtgtgctcttttgtcttgcatggtggttctctgtctagtttctgtgtgccaatttacttctccgaaaaggcattacgcaaattaaccttcgtatgtcggtggaatcttttcgtttccttcgcttttctgcggatttcaacctgctcttcttcgggcaaatgaataacttctatgcactgaggcgtgcagcaaccttcgtgtttttctgcacattcttcgcattgaataaatagaagattacacgccttattggcacaatttgcatggtttgcagaaggctgggcncattgatggcattctgaaatgatctcatccgagatgctttcacctaaacgttcgtcgaaaacgaaattgatgccgtgaaatttattgggcaatttctcctcttcaatctggcgtgcataatcaatgatgccgccgtgcaattggttgacatctttaaacccatggtgcttcaaataagcagaggtcttctcgcaacgaatgccgccggtacaatacaataggatcttgcggtcttcctgacctttgagtttttccagtaccatagggagctcctcacgaaaggtttcngcctcaggaagaacagcgccttcaaaatgaccaatttcactttcatagtgattccgcatatccaccaccactggatcgtttttctctatggcgtcgttccaatccttcgctgttaagtgcgcgccaacatctgtaacatcataatcttccggctgaagtccatctgcnacaatctgctctcgaactttgacgacaagcttcaaaaatgactttccttctgtcttatccgtcacggccaatttaaagggtacatcatggaaatattccatgccgtgtataaaggcatcaaaggcatcccaatggtgctgtggaacattcatttgtgcgttaataccttcgcgagagacataaatacgtcctaaacaatcccactccgaccattgcgcgaataattcatcacgcaaggcttgcgggttttctatgatgacatatttgtaaaaagaaaccgttgtacggtggaaggattctgcatcaagcttagcctgcagttcttctcgactcaatttattaacgagcgttcttttcccagcatttggatccatagacgggtgatttatagtgcaaagataagttatctttgagggacctaattctgatctttatcacattcagagcatgaacaaaaccatccttatcctaggcgcttgcgggcaaatagggactgaacttaccttggcccttcgccagaaatacggcaacgaaagcgttgtagcatccgacattcgtcgcagcgaccttgccgaactccaagacggcccttttgaaatcctagacgccagcgatgccgntgccctgcgcgcagtatgtgagcaatataagatccataccgtataccacctcgtggccatgctcagcgctactggggagaaattcccgatgaaggcttgggacctgaacatgcaaagcttgctgcacgtgctggaattggcccgtgaaggagtcattcaaaagattttttggcccagctccattgccgtttttggaccgactactccaaaggaccataccccacagcaaaccattatggagccctcgacggtctacggcatctccaaacttgctggcgagcgttggtgtgaatactacttcaataagtacggcgtggacgttcgttccatccgctaccctggactcatttcttggaaatctcaaccgggcggcggaaccacagattatgccgtcgagatctattacaaggccttggaagaaggtcgctacacnagctttttntccgagcancgtgcnttgccgatgatgtatatggacgatgccattcgcgcgaccatngagctcactgangcaccngcggaacnggtaaaggtgcgcaacagctataatntggcgggcatcagcttcgatccagtgacnattgcggcgagcatngcngggcacattgaaggattngaaatggactgtgtaccggatttccgcgagaatatcgcggccagttggcctgctagtattgacgatagtgcggcgcaggcagattggaactggacaccngagtacgatcttgaagcgatgacggcggccatgttgggcaatctgaaggtcaagctcggactataatnctacctcgaaatattcggaaggcccgtcgtatcctgccacggttttttgccctaggtgtntgaaccccagggcctccaggactttgatgctcgcagtgttttctccgtgggtgatggcgctcagttttaattggccaaagcgctcttttgctgcttgcatgatgcgctttgaggcntcgcgggcatagccntggccttcgtggtncggntgnagngcntancccaggtcaatgagctccaaatctggncgnacgtacaatccacaaaccccaaccttggtccccgtttctttggtcacgagggtgtagttcgcatanccgcgctcgcgcagttgcnntagggcgcgntgacggatgtattcccgtgcatcttcctcgctgtggaggttgcggtcgccaataaattttagggctttcggggcggttaaaatagccagcacgagggcggcatcttcttcggtcgtcggacgnaggtagaggcggtccgattcaaaactcaaataactactcatcgtctttgtaccaggagctgtattttaaataattgttggcaatgcgctcgatttcccctttgcgcaggcgttcgggtacgggaccaatttctttcgccggcacccccgcccacanngttcccggggccaatttttttccttgngtcacgaccgatccggccgccacaatacatccctcaccgaccacacagtcgtccatgacgatggcgcccatgccgatgagcacattgtcctcgatggtgcagccgtgcacgatggcgttgtggcctatgctcacattgttgccgaccacagtggggaatttctcgtaggtgcagtggacggtagcattatcctgaacattgaccttatgaccgaaggtgatgctgttgacatcgccgcgcacgacactaccgtaccaaaagctacagccgtcgccgcatttgaattggccaataatggtggcattctcagctacaaaacactcttcgccaaattcaggtgtatgtcctaacanggacttaattaatgccatggtatgatcgtttaaggttctcttttcaaatgtacgctttgcgacttttaccacgtacctttgtatctacaaacaaccccatatcatggacatcaagcgcgtacccgttagtatttatgcagagatgaccccgaatccgaaggtcatgaagttcgtcagcaacaagctgttgttgcagaccgattctgcagaattcagaaacat

SEQ ID NO: 1612 - DNA, 4000 bp, Escherichia coli
  misc_feature (795)..(795): n is a, c, g, or t
  misc_feature (1202)..(1202): n is a, c, g, or t
  misc_feature (1205)..(1205): n is a, c, g, or t
  misc_feature (1884)..(1884): n is a, c, g, or t
  misc_feature (2428)..(2428): n is a, c, g, or t
  misc_feature (2565)..(2565): n is a, c, g, or t
  misc_feature (2602)..(2602): n is a, c, g, or t
  misc_feature (3167)..(3167): n is a, c, g, or t
  misc_feature (3335)..(3335): n is a, c, g, or t
  misc_feature (3536)..(3536): n is a, c, g, or t
gcaccttccacaaaagaaaccggatattttgtaggaaactcagcaataaaacgttcctgctcctttgcccgcatatgatattcttccggcggataaatattgggattgtaataaaataccgttacatggaaatgttctgcaagacatgcaatacaataagaactgcacggtgcacaacagctgtgcaaaaggaggcttggagcctcccctgccgtacagttttcacggatcagatcttccattattttctgataattttttttattcatctttcatctgtatacatctgattaaaaatttcttttccggtctgcgtccggaaaatttgctgatatgcctgttcaattccgtgacgattgacgtcatcttcatataaattgaccagaaaatctgcctccaccagaatctgataatccagtccttcgatattatcatatgtatgatgatgtccgatcagatagcagatacggtcgatcagataattttcaattcccacatcggaaagcattctctgtgccacaatcggtccttcctgctcctgcagctttccgtcacaccgtccatacttttcttctgccggacggattccaatgtcatgggtataagcggctgcttccaatataaaaagggatgtctcgtcaagcccttcttttgttccgatgattcttgcgaaactatgcactttcatgaaatgctgaatccgtttcggatctccggaaaaaaaggcgatcatctgtaaaaacagctcatccagctgttgcctgctgtaataactactgtcactactgtccattntgtgtttctcctttatctaacatctgcagtgcaaacgtcgctgcaatgtaaacaactgcacataaaataatcaatactgtttttttcccggcaacaccggcacaaagttctgccagaataagaagtccatgcacccagagttccgcatgatgcagcatcactgcaataactgcctcaatgataacaagcagacacataggaactaccggaacgttaaggactctcacccctacaatcaccataattgcaacaattgctgcaaaggccagtaatgtcggtacctgaaacgtctttttgttcttgtccattttttacctcaacctttattcttattttctttgtctgcgcccattataccaatttcatgcctaagaaacaagcactttttaaagtaaaaaagacacgtnttncatcggatacccgatacaaaacgtgtctgaaacgaagccaataaggggactcgaacccctgacccacgcattacgaatgcgttgctctaccaactgagccatattggcaaaacgtacttgtatataataccaaaaccgattcagaaaatcaactgttttttcataaaatttatattaaaaaaagattgacttttcacatggattctgtagaatagaaactgttgagtttataatcagtaaacaaaaaatcaactaacaatcatgtttcataaatttacgggaggcatgccatggacattggacaccgcatgaaagaactgcgcatccagtacggactgacgcaacaggagctggcggaccgtgccgagctgaccaagggctttatctcacagttggaacgaaaccagaactctccgtccatcggaactcttctggatatcatccagtgccttggtacgacaccagcagaattttttacagatgaagagccggaacagattgttttcaaacaggaagattattttgaaaaaaccgacgaagaaaaacactgctgtattgaatgggtcgttcccaatgcacagaaaaaccagatggaaccggttcgtctgactttacacgccggtggacggtcagaagtttatcagccccatgagggggaggatttcggttatgtaatcanaggaaacgtccgtatccactatgccggacaaaaccagacggtacatgccggggaatctttctattttaaagcaggaaaaaagcattatctggaaaacaccggttcgaaagatgccgtcatcatctgggttactaccccaccaaatttttaagaggacaaacgtatgagtaaacatttaattgattttattggaatttccaaatcctacgattccaatcttgtgttggatgatttaaatctgtatatccgggagaatgaatttctgacccttttaggtccgtccggatgcggaaaaactacaaccctgcgtctgctgggaggctttgaaagcccggacaagggacagattctgtttgacggacaggatatcacagctcttgcagccaatgaacggaaactgaataccgtttttcagaagtattctcttttcccgcatatgtccatcgccgaaaacattgcattcggccttaaaataagtaagaaaagcaaagcatatattcaggataaaatcaaatatgccttaaaactggtcaatctggaaggntttgaaaaccgttcggtcgattctctctccggtggtcagcagcagcgtatcgccatcgcccgtgcgattgtaaacgagccaaaagtccttcttttagatgaacctctcggtgcacttgatttaaaactgcgccagancatgcagtatgagctcatccgtctgaaagaagaactnggaattacttttgtatatgtcacccacgatcaggaagaagcactgaccatgtccgataccattgttgtcatgaatcagggatatatccagcagatcggtactccggaaaacatttacaacgaaccggaaaacgcatttgttgccgattttatcggacacagcaatatcattgacggaaccatgataaaagatgaacttgtagagattctcggtgcccgttgggcatgtgtcgacaagggattcggcaataacaagccggtcgacgttgtcatccgtccggaagatgtagaactggtcgatccttcggagggaacgctgcagggcgaagtaacctccctgatttttaaaggcgttcactatgaacttgatgtcatggccggcggctatgaatggctggttcacaccaccagatttgttccggtcggcaccaaagtcggcatcaaagtaatcccgttcaatatccagattatgcataagccggaatcttccgatgaaaaggcggtggagatcgatgcgtaaattcaaacagcaatttcttgccggtccatacctcatatggatcatnggttttatcctcctgccgcttatcatgattctttactatgcatttacaaacggcgatggcagttttacgttatcctatatcacagcgatagcagatgaaaccaaccgcaaagccatgggactttccctgagacttggaattatatgcaccatcgtgtgcctggttctntcctatccgctggcaatgattttaaataatatgaaaatcaaaaatcagggactggttgtttttatctttatgcttccgatgtggatgaactttatgctccgtatcctggcatggaaacttctgctttccaaaaatggtgtaatcaactccattctcacaggtttcgggctttcccgcatcaatatcataaatacaccaacngcagttgtccttggcatggtatacgacttcctgccatttatgctgctgccaatctacaactccatgacacgaatccgtaaagactggattgaggcggcccgtgatctgggtgccggaaatgtaaccatctttttaaagattatccttccgcttaccgtatccggaatcatcagcggaatcgtcatggtatttgtcccgtcacttacctcgtttgcaatctcgcaggtattaggcggtggtcatgttcttttaatcggaaatgtgatcgaacaggattttatgcagggtatgcaatggaatgccggaagcggtctttcctttgttcttatgatttttgtgattgcaagtatgactattgtaaatatatttgataaagaaggggagggaacatccatatgttaaaaaaatgtgcatcccggatctatatggtcctgatttttgccttcctttaccttccgattatt

SEQ ID NO: 1613 - DNA, 4000 bp, Escherichia coli
  misc_feature (105)..(105): n is a, c, g, or t
  misc_feature (124)..(124): n is a, c, g, or t
  misc_feature (151)..(152): n is a, c, g, or t
  misc_feature (229)..(229): n is a, c, g, or t
  misc_feature (1322)..(1322): n is a, c, g, or t
  misc_feature (2940)..(2940): n is a, c, g, or t
  misc_feature (3051)..(3051): n is a, c, g, or t
  misc_feature (3093)..(3093): n is a, c, g, or t
  misc_feature (3183)..(3183): n is a, c, g, or t
  misc_feature (3268)..(3268): n is a, c, g, or t
gccgtaggccgttacccaatcatcagtactgggacctcgtccagcgaattgccatagaaaatatcgccaatacattttctttacctgataactccaaaaataatnccactgcttatccattcgntaggatttgtattttcgttcctggctnncggaataattacgaccacctttcgcaggtcttcccacaacttcatgtttgggcggcaatcctgtaaatcgacgaggnaattgggtcatttggccatattgttctctttccatataagcaatcgctcgtggaacggtagaagggtcattttcattaatggcaggctgctgccccgatcgaataaaaatagtggcatagcttgaatacccgaccaaaataaggactatagatgtgagggccaatgcatattgaaattgtcttttaataattgtgaaaaccataccacccataatcgccaagcataagaataaaaatagctctaaaccgacagcattcacaatcttaggcactccattaatgatacctgtattgattatcagataaatcacgcccgtaatagctgtggttattagaaatcctttgtatgaaaattcatattttttgaaataaataatgagtgcaataaatggaagtgccagtaagttgagtaaatgaacaccagtggctaaaccaatcatataggcaataatgagaatgtatctctcattccccttttcatctgcccgttcggcccaatgaaggatgagccacaccacaatagcggtgaaaaatgttgaaaagccatacacttctgcttcaactgcattaaaccattgagaatctgtaaaagcaaatgtaagggcacctaccaaagaaccgccaaatgtaataatggcatccatagagcattcaatttttccacgataattcgaaatcagcttcacagttgaaagataaagatacatgactgctaaggcactgaccacaggtgaaatcaaattgattcggaatgcaatatccggattaaaaggaatcatagaaaaaacacgaccaataatcaaatacaaagggctccctggcggatggggtacacccaaaataaatgatgtggcaataaattcacccgaatcccaatatggcacagtatccgccatggttaataggtacacaataaaggagatgccaagcgccaacccggcaaaaattcggttcaaacgaatataatcagaatggatcaagtgttagtctttctttttttagtagcctttttggctttcttttttgctttggtctttgcttcagttttagatttttctgtcttctgatcttctgatttctcagattcttctgnagaagaatctgaacctttcttttgttcgtcgatgaaatttaatttcaattcgctgaggctatggataatatattgttcttcccattcgctgaggtttcccttcattttaacttgaagcatatccattaggtcgatatagtaagaagcctgatcaaggttacgttctaacgcatcattcatagggttttttacttttcctagagatatccatgcactttgcacgaatgtattcaccaagtgaataaataattgatcttcttttttcatttgttcttcagccatgattttcctctaaagttacttatattcaattttgttaaaaatgtttcaaaaacagccggtgaaaatacaccatatctaatgaatattgaatatccaatattcattaataaattatgaaatattcacctgcacaagtttatcctgatattctgacatgaagcgtgtatggattaattcatgtgccgactgattcaaattcggatctgttttcaccaattcaaaagctgctttgcgagcttttcttaagataggcccatcggtcaccatatccgcaattttatattttaggaatccactttggcggataccgaaaaattctcctggtcctctgatttttaaatcttcatctgaaattacaaaaccatcatttgtggattccataatctgtaggcgctttttggaattgtccgtaaaattccggcgaacgagaatgcagtaacttttttcactcccccgccccacacggccccgaagttggtgaagttgggtcaaaccaaagcgatccgcatgctcaataagcattaccgtagcgttgggtatgtcaatccccacttcaatcaccgtagtagaaatcaaaatgtgaatttcattacggccgtaagcatccatgacaacgtctttctcatcttttttcattcgcccgtgaatgaggcctactttgaattcccggaatatatttcctgaaagattcgcgtgcatttctacggcggcggctaaatcggatttttccgtctcctctaccaaaggataaaccaccatacactgacgtccggcggccacttcatctttcataaaatcgtatacttttttcaatcgttgttcatccaccactttggtcacgataggaatacgattctttggcatttcatcaatgatggataaatccatatctccatggtaggtaatggccaatgttcgtggaattggtgtggcagtcattgccaaaagatggggattcaaccctttcgatgtaaggtctcctcgctggagaacgccaaaacgatgttgttcgtccacaatagccaaacccaattctttaaatattacatccttttgaatgagggcatgggtaccgatgataatgtcgatccgtccttcagctaaaccaccaagaatggctttacgttcttttgcgggggtgcctccgacgagaatagcgcaagtcatgtgggccatttcagcatactttttaaatgatgccaaatgttgatgggctaaaatttccgtgggcgccatgactgccacctgtacattattcgccaccgcaatggccgccgctaaaacagatacgatggttttccccgatcctacatctccctgcaaaagtctgttcatngagaagggccgggccatatcatccttgatttctttaattacttttttctgggcattggtcagttcaaaatcaagactatcagaaatgagtttaacttgaggcccgattttnttcaatgctttggtccctgtttgctgtagagatgattttcgnaatgccataagcatttggagaaaaaagtgttcgtcaaattttaagcggtgaaccgcctcattcagtacctcttctgattcggcaaaatgnatatttctcagggcgctgttaatatggataagatcgttggactttcggaattcaggcgaaaaatgatcgggaatttctttaaggnaatcggaaatggttttaatgaggcggcgaaggccgcggctatccaatctcgtcttttttaattcggcgggaattgaatagaggggaatgaccaaaccggaattgacggggtcttcatcttctttcagtttatcatattcaggatgaacaatctggaagccgttgaaaaattcaactttcccactcacagccaggcggtccccaatttttatcgctttttttatgtattgtgcaccattgaaccaggtgagtgtcatcataccctttccatcagaaataatagcctgaaaatattggcgacgcttcccacggcgcaaatccgctgcttcaactttaccgataacagtggcttccatatctcttttgagtttagatattggtgtaacggtggtgcggtctaaatgcttgcgaggataataatgaagtaaatcagacactgtattaacgtcgatggctgacaaagcatccgcccgggccgggccgacacctttaacggattggagagataaggaaagcgttatggccttttcaggcacaatttattagttccattccttgcggtaagtatatgtcacaatttgagaaccatttgctggaatggtgagtgggaagtgaatggtagacgcatccttttttcgatagttcacagatgcatctcgaatcacccagtccccaaaaacatgctcgataaggcgaacttttatttctgtgtttaacgtattcgttacttcaa

SEQ ID NO: 1614 - DNA, 4000 bp, Escherichia coli
  misc_feature (1224)..(1224): n is a, c, g, or t
  misc_feature (1302)..(1302): n is a, c, g, or t
  misc_feature (1317)..(1317): n is a, c, g, or t
  misc_feature (1592)..(1592): n is a, c, g, or t
  misc_feature (1607)..(1607): n is a, c, g, or t
  misc_feature (1610)..(1610): n is a, c, g, or t
  misc_feature (1634)..(1634): n is a, c, g, or t
  misc_feature (1676)..(1676): n is a, c, g, or t
  misc_feature (1684)..(1684): n is a, c, g, or t
  misc_feature (1686)..(1686): n is a, c, g, or t
  misc_feature (1757)..(1757): n is a, c, g, or t
  misc_feature (1832)..(1832): n is a, c, g, or t
  misc_feature (1874)..(1874): n is a, c, g, or t
  misc_feature (1988)..(1988): n is a, c, g, or t
  misc_feature (1992)..(1992): n is a, c, g, or t
  misc_feature (2120)..(2120): n is a, c, g, or t
  misc_feature (2147)..(2147): n is a, c, g, or t
  misc_feature (2150)..(2150): n is a, c, g, or t
  misc_feature (2177)..(2177): n is a, c, g, or t
  misc_feature (3144)..(3144): n is a, c, g, or t
ggtcgccatcttttcctatctggtttatatgggactgggagcgatcaactgggcattcctcactcagactcccaaaccggttggcgaagccggtggaggaatggccaacgccatggtgggctcgggagtgattttgctgctcgccagcgtgattggaattcccttcggcgtgggcacagggatttatctggcagaattcggccgcaatcgcttcggcaatgtgattcgtttcgctgccgatgtgctcaacggcgttccttccatcgtgatgggcatcgccgtgtatggcctggtagttttgcggcagggacatttttccgcgctggcgggagggattgtgctgggcatcatgatggtgcccacggtttcccgctccacagaagagatgctgctcatggtgccgcagaacattcgcgaggcggccttggggctggggatcccgcagtggcgaacaacgatctcggtgacgttgcgcaccgccagctcggggatcatcaccggcatcatgctggcctttgcgcgcgtggcgggcgaaaccgcgccgctgttgtttaccgctttcggcaatcagttctggagcctgaaggtgaaccaacccatcgctgccttgccgctgcaaatctttgtttacgccatttctcctttcgacgagtggcatcggcaagcgtgggcgggagcgctggtgctggtggccctcatcgttgccacggtcgcggtggtgcgtctgctagcgcgccgtggaatgttccagggagcccactgatgggggtcggcatacgggtcagcgccctgaacgcatggtttggcaagacgcaggcgctgcgcaacattgatctggaagttcccgctaaccatgccacggccatcatcgggccttcgggctgcggtaaatccacctttgtgcgctgcttgaatcgcatgcacgaaactgtgccggaagcgcgcgtcgaaggacgggttgaaatcggcggaaccgacatttacagcaacggtaagtcgccagtggaagtgcggcgaagagtggggatggtgtttcaaaaggccaatccgtttcccaccatgtcgatttacgacaatgtggctgccgggctgaagctgaatgggctgcgcagccgccgcatgctcgacgagatcgtagagcgctcgctgcggcaggcggcgctgtgggacgaggtgaaagatctgttgaagaagaaatctggcgccagtctttccggcggccancagcaacggctgtgcatcgcgcgggcgctggcagtggaaccggaagtcatgctcatggacgagcccgcctcagcgctngacccgatctccacngctaagatcgaggaccttattttccagttgaaagaggattacaccatcgtgatcgtgacccacaacatgcaacaggcggcgcgcgtggccgaattcaccggcttcttcttgctgggcgagctggtggaattcgataagacacagaaaattttcactactccggccgacaagcggacggaagactacatcaccggcaggtttggataatgcgcgaacgatttcaccagggattagacgagctgcgggcgcgcctcttggccatgggcggcatggcngaacaggcggtagancgngccaccacggcttatcgcaaccgngacttgaagctttgccacgcggtgctggccagcgagaacgcnatcaacgncnttgagcgggagattgacgagctggcgctcgacctgctggccatgcagcagccgatggcggttgatctgcgntttatcaccgcagtgatgaagatcaacgccgacttggaacgcgttggcgatcaggcggtgaacatcgcggagcgngtgatgagcctggccaagctgccgccggccgacttgccgatngatattccccgcatggcagcaaccgtctctggaatggtgcgtcgcgcgctggaatcttttctggaggccaaagcagaattggccgaggcggtgctgaagatggatgacgtcgtngacnggatgaacgacgaagcctatgtcaacctggtgaacgccatgcaggccaacaaggaaatcacgcaacaggcgctggacgcattgctgatcgcgcgcaacctggagcgggtggcggaccacgccaccaanatcgccgaggatgtcattttctgggtncgnggcgccgatgtgcgccatcatcagccngcggagtgaaggaaaatgatcaataacctgtccactctgtggtttccgttactttgccgcggaagatgcgatagacgaacaccacgtatccaatcgccagcaacattccaaatccccaccaaatgagtccgatggaaagcgaatgcgtcccgctggcggcgttgtacatggtgatgttcagcgctgggtcggtggtcgaaatcagcagattgggataaacggccgcggccgcgcccagcagcataagagctaaataagcggaggaagcaacaaatgccgctttctctgcccgctttcgcgcgaaaacaaacatcgcaactaggctcgcggcaaccgcggcaggaatcacaagcagaatggcatggcgtcggtaattcgccagcatctcggggcgaatcgaaagcgtcgcccacagactggcaagtgtcagaaccgccagcagcggccaaagtatacctgcgacgcgcttggcgcgagcgttcaattcaccactagttttcaaagccacccaattcgcgccgtgaatcgtgagtgcaagcaatgccagcacagcagcgatcacggtataccagtccagaacgccaggctgcgaaccgattcgccaatcggtccacagcggcaggaagaaatagccgtcagcgttcagcggaactcctcggaccacgttgcccagggcggcgccgtaaaaaattgtcagcagcaggctggaaaaagcgaaacatccatcaaaaaagccgcgccacaccgccgaatccacatgcgcgcgcagctcaacgccgatgccgcgaaagatgagcagccacagaacgatcatcaacggcagataaaatccactgaaggcggaagcgtagagaagcgggaatgcgaaatagagtgtgccgccagcggccagaagccagacttcgttgccgtcccacacgggaccgatggttcgcaacaaaagcttgcgttcccggtctgtgctggnaataaacaaatagagcgcacccacgccgaggtcgaagccatccagaaccacataagcggcgatcattccagcgaccagcaaaaaccatgtggtgagcattggcattctctcaggctgcccttaccgagcgcgctgcctctttcgccggcactggaccgtgcgcgatctcccgatgcatcaggaacagaaacagaatccccagcatggtgtacaggcccatgaaaccgagtagcgtgaacaatccgttgccggcgtgaacatacttggaatatccctcgctggttcgcatcaagccgtaaaccagccacggctggcggccgacttcggcggtcatccagccggccgtgttggccacgtacggaaagggcaggcagagcagaaggatccacaacatccagcgggattcatacagccgcttacgccacagcagcaaggctgcgacgaccattaccaccacaaaaatcgttcctaagccggccatgatgtggtagctgtaatacaaaagcggaatgttggtgggccagacatctttgggaaattggttcaaccccggcacttcagccgtgctggttccgtaaatcaaaaaactcagcgcgcgattcatgatgagcggattatccatccgctggtgttcttcatccggctgcccgagaatcacgatgggagcgcccttctctgacttgaataatccttccatggcggcagtggtcaccggctggtgcctggccatgtagcgaccgtgaagatcgccggtggggaagatctgcaagatgcaaaagatggcgccgaccgtgacgccgacgcgcagaaaggcgcgggcatgctgactgaattttccttccagcaaataataggc

SEQ ID NO: 1615 - DNA, 4000 bp, Escherichia coli
  misc_feature (13)..(13): n is a, c, g, or t
  misc_feature (56)..(56): n is a, c, g, or t
  misc_feature (83)..(83): n is a, c, g, or t
  misc_feature (89)..(89): n is a, c, g, or t
  misc_feature (561)..(561): n is a, c, g, or t
  misc_feature (886)..(886): n is a, c, g, or t
  misc_feature (896)..(896): n is a, c, g, or t
  misc_feature (899)..(899): n is a, c, g, or t
  misc_feature (967)..(967): n is a, c, g, or t
  misc_feature (977)..(977): n is a, c, g, or t
  misc_feature (1583)..(1583): n is a, c, g, or t
  misc_feature (2080)..(2080): n is a, c, g, or t
  misc_feature (2158)..(2158): n is a, c, g, or t
  misc_feature (2357)..(2357): n is a, c, g, or t
  misc_feature (2416)..(2416): n is a, c, g, or t
  misc_feature (2463)..(2463): n is a, c, g, or t
  misc_feature (2469)..(2469): n is a, c, g, or t
  misc_feature (2494)..(2494): n is a, c, g, or t
  misc_feature (2498)..(2498): n is a, c, g, or t
  misc_feature (2826)..(2826): n is a, c, g, or t
  misc_feature (2865)..(2865): n is a, c, g, or t
  misc_feature (3232)..(3232): n is a, c, g, or t
  misc_feature (3237)..(3237): n is a, c, g, or t
  misc_feature (3271)..(3271): n is a, c, g, or t
gatttggaaccgntgggtcaaactctgcgtgaagtcgaaagtcaaacaaagaaaantcgagctgtctcaccatcgacatagcngattgnaagtttttccccgccaacattttcgccaacatctcttcgggcaaaacttctccggactcatagtgccctgaaataaaaccaagcgcctctctctgccaacaccagttctccataaactggctaggaagttcgaccgcatcccatgcaacaccgttaattcccgatacaccagcggcagatactttcgtcagcatatggtgcaagccatgtccgaattcatgaaacagcgtgacaacctggtcgtgggtcaacagggcaggcgcatctccaaccggcccggtaaaattacaagtcagataagcaactggcaattgaatggaagcaacctcttcacccgctgctttgacctttcttcgcactcgacattcatccatccaggcgccaccttgtttattcgggcgtgcgaacaaatctagataaaatctggcaacgcgctgaccatccttcttgatgtcgaacgtctgaacatccncgtgccatgtcacaacgtcagtcgcagggaccacgtcaatgtcatataaacggcgcacgacttcatacatgccatccaacacagaggacgctgggaaataaggtctcaacgcttcctcagagatatcaaacgtttgctcttttagcttttctgaataaaaagtaacatcccaggcttgcagctcactttttccgtaacgctgtcgggcaaactcacagagctcttcaaactgcgccgtcgcgacggagacagattttgaggcaagatcttccaggaacgtaattacctgatcagtgctctgtgccattttttttgcgatcgaatnttcggcatanttnctaaaaccaagtaactcggacttctcctttcgcagcaataaaatttcctgcatcactggagtgttgtnccactctccngcattggggccttgatccgaagctcgggttacataagcttcatagatttctttgcggaaggattcattttcacaataggtcatcaccggcaaataacttggaaattcaagcgtgaagacgtagcctttttcgcctctttgctttgccgtttggctggctaactccaacgcggtttcgggtaacccctgaagttcactgctgtcgtcaaactgtcgagaccaagccatcgttgaatcgagcacgttgtcgctgaacttgctggagagctccgatagtcgtttcgagatttccgaaaaacgctgttgttcttgctttggtaaattaaccccagacatcttgaagtctcgaattgcttgctcgatgaccatccgttgtgcctgatcaagcttaccgaactcctcgctcgcctgaatcgcctgataagcggaataaagcctcgggttttgtcccatttccgtcgcatactccgaaattttcggcaaacaggcattataagcatctcgcaactccgccgagttcactacggaattcatatgcgaaacgggtgagaaagcttggttgagtgcgtcatcaagggcttcgagttcaacaaccagatcttcgtancccattgcacccgcactcagaagacggctaactgcttctctgttgtcagcaagaatctggtcaatggccggcacgatatgctcaggtttaatgacatcaaaggggggtaattcgtgttgttctagtaatgggtttttcatgttaaatccggattctccggctcatcattcatatgaccaccgcggagtttattaataacagacgctgaatccggacgttttccaaaccagatttcaaacgccaacgctgcttgttcaactaacataccgaggccatcagcccgctctttggcacctaggtcccggcagagagataaaaagggtgtctcggtcttactgtaaatcaggtcataacaaaatgtgtgctcgccaataatctgcttgggaatcggcatttcttgcgcactctcaccagccatgggcaaacctgccgatgaaccactgatcacgagatcataattcgcggataactcagatggttttaccgcctgaattttnccagaatatttttcggccagcgccacggcctttgcatgagtgcggttgacaatatgaatactcgaagggccctgttcnagtattggttcaagaataccgctgacagcaccaccggcgcctagtaccagaatttgctttccttcaatcgaccacgctaaattctccgtcatgtcccgcaccagaccaagcccatcggtgttgtggccgctgagaagccccgaacgctcacgcttgatcgtgtttaccgcctgcgccctgctggcatattgcgataatntgtcggctaaatcgcatgcttcaaatttaaaagggacagtgatattaaagcccactgcnccctgatcaagtaacttcgccgatgcttctgcaaagccatccaaggncgcttncactttttgataggtgacagacatncctntctgatcagcaaacatctgatgaatttgtggtgaaagactatgcccaaccggattgccaataaccgccaacaaattcactatgttcccccttgtcgaatcaccgcgccagttgccaggtcaacgatctcactcgctccctgcctgccacctaattgacctggcacaatgtaatcaatttgttgtccaaaacttccgaggagctgcatgcgcgttttagctgccggtctgccggcaatatttgctgacgtagaaactataggttgtcctaccgattcgcatatcccttttaccgtcgcgtgatttgtcaatctaacggctactttgtgntgtataccactaatccaaaaagggactctttcactcttntcgacgaggtatgtcacgcctcggtcggctgagttctccaacacgcctgcttcaccagttcccagcataatatagggttttatttgttttaggctagagcctattaatatcaaccctttttcccatgagcgctttttgagcgcgagtattttcatagtcgcagtctcattttccggcagacatccaaggccccatactccttccgttgggtaagcaatgacatctccagaatgaagcttcgtagcgaccagtttgtattgccaatctctatgactcatacgcgaaatgttctgcttagattgacagcccttcgtttttatctctgattatttgggcattatccagacgctcctgttttatcttcgcngcaanactctcatcgatcatgcctaacatctgtgcagcnagataaccggcgtttcgagcaccaacggagccaatagcgacagttgccacaggaatgccggggggcatttgaaccatggaaagcaatgcatcaacaccctgcagagggcccgtatcgattggaaccccgatcaccgggcgtgttgtgtatgcggcaacaacgccaggcaaagcagcagaaagccctgcgccggcaataaacactgcacagcctcgatcttcggcttctacaacaaactgcttggtatcctctggtgttctatgggcagaatagattctgacctcataaggtatatcaaattttttcagtatctggcatgttttctccatcaccggaaggtcagaatctgagcccataagaatcgagacaaaaggggcagccataagctctccaaataaagattattagacgggtcggcacggtaccccagcccttcaaatgtttcaatcatctattcgcaatttcactcacacttgacgcaacaacctgccaattaatcatcagtacctttagtctcgtgaccagttgctacacagttgatagcaacctgccactgagctaacaaagccgaccaattcaagctcgaccagtgtttgcagaacttccgccgtgaccatgcccgtttgtttcacaaccgaatcaacacttctcggctcgagatcaatagcttcaagcacattttgctggcgctgattcagactagttggcttaagcactgggcccgtattc

SEQ ID NO: 1616 - DNA, 4000 bp, Escherichia coli
  misc_feature (714)..(715): n is a, c, g, or t
  misc_feature (831)..(831): n is a, c, g, or t
  misc_feature (1960)..(1960): n is a, c, g, or t
  misc_feature (1985)..(1985): n is a, c, g, or t
  misc_feature (1988)..(1988): n is a, c, g, or t
  misc_feature (1991)..(1992): n is a, c, g, or t
  misc_feature (1994)..(1994): n is a, c, g, or t
  misc_feature (2473)..(4000): n is a, c, g, or t
aaggtacttggaagctaccaacgaaaataccagaatcaagagtagtctctactaatgtaaagcctgaatcttgaagtccgtcacttccgctaatatcttcaatagtggaaccgacaccatcgttacaatcggtggcatcagaatttgcgtctacccattgggagtcattaaatgtaatatctaagatgtgatcaccagaaccatcaccaactttatcatcagctttagtgacgtaaacgtcaattaattctgaatcagtgttgaggtcttggtcatctacggtaacaacaacagtatctgcaattttatagttttcagaatcaaatgatactgttccactatgtgatggagcagctacttgatctgcgatctgagttacaacaccatctgcaccaagatcattatagttgattcttggggaatcctcatcagtcaaatcttcgtggacaataatgtctacgtcttgatcgattgttgagagtcctaagtaagtagatgtctgatcagtgttgagttgattcaacataagatattcgacactacctacaaatacaccagtattatcatcagtctcctctaagaggagtctatagattgcgttgttttgtctaacaccgtcatctgcaataccgaaactgaaaatatcagaaacgaatggcaaagctgctggagcagaaacatctgctgctgtatcgagttcaattgtgatctcgnngtcagttgtagacattcccattgcattgtagatgattactaatcctttctcgtctgttcctttattatcaccttgattggcacagacaaagtgattggatctgttggtcaaacagncaccatcaacaccagtagtttctgagttgacaaatgctgagaaatcaaagttccagaatgtttgtcttgtatcaatatcaaggacttcactggttaagataccagtgttgatagtaaagtttgcagtattaccaaatgatgaagatgtgttagtatatcttgcgatgttactaaatgcatctacagtcaaataataatcgtttgttcctgatcctttggcactgttagtggtatcgttatgaaccattaatggtgaaccaatttggagtgcaggtacgaggaggagtgtgttagttctgttgttgagtacaagatcttcatcaaccaaagtgttttggttgagatcttgatctcttagtgtaactgtcaatgcttcaccggaattccattcatcaccgacagaggattcttccatatcgatagtaccaaagtcatttgttactacgaaggattgtgctgcatcattgtaatcaatgacagctgttgttcctcttttagcgtcagcgttaacaactaagtttgaatcatctttatcatctgtattaacaaagacaccactgttttcagatgtttcccagaaaattaattgtttgtctggtactgaatcgtcttcagtgaaatcatttaagaatacgtctgttccgatgctttgtgcatcgtaatcgatgattaacttaccgttgtcaccgaaggagttgtcatatgcaatgtaagtatgtgaacctacattgagtacagctgtatcgtgattagatgtatcagtaaatgatacagattcactaccagttgtaacatcaaatataacaatatcttcgttggttggatctaagtttagttgattgtcagtaatggttaaatggacttgggaaccttgtgtggcaccttgtctatctacttcaatacttgcgtaatcatctaaatctgcagaattgtaatctagtgtgactacttcatctgctccggcttgctctaatacaatatcaaatacaccagtgtcaaatgcaaatgcttggatcattggccattcttcgtgttgaataccaatttgtccaattgtttgatttgcacctgttagaccttgtactggaagtgttggttgtgttccgttccatgcacttaatgttggtgnattttgtacaacggaagtaccgttnttnatnncnggtccagtggcaccgttagtactcacccaaatgaatgcagtgtttgttgcattaattgagctgtgtatgtcagtaccggtcataagtgctgagtcaaatcctcttggtaattttgagacaccgaaaccgatgttgtttaaggtgttgtttgctaacttggatgctgttttatcagcaatgtaagcataccagaaaccatctgctccttgagccaatctgatgtaatggttatcaactcttacagttggttctgccactttctcatcagtttgggttctatttggatctctaactacaatttcgacgacttgagctccaccgaatgtattattgaattgtgcattttctgcggagacataaagttggcctgcggctgcggcttctggcaccattgaaggtgcggcaataaccataccaccggctaacattattgtcattagcgtaagactagttaatttacgtcctatttcgttattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn
